US012553037B2

(12) United States Patent
Fernandes et al.

(10) Patent No.: US 12,553,037 B2
(45) **Date of Patent: *Feb. 17, 2026**

(54) ENGINEERED CLASS 2, TYPE V REPRESSOR SYSTEMS

(71) Applicant: Scribe Therapeutics Inc., Alameda, CA (US)

(72) Inventors: Jason Fernandes, Redwood City, CA (US); Ross White, Concord, CA (US); Sean Higgins, Alameda, CA (US); Sarah Denny, San Francisco, CA (US); Benjamin Oakes, El Cerrito, CA (US); Emeric Jean Marius Charles, Berkeley, CA (US)

(73) Assignee: Scribe Therapeutics Inc., Alameda, CA (US)

(*) Notice: Subject to any disclaimer, the term of this patent is extended or adjusted under 35 U.S.C. 154(b) by 0 days.

This patent is subject to a terminal disclaimer.

(21) Appl. No.: 18/612,882

(22) Filed: Mar. 21, 2024

(65) Prior Publication Data

US 2024/0254466 A1 Aug. 1, 2024

Related U.S. Application Data

(63) Continuation of application No. PCT/US2022/076774, filed on Sep. 21, 2022.

(60) Provisional application No. 63/321,517, filed on Mar. 18, 2022, provisional application No. 63/246,543, filed on Sep. 21, 2021.

(51) Int. Cl.

| | |
|---|---|
| ***C12N 9/22*** | (2006.01) |
| ***A61K 48/00*** | (2006.01) |
| ***C12N 9/10*** | (2006.01) |
| ***C12N 15/11*** | (2006.01) |
| ***C12N 15/86*** | (2006.01) |
| ***C12N 15/88*** | (2006.01) |
| ***C12N 15/90*** | (2006.01) |

(52) U.S. Cl.

CPC .............. *C12N 9/22* (2013.01); *A61K 48/005* (2013.01); *C12N 9/1007* (2013.01); *C12N 15/11* (2013.01); *C12N 15/86* (2013.01); *C12N 15/88* (2013.01); *C12N 15/907* (2013.01); *C07K 2319/00* (2013.01); *C12N 2310/20* (2017.05); *C12N 2750/14143* (2013.01)

(58) Field of Classification Search

CPC .......... C12N 9/22; C12N 15/11; C12N 15/88; C12N 2310/20; C12N 2830/005

See application file for complete search history.

(56) References Cited

U.S. PATENT DOCUMENTS

| | | | |
|---|---|---|---|
| 5,208,036 | A | 5/1993 | Eppstein et al. |
| 5,264,618 | A | 11/1993 | Felgner et al. |
| 5,279,833 | A | 1/1994 | Rose |
| 5,283,185 | A | 2/1994 | Epand et al. |
| 5,405,783 | A | 4/1995 | Pirrung et al. |
| 5,412,087 | A | 5/1995 | Mcgall et al. |
| 5,445,934 | A | 8/1995 | Fodor et al. |
| 5,695,937 | A | 12/1997 | Kinzler et al. |
| 5,785,992 | A | 7/1998 | Ansell et al. |
| 6,919,204 | B2 | 7/2005 | Wolffe et al. |
| 7,001,768 | B2 | 2/2006 | Wolffe |
| 7,008,780 | B2 | 3/2006 | Pomerantz et al. |
| 7,368,551 | B2 | 5/2008 | Li et al. |
| 8,450,107 | B1 | 5/2013 | Zhang et al. |
| 8,735,153 | B2 | 5/2014 | Wolffe et al. |
| 9,738,593 | B2 | 8/2017 | Ansell et al. |
| 9,834,791 | B2 | 12/2017 | Zhang et al. |
| 10,106,490 | B2 | 10/2018 | Du |
| 10,166,298 | B2 | 1/2019 | Ansell et al. |
| 10,221,127 | B2 | 3/2019 | Du et al. |
| 10,266,850 | B2 | 4/2019 | Doudna et al. |
| 10,570,415 | B2 | 2/2020 | Doudna et al. |
| 10,704,060 | B2 | 7/2020 | Gersbach et al. |
| 10,968,253 | B2 | 4/2021 | Ohlmann et al. |
| 11,015,210 | B2 | 5/2021 | Faust et al. |
| 11,072,782 | B2 | 7/2021 | Cathomen et al. |
| 11,219,634 | B2 | 1/2022 | Prieve et al. |
| 11,312,955 | B2 | 4/2022 | Berry et al. |
| 11,434,476 | B2 | 9/2022 | Jaenisch et al. |
| 11,434,491 | B2 | 9/2022 | Chen et al. |
| 11,560,555 | B2 | 1/2023 | Oakes et al. |
| 11,795,472 | B2 | 10/2023 | Doudna et al. |
| 11,873,504 | B2 | 1/2024 | Doudna et al. |
| 12,084,692 | B2 | 9/2024 | Oakes et al. |
| 12,163,125 | B2 | 12/2024 | Vijayakumar et al. |

(Continued)

FOREIGN PATENT DOCUMENTS

| | | | |
|---|---|---|---|
| EP | 0 805 819 | B1 | 2/2012 |
| EP | 3 004 370 | A2 | 4/2016 |

(Continued)

OTHER PUBLICATIONS

US 12,018,249 B2, 06/2024, Vijayakumar et al. (withdrawn)

Yeo et al (An enhanced CRISPR repressor for targeted mammalian gene regulation. Nat Methods. Aug. 2018 ; 15(8): 611-616) (Year: 2018).*

Liu et al (Engineering cell signaling using tunable CRISPR-Cpf1-based transcription factors. Nature Communications, vol. 8, 2017). (Year: 2017).*

Schmitges et al (Multiparameter functional diversity of human C2H2 zinc finger proteins. Genome Res. 2016 26: 1742-1752) (Year: 2016).*

KRAB domain sequence in ZNF73 protein (available through UniProt since Feb. 19, 2014, attached in PTO-892) (Year: 2014).*

(Continued)

*Primary Examiner* — Emily A Cordas
*Assistant Examiner* — Matasha Dhar
(74) *Attorney, Agent, or Firm* — COOLEY LLP

(57) ABSTRACT

The disclosure relates to gene repressor systems comprising catalytically-dead Class 2 CRISPR proteins and one or more transcription repressor domains linked to the catalytically-dead Class 2 CRISPR protein as a fusion protein, as well as a guide ribonucleic acid (gRNA); and methods of making and using same.

26 Claims, 61 Drawing Sheets

Specification includes a Sequence Listing.

(56) References Cited

U.S. PATENT DOCUMENTS

| | | | |
|---|---|---|---|
| 2002/0160940 A1 | 10/2002 | Case et al. | |
| 2003/0082552 A1 | 5/2003 | Wolffe et al. | |
| 2003/0108880 A1 | 6/2003 | Rebar et al. | |
| 2006/0083780 A1 | 4/2006 | Heyes et al. | |
| 2006/0240554 A1 | 10/2006 | Chen et al. | |
| 2007/0059795 A1 | 3/2007 | Moore et al. | |
| 2007/0192880 A1 | 8/2007 | Muyan et al. | |
| 2009/0023153 A1 | 1/2009 | Wolffe et al. | |
| 2011/0071208 A1 | 3/2011 | Maclachlan et al. | |
| 2011/0076335 A1 | 3/2011 | Yaworski et al. | |
| 2011/0117125 A1 | 5/2011 | Hope et al. | |
| 2012/0207744 A1 | 8/2012 | Mendlein et al. | |
| 2016/0304872 A1 | 10/2016 | Elowitz et al. | |
| 2017/0056524 A1 | 3/2017 | Kaestner | |
| 2017/0369870 A1 | 12/2017 | Gill et al. | |
| 2018/0179525 A1 | 6/2018 | Lande et al. | |
| 2018/0258424 A1 | 9/2018 | Greenberg et al. | |
| 2019/0024086 A1 | 1/2019 | Lande et al. | |
| 2019/0032049 A1 | 1/2019 | Naldini et al. | |
| 2019/0127713 A1 | 5/2019 | Gersbach et al. | |
| 2019/0167815 A1 | 6/2019 | Holmes et al. | |
| 2019/0233805 A1 | 8/2019 | Segal et al. | |
| 2019/0336608 A1 | 11/2019 | Baumhof et al. | |
| 2019/0359959 A1 | 11/2019 | Jaenisch et al. | |
| 2019/0376088 A1 | 12/2019 | Yamagata et al. | |
| 2019/0381180 A1 | 12/2019 | Baumhof et al. | |
| 2020/0017879 A1* | 1/2020 | Doudna | C12N 15/62 |
| 2020/0087641 A1 | 3/2020 | Zhang et al. | |
| 2020/0109406 A1 | 4/2020 | Miller et al. | |
| 2020/0121809 A1 | 4/2020 | Hope et al. | |
| 2020/0149039 A1 | 5/2020 | Schuijers et al. | |
| 2020/0339638 A1 | 10/2020 | Nabhan et al. | |
| 2020/0377564 A1 | 12/2020 | Khalil et al. | |
| 2021/0047653 A1 | 2/2021 | Bowlin et al. | |
| 2021/0123034 A1 | 4/2021 | Chavez et al. | |
| 2021/0139918 A1* | 5/2021 | Chen | C12N 9/22 |
| 2021/0260170 A1 | 8/2021 | Yamagata et al. | |
| 2021/0284981 A1 | 9/2021 | Doudna et al. | |
| 2021/0309981 A1 | 10/2021 | Doudna et al. | |
| 2022/0002753 A1 | 1/2022 | Qi et al. | |
| 2022/0177872 A1 | 6/2022 | Oakes et al. | |
| 2022/0220508 A1 | 7/2022 | Oakes et al. | |
| 2022/0233721 A1 | 7/2022 | Yoshimi et al. | |
| 2022/0343485 A1 | 10/2022 | Urata et al. | |
| 2022/0403387 A1 | 12/2022 | Lande et al. | |
| 2023/0028178 A1 | 1/2023 | Doudna et al. | |
| 2023/0036273 A1 | 2/2023 | Joung et al. | |
| 2023/0096554 A1 | 3/2023 | Jaenisch et al. | |
| 2023/0124880 A1 | 4/2023 | Oakes et al. | |
| 2023/0287391 A1 | 9/2023 | Taipale et al. | |
| 2023/0340439 A1 | 10/2023 | Qi et al. | |
| 2023/0340471 A1 | 10/2023 | Naldini et al. | |
| 2023/0407276 A1 | 12/2023 | Doudna et al. | |
| 2024/0026352 A1 | 1/2024 | Gersbach et al. | |
| 2024/0026385 A1 | 1/2024 | Vijayakumar et al. | |
| 2024/0052328 A1 | 2/2024 | Kwon et al. | |
| 2024/0076678 A1 | 3/2024 | Maeder et al. | |
| 2024/0123089 A1 | 4/2024 | Fernandes et al. | |
| 2024/0124537 A1 | 4/2024 | Fernandes et al. | |
| 2024/0139319 A1 | 5/2024 | Lombardo et al. | |
| 2024/0167052 A1 | 5/2024 | Doudna et al. | |
| 2024/0209359 A1 | 6/2024 | Zhang et al. | |
| 2024/0209396 A1 | 6/2024 | Yang et al. | |
| 2024/0376462 A1 | 11/2024 | Vijayakumar et al. | |
| 2024/0392271 A1 | 11/2024 | Fernandes et al. | |
| 2025/0011756 A1 | 1/2025 | Vijayakumar et al. | |
| 2025/0043262 A1 | 2/2025 | Oakes et al. | |
| 2025/0136962 A1 | 5/2025 | Oakes et al. | |

FOREIGN PATENT DOCUMENTS

| | | | |
|---|---|---|---|
| EP | 3 209 783 | B1 | 11/2021 |
| EP | 4 158 009 | | 4/2023 |
| EP | 4 196 505 | | 6/2023 |
| EP | 4 208 545 | | 7/2023 |
| EP | 4 244 345 | | 9/2023 |
| EP | 4 267 743 | | 11/2023 |
| EP | 4 374 004 | | 5/2024 |
| WO | WO-96/10390 | A1 | 4/1996 |
| WO | WO-03/072788 | A1 | 9/2003 |
| WO | WO-2009/127060 | A1 | 10/2009 |
| WO | WO-2013/176772 | A1 | 11/2013 |
| WO | WO-2015/070083 | A1 | 5/2015 |
| WO | WVO-2016/063264 | A1 | 4/2016 |
| WO | WO-2018/064371 | A1 | 4/2018 |
| WO | WO-2018/195555 | A1 | 10/2018 |
| WO | WO-2019/079462 | A1 | 4/2019 |
| WO | WO-2019/204766 | A1 | 10/2019 |
| WO | WO-2020/023529 | A1 | 1/2020 |
| WO | WO-2020/041456 | A1 | 2/2020 |
| WO | WO-2020/247882 | A1 | 12/2020 |
| WO | WO-2020/247883 | A2 | 12/2020 |
| WO | WO-2021/026336 | A2 | 2/2021 |
| WO | WO-2021/026336 | A3 | 2/2021 |
| WO | WO-2021/113772 | A1 | 6/2021 |
| WO | WO-2021/226077 | A2 | 11/2021 |
| WO | WO-2021/247570 | A2 | 12/2021 |
| WO | WO-2021/247570 | A3 | 12/2021 |
| WO | WO-2022/114243 | A1 | 6/2022 |
| WO | WO-2022/119957 | A1 | 6/2022 |
| WO | WO-2022/120095 | A1 | 6/2022 |
| WO | WO-2022/125843 | A1 | 6/2022 |
| WO | WO-2022/140577 | A2 | 6/2022 |
| WO | WO-2022/261149 | A2 | 12/2022 |
| WO | WO-2022/261150 | A2 | 12/2022 |
| WO | WO-2022/261150 | A3 | 12/2022 |
| WO | WO-2023/004338 | A2 | 1/2023 |
| WO | WO-2023/004338 | A3 | 1/2023 |
| WO | WO-2023/023553 | A2 | 2/2023 |
| WO | WO-2023/039378 | A1 | 3/2023 |
| WO | WO-2023/049742 | A2 | 3/2023 |
| WO | WO-2023/049872 | A2 | 3/2023 |
| WO | WO-2023/049872 | A3 | 3/2023 |
| WO | WO-2023/055893 | A1 | 4/2023 |
| WO | WO-2023/093862 | A1 | 6/2023 |
| WO | WO-2023/138617 | A1 | 7/2023 |
| WO | WO-2023/165597 | A1 | 9/2023 |
| WO | WO-2023/173110 | A1 | 9/2023 |
| WO | WO-2023/178280 | A2 | 9/2023 |
| WO | WO-2023/178280 | A3 | 9/2023 |
| WO | WO-2023/215711 | A1 | 11/2023 |
| WO | WO-2023/235818 | A2 | 12/2023 |
| WO | WO-2023/240076 | A1 | 12/2023 |
| WO | WO-2023/241669 | A1 | 12/2023 |
| WO | WO-2023/247789 | A1 | 12/2023 |
| WO | WO-2023/250148 | A1 | 12/2023 |
| WO | WO-2023/250183 | A2 | 12/2023 |
| WO | WO-2023/250183 | A3 | 12/2023 |
| WO | WO-2023/250511 | A2 | 12/2023 |
| WO | WO-2023/250511 | A3 | 12/2023 |
| WO | WO-2024/032681 | A1 | 2/2024 |
| WO | WO-2024/131940 | A1 | 6/2024 |
| WO | WO-2024/206555 | A1 | 10/2024 |
| WO | WO-2024/206565 | A1 | 10/2024 |
| WO | WO-2024/206620 | A1 | 10/2024 |

OTHER PUBLICATIONS

Alerasool et al (An efficient KRAB domain for CRISPRi applications in human cells. Nature Methods | vol. 17 | Nov. 2020 | 1093-1096; cited in IDS dated Mar. 22, 2024) (Year: 2020).*

Nunez et al (Genome-wide programmable transcriptional memory by CRISPR-based epigenome editing. Cell 184, 2503-2519, Apr. 29, 2021; cited in IDS dated Mar. 22, 2024; NPL associated with Chen). (Year: 2021).*

Cao et al (A CRISPR/dCasX-mediated transcriptional programming system for inhibiting the progression of bladder cancer cells by repressing c-MYC or activating TP53. Clin. Transl. Med. 2021;11:e537. First Published Sep. 15, 2021). (Year: 2021).*

Karemaker et al (DNA methyltransferases hitchhiking on chromatin. Swiss Med Wkly. 2020;150:w20329) (Year: 2020).*

NP_001307822.1 (ADD sequence from DNMT3A protein sequence, in PTO-892). (Year: 2016).*

(56) References Cited

OTHER PUBLICATIONS

Conserved Protein Domain Family entry cd07765: KRAB_A-box, https://www.ncbi.nlm.nih.gov/Structure/cdd/cddsrv.cgi?ascbin=8&maxaln=10&seltype=2&uid=cd07765, updated Jan. 17, 2013, printed as pp. 1/2-2/2, (2013), 2 pages.
Hie, B.L. et al. (Apr. 2022). "Evolutionary velocity with protein language models predicts evolutionary dynamics of diverse proteins," Cell Syst. 13:274-285.e6.
Hirakawa, M.P. et al. (Apr. 2020). "Gene editing and CRISPR in the clinic: current and future perspectives," Biosci. Rep. 40(4):BSR20200127, 37 pages.
Hochstrasser, M.L. et al. (2014). "CasA mediates Cas3-catalyzed target degradation during CRISPR RNA-guided interference," PNAS 111:6618-6623.
Margolin, J.F. et al. (May 1994). "Kruppel-associated boxes are potent transcriptional repression domains," PNAS 91(10):4509-4513.
Mlambo, T. et al. (2018). "Designer epigenome modifiers enable robust and sustained gene silencing in clinically relevant human cells," Nucleic Acids Research 46:4456-4468, Supplemental Figures, 15 pages.
NCBI Reference Sequence NM_175629.2 (Jul. 2024). "*Homo sapiens* DNA methyltransferase 3 alpha (DNMT3A), transcript variant 1, mRNA," located at https://www.ncbi.nlm.nih.gov/nuccore/NM_175629.2, retrieved on Jul. 12, 2024, 7 pages.
NCBI Reference Sequence NP_783328.1 (Jul. 2024). "DNA (cytosine-5)-methyltransferase 3A isoform a [*Homo sapiens*]," located at https://www.ncbi.nlm.nih.gov/protein/NP_783328.1, retrieved on Jul. 12, 2024, 4 pages.
NCBI Reference Sequence NM_153759.3 (Jul. 2024). "*Homo sapiens* DNA methyltransferase 3 alpha (DNMT3A), transcript variant 2, mRNA," located at https://www.ncbi.nlm.nih.gov/nuccore/NM_153759.3, retrieved on Jul. 12, 2024, 5 pages.
NCBI Reference Sequence NP_715640.2 (Jul. 2024). "DNA (cytosine-5)-methyltransferase 3A isoform b [*Homo sapiens*]," located at https://www.ncbi.nlm.nih.gov/protein/NP_715640.2, retrieved on Jul. 12, 2024, 3 pages.
NCBI Reference Sequence NM_022552.4 (Jul. 2024). "*Homo sapiens* DNA methyltransferase 3 alpha (DNMT3A), transcript variant 3, mRNA," located at https://www.ncbi.nlm.nih.gov/nuccore/NM_022552, retrieved on Jul. 12, 2024, 8 pages.
NCBI Reference Sequence NP_072046.2 (Jul. 2024). "DNA (cytosine-5)-methyltransferase 3A isoform a [*Homo sapiens*]," located at https://www.ncbi.nlm.nih.gov/protein/NP_072046.2?report=GenPept, retrieved on Jul. 12, 2024, 4 pages.
NCBI Reference Sequence NM_175630.1 (Jul. 2024). "*Homo sapiens* DNA methyltransferase 3 alpha (DNMT3A), transcript variant 4, mRNA," located at https://www.ncbi.nlm.nih.gov/nuccore/NM_175630.1?report=GenBank, retrieved on Jul. 12, 2024, 4 pages.
NCBI Reference Sequence NP_783329.1 (Jul. 2024). "DNA (cytosine-5)-methyltransferase 3A isoform c [*Homo sapiens*]," located at https://www.ncbi.nlm.nih.gov/protein/NP_783329.1, retrieved on Jul. 12, 2024, 3 pages.
NCBI Reference Sequence NM_001320892.1 (Jul. 2024). "*Homo sapiens* DNA methyltransferase 3 alpha (DNMT3A), transcript variant 5, mRNA," located at https://www.ncbi.nlm.nih.gov/nuccore/NM_001320892.2; retrieved on Jul. 12, 2024, 4 pages.
NCBI Reference Sequence NP_001307821.1 (Jul. 2024). "DNA (cytosine-5)-methyltransferase 3A isoform c [*Homo sapiens*]," located at https://www.ncbi.nlm.nih.gov/protein/NP_001307821.1, retrieved on Jul. 12, 2024, 3 pages.
Non-Final Office Action mailed on Jun. 23, 2021, for U.S. Appl. No. 15/521,294, filed Apr. 23, 2017, 24 pages.
Tajima, S. et al. (Nov. 2016). "Domain Structure of the Dnmt1, Dnmt3a, and Dnmt3b DNA Methyltransferases," DNA Methyltransferases—Role and Function, pp. 63-86.
Urrutia, R. (Sep. 2003). "KRAS-containing zinc-finger repressor proteins," Genome Biology, vol. 4, Article No. 231, 8 pages.
Wolf, G. et al. (Oct. 2015). "Spotting the enemy within: Targeted silencing of foreign DNA in mammalian genomes by the Krüppel-associated box zinc finger protein family," Mob DNA 6:17, 20 pages.
U.S. Appl. No. 18/663,845, filed May 14, 2024, by Vijayakumar et al.
Abaandou, L. et al. (2021). "Affecting HEK293 cell growth and production performance by modifying the expression of specific genes," Cells 10:1667, 21 pages.
Alerasool, N. et al. (2020). "An efficient KRAB domain for CRISPRi applications in human cells," Nature Methods 17:1093-1096.
Alignment of SEQ ID No. 8 (2022). DNMT3A sequence disclosed in Siddique, A. N. et al. (2013). J. Mol. Biol. 425:479-491, 2 total pages.
Altschul, S.F. et al. (1990). "Basic local alignment search tool," J. Mol. Biol. 215:403-410.
Amabile, A. et al. (2016). "Inheritable Silencing of Endogenous Genes by Hit-and-Run Targeted Epigenetic Editing," Cell 167:219-232.e14.
Ayyanathan, K. et al. (2003). "Regulated recruitment of HP1 to a euchromatic gene induces mitotically heritable, epigenetic gene silencing: a mammalian cell culture model of gene variegation," Genes and Development 17:1855-1869.
Bailey, T.L. (2021). "STREME: Accurate and versatile sequence motif discovery," Bioinformatics 37:2834-2840.
Braliou, G.G. et al. (2001). "The v-ErbA oncoprotein quenches the activity of an erythroid-specific enhancer," Oncogene 20:775-787.
Brief Communication in Opposition Proceedings for EP Patent No. 3 209 783, dated Dec. 21, 2023, 26 pages.
Broude, E.V. et al. (2007). "p21 (CDKN1A) is a negative regulator of p53 stability," Cell Cycle 6:1468-1471.
Burstein, D. et al. (Feb. 2017). "New CRISPR-Cas systems from uncultivated microbes," Nature 542:237-241. Published online Dec. 22, 2016, with Supplemental Materials, 28 total pages.
Cedar, H. et al. (2009). "Linking DNA methylation and histone modification: Patterns and paradigms," Nat. Rev. Genet. 10:295-304.
Chen, J. et al. (2016). "Production and clinical development of nanoparticles for gene delivery," Mol. Ther. Methods Clin. Dev. 3:16023, 8 pages.
Cortes-Mancera, F.M. et al. (2022). "gene-targeted DNA methylation: Towards long-lasting reprogramming of gene expression?" Adv. Exp. Med. Biol. 1389:515-533.
Das, A.T. et al. (2016). "Tet-On systems for doxycycline-inducible gene expression," Curr. Gene Ther. 16:156-167.
Ding, L. et al. DNA methylation-independent long-term epigenetic silencing with dCRISPR/Cas9 fusion proteins. Life Sci Alliance. Mar. 14, 2022;5(6):e202101321, 11 pages.
Ecco, G. et al. (2017). "KRAB zinc finger proteins," Development 144:2719-2729.
Fiddes, I.T. et al. (2018). "Comparative Annotation Toolkit (CAT)—simultaneous clade and personal genome annotation," Genome Res. 28:1029-1038.
Figures 1-20 filed on Nov. 6, 2015, of granted European Patent No. 3 209 783, 20 total pages.
Fuks, F. (2005). "DNA methylation and histone modifications: Teaming up to silence genes," Curr. Opin. Genet Develop. 15:490-495.
Gilbert, L.A. et al. (2013). "CRISPR-mediated modular RNA-guided regulation of transcription in eukaryotes," Cell 154:442-451.
Gilbert, L.A. et al. (2014). "Genome-scale CRISPR-mediated control of gene repression and activation," Cell 159:647-661.
Haberle, V. et al. (2018). "Eukaryotic core promoters and the functional basis of transcription initiation.," Nat. Rev. Mol. Cell. Biol. 19:621-637, 40 pages provided.
Hofacker, D. et al. Engineering of Effector Domains for Targeted DNA Methylation with Reduced Off-Target Effects. Int J Mol Sci Jan. 13, 2020;21(2):502, 16 pages.
International Search Report mailed on Mar. 30, 2023, for PCT Application No. PCT/US2022/076774, filed on Sep. 21, 2022, 11 pages.
Jackson, A.L. et al. (2003). "Expression profiling reveals off-target gene regulation by RNAi," Nat. Biotechnol. 21:635-637.

(56) References Cited

OTHER PUBLICATIONS

Jain, S. et al. (2021). "TALEN outperforms Cas9 in editing heterochromatin target sites," Nat. Commun. 12:606, 10 total pages.
Kabadi, A.M. et al. (2014). "Engineering synthetic TALE and CRISPR/Cas9 transcription factors for regulating gene expression," Methods 69:188-197.
Kao, T-H. et al. (2014). "Ectopic DNMT3L triggers assembly of a repressive complex for retroviral silencing in somatic cells," J. Virology 88:10680-10695.
Kim, S-H. et al. (2007). "Zinc-fingers and homeoboxes 1 (ZHX1) binds DNA methyltransferase (DNMT) 3B to enhance DNMT3B-mediated transcriptional repression," Biochemical and Biophysical Research Communications 355:318-323.
Kocak, D.D. (2013). "Synthetic Transcription Factors and their Effects on Endogenous DNA Methylation in Human Cells," Thesis submitted in partial fulfillment of the requirements for the degree of Master of Science in the Department of Biomedical Engineering in the Graduate School of Duke University, 35 total pages.
Kotin, R.M. (1994). "Prospects for the use of adeno-associated virus as a vector for human gene therapy," Human Gene Therapy 5:793-801.
Kuhnel, F. et al. (2004). "Tumor-specific adenoviral gene therapy: transcriptional repression of gene expression by utilizing p53-signal transduction pathways," Cancer Gene Therapy 11:28-40.
Letter from D Young & Co. to the European Patent Office (Munich, Germany) dated Dec. 18, 2017, 5 total pages.
Letter from D Young & Co. to the European Patent Office (Munich, Germany) dated Aug. 12, 2019, 4 total pages.
Li, H. et al. (2006). "The Histone Methyltransferase SETDB1 and the DNA Methyltransferase DNMT3A Interact Directly and Localize to Promoters Silenced in Cancer Cells," Journal Biological Chemistry 281:19489-19500.
Li, F. et al. (2007). "Chimeric DNA methyltransferases target DNA methylation to specific DNA sequences and repress expression of target genes," Nucleic Acid Research 35:100-112.
Li, W. et al. (2014). "MAGeCK enables robust identification of essential genes from genome-scale CRISPR/Cas9 knockout screens," Genome Biol. 15:554, 12 total pages.
Liu, X.S. et al. (2016). "Editing DNA methylation in the mammalian genome," Cell 167:233-247.e17.
Liu, J.J. et al. "CasX enzymes comprise a distinct family of RNA-guided genome editors," Nature 566:218-223. Published online Feb. 4, 2019.
Liu, J.J. et al. CasX enzymes comprise a distinct family of RNA-guided genome editors, Nature 568:E8-E10. (Author correction: published online Apr. 3, 2019).
Luo, M.L. et al. (2015). "Repurposing endogenous type I CRISPR-Cas systems for programmable gene repression," Nucl. Acids Res. 43:674-681.
Ma, A-N. et al. (2014). "Targeted gene suppression by inducing de novo DNA methylation in the gene promoter," Epigenetics and Chromatin 7:20, 11 total pages.
Makarova, K.S. et al. (2020). "Evolutionary classification of CRISPR-Cas systems: A burst of class 2 and derived variants," Nat. Rev. Microbiol. 18:67-83.
Mao, Y. et al. (2021). "A high-quality bonobo genome refines the analysis of hominid evolution," Nature 594:77-81.
McDonald, J.I. et al. (2016). "Reprogrammable CRISPR/Cas9-based system for inducing site-specific DNA methylation," Biol. Open 5:866-874.
McInnes, L. et al. (2018). "UMAP: Uniform manifold approximation and projection for dimension reduction," ArXiv e-prints 1802. 03426, pp. 1-63.
Mlambo, T. et al. (2018). "Designer epigenome modifiers enable robust and sustained gene silencing in clinically relevant human cells," Nucleic Acids Research 46:4456-4468.
Moussa, H.F. et al. (2021). "Here to stay: Writing lasting epigenetic memories," Cell 184:2281-2283.
Murphy, K.E. et al. (2016). "The transcriptional repressive activity of KRAB zinc finger proteins does not correlate with their ability to recruit TRIM28," PLoS ONE 11:e0163555, 19 total pages.
Nakamura, M. et al. (2021). "Durable CRISPR-Based Epigenetic Silencing," BioDesign Research 2021, 1-8.
National Cancer Institute (2015). "Cell lines in the In Vitro Screen," 5 total pages.
Noguchi, H. et al. (Jul. 2003). "PDX-1 protein containing its own antennapedia-like protein transduction domain can transduce pancreatic duct and islet cells," Diabetes 52:1732-1737.
Nunez JK et al. Genome-wide programmable transcriptional memory by CRISPR-based epigenome editing. Cell. Apr. 29, 2021,184(9):2503-2519.e17.
O'Geen, H. et al. (2019). "Ezh2-dCas9 and KRAB-dCas9 enable engineering of epigenetic memory in a context-dependent manner," Epigenetics Chromatin. 12:26, 20 pages.
O'Geen, H. et al. (2022). "Determinants of heritable gene silencing for KRAB-dCas9+DNMT3 and Ezh2-dCas9+DNMT3 hit-and-run epigenome editing," Nucl. Acids Res. 50:3239-3253.
Orth, P. et al. (2000). "Structural basis of gene regulation by the tetracycline inducible Tet repressor-operator system," Nat. Struct. Biol, 7:215-219.
Pflueger, C. et al. (2018). "A modular dCas9-SunTag DNMT3A epigenome editing system overcomes pervasive off-target activity of direct fusion dCas9-DNMT3A constructs," Genome Res. 28:1193-1206.
Policarpi, C. et al. (2021). "Epigenetic editing: Dissecting chromatin function in context," BioEssays 43:e2000316, 16 total pages.
Qi, L. S. et al. (Feb. 2013). "Repurposing CRISPR as an RNA-guided platform for sequence-specific control of gene expression," Cell 152:1173-1183.
Rivenbark, A. et al. (2012). "Epigenetic reprogramming of cancer cells via targeted DNA methylation," Epigenetics 7:350-360.
Rives, A. et al. (2021). "Biological structure and function emerge from scaling unsupervised learning to 250 million protein sequences," PNAS 118:e2016239118, 12 total pages.
Rodriguez, D. et al. (2016). "Epigenetic editing: On the verge of reprogramming gene expression at will," Curr. Genet. Med. Rep. 4:170-179.
Schultz, D.C. et al. (2002). "SETDB1: a novel KAP-1-associated histone H3, lysine 9-specific methyltransferase that contributes to HP1-mediated silencing of euchromatic genes by KRAB zinc-finger proteins," Genes Dev. 16:919-932.
Siddique, A.N. et al. (2013). "Targeted methylation and gene silencing of VEGF-A in human cells by using a designed Dnmt3a-Dnmt3L single-chain fusion protein with increased DNA methylation activity," J. Mol. Biol. 425:479-491.
Sigoillot, F.D. et al. (2012). "A bioinformatics method identifies prominent off-targeted transcripts in RNAi screens," Nat. Methods 9:363-366.
Smith, T.F. et al. (1981). "Comparison of biosequences," Adv. Appl. Math. 2:482-489.
Stepper, P. et al. (2017). "Efficient targeted DNA methylation with chimeric dCas9-Dnmt3a-Dnmt3L methyltransferase," Nucleic Acids Res. 45:1703-1713.
Stepper, P. (2020). "CRISPR-Cas9 fusions for synthetic epigenetics," Institut für Biochemie und Technische Biochemie der Universität Stuttgart, 152 pages.
Stoll, G.A. et al. (2022). "Structure and functional mapping of the KRAB-KAP1 repressor complex," bioRxiv, 34 total pages.
Tréhin, R. et al. (Jul. 2004). "Cellular uptake but low permeation of human calcitonin-derived cell penetrating peptides and Tat(47-57) through well-differentiated epithelial models," Pharm. Res. 21:1248-1256.
Tsuchida, C.A. et al. (2022). "Chimeric CRISPR-CasX enzymes and guide RNAs for improved genome editing activity," Mol. Cell 82:1199-1209, 28 pages provided.
Tycko, J. et al. (2020). "High-Throughput Discovery and Characterization of Human Transcriptional Effectors," Cell 183:2020-2035, 38 pages provided.
Valton, J. et al. (2012). "Overcoming transcription activator-like effector (TALE) DNA binding domain sensitivity to cytosine methylation," J. Biol. Chem. 287:38427-38432.

(56) References Cited

OTHER PUBLICATIONS

Vojta, A. et al. (2016). "Repurposing the CRISPR-Cas9 system for targeted DNA methylation," Nucleic Acids Res. 44:5615-5628.
Warren, W.C. et al. (2020). "Sequence diversity analyses of an improved rhesus macaque genome enhance its biomedical utility," Science 370:eabc6617, 26 total pages.
Wender, P.A. et al. (Nov. 2000). "The design, synthesis, and evaluation of molecules that enable or enhance cellular uptake: peptoid molecular transporters," PNAS 97:13003-13008.
Written Opinion of the International Searching Authority mailed on Mar. 30, 2023, for PCT Application No. PCT/US2022/076774, filed on Sep. 21, 2022, 11 pages.
Yang, H. et al. (May 2019). "CasX: a new and small CRISPR gene-editing protein," Cell Res. 29:345-346. Published online Apr. 16, 2019.
Ying, Y. et al. (2015). "The Krüppel-associated box repressor domain induces reversible and irreversible regulation of endogenous mouse genes by mediating different chromatin states," Nucl. Acids Res. 43:1549-1561.
Zender, L. et al. (Jun. 2002). "VP22-mediated intercellular transport of p53 in hepatoma cells in vitro and in vivo," Cancer Gene Ther. 9:489-496.
Zhang, J. et al. (Jun. 1997). "PowerBLAST: a new network BLAST application for interactive or automated sequence analysis and annotation," Genome Res. 7:649-656.
Zhang, Y. et al. (2010). "Chromatin methylation activity of Dnmt3a and Dnmt3a/3L is guided by interaction of the ADD domain with the histone H3 tail.," Nucl. Acids Res. 38:4246-4253.
Zhao, X. et al. (2013). "Intracellular delivery of artificial transcription factors fused to the protein transduction domain of HIV-1 Tat," Protein Expression and Purification 90:27-33.
International Search Report mailed on Aug. 5, 2024, for PCT Application No. PCT/US2024/021866, filed on Mar. 28, 2024, 6 pages.
Margres, M.J. et al. (2021). "The tiger rattlesnake genome reveals a complex genotype underlying a simple venom phenotype," PNAS 118:e2014634118, 12 pages.
NCBI Reference Sequence UNIPROT Q96PE6, ZIM3_Human (2021). Accession No. Q96PE6, 13 pages.
NCBI Reference Sequence NM_022552.4 (2020). "*Homo sapiens* DNA methyltransferase 3 alpha (DNMT3A), transcript variant 3, mRNA," Accession No. NM_022552.4, 7 pages.
NCBI Reference Sequence NP_072046.2 (2021). "DNA (cytosine-5)-methyltransferase 3A isoform a [*Homo sapiens*]," Accession No. NP_072046.2, 5 pages.
NCBI Reference Sequence UNIPROT Q9CWR8, DNM3L_Mouse (2021), Accession No. Q9CWR8, 11 pages.
NCBI Reference Sequence NP_001075164.1 (2021). "DNA (cytosine-5)-methyltransferase 3-like isoform 1[Mus Musculus]," Accession No. NP_001075164.1, 3 pages.
O'Geen, H. et al. (2017). "dCas9-based epigenome editing suggests acquisition of histone methylation is not sufficient for target gene repression," Nucl. Acids Res. 45:9901-9916.
Otani, J. et al. (2009). "Structural basis for recognition of H3K4 methylation status by the DNA methyltransferase 3A ATRX-DNMT3-DNMT3L domain," EMBO Rep. 10(11):1235-1241.
Thakore, P.I. et al. (2018). "RNA-guided transcriptional silencing in vivo with *S. aureus* CRISPR-Cas9 repressors," Nature Communications 9:1674, 9 total pages.
Vonk, F.J. et al. (2013). "The king cobra genome reveals dynamic gene evolution and adaptation in the snake venom system," PNAS 110(51):20651-20656.
Written Opinion of the International Searching Authority mailed on Aug. 5, 2024, for PCT Application No. PCT/US2024/021866, filed on Mar. 28, 2024, 10 pages.
U.S. Appl. No. 18/778,393, filed Jul. 19, 2024, by Oakes et al.
U.S. Appl. No. 18/909,093, filed Oct. 8, 2024, by Oakes et al.
U.S. Appl. No. 18/789,158, filed Jul. 30, 2024, by Vijayakumar et al.
Alhaji, S.Y. et al. (Apr. 2019). "Silencing of transgene expression in mammalian cells by DNA methylation and histone modifications in gene therapy perspective," Biotechnol. Genet. Eng. Rev. 35(1):1-25.
Amabile, A. et al. (May 2015). "Permanent epigenetic silencing of human genes with artificial transcriptional repressors," Molecular Therapy 23(Suppl. 1): S275, 1 page.
Cappelluti, M.A. et al. (Feb. 2024). "Durable and efficient gene silencing in vivo by hit-and-run epigenome editing," Nature 627:416-423.
Cedar, H. (Apr. 1988). "DNA methylation and gene activity," Cell 53(1):3-4.
Chen, X. et al. (2012). "Fusion protein linkers: Property, design and functionality," Advanced Drug Delivery Reviews 65(10):1357-1369.
De Groote, M.L. et al. (Sep. 2012). "Epigenetic editing: Targeted rewriting of epigenetic marks to modulate expression of selected target genes," Nucl. Acids Res. 40(21):10596-10613.
Delrosso, N. et al. (Apr. 2023). "Large-scale mapping and mutagenesis of human transcriptional effector domains," Nature 616(7956):365-372.
Han, H. et al. (2023). "Leverage of nuclease-deficient CasX for preventing pathological angiogenesis," Mol. Ther. Nucl. Acids 33:738-748.
Jia, D. et al. (Sep. 2007). "Structure of Dnmt3a bound to Dnmt3L suggests a model for de novo DNA methylation," Nature 449(7159):248-251.
Makarova, K.S. et al. (Nov. 2015). "An updated evolutionary classification of CRISPR-Cas systems," Nat. Rev. Microbiol. 13(11):722-736.
Mukund, A.X. et al. (Sep. 2023). "High-throughput functional characterization of combinations of transcriptional activators and repressors," Cell Systems 14(9):746-763.
NCBI Reference Sequence UNIPROT P15840 (2025), located at www.uniprot.org/uniprotkb/P15840/entry, retrieved on Feb. 19, 2025, 5 pages.
Quenneville et al. (2012). "The KRAB-ZFP/KAP1 system contributes to the early embryonic establishment of site-specific DNA methylation patterns maintained during development," Cell Rep. 2:766-773.
Schunder, E. et al. (2013). "First indication for a functional CRISPR/Cas system in Francisella Tularensis," Int'l J. Med. Microbiol. 303:51-60.
Tak, Y.E. et al. (Dec. 2017). "Inducible and multiplex gene regulation using CRISPR-Cpf1-based transcription factors," Nature Methods 14(12):1163-1166.
Tang, X. et al. (2017). "A CRISPR-Cpf1 system for efficient genome editing and transcriptional repression in plants," Nature Plants 3:17018, 5 pages.
Vonk, F.J. et al. (2013). "The king cobra genome reveals dynamic gene evolution and adaptation in the snake venom system," PNAS 110(51):20651-20656, Supplemental Information, 68 pages.
Yamazaki, T. et al. (May 2017). "Targeted DNA methylation in pericentromeres with genome editing-based artificial DNA methyltransferase," PLos One 12(5):e0177764, 18 pages.
Yamazaki, T. et al. (Apr. 2007). "Time-lapse and retrospective analysis of DNA methylation in mouse preimplantation embryos by live cell imaging," Dev. Biol. 304(1):409-419.
Zetsche, B. et al. (Oct. 2015). "Cpf1 is a single RNA-guided endonuclease of a class 2 CRISPR-cas system," Cell 163:759-771.
U.S. Appl. No. 18/869,765, filed Nov. 26, 2024, by Zhou et al.
U.S. Appl. No. 19/343,818, filed Sep. 29, 2025, Inventor Fernandes, Jason et al.
U.S. Appl. No. 19/343,824, filed Sep. 29, 2025, Inventor Fernandes, Jason et al.

* cited by examiner

Motif 3:

Motif 5:

Motif 7:

Motif 8:

Generic dXR configuration:

Specificity/Activity with ELXR-ZIM3 for spacer 7.37

Specificity/Activity with ELXR-ZNF10 for spacer 7.37

ENGINEERED CLASS 2, TYPE V REPRESSOR SYSTEMS

CROSS REFERENCE TO RELATED APPLICATIONS

This application is a continuation of International Application No. PCT/US2022/076774, filed Sep. 21, 2022, which claims priority to U.S. provisional applications 63/246,543, filed on Sep. 21, 2021, and 63/321,517, filed on Mar. 18, 2022, the contents of each of which are incorporated herein by reference in their entirety.

INCORPORATION BY REFERENCE OF SEQUENCE LISTING

The contents of the electronic sequence listing (SCRB_034_02US_SeqList_ST26.xml; Size: 63,394,386 bytes; and Date of Creation: Mar. 15, 2024) is herein incorporated by reference in its entirety.

BACKGROUND

Methods of modulating expression of a target gene in a cell are varied. In mammalian systems, cells use a system of chromatin regulators (CRs) and associated histone and DNA modifications to modulate gene expression and establish long-term epigenetic memory. This system is critical in development, aging, and disease, and may provide essential capabilities for incorporating regulation in synthetic biology. In experimental systems, methods such as RNA interference (RNAi) are useful for targeted-gene knockdown and have been widely used for large-scale library screens. RNAi, however, has several limitations. In particular, RNAi-based knockdown suffers from off-target effects, along with incomplete knockdown of the target (Jackson A L, et al. Expression profiling reveals off-target gene regulation by RNAi. Nat Biotechnol. 21:635 (2003)); Sigoillot F D, et al., A bioinformatics method identifies prominent off-targeted transcripts in RNAi screens. Nat Methods. 19:9(4):363 (2012)). Tailored DNA binding proteins such as zinc finger proteins or transcription activator-like effectors (TALEs) linked to transcriptional repressor domains, while able to mediate selective gene suppression, are limited by the fact that each desired target gene necessitates the generation of a new protein.

The advent of CRISPR/Cas systems and the programmable nature of these systems has facilitated their use as a versatile technology for genomic manipulation and engineering. Particular CRISPR proteins are particularly well suited for such manipulation. For example, certain Class 2 CRISPR/Cas systems have a compact size, offering ease of delivery, and the nucleotide sequence encoding the protein is relatively short, an advantage for its incorporation into viral vectors for cellular delivery. However, in certain disease indications, gene silencing, or repression, is preferable to gene editing. The ability to render CasX catalytically-inactive (dCasX) has been demonstrated (WO2020247882A1), which makes it an attractive platform for the generation of fusion proteins capable of gene silencing. Thus, there is a need in the art for additional gene repressor systems (e.g., a dCas protein plus repressor domain) that have been optimized and/or offer improvements over earlier generation gene repressor systems, such as those based on Cas9 for utilization in a variety of therapeutic, diagnostic, and research applications.

SUMMARY

Aspects of the present disclosure are directed to compositions and methods of modulating expression of a target nucleic acid in a cell.

The present disclosure provides compositions of a gene repressor system comprising catalytically-dead Class 2 CRISPR proteins, for example Class 2 Type V CRISPR proteins, linked with one or more transcription repressor domains as a fusion protein and guide ribonucleic acids (gRNA) comprising a targeting sequence complementary to a target nucleic acid sequence of a gene in a cell (dXR:gRNA system), nucleic acids encoding the fusion proteins, vectors encoding or comprising the components of the dXR:gRNA systems, and lipid nanoparticles encoding or encapsidating the components of the dXR:gRNA systems, and methods of making and using the dXR:gRNA systems. The dXR:gRNA systems of the disclosure have utility in methods of gene silencing, or gene repression, in diseases where repression of a gene product is useful to reverse the underlying cause of the disease or to ameliorate the signs or symptoms of the disease, which methods are also provided.

Further features and advantages of certain embodiments of the present disclosure will become more fully apparent in the following description of embodiments and drawings thereof, and from the claims.

INCORPORATION BY REFERENCE

All publications, patents, and patent applications mentioned in this specification are herein incorporated by reference to the same extent as if each individual publication, patent, or patent application was specifically and individually indicated to be incorporated by reference.

BRIEF DESCRIPTION OF THE DRAWINGS

The novel features of the invention are set forth with particularity in the appended claims. A better understanding of the features and advantages of the present invention will be obtained by reference to the following detailed description that sets forth illustrative embodiments, in which the principles of the invention are utilized, and the accompanying drawings of which:

DETAILED DESCRIPTION

Figure 1:
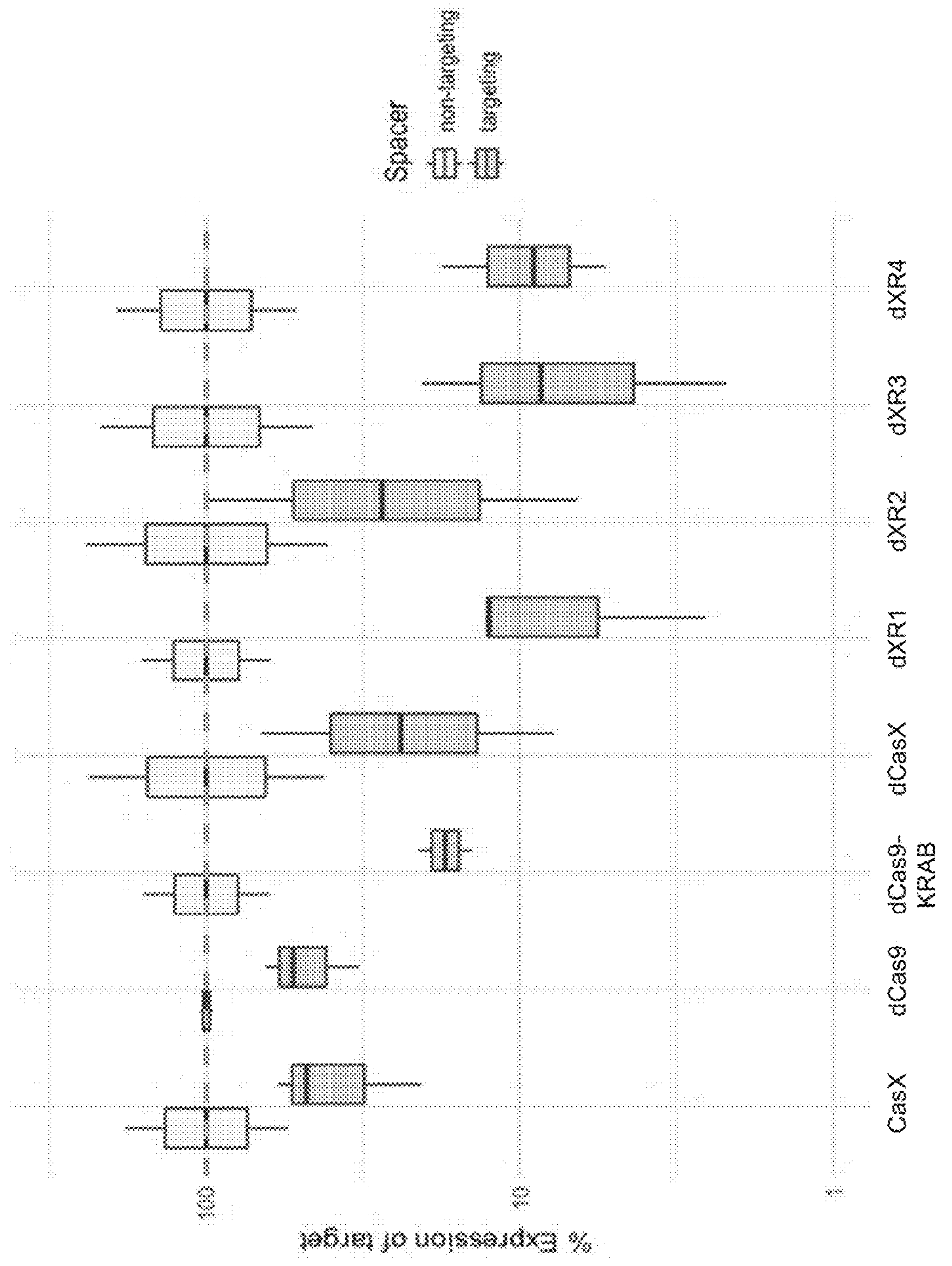
FIG. 1 shows results of an assay evaluating targeting and non-targeting dXR molecules using non-targeting and targeting spacers (left and right bars, respectively), with percentage (%) loss of target mRNA as measured by qPCR in HEK293T cells, as described in Example 1. Data represent ΔΔCt values from biological duplicates.

While preferred embodiments of the present invention have been shown and described herein, it will be obvious to those skilled in the art that such embodiments are provided by way of example only. Numerous variations, changes, and substitutions will now occur to those skilled in the art without departing from the invention. It should be understood that various alternatives to the embodiments of the invention described herein may be employed in practicing the invention. It is intended that the following claims define the scope of the invention and that methods and structures within the scope of these claims and their equivalents be covered thereby.

Unless otherwise defined, all technical and scientific terms used herein have the same meaning as commonly understood by one of ordinary skill in the art to which this invention belongs. Although methods and materials similar or equivalent to those described herein can be used in the practice or testing of the present embodiments, suitable methods and materials are described below. In case of conflict, the patent specification, including definitions, will control. In addition, the materials, methods, and examples are illustrative only and not intended to be limiting. Numerous variations, changes, and substitutions will now occur to those skilled in the art without departing from the invention.

Definitions

The terms "polynucleotide" and "nucleic acid," used interchangeably herein, refer to a polymeric form of nucleotides of any length, either ribonucleotides or deoxyribonucleotides. Thus, terms "polynucleotide" and "nucleic acid" encompass single-stranded DNA; double-stranded DNA; multi-stranded DNA; single-stranded RNA; double-stranded RNA; multi-stranded RNA; genomic DNA; cDNA; DNA-RNA hybrids; and a polymer comprising purine and pyrimidine bases or other natural, chemically or biochemically modified, non-natural, or derivatized nucleotide bases.

"Hybridizable" or "complementary" are used interchangeably to mean that a nucleic acid (e.g., RNA, DNA) comprises a sequence of nucleotides that enables it to non-covalently bind, i.e., form Watson-Crick base pairs and/or G/U base pairs, "anneal", or "hybridize," to another nucleic acid in a sequence-specific, antiparallel, manner (i.e., a nucleic acid specifically binds to a complementary nucleic acid) under the appropriate in vitro and/or in vivo conditions of temperature and solution ionic strength. It is understood that the sequence of a polynucleotide need not be 100% complementary to that of its target nucleic acid sequence to be specifically hybridizable; it can have at least about 70%, at least about 80%, or at least about 90%, or at least about 95% sequence identity and still hybridize to the target nucleic acid sequence. Moreover, a polynucleotide may hybridize over one or more segments such that intervening or adjacent segments are not involved in the hybridization event (e.g., a loop structure or hairpin structure, a 'bulge', 'bubble' and the like).

A "gene," for the purposes of the present disclosure, includes a DNA region encoding a gene product (e.g., a protein, or RNA), as well as all DNA regions which regulate the production of the gene product, whether or not such regulatory element sequences are adjacent to coding and/or transcribed sequences. Accordingly, a gene may include regulatory sequences including, but not necessarily limited to, promoter sequences, terminators, translational regulatory sequences such as ribosome binding sites and internal ribosome entry sites, enhancers, silencers, insulators, boundary elements, replication origins, matrix attachment sites and locus control regions. Coding sequences encode a gene product upon transcription or transcription and translation; the coding sequences of the disclosure may comprise fragments and need not contain a full-length open reading frame. A gene can include both the strand that is transcribed; e.g. the strand containing the coding sequence, as well as the complementary strand.

The term "downstream" refers to a nucleotide sequence that is located 3' to a reference nucleotide sequence. In certain embodiments, downstream nucleotide sequences relate to sequences that follow the starting point of transcription. For example, the translation initiation codon of a gene is located downstream of the start site of transcription.

The term "upstream" refers to a nucleotide sequence that is located 5' to a reference nucleotide sequence. In certain embodiments, upstream nucleotide sequences relate to sequences that are located on the 5' side of a coding region or starting point of transcription. For example, most promoters are located upstream of the start site of transcription.

The term "regulatory element" is used interchangeably herein with the term "regulatory sequence," and is intended to include promoters, enhancers, and other expression regulatory elements (e.g., transcription termination signals, such as polyadenylation signals and poly-U sequences). Exemplary regulatory elements include a transcription promoter such as, but not limited to, CMV, CMV+intron A, SV40, RSV, HIV-Ltr, elongation factor 1 alpha (EF1α), MMLV-ltr, internal ribosome entry site (IRES) or P2A peptide to permit translation of multiple genes from a single transcript, metallothionein, a transcription enhancer element, a transcription termination signal, polyadenylation sequences, sequences for optimization of initiation of translation, and translation termination sequences. It will be understood that the choice of the appropriate regulatory element will depend on the encoded component to be expressed (e.g., protein or RNA) or whether the nucleic acid comprises multiple components that require different polymerases or are not intended to be expressed as a fusion protein.

The term "promoter" refers to a DNA sequence that contains an RNA polymerase binding site, transcription start site, TATA box, and/or B recognition element and assists or promotes the transcription and expression of an associated transcribable polynucleotide sequence and/or gene (or transgene). A promoter can be synthetically produced or can be derived from a known or naturally occurring promoter sequence or another promoter sequence. A promoter can be proximal or distal to the gene to be transcribed. A promoter can also include a chimeric promoter comprising a combination of two or more heterologous sequences to confer certain properties. A promoter of the present disclosure can include variants of promoter sequences that are similar in composition, but not identical to, other promoter sequence(s) known or provided herein. A promoter can be classified according to criteria relating to the pattern of expression of an associated coding or transcribable sequence or gene operably linked to the promoter, such as constitutive, developmental, tissue specific, inducible, etc.

The term "enhancer" refers to regulatory element DNA sequences that, when bound by specific proteins called transcription factors, regulate the expression of an associated gene. Enhancers may be located in the intron of the gene, or 5' or 3' of the coding sequence of the gene. Enhancers may be proximal to the gene (i.e., within a few tens or hundreds of base pairs (bp) of the promoter), or may be located distal to the gene (i.e., thousands of bp, hundreds of thousands of bp, or even millions of bp away from the promoter). A single gene may be regulated by more than one enhancer, all of which are envisaged as within the scope of the instant disclosure.

"Operably linked" means with reference to a juxtaposition of two or more components (such as sequence elements), in which the components are arranged such that both components function normally and allow the possibility that at least one of the components can mediate a function that is exerted upon at least one of the other components; e.g., a promoter and an encoding sequence.

"Repressor domain" refers to polypeptide factors that act as regulatory elements on DNA that inhibit, repress, or block transcription of DNA, resulting in repression of gene expression. A repressor domain can be a subunit of a repressor and individual domains can possess different functional properties. In the context of the present disclosure, the linking of a repressor domain to a catalytically inactive CRISPR protein that is paired as a ribonucleoprotein complex (RNP) with a guide RNA with binding affinity to certain regions of a target nucleic acid, can, when bound to the target nucleic acid, prevent transcription from a promoter or otherwise inhibit the expression of a gene. Without wishing to be bound by theory, it is thought that transcriptional repressors can function by a variety of mechanisms, including physically blocking RNA polymerase passage by steric hindrance, altering the polymerase's post-translational modification state, modifying the epigenetic state of the nascent RNA, changing the epigenetic state of the DNA through methylation, changing the epigenetic state of the DNA through histone deacetylation or modulating nucleosome remodeling, or preventing enhancer-promoter interactions, thereby leading to gene silencing or a reduction in the level of gene expression.

As used herein a "catalytically-dead CRISPR protein" refers to a CRISPR protein that lacks endonuclease activity. The skilled artisan will appreciate that a CRISPR protein can be catalytically dead, and still able to carry out additional protein functions, such as DNA binding. Similarly, a "catalytically-dead CasX" refers to a CasX protein that lacks endonuclease activity but is still able to carry out additional protein functions, such as DNA binding.

"Recombinant," as used herein, means that a particular nucleic acid (DNA or RNA) is the product of various combinations of cloning, restriction, and/or ligation steps resulting in a construct having a structural coding or non-coding sequence distinguishable from endogenous nucleic acids found in natural systems. Generally, DNA sequences encoding the structural coding sequence can be assembled from cDNA fragments and short oligonucleotide linkers, or from a series of synthetic oligonucleotides, to provide a synthetic nucleic acid which is capable of being expressed from a recombinant transcriptional unit contained in a cell or in a cell-free transcription and translation system. Such sequences can be provided in the form of an open reading frame uninterrupted by internal non-translated sequences, or introns, which are typically present in eukaryotic genes. Genomic DNA comprising the relevant sequences can also be used in the formation of a recombinant gene or transcriptional unit. Sequences of non-translated DNA may be present 5' or 3' from the open reading frame, where such sequences do not interfere with manipulation or expression of the coding regions, and may indeed act to modulate production of a desired product by various mechanisms (see "enhancers" and "promoters", above).

The term "recombinant polynucleotide" or "recombinant nucleic acid" refers to one which is not naturally occurring; e.g., is made by the artificial combination of two otherwise separated segments of sequence through human intervention. This artificial combination is often accomplished by either chemical synthesis means, or by the artificial manipulation of isolated segments of nucleic acids; e.g., by genetic engineering techniques. Such is usually done to replace a codon with a redundant codon encoding the same or a conservative amino acid, while typically introducing or removing a sequence recognition site. Alternatively, it is performed to join together nucleic acid segments of desired functions to generate a desired combination of functions. This artificial combination is often accomplished by either chemical synthesis means, or by the artificial manipulation of isolated segments of nucleic acids; e.g., by genetic engineering techniques.

Similarly, the term "recombinant polypeptide" or "recombinant protein" refers to a polypeptide or protein which is not naturally occurring; e.g., is made by the artificial combination of two otherwise separated segments of amino sequence through human intervention. Thus; e.g., a protein that comprises a heterologous amino acid sequence is recombinant.

As used herein, the term "contacting" means establishing a physical connection between two or more entities. For example, contacting a target nucleic acid sequence with a guide nucleic acid means that the target nucleic acid sequence and the guide nucleic acid are made to share a physical connection; e.g., can hybridize if the sequences share sequence similarity.

"Dissociation constant", or "$K_d$", are used interchangeably and mean the affinity between a ligand "L" and a protein "P"; i.e., how tightly a ligand binds to a particular protein. It can be calculated using the formula $K_d$=[L][P]/[LP], where [P], [L] and [LP] represent molar concentrations of the protein, ligand and complex, respectively.

As used herein, "homology-directed repair" (HDR) refers to the form of DNA repair that takes place during repair of double-strand breaks in cells. This process requires nucleotide sequence homology, and uses a donor template to repair or knock-out a target DNA, and leads to the transfer of genetic information from the donor (e.g., such as the donor template) to the target. Homology-directed repair can result in an alteration of the sequence of the target nucleic acid sequence by insertion, deletion, or mutation if the donor template differs from the target DNA sequence and part or all of the sequence of the donor template is incorporated into the target DNA.

As used herein, "non-homologous end joining" (NHEJ) refers to the repair of double-strand breaks in DNA by direct ligation of the break ends to one another without the need for a homologous template (in contrast to homology-directed repair, which requires a homologous sequence to guide repair). NHEJ often results in the loss (deletion) of nucleotide sequence near the site of the double-strand break.

As used herein "micro-homology mediated end joining" (MMEJ) refers to a mutagenic DSB repair mechanism, which always associates with deletions flanking the break sites without the need for a homologous template (in contrast to homology-directed repair, which requires a homologous sequence to guide repair). MMEJ often results in the loss (deletion) of nucleotide sequence near the site of the double-strand break.

A polynucleotide or polypeptide (or protein) has a certain percent "sequence similarity" or "sequence identity" to another polynucleotide or polypeptide, meaning that, when aligned, that percentage of bases or amino acids are the same, and in the same relative position, when comparing the two sequences. Sequence similarity (sometimes referred to as percent similarity, percent identity, or homology) can be determined in a number of different manners. To determine sequence similarity, sequences can be aligned using the methods and computer programs that are known in the art, including BLAST, available over the world wide web at ncbi.nlm.nih.gov/BLAST. Percent complementarity between particular stretches of nucleic acid sequences within nucleic acids can be determined using any convenient method. Example methods include BLAST programs (basic local alignment search tools) and PowerBLAST programs (Altschul et al., J. Mol. Biol., 1990, 215, 403-410; Zhang and Madden, Genome Res., 1997, 7, 649-656) or by using the Gap program (Wisconsin Sequence Analysis Package, Version 8 for Unix, Genetics Computer Group, University Research Park, Madison Wis.); e.g., using default settings, which uses the algorithm of Smith and Waterman (Adv. Appl. Math., 1981, 2, 482-489).

The terms "polypeptide," and "protein" are used interchangeably herein, and refer to a polymeric form of amino acids of any length, which can include coded and non-coded amino acids, chemically or biochemically modified or derivatized amino acids, and polypeptides having modified peptide backbones. The term includes fusion proteins, including, but not limited to, fusion proteins with a heterologous amino acid sequence.

A "vector" or "expression vector" is a replicon, such as plasmid, phage, virus, or cosmid, to which another DNA segment, i.e., an "insert", may be attached so as to bring about the replication or expression of the attached segment in a cell.

The term "naturally-occurring" or "unmodified" or "wild type" as used herein as applied to a nucleic acid, a polypeptide, a cell, or an organism, refers to a nucleic acid, polypeptide, cell, or organism that is found in nature.

As used herein, a "mutation" refers to an insertion, deletion, substitution, duplication, or inversion of one or more amino acids or nucleotides as compared to a wild-type or reference amino acid sequence or to a wild-type or reference nucleotide sequence.

As used herein the term "isolated" is meant to describe a polynucleotide, a polypeptide, or a cell that is in an environment different from that in which the polynucleotide, the polypeptide, or the cell naturally occurs. An isolated genetically modified host cell may be present in a mixed population of genetically modified host cells.

A "host cell," as used herein, denotes a eukaryotic cell, a prokaryotic cell, or a cell from a multicellular organism (e.g., in a cell line), cultured as a unicellular entity, which eukaryotic or prokaryotic cells are used as recipients for a nucleic acid (e.g., an expression vector), and include the progeny of the original cell which has been genetically modified by the nucleic acid. It is understood that the progeny of a single cell may not necessarily be completely identical in morphology or in genomic or total DNA complement as the original parent, due to natural, accidental, or deliberate mutation. A "recombinant host cell" (also referred to as a "genetically modified host cell") is a host The term "tropism" as used herein refers to preferential entry of the virus like particle (VLP or XDP) into certain cell or tissue type(s) and/or preferential interaction with the cell surface that facilitates entry into certain cell or tissue types, optionally and preferably followed by expression (e.g., transcription and, optionally, translation) of sequences carried by the VLP or XDP into the cell.

The terms "pseudotype" or "pseudotyping" as used herein, refers to viral envelope proteins that have been substituted with those of another virus possessing preferable characteristics. For example, HIV can be pseudotyped with vesicular stomatitis virus G-protein (VSV-G) envelope proteins (amongst others, described herein, below), which allows HIV to infect a wider range of cells because HIV envelope proteins target the virus mainly to CD4+ presenting cells.

The term "tropism factor" as used herein refers to components integrated into the surface of an XDP or VLP that provides tropism for a certain cell or tissue type. Non-limiting examples of tropism factors include glycoproteins, antibody fragments (e.g., scFv, nanobodies, linear antibodies, etc.), receptors and ligands to target cell markers.

A "target cell marker" refers to a molecule expressed by a target cell including but not limited to cell-surface receptors, cytokine receptors, antigens, tumor-associated antigens, glycoproteins, oligonucleotides, enzymatic substrates, antigenic determinants, or binding sites that may be present in the on the surface of a target tissue or cell that may serve as ligands for a tropism factor.

The term "conservative amino acid substitution" refers to the interchangeability in proteins of amino acid residues having similar side chains. For example, a group of amino acids having aliphatic side chains consists of glycine, alanine, valine, leucine, and isoleucine; a group of amino acids having aliphatic-hydroxyl side chains consists of serine and threonine; a group of amino acids having amide-containing side chains consists of asparagine and glutamine; a group of amino acids having aromatic side chains consists of phenylalanine, tyrosine, and tryptophan; a group of amino acids having basic side chains consists of lysine, arginine, and histidine; and a group of amino acids having sulfur-containing side chains consists of cysteine and methionine. Exemplary conservative amino acid substitution groups are: valine-leucine-isoleucine, phenylalanine-tyrosine, lysine-arginine, alanine-valine, and asparagine-glutamine.

As used herein, "treatment" or "treating," are used interchangeably herein and refer to an approach for obtaining beneficial or desired results, including but not limited to a therapeutic benefit and/or a prophylactic benefit. By therapeutic benefit is meant eradication or amelioration of the underlying disorder or disease being treated. A therapeutic benefit can also be achieved with the eradication or amelioration of one or more of the symptoms or an improvement in one or more clinical parameters associated with the underlying disease such that an improvement is observed in the subject, notwithstanding that the subject may still be afflicted with the underlying disorder.

The terms "therapeutically effective amount" and "therapeutically effective dose", as used herein, refer to an amount of a drug or a biologic, alone or as a part of a composition, that is capable of having any detectable, beneficial effect on any symptom, aspect, measured parameter or characteristics of a disease state or condition when administered in one or repeated doses to a subject such as a human or an experimental animal. Such effect need not be absolute to be beneficial.

As used herein, "administering" is meant a method of giving a dosage of a compound (e.g., a composition of the disclosure) or a composition (e.g., a pharmaceutical composition) to a subject.

A "subject" is a mammal. Mammals include, but are not limited to, domesticated animals, non-human primates, humans, rabbits, mice, rats and other rodents.

All publications, patents, and patent applications mentioned in this specification are herein incorporated by reference to the same extent as if each individual publication, patent, or patent application was specifically and individually indicated to be incorporated by reference.

I. General Methods

The practice of the present invention employs, unless otherwise indicated, conventional techniques of immunology, biochemistry, chemistry, molecular biology, microbiology, cell biology, genomics and recombinant DNA, which can be found in such standard textbooks as Molecular Cloning: A Laboratory Manual, 3rd Ed. (Sambrook et al., Harbor Laboratory Press 2001); Short Protocols in Molecular Biology, 4th Ed. (Ausubel et al. eds., John Wiley & Sons 1999); Protein Methods (Bollag et al., John Wiley & Sons 1996); Nonviral Vectors for Gene Therapy (Wagner et al. eds., Academic Press 1999); Viral Vectors (Kaplift & Loewy eds., Academic Press 1995); Immunology Methods Manual (I. Lefkovits ed., Academic Press 1997); and Cell and Tissue Culture: Laboratory Procedures in Biotechnology (Doyle & Griffiths, John Wiley & Sons 1998), the disclosures of which are incorporated herein by reference.

Where a range of values is provided, it is understood that endpoints are included and that each intervening value, to the tenth of the unit of the lower limit unless the context clearly dictates otherwise, between the upper and lower limit of that range and any other stated or intervening value in that stated range, is encompassed. The upper and lower limits of these smaller ranges may independently be included in the smaller ranges, and are also encompassed, subject to any specifically excluded limit in the stated range. Where the stated range includes one or both of the limits, ranges excluding either or both of those included limits are also included.

Unless defined otherwise, all technical and scientific terms used herein have the same meaning as commonly understood by one of ordinary skill in the art to which this invention belongs. All publications mentioned herein are incorporated herein by reference to disclose and describe the methods and/or materials in connection with which the publications are cited.

It must be noted that as used herein and in the appended claims, the singular forms "a," "an," and "the" include plural referents unless the context clearly dictates otherwise.

It will be appreciated that certain features of the disclosure, which are, for clarity, described in the context of separate embodiments, may also be provided in combination in a single embodiment. In other cases, various features of the disclosure, which are, for brevity, described in the context of a single embodiment, may also be provided separately or in any suitable sub-combination. It is intended that all combinations of the embodiments pertaining to the disclosure are specifically embraced by the present disclosure and are disclosed herein just as if each and every combination was individually and explicitly disclosed. In addition, all sub-combinations of the various embodiments and elements thereof are also specifically embraced by the present disclosure and are disclosed herein just as if each and every such sub-combination was individually and explicitly disclosed herein.

II. Repressor and Epigenetic Long-Term X-Repressor (ELXR) Systems

In a first aspect, the present disclosure provides gene repressor systems comprising a catalytically-dead CRISPR protein linked to one or more repressor domains, and one or more guide ribonucleic acids (gRNA) comprising a targeting sequence complementary to a target nucleic acid sequence of a gene targeted for repression, silencing, or downregulation, wherein the system is capable of binding to a target nucleic acid of the gene and repressing transcription of the gene.

In the context of the present disclosure and with respect to a gene, "repression", "repressing", "inhibition of gene expression", "downregulation", and "silencing" are used interchangeably herein to refer to the inhibition or blocking of transcription of a gene or a portion thereof. A gene product capable of being repressed by the systems of the disclosure include mRNA, rRNA, tRNA, structural RNA or protein encoded by the mRNA. Accordingly, repression of a gene can result in a decrease in production of a gene product. Examples of gene repression processes which decrease transcription include, but are not limited to, those which inhibit formation of a transcription initiation complex, those which decrease transcription initiation rate, those which decrease transcription elongation rate, those which decrease processivity of transcription and those which antagonize transcriptional activation (by, for example, blocking the binding of a transcriptional activator). Gene repression can constitute, for example, prevention of activation as well as inhibition of expression below an existing level. Transcriptional repression includes both reversible and irreversible inactivation of gene transcription. In some embodiments, repression by the systems of the disclosure comprises any detectable decrease in the production of a gene product in cells, preferably a decrease in production of a gene product by at least about 10%, 20%, 30%, 40%, 50%, 60%, 70%, 80%, 90%, 95%, or 99%, or any integer there between, when compared to untreated cells or cells treated with a comparable system comprising a non-targeting spacer. Most preferably, gene repression results in complete inhibition of gene expression, such that no gene product is detectable. In some embodiments, the repression of transcription by the systems of the embodiments is sustained for at least about 8 hours, at least about 1 day, at least about 1 week, at least about 2 weeks, at least about 3 weeks, at least about 1 month, or at least about 3 months, or at least about 6 months when assessed in an in vitro assay, including cell-based assays. In some embodiments, the repression of transcription by the gene repressor systems of the embodiments is sustained for at least about 1 day, at least about 1 week, at least about 2 weeks, at least about 3 weeks, at least about 1 month, or at least about 3 months, or at least about 6 months when assessed in a subject that has been administered a therapeutically-effective dose of a system of the embodiments described herein. In some embodiments, gene repression by the system results in no or minimal detectable off-target methylation or off-target activity, when assessed in an in vitro assay. In other embodiments, gene repression by the system results in no or minimal detectable off-target methylation or off-target activity, when assessed in a subject that has been administered a therapeutically-effective dose of a system of the embodiments described herein.

In some embodiments, the present disclosure provides systems of catalytically-dead CRISPR proteins linked to one or more repressor domains as a fusion protein and one or more guide ribonucleic acids (gRNA) for use in repressing a target nucleic acid, inclusive of coding and non-coding regions.

In some embodiments, the present disclosure provides systems of catalytically-dead CasX (dCasX) proteins linked to one or more repressor domains as a fusion protein (dXR) and one or more guide ribonucleic acids (gRNA) for use in repressing a target nucleic acid, inclusive of coding and non-coding regions; collectively, a dXR:gRNA system. A gRNA variant and targeting sequence, and a dCasX variant protein and linked repressor domain(s) of any of the embodiments, can form a complex and bind via non-covalent interactions, referred to herein as a ribonucleoprotein (RNP) complex. In some embodiments, the use of a pre-complexed dXR:gRNA RNP confers advantages in the delivery of the system components to a cell or target nucleic acid for repression of the target nucleic acid. In the RNP, the gRNA can provide target specificity to the RNP complex by including a targeting sequence (also referred to as a "spacer") having a nucleotide sequence that is complementary to a sequence of a target nucleic acid. In the RNP, the dCasX protein and linked repressor domain(s) of the pre-complexed dXR:gRNA provides the site-specific activity and is guided to a target site (and further stabilized at a target site) within a target nucleic acid sequence to be modified by virtue of its association with the gRNA. The dCasX protein and linked repressor domain(s) of the RNP complex provides the site-specific activities of the complex such as binding of the target sequence by the dCasX protein and the linked repressor domains provide the repression activity either directly or by the recruitment of other cellular factors.

Provided herein are compositions comprising or encoding the dCasX variant protein and linked repressor domains (dXR), gRNA variants, and dXR:gRNA gene repression pairs of any combination of dXR and gRNA, nucleic acids encoding the dXR and gRNA, as well as delivery modalities comprising the dXR:gRNA or encoding nucleic acids. Also provided herein are methods of making dCasX protein and linked repressor domain(s) and gRNA, as well as methods of using the CasX and gRNA, including methods of gene repression and methods of treatment. The dCasX protein and linked repressor domain(s) and gRNA components of the dXR:gRNA systems and their features, as well as the delivery modalities and the methods of using the compositions for the repression, down-regulation or silencing of a gene are described more fully, below.

III. Repressor Domain Fusion Proteins of the dXR:gRNA Systems

In one aspect, the disclosure relates to fusion proteins comprising one or more repressor domains operably linked to a catalytically dead CRISPR protein, e.g., a catalytically-dead Class 2 CRISPR protein. In some embodiments, the catalytically-dead Class 2 CRISPR protein is a catalytically-dead Class 2, Type V CRISPR protein. In some embodiments, the catalytically-dead CRISPR proteins include Class 2, Type II CRISPR/Cas nucleases such as Cas9. In other cases, the catalytically-dead CRISPR proteins include Class 2, Type V CRISPR/Cas nucleases such as a Cas12a (Cpf1), Cas12b (C2c1), Cas12c (C2c3), Cas12d (CasY), Cas12e (CasX), Cas12f, Cas12g, Cas12h, Cas12i, Cas12j, Cas12k, Cas12l, Cas14, and/or CasΦ. In some embodiments, the catalytically-dead Class 2, Type V CRISPR protein is a catalytically-dead CasX protein (dCasX) selected from the group of sequences of SEQ ID NOS: 17-36 and 59353-59358 as set forth in Table 4, or a sequence variant having at least about 70%, at least about 80%, at least about 85%, at least about 90% at least about 91%, at least about 92%, at least about 93% at least about 94% at least about 95%, at least about 96%, at least about 97%, at least about 98%, or at least about 99% identity thereto, linked to one or more repressor domains, resulting in a dXR fusion protein. In some embodiments, the catalytically-dead Class 2, Type V CRISPR protein is a catalytically-dead CasX protein (dCasX) selected from the group of sequences of SEQ ID NOS: 17-36 and 59353-59358 as set forth in Table 4 linked to one or more repressor domains, resulting in a dXR fusion protein.

In some embodiments, the disclosure provides fusion proteins comprising a first repressor domain as a fusion protein wherein the first repressor domain is a Krüppel-associated box (KRAB) domain which can be fused to a catalytically dead CRISPR protein by linker peptides disclosed herein. In some embodiments, the disclosure provides dXR fusion proteins comprising a first repressor domain as a fusion protein wherein the first repressor domain is a Krüppel-associated box (KRAB) domain which can be fused to the dCasX by linker peptides disclosed herein, resulting in a dXR fusion protein.

Amongst repressor domains that have the ability to repress, or silence genes, the Krüppel-associated box (KRAB) repressor domain is amongst the most powerful in human genome systems (Alerasool, N., et al. An efficient KRAB domain for CRISPRi applications. Nat. Methods 17:1093 (2020)). KRAB domains are present in approximately 400 human zinc finger protein-based transcription factors that upon binding of the dXR to the target nucleic acid, is capable of recruiting additional repressor domains such as, but not limited to, Trim28 (also known as Kap1 or Tif1-beta) that, in turn, assembles a protein complex with chromatin regulators such as CBX5/HP1α and SETDB1 that induce repression of transcription of the gene. SETDB1 is a histone methyltransferase that deposit H3K9me3 marks on histones, which is a mark of heterochromatin (complexes which acetylate histones and deposit active H3K9ac marks are displaced). In some cases, DNA methyltransferases (the DNMT domains DNMT3A and DNMT3L) are subsequently recruited to deposit methylation marks on the DNA so that silencing of the gene will persist after the system complex is no longer bound to the target nucleic acid. The methylation of CpG dinucleotides (CpG) in mammalian cells is catalyzed by the DNA methyltransferases DNMT3a and 3b, which establish DNA methylation patterns, and DNMTL, which maintains the methylation pattern after DNA replication (Zhang, Y., et al. Chromatin methylation activity of Dnmt3a and Dnmt3a/3L is guided by interaction of the ADD domain with the histone H3 tail. Nucleic Acids Research 38:4246 (2010)). Thus, SETDB1 and DNMT3's recruited by the KRAB domain act as co-repressors of the dXR fusion protein (Tatsumi, D., et al. DNMTs and SETDB1 function as co-repressors in MAX-mediated repression of germ cell-related genes in mouse embryonic stem cells. PLoS ONE 13(11): e0205969 (2018)).

Other repressor domains suitable for inclusion in the dXR of the disclosure include DNA methyltransferase 3 alpha (DNMT3A or subdomains thereof), DNMT3A-like protein (DNMT3L or subdomains thereof), DNA methyltransferase 3 beta (DNMT3B), DNA methyltransferase 1 (DNMT1), Friend of GATA-1 (FOG), Mad mSIN3 interaction domain (SID), enhanced SID (SID4X), nuclear receptor corepressor (NcoR), nuclear effector protein (NuE), KOX1 repression domain, the ERF repressor domain (ERD), the SRDX repression domain, histone lysine methyltransferases such as PR/SET domain containing protein (Pr-SET)7/8, lysine methyltransferase 5B (SUV4-20H1), PR/SET domain 2 (RIZ1), histone lysine demethylases such as lysine demethylase 4A (JMJD2A/JHDM3A), lysine demethylase 4B (JMJD2B), lysine demethylase 4C (JMJD2C/GASC1), lysine demethylase 4D (JMJD2D), lysine demethylase 5A (JARID1A/RBP2), lysine demethylase 5B (JARID1B/PLU-1), lysine demethylase 5C (JARID 1C/SMCX), lysine demethylase 5D (JARID1D/SMCY), sirtuin 1 (SIRT1), SIRT2, DNA methylases such as HhaI DNA m5c-methyltransferase (M.HhaI), methyltransferase 1 (MET1), histone H3 lysine 9 methyltransferase G9a (G9a), S-adenosyl-L-methionine-dependent methyltransferases superfamily protein (DRM3), DNA cytosine methyltransferase MET2a (ZMET2), methyl-CpG (mCpG) binding domain 2 (meCP2), Switch independent 3 transcription regulator family member A (SIN3A), histone deacetylase HDT1 (HDT1), n-terminal truncation of methyl-CpG-binding domain containing protein 2 (MBD2B), nuclear inhibitor of protein phosphatase-1 (NIPP1), GLP, chromomethylase 1 (CMT1), chromomethylase 2 (CMT2), heterochromatin protein 1 (HP1A), mixed lineage leukemia protein-5 (MLL5), histone-lysine N-methyltransferase SETDB1 (SETB1), Suppressor Of Variegation 3-9 Homolog 1 (SUV39H1), SUV39H2, euchromatic histone lysine methyltransferase 1 (EHMT1), histone-lysine N-methyltransferase EZH1 (EZH1), EZH2, nuclear receptor binding SET domain protein 1 (NSD1), NSD2, NSD3, ASH1 like histone lysine methyltransferase (ASH1L), tripartite motif containing 28 (TRIM28), Methyltransferase Like 3 (METTL3), METTL4, family with sequence similarity 208 member A (FAM208A), M-Phase Phosphoprotein 8 (MPHOSPH8), SET domain containing 2 (SETD2), histone deacetylase 1 (HDAC1), HDAC2, HDAC3, HDAC8, HDAC4, HDAC5, HDAC7, HDAC9, Periphilin 1 (PPHLN1), and subdomains thereof.

Human genes encoding KRAB zinc-finger proteins include KOX1/ZNF10, KOX8/ZNF708, ZNF43, ZNF184, ZNF91, HPF4, HTF10, HTF34, and the sequences of SEQ ID NOS: 355-888. In some embodiments, the KRAB transcriptional repressor domain of the dXR:gRNA systems is selected from the group consisting of (in all cases, ZNF=zinc finger protein; KRBOX=KRAB box domain containing; ZKSCAN=zinc finger with KRAB and SCAN domains; SSX=SSX family member; KRBA=KRAB-A domain containing; ZFP=zinc finger protein) ZNF343, ZNF10, ZNF337, ZNF334, ZNF215, ZNF519, ZNF485, ZNF214, ZNF33B, ZNF287, ZNF705A, ZNF37A, KRBOX4, ZKSCAN3, ZKSCAN4, ZNF57, ZNF557, ZNF705B, ZNF662, ZNF77, ZNF500, ZNF558, ZNF620, ZNF713, ZNF823, ZNF440, ZNF441, ZNF136, small nuclear ribonucleoprotein polypeptides B and B1 (SNRPB), ZNF735, ZKSCAN2, ZNF619, ZNF627, ZNF333, ATP binding cassette subfamily A member 11 (ABCA11P), PLD5 pseudogene 1 (PLD5P1), ZNF25, ZNF727, ZNF595, ZNF14, ZNF33A, ZNF101, ZNF253, ZNF56, ZNF720, ZNF85, ZNF66, ZNF722P, ZNF486, ZNF682, ZNF626, ZNF100, ZNF93, ZKSCAN1, ZNF257, ZNF729, ZNF208, ZNF90, ZNF430, ZNF676, ZNF91, ZNF429, ZNF675, ZNF681, ZNF99, ZNF431, ZNF98, ZNF708, ZNF732, SSX family member 2 (SSX2), ZNF721, ZNF726, ZNF730, ZNF506, ZNF728, ZNF141, ZNF723, ZNF302, ZNF484, SSX2B, ZNF718, ZNF74, ZNF157, ZNF790, ZNF565, ZNF705G, vomeronasal 1 receptor 107 pseudogene (VN1R107P), solute carrier family 27 member 5 (SLC27A5), ZNF737, SSX4, ZNF850, ZNF717, ZNF155, ZNF283, ZNF404, ZNF114, ZNF716, ZNF230, ZNF45, ZNF222, ZNF286A, ZNF624, ZNF223, ZNF284, ZNF790-AS1, ZNF382, ZNF749, ZNF615, ZFP90, ZNF225, ZNF234, ZNF568, ZNF614, ZNF584, ZNF432, ZNF461, ZNF182, ZNF630, ZNF630-AS1, ZNF132, ZNF420, ZNF324B, ZNF616, ZNF471, ZNF227, ZNF324, ZNF860, ZFP28 zinc finger protein (ZFP28), ZNF470, ZNF586, ZNF235, ZNF274, ZNF446, ZFP1, ZIM3, ZNF212, ZNF766, ZNF264, ZNF480, ZNF667, ZNF805, ZNF610, ZNF783, ZNF621, ZNF8-DT, ZNF880, ZNF213-AS1, ZNF213, ZNF263, zinc finger and SCAN domain containing 32 (ZSCAN32), ZIM2, ZNF597, ZNF786, KRAB-A domain containing 1 (KRBA1), ZNF460, ZNF8, ZNF875, ZNF543, ZNF133, ZNF229, ZNF528, SSX1, ZNF81, ZNF578, ZNF862, ZNF777, ZNF425, ZNF548, ZNF746, ZNF282, ZNF398, ZNF599, ZNF251, ZNF195, ZNF181, RBAK-RBAKDN readthrough (RBAK-RBAKDN), ZFP37, RNA, 7SL, cytoplasmic 526, pseudogene (RN7SL526P), ZNF879, ZNF26, ZSCAN21, ZNF3, ZNF354C, ZNF10, ZNF75D, ZNF426, ZNF561, ZNF562, ZNF846, ZNF782, ZNF552, ZNF587B, ZNF814, ZNF587, ZNF92, ZNF417, ZNF256, ZNF473, ZFP14, ZFP82, ZNF529, ZNF605, ZFP57, ZNF724, ZNF43, ZNF354A, ZNF547, SSX4B, ZNF585A, ZNF585B, ZNF792, ZNF789, ZNF394, ZNF655, ZFP92, ZNF41, ZNF674, ZNF546, ZNF780B, ZNF699, ZNF177, ZNF560, ZNF583, ZNF707, ZNF808, ZKSCAN5, ZNF137P, ZNF611, ZNF600, ZNF28, ZNF773, ZNF549, ZNF550, ZNF416, ZIK1, ZNF211, ZNF527, ZNF569, ZNF793, ZNF571-AS1, ZNF540, ZNF571, ZNF607, ZNF75A, ZNF205, ZNF175, ZNF268, ZNF354B, ZNF135, ZNF221, ZNF285, ZNF419, ZNF30, ZNF304, ZNF254, ZNF701, ZNF418, ZNF71, ZNF570, ZNF705E, KRBOX1, ZNF510, ZNF778, PR/SET domain 9 (PRDM9), ZNF248, ZNF845, ZNF525, ZNF765, ZNF813, ZNF747, ZNF764, ZNF785, ZNF689, ZNF311, ZNF169, ZNF483, ZNF493, ZNF189, ZNF658, ZNF564, ZNF490, ZNF791, ZNF678, ZNF454, ZNF34, ZNF7, ZNF250, ZNF705D, ZNF641, ZNF2, ZNF554, ZNF555, ZNF556, ZNF596, ZNF517, ZNF331, ZNF18, ZNF829, ZNF772, ZNF17, ZNF112, ZNF514, ZNF688, PRDM7, ZNF695, ZNF670-ZNF695, ZNF138, ZNF670, ZNF19, ZNF316, ZNF12, ZNF202, RBAK, ZNF83, ZNF468, ZNF479, ZNF679, ZNF736, ZNF680, ZNF273, ZNF107, ZNF267, ZKSCAN8, ZNF84, ZNF573, ZNF23, ZNF559, ZNF44, ZNF563, ZNF442, ZNF799, ZNF443, ZNF709, ZNF566, ZNF69, ZNF700, ZNF763, ZNF433-AS1, ZNF433, ZNF878, ZNF844, ZNF788P, ZNF20, ZNF625-ZNF20, ZNF625, ZNF606, ZNF530, ZNF577, ZNF649, ZNF613, ZNF350, ZNF317, ZNF300, ZNF180, ZNF415, vomeronasal 1 receptor 1 (VN1R1), ZNF266, ZNF738, ZNF445, ZNF852, ZKSCAN7, ZNF660, myosin phosphatase Rho interacting protein pseudogene 1 (MPRIPP1), ZNF197, ZNF567, ZNF582, ZNF439, ZFP30, ZNF559-ZNF177, ZNF226, ZNF841, ZNF544, ZNF233, ZNF534, ZNF836, ZNF320, KRBA2, ZNF761, ZNF383, ZNF224, ZNF551, ZNF154, ZNF671, ZNF776, ZNF780A, ZNF888, ZNF816-ZNF321P, ZNF321P, ZNF816, ZNF347, ZNF665, ZNF677, ZNF160, ZNF184, ZNF140, ZNF589, ZNF891, ZFP69B, ZNF436, pogo transposable element derived with KRAB domain (POGK), ZNF669, ZFP69, ZNF684, ZNF124, and ZNF496, or sequence variants having at least about 70%, at least about 80%, at least about 85%, at least about 90% at least about 91%, at least about 92%, at least about 93% at least about 94% at least about 95%, at least about 96%, at least about 97%, at least about 98%, or at least about 99% identity thereto.

In some embodiments, the gene repressor system comprises a single KRAB domain operably linked to the catalytically-dead CRISPR protein as a fusion protein, wherein the KRAB domain is selected from the group of sequences consisting of SEQ ID NOS: 889-2100 and 2332-33239, or a sequence having at least about 70%, at least about 80%, at least about 85%, at least about 90% at least about 91%, at least about 92%, at least about 93% at least about 94% at least about 95%, at least about 96%, at least about 97%, at least about 98%, or at least about 99% identity thereto. In some embodiments, the system comprises a single KRAB domain operably linked to the catalytically-dead CRISPR protein, wherein the KRAB domain is selected from the group of sequences consisting of SEQ ID NOS: 889-2100 and 2332-33239. In some embodiments, the fusion protein of the systems comprises a single KRAB domain operably linked to the catalytically-dead CRISPR protein, wherein the KRAB domain is selected from the group of sequences consisting of SEQ ID NOS: 57746-59342, or a sequence having at least about 70%, at least about 75%, at least about 80%, at least about 85%, at least about 90% at least about 91%, at least about 92%, at least about 93% at least about 94% at least about 95%, at least about 96%, at least about 97%, at least about 98%, or at least about 99% identity thereto. In some embodiments, the fusion protein of the systems comprises a single KRAB domain operably linked to the catalytically-dead CRISPR protein, wherein the KRAB domain is selected from the group of sequences consisting of SEQ ID NOS: 57746-57840, or a sequence having at least about 70%, at least about 75%, at least about 80%, at least about 85%, at least about 90% at least about 91%, at least about 92%, at least about 93% at least about 94% at least about 95%, at least about 96%, at least about 97%, at least about 98%, or at least about 99% identity thereto. In some embodiments, the fusion protein of the systems comprises a single KRAB domain operably linked to the catalytically-dead CRISPR, wherein the KRAB domain is selected from the group of sequences consisting of SEQ ID NOS: 57746-57755, or a sequence having at least about 70%, at least about 75%, at least about 80%, at least about 85%, at least about 90% at least about 91%, at least about 92%, at least about 93% at least about 94% at least about 95%, at least about 96%, at least about 97%, at least about 98%, or at least about 99% identity thereto. In a particular embodiment, the fusion protein of the systems comprises a single KRAB domain operably linked to a catalytically dead Cas9 protein, wherein the KRAB domain is selected from the group of sequences consisting of SEQ ID NOS: 57746-57755, or a sequence having at least about 70%, at least about 75%, at least about 80%, at least about 85%, at least about 90% at least about 91%, at least about 92%, at least about 93% at least about 94% at least about 95%, at least about 96%, at least about 97%, at least about 98%, or at least about 99% identity thereto.

In some embodiments, the fusion proteins of the systems comprise a single KRAB domain operably linked by a peptide linker to the catalytically-dead CRISPR protein, wherein the KRAB domain comprises one or more motifs selected from the group consisting of a) $PX_1X_2X_3X_4X_5X_6EX_7$, wherein $X_1$ is A, D, E, or N, $X_2$ is L or V, $X_3$ is I or V, $X_4$ is S, T, or F, $X_5$ is H, K, L, Q, R or W, $X_6$ is L or M, and $X_7$ is G, K, Q, or R; b) $X_1X_2X_3X_4GX_5X_6X_7X_8X_9$, wherein $X_1$ is L or V, $X_2$ is A, G, L, T or V, $X_3$ is A, F, or S, $X_4$ is L or V, $X_5$ is C, F, H, I, L or Y, $X_6$ is A, C, P, Q, or S, $X_7$ is A, F, G, I, S, or V, $X_8$ is A, P, S, or T, and $X_9$ is K or R; c) $QX_1X_2LYRX_3VMX_4$(SEQ ID NO: 59345), wherein $X_1$ is K or R, $X_2$ is A, D, E, G, N, S, or T, $X_3$ is D, E, or S, and $X_4$ is L or R; d) $X_1X_2X_3FX_4DVX_5X_6X_7FX_8X_9X_{10}X_{11}$ (SEQ ID NO: 59346), wherein $X_1$ is A, L, P, or S, $X_2$ is L or V, $X_3$ is S or T, $X_4$ is A, E, G, K, or R, $X_5$ is A or T, $X_6$ is I or V, $X_7$ is D, E, N, or Y, $X_8$ is S or T, $X_9$ is E, P, Q, R, or W, $X_{10}$ is E or N, and $X_{11}$ is E or Q; e) $X_1X_2X_3PX_4X_5X_6X_7X_8X_9X_{10}$, wherein $X_1$ is E, G, or R, $X_2$ is E or K, $X_3$ is A, D, or E, $X_4$ is C or W, $X_5$ is I, K, L, M, T, or V, $X_6$ is I, L, P, or V, $X_7$ is D, E, K, or V, $X_8$ is E, G, K, P, or R, $X_9$ is A, D, R, G, K, Q, or V, and $X_{10}$ is D, E, G, I, L, R, S, or V; f) $LYX_1X_2VMX_3EX_4X_5X_6X_7X_8X_9X_{10}$ (SEQ ID NO: 59348), wherein $X_1$ is K or R, $X_2$ is D or E, $X_3$ is L, Q, or R, $X_4$ is N or T, $X_5$ is F or Y, $X_6$ is A, E, G, Q, R, or S, $X_7$ is H, L, or N, $X_8$ is L or V, $X_9$ is A, G, I, L, T, or V, and $X_{10}$ is A, F, or S; g) $FX_1DVX_2X_3X_4FX_5X_6X_7EWX_8$ (SEQ ID NO: 59349), wherein $X_1$ is A, E, G, K, or R, $X_2$ is A, S, or T, $X_3$ is I or V, $X_4$ is D, E, N, or Y, $X_5$ is S or T, $X_6$ is E, L, P, Q, R, or W, $X_7$ is D or E, and $X_8$ is A, E, G, Q, or R; h) $X_1PX_2X_3X_4X_5$ $X_6LEX_7X_8X_9X_{10}X_{11}X_{12}$, wherein $X_1$ is K or R, $X_2$ is A, D, E, or N, $X_3$ is I, L, M, or V, $X_4$ is I or V, $X_5$ is F, S, or T, $X_6$ is H, K, L, Q, R, or W, $X_7$ is K, Q, or R, $X_8$ is E, G, or R, $X_9$ is D, E, or K, $X_{10}$ is A, D, or E, $X_{11}$ is L or P, and $X_{12}$ is C or W; or i) $X_1LX_2X_3X_4QX_5X_6$, wherein $X_1$ is C, H, L, Q, or W, $X_2$ is D, G, N, R, or S, $X_3$ is L, P, S, or T, $X_4$ is A, S, or T, $X_5$ is K or R, and $X_6$ is A, D, E, K, N, S, or T, and the KRAB domain comprises a sequence selected from the group consisting of SEQ ID NOS: 57746-59342. In other embodiments, the fusion proteins of the systems comprise a single KRAB domain operably linked to the catalytically-dead CRISPR protein wherein the KRAB domain comprises a first domain comprising the sequence $LYX_1X_2VMX_3EX_4X_5X_6X_7X_8X_9X_{10}$ (SEQ ID NO: 59348), wherein $X_1$ is K or R, $X_2$ is D or E, $X_3$ is L, Q, or R, $X_4$ is N or T, $X_5$ is F or Y, $X_6$ is A, E, G, Q, R, or S, $X_7$ is H, L, or N, $X_8$ is L or V, $X_9$ is A, G, I, L, T, or V, and $X_{10}$ is A, F, or S, and a second sequence motif comprises the sequence $FX_1DVX_2X_3X_4FX_5X_6X_7EWX_8$ (SEQ ID NO: 59349), wherein $X_1$ is A, E, G, K, or R, $X_2$ is A, S, or T, $X_3$ is I or V, $X_4$ is D, E, N, or Y, $X_5$ is S or T, $X_6$ is E, L, P, Q, R, or W, $X_7$ is D or E, and $X_8$ is A, E, G, Q, or R, and the KRAB domain comprises a sequence selected from the group consisting of SEQ ID NOS: 57746-59342. In other embodiments, the fusion proteins of the systems comprise a single KRAB domain operably linked to the catalytically-dead CRISPR protein wherein the KRAB domain comprises a first domain comprising the sequence $LYX_1X_2VMX_3EX_4X_5X_6X_7X_8X_9X_{10}$ (SEQ ID NO: 59348), wherein $X_1$ is K or R, $X_2$ is D or E, $X_3$ is L, Q, or R, $X_4$ is N or T, $X_5$ is F or Y, $X_6$ is A, E, G, Q, R, or S, $X_7$ is H, L, or N, $X_8$ is L or V, $X_9$ is A, G, I, L, T, or V, and $X_{10}$ is A, F, or S, and a second sequence motif comprises the sequence $FX_1DVX_2X_3X_4FX_5X_6X_7EWX_8$ (SEQ ID NO: 59349), wherein $X_1$ is A, E, G, K, or R, $X_2$ is A, S, or T, $X_3$ is I or V, $X_4$ is D, E, N, or Y, $X_5$ is S or T, $X_6$ is E, L, P, Q, R, or W, $X_7$ is D or E, and $X_8$ is A, E, G, Q, or R, and the KRAB domain comprises a sequence selected from the group consisting of SEQ ID NOS: 57746-57840. In still other embodiments, the fusion proteins of the systems comprise a single KRAB domain operably linked to the catalytically-dead CRISPR protein wherein the KRAB domain comprises a first domain comprising the sequence $LYX_1X_2VMX_3EX_4X_5X_6X_7X_8X_9X_{10}$ (SEQ ID NO: 59348), wherein $X_1$ is K or R, $X_2$ is D or E, $X_3$ is L, Q, or R, $X_4$ is N or T, $X_5$ is F or Y, $X_6$ is A, E, G, Q, R, or S, $X_7$ is H, L, or N, $X_8$ is L or V, $X_9$ is A, G, I, L, T, or V, and $X_{10}$ is A, F, or S, and a second sequence motif comprises the sequence $FX_1DVX_2X_3X_4FX_5X_6X_7EWX_8$ (SEQ ID NO: 59349), wherein $X_1$ is A, E, G, K, or R, $X_2$ is A, S, or T, $X_3$ is I or V, $X_4$ is D, E, N, or Y, $X_5$ is S or T, $X_6$ is E, L, P, Q, R, or W, $X_7$ is D or E, and $X_8$ is A, E, G, Q, or R, and the KRAB domain comprises a sequence selected from the group consisting of SEQ ID NOS: 57746-57755.

In some embodiments, the dXR:gRNA system comprises a single KRAB domain operably linked to a catalytically-dead Class 2, Type V CRISPR protein as a fusion protein, wherein the catalytically-dead Class 2, Type V CRISPR protein is a dCasX selected from the group of sequences of SEQ ID NOS: 17-36 and 59353-59358 as set forth in Table 4, or a sequence variant having at least about 70%, at least about 80%, at least about 85%, at least about 90% at least about 91%, at least about 92%, at least about 93% at least about 94% at least about 95%, at least about 96%, at least about 97%, at least about 98%, or at least about 99% identity thereto, and wherein the KRAB domain is selected from the group of sequences consisting of SEQ ID NOS: 889-2100 and 2332-33239, or a sequence having at least about 70%, at least about 80%, at least about 85%, at least about 90% at least about 91%, at least about 92%, at least about 93% at least about 94% at least about 95%, at least about 96%, at least about 97%, at least about 98%, or at least about 99% identity thereto. In some embodiments, the system comprises a single KRAB domain operably linked to the dCasX selected from the group of sequences of SEQ ID NOS: 17-36 and 59353-59358 as set forth in Table 4, wherein the KRAB domain is selected from the group of sequences consisting of SEQ ID NOS: 889-2100 and 2332-33239. In some embodiments, the dXR fusion protein of the systems comprises a single KRAB domain operably linked to the dCasX selected from the group of sequences of SEQ ID NOS: 17-36 and 59353-59358 as set forth in Table 4, wherein the KRAB domain is selected from the group of sequences consisting of SEQ ID NOS: 57746-59342, or a sequence having at least about 70%, at least about 75%, at least about 80%, at least about 85%, at least about 90% at least about 91%, at least about 92%, at least about 93% at least about 94% at least about 95%, at least about 96%, at least about 97%, at least about 98%, or at least about 99% identity thereto. In some embodiments, the dXR fusion protein of the systems comprises a single KRAB domain operably linked to the dCasX selected from the group of sequences of SEQ ID NOS: 17-36 and 59353-59358 as set forth in Table 4, wherein the KRAB domain is selected from the group of sequences consisting of SEQ ID NOS: 57746-57840, or a sequence having at least about 70%, at least about 75%, at least about 80%, at least about 85%, at least about 90% at least about 91%, at least about 92%, at least about 93% at least about 94% at least about 95%, at least about 96%, at least about 97%, at least about 98%, or at least about 99% identity thereto. In some embodiments, the dXR fusion protein of the systems comprises a single KRAB domain operably linked to the dCasX selected from the group of sequences of SEQ ID NOS: 17-36 and 59353-59358 as set forth in Table 4, wherein the KRAB domain is selected from the group of sequences consisting of SEQ ID NOS: 57746-57755, or a sequence having at least about 70%, at least about 75%, at least about 80%, at least about 85%, at least about 90% at least about 91%, at least about 92%, at least about 93% at least about 94% at least about 95%, at least about 96%, at least about 97%, at least about 98%, or at least about 99% identity thereto. In a particular embodiment, the dXR fusion protein of the systems comprises a single KRAB domain operably linked to the dCasX of SEQ ID NO: 18 as set forth in Table 4, wherein the KRAB domain is selected from the group of sequences consisting of SEQ ID NOS: 57746-57755, or a sequence having at least about 70%, at least about 75%, at least about 80%, at least about 85%, at least about 90% at least about 91%, at least about 92%, at least about 93% at least about 94% at least about 95%, at least about 96%, at least about 97%, at least about 98%, or at least about 99% identity thereto. In another particular embodiment, the dXR fusion protein of the systems comprises a single KRAB domain operably linked to the dCasX of SEQ ID NO: 25, as set forth in Table 4, wherein the KRAB domain is selected from the group of sequences consisting of SEQ ID NOS: 57746-57755, or a sequence having at least about 70%, at least about 75%, at least about 80%, at least about 85%, at least about 90% at least about 91%, at least about 92%, at least about 93% at least about 94% at least about 95%, at least about 96%, at least about 97%, at least about 98%, or at least about 99% identity thereto. In another particular embodiment, the dXR fusion protein of the systems comprises a single KRAB domain operably linked to the dCasX of SEQ ID NO: 59357, as set forth in Table 4, wherein the KRAB domain is selected from the group of sequences consisting of SEQ ID NOS: 57746-57755, or a sequence having at least about 70%, at least about 75%, at least about 80%, at least about 85%, at least about 90% at least about 91%, at least about 92%, at least about 93% at least about 94% at least about 95%, at least about 96%, at least about 97%, at least about 98%, or at least about 99% identity thereto. In another particular embodiment, the dXR fusion protein of the systems comprises a single KRAB domain operably linked to the dCasX of SEQ ID NO: 59358, as set forth in Table 4, wherein the KRAB domain is selected from the group of sequences consisting of SEQ ID NOS: 57746-57755, or a sequence having at least about 70%, at least about 75%, at least about 80%, at least about 85%, at least about 90% at least about 91%, at least about 92%, at least about 93% at least about 94% at least about 95%, at least about 96%, at least about 97%, at least about 98%, or at least about 99% identity thereto.

In some embodiments, the dXR fusion proteins of the systems comprise a single KRAB domain operably linked by a peptide linker to a dCasX selected from the group of sequences of SEQ ID NOS: 17-36 and 59353-59358 as set forth in Table 4, wherein the KRAB domain comprises one or more motifs selected from the group consisting of a) $PX_1X_2X_3X_4X_5X_6EX_7$, wherein $X_1$ is A, D, E, or N, $X_2$ is L or V, $X_3$ is I or V, $X_4$ is S, T, or F, $X_5$ is H, K, L, Q, R or W, $X_6$ is L or M, and $X_7$ is G, K, Q, or R; b) $X_1X_2X_3X_4GX_5X_6X_7X_8X_9$, wherein $X_1$ is L or V, $X_2$ is A, G, L, T or V, $X_3$ is A, F, or S, $X_4$ is L or V, $X_5$ is C, F, H, I, L or Y, $X_6$ is A, C, P, Q, or S, $X_7$ is A, F, G, I, S, or V, $X_8$ is A, P, S, or T, and $X_9$ is K or R; c) $QX_1X_2LYRX_3VMX_4$(SEQ ID NO: 59345), wherein $X_1$ is K or R, $X_2$ is A, D, E, G, N, S, or T, $X_3$ is D, E, or S, and $X_4$ is L or R; d) $X_1X_2X_3FX_4DVX_5X_6X_7FX_8X_9X_{10}X_{11}$ (SEQ ID NO: 59346), wherein $X_1$ is A, L, P, or S, $X_2$ is L or V, $X_3$ is S or T, $X_4$ is A, E, G, K, or R, $X_5$ is A or T, $X_6$ is I or V, $X_7$ is D, E, N, or Y, $X_8$ is S or T, $X_9$ is E, P, Q, R, or W, $X_{10}$ is E or N, and $X_{11}$ is E or Q; e) $X_1X_2X_3PX_4X_5X_6X_7X_8X_9X_{10}$, wherein $X_1$ is E, G, or R, $X_2$ is E or K, $X_3$ is A, D, or E, $X_4$ is C or W, $X_5$ is I, K, L, M, T, or V, $X_6$ is I, L, P, or V, $X_7$ is D, E, K, or V, $X_8$ is E, G, K, P, or R, $X_9$ is A, D, R, G, K, Q, or V, and $X_{10}$ is D, E, G, I, L, R, S, or V; f) $LYX_1X_2VMX_3EX_4X_5X_6X_7X_8X_9X_{10}$ (SEQ ID NO: 59348), wherein $X_1$ is K or R, $X_2$ is D or E, $X_3$ is L, Q, or R, $X_4$ is N or T, $X_5$ is F or Y, $X_6$ is A, E, G, Q, R, or S, $X_7$ is H, L, or N, $X_8$ is L or V, $X_9$ is A, G, I, L, T, or V, and $X_{10}$ is A, F, or S; g) $FX_1DVX_2X_3X_4FX_5X_6X_7EWX_8$ (SEQ ID NO: 59349), wherein $X_1$ is A, E, G, K, or R, $X_2$ is A, S, or T, $X_3$ is I or V, $X_4$ is D, E, N, or Y, $X_5$ is S or T, $X_6$ is E, L, P, Q, R, or W, $X_7$ is D or E, and $X_8$ is A, E, G, Q, or R; h) $X_1PX_2X_3X_4X_5$ $X_6LEX_7X_8X_9X_{10}X_{11}X_{12}$, wherein $X_1$ is K or R, $X_2$ is A, D, E, or N, $X_3$ is I, L, M, or V, $X_4$ is I or V, $X_5$ is F, S, or T, $X_6$ is H, K, L, Q, R, or W, $X_7$ is K, Q, or R, $X_8$ is E, G, or R, $X_9$ is D, E, or K, $X_{10}$ is A, D, or E, $X_{11}$ is L or P, and $X_{12}$ is C or W; or i) $X_1LX_2X_3X_4QX_5X_6$, wherein $X_1$ is C, H, L, Q, or W, $X_2$ is D, G, N, R, or S, $X_3$ is L, P, S, or T, $X_4$ is A, S, or T, $X_5$ is K or R, and $X_6$ is A, D, E, K, N, S, or T, and the KRAB domain comprises a sequence selected from the group consisting of SEQ ID NOS: 57746-59342. In other embodiments, the dXR fusion proteins of the systems comprise a single KRAB domain operably linked to the dCasX wherein the KRAB domain comprises a first domain comprising the sequence $LYX_1X_2VMX_3EX_4X_5X_6X_7X_8X_9X_{10}$ (SEQ ID NO: 59348), wherein $X_1$ is K or R, $X_2$ is D or E, $X_3$ is L, Q, or R, $X_4$ is N or T, $X_5$ is F or Y, $X_6$ is A, E, G, Q, R, or S, $X_7$ is H, L, or N, $X_8$ is L or V, $X_9$ is A, G, I, L, T, or V, and $X_{10}$ is A, F, or S, and a second sequence motif comprises the sequence $FX_1DVX_2X_3X_4FX_5X_6X_7EWX_8$ (SEQ ID NO: 59349), wherein $X_1$ is A, E, G, K, or R, $X_2$ is A, S, or T, $X_3$ is I or V, $X_4$ is D, E, N, or Y, $X_5$ is S or T, $X_6$ is E, L, P, Q, R, or W, $X_7$ is D or E, and $X_8$ is A, E, G, Q, or R, and the KRAB domain comprises a sequence selected from the group consisting of SEQ ID NOS: 57746-59342. In other embodiments, the dXR fusion proteins of the systems comprise a single KRAB domain operably linked to the dCasX wherein the KRAB domain comprises a first domain comprising the sequence $LYX_1X_2VMX_3EX_4X_5X_6X_7X_8X_9X_{10}$ (SEQ ID NO: 59348), wherein $X_1$ is K or R, $X_2$ is D or E, $X_3$ is L, Q, or R, $X_4$ is N or T, $X_5$ is F or Y, $X_6$ is A, E, G, Q, R, or S, $X_7$ is H, L, or N, $X_8$ is L or V, $X_9$ is A, G, I, L, T, or V, and $X_{10}$ is A, F, or S, and a second sequence motif comprises the sequence $FX_1DVX_2X_3X_4FX_5X_6X_7EWX_8$ (SEQ ID NO: 59349), wherein $X_1$ is A, E, G, K, or R, $X_2$ is A, S, or T, $X_3$ is I or V, $X_4$ is D, E, N, or Y, $X_5$ is S or T, $X_6$ is E, L, P, Q, R, or W, $X_7$ is D or E, and $X_8$ is A, E, G, Q, or R, and the KRAB domain comprises a sequence selected from the group consisting of SEQ ID NOS: 57746-57840. In still other embodiments, the dXR fusion proteins of the systems comprise a single KRAB domain operably linked to the dCasX wherein the KRAB domain comprises a first domain comprising the sequence $LYX_1X_2VMX_3EX_4X_5X_6X_7X_8X_9X_{10}$ (SEQ ID NO: 59348), wherein $X_1$ is K or R, $X_2$ is D or E, $X_3$ is L, Q, or R, $X_4$ is N or T, $X_5$ is F or Y, $X_6$ is A, E, G, Q, R, or S, $X_7$ is H, L, or N, $X_8$ is L or V, $X_9$ is A, G, I, L, T, or V, and $X_{10}$ is A, F, or S, and a second sequence motif comprises the sequence $FX_1DVX_2X_3X_4FX_5X_6X_7EWX_8$ (SEQ ID NO: 59349), wherein $X_1$ is A, E, G, K, or R, $X_2$ is A, S, or T, $X_3$ is I or V, $X_4$ is D, E, N, or Y, $X_5$ is S or T, $X_6$ is E, L, P, Q, R, or W, $X_7$ is D or E, and $X_8$ is A, E, G, Q, or R, and the KRAB domain comprises a sequence selected from the group consisting of SEQ ID NOS: 57746-57755. In a particular embodiment, the dXR fusion protein comprises a sequence selected from the group consisting of SEQ ID NOS: 59508-59567 and 59673-60012. In the foregoing embodiments of the paragraph, the dXR fusion proteins is capable of repressing expression of a reporter gene to a greater extent than a comparable fusion protein comprising a ZNF10 KRAB domain (SEQ ID NO: 59626) when assayed in an in vitro cellular assay, together with a gRNA targeting the reporter gene. In some embodiments, the reporter gene is a B2M locus of a eukaryotic cell such as, but not limited to, an HEK293 cell. In some embodiments, expression of reporter gene is repressed in the in vitro assay by at least about 75%, at least about 80%, at least about 85%, or at least about 90% at day 7 of the assay. Exemplary methods of measuring repression of a reporter gene are provided in the examples, for example, in Example 4.

In some embodiments, the dXR fusion protein is capable of forming a ribonuclear protein complex (RNP) with the gRNA and, upon binding to the target nucleic acid of the cell in a cellular assay, the dXR:gRNA system is capable of repressing transcription of a gene encoded by the target nucleic acid by at least about 10%, at least about 20%, at least about 30%, at least about 40%, at least about 50%, at least about 60%, at least about 70%, at least about 75%, at least about 80%, at least about 85%, at least about 90%, at least about 95%, or at least 99%. In some embodiments, the dXR fusion protein is capable of forming a ribonuclear protein complex (RNP) with the gRNA and, upon binding to the target nucleic acid of the cell in a cellular assay, the system is capable of repressing transcription of a gene encoded by the target nucleic acid, wherein the repression of transcription of the gene is sustained for at least about 8 hours, at least about 1 day, at least about 7 days, at least about 2 weeks, at least about 3 weeks, at least about 1 month, or at least about 2 months.

In some embodiments, the present disclosure provides systems comprising a first and a second repressor domain linked to a catalytically-dead CRISPR protein as a fusion protein, and one or more gRNA comprising a targeting sequence complementary to a target nucleic acid sequence of a gene targeted for silencing, wherein the system is capable of binding the target nucleic acid in a manner that leads to long-term epigenetic modification of the gene so that repression persists even after the system is no longer present on the target nucleic acid. In some embodiments, the first and the second repressor domains are operably linked as a fusion protein, such as to a dCasX of the embodiments described herein. As used herein "epigenetic modification" means a modification to either DNA or histones associated with DNA, wherein the modification is either a direct modification by a component of the system or is indirect by the recruitment of one or more additional cellular components, but in which the DNA target nucleic acid sequence itself is not edited. For example, DNMT3A (or its catalytic domain) directly modifies the DNA by methylating it, whereas KRAB recruits KAP-1/TIF1β corepressor complexes that act as potent transcriptional repressors and can further recruit factors associated with DNA methylation and formation of repressive chromatin, such as heterochromatin protein 1 (HP1), histone deacetylases and histone methyltransferases (Ying, Y., et al. The Krüppel-associated box repressor domain induces reversible and irreversible regulation of endogenous mouse genes by mediating different chromatin states. Nucleic Acids Res. 43(3): 1549 (2015)). Together, the first and second repressor components of the systems work in synchrony to result in an additive or synergistic effect on transcriptional silencing of the targeted gene. In some embodiments, the present disclosure provides systems comprising a first and a second repressor domain operably linked to a dCasX, the first repressor is a KRAB domain of any of the foregoing embodiments, and the second repressor is selected from the group consisting of DNMT3A, DNMT3L, DNMT3B, DNMT1, FOG, SID4X, SID, NcoR, NuE, histone H3 lysine 9 methyltransferase G9a (G9a), methyl-CpG (mCpG) binding domain 2 (meCP2), Switch independent 3 transcription regulator family member A (SIN3A), histone deacetylase HDT1 (HDT1), n-terminal truncation of methyl-CpG-binding domain containing protein 2 (MBD2B), nuclear inhibitor of protein phosphatase-1 (NIPP1), GLP, heterochromatin protein 1 (HP1A), mixed lineage leukemia protein-5 (MLL5), histone-lysine N-methyltransferase SETDB1 (SETB1), Suppressor Of Variegation 3-9 Homolog 1 (SUV39H1), SUV39H2, euchromatic histone lysine methyltransferase 1 (EHMT1), histone-lysine N-methyltransferase EZH1 (EZH1), EZH2, nuclear receptor binding SET domain protein 1 (NSD1), NSD2, NSD3, ASH1 like histone lysine methyltransferase (ASH1L), tripartite motif containing 28 (TRIM28), Methyltransferase Like 3 (METTL3), METTL4, family with sequence similarity 208 member A (FAM208A), M-Phase Phosphoprotein 8 (MPHOSPH8), SET domain containing 2 (SETD2), histone deacetylase 1 (HDAC1), HDAC2, HDAC3, Periphilin 1 (PPHLN1), and subdomains thereof (e.g., the DNMT3A catalytic domain and the ATRX-DNMT3-DNMT3L (ADD) domain are subdomains of DNMT3A, and the DNMT3L interaction domain is a subdomain of DNMT3L).

In some embodiments, the present disclosure provides dXR:gRNA systems comprising a first and a second repressor domain operably linked to a dCasX. In some embodiments, the disclosure provides a dXR fusion protein comprising a dCasX selected from the group of sequences of SEQ ID NOS: 17-36 and 59353-59358 as set forth in Table 4, or a sequence variant having at least about 70%, at least about 80%, at least about 85%, at least about 90% at least about 91%, at least about 92%, at least about 93% at least about 94% at least about 95%, at least about 96%, at least about 97%, at least about 98%, or at least about 99% identity thereto, wherein the first repressor is a KRAB domain selected from the group of sequences consisting of SEQ ID NOS: 889-2100 and 2332-33239, or a sequence having at least about 70%, at least about 80%, at least about 85%, at least about 90% at least about 91%, at least about 92%, at least about 93% at least about 94% at least about 95%, at least about 96%, at least about 97%, at least about 98%, or at least about 99% identity thereto, and wherein the second repressor is a DNMT3A domain that lacks a regulatory subdomain and only maintains a catalytic domain selected from the group consisting of SEQ ID NOS: 33625-57543 and 59450, wherein the transcriptional repressor domains are linked by linker peptide sequences to the catalytically-dead CasX protein or to the other repressor domain. In some embodiments, the dXR comprising a DNMT3A catalytic domain effects methylation exclusively at CpG sequences. In a particular embodiment, the present disclosure provides systems comprising a first and a second repressor domain operably linked to a dCasX comprising the sequence of SEQ ID NO: 18, or a sequence having at least about 65%, at least about 70%, at least about 75%, at least about 80%, at least about 85%, at least about 90% at least about 91%, at least about 92%, at least about 93% at least about 94% at least about 95%, at least about 96%, at least about 97%, at least about 98%, or at least about 99% identity thereto, wherein the first repressor is a KRAB domain selected from the group of sequences consisting of SEQ ID NOS: 57746-59342, or is selected from the group consisting of SEQ ID NOS: 57746-57840, or is selected from the group consisting of SEQ ID NOS: 57746-57755, or a sequence having at least about 70%, at least about 80%, at least about 85%, at least about 90% at least about 91%, at least about 92%, at least about 93% at least about 94% at least about 95%, at least about 96%, at least about 97%, at least about 98%, or at least about 99% identity thereto, and the second repressor domain is a DNMT3A catalytic domain selected from the group consisting of SEQ ID NOS: 33625-57543 and 59450, or a sequence having at least about 70%, at least about 80%, at least about 85%, at least about 90% at least about 91%, at least about 92%, at least about 93% at least about 94% at least about 95%, at least about 96%, at least about 97%, at least about 98%, or at least about 99% identity thereto, wherein the transcriptional repressor domains are linked by linker peptide sequences to the catalytically-dead CasX protein or to the other repressor domain. In a particular embodiment, the present disclosure provides systems comprising a first and a second repressor domain operably linked to a dCasX comprising the sequence of SEQ ID NO: 18, wherein the first repressor is a KRAB domain selected from the group of sequences consisting of SEQ ID NOS: 57746-59342, or is selected from the group consisting of SEQ ID NOS: 57746-57840, and the second repressor domain is a DNMT3A catalytic domain selected from the group consisting of SEQ ID NOS: 33625-57543 and 59450, wherein the transcriptional repressor domains are linked by linker peptide sequences to the catalytically-dead CasX protein or to the other repressor domain. In the foregoing embodiments, wherein the fusion protein comprises KRAB and the second transcriptional repressor domain comprises a DNMT3A catalytic domain, upon binding of the RNP of the fusion protein and the gRNA to the target nucleic acid, the system is capable of recruiting one or more of the additional repressor domains of the cell, including the repressor domains listed herein, in order to affect repression of transcription of a gene encoded by the target nucleic acid, such that upon binding of an RNP of the fusion protein and the gRNA to the target nucleic acid, transcription of the gene in the cells is repressed by at least about 10%, at least about 20%, at least about 30%, at least about 40%, at least about 50%, at least about 60%, at least about 70%, at least about 75%, at least about 80%, at least about 85%, at least about 90%, at least about 95%, or at least 99%, or any percentage there between, when assayed in an in vitro assay, including cell-based assays. Most preferably, the epigenetic modification results in complete silencing of gene expression, such that no gene product is detectable. In some embodiments, the repression of transcription by the systems of the embodiments is sustained for at least about 1 day, at least about 1 week, at least about 2 weeks, at least about 3 weeks, at least about 1 month, or at least about 3 months, or at least about 6 months when assessed in an in vitro assay. In some embodiments, the repression of transcription by the systems of the embodiments is sustained for at least about 1 day, at least about 1 week, at least about 2 weeks, at least about 3 weeks, at least about 1 month, or at least about 3 months, at least about 6 months, or at least about 1 year when assessed in a subject that has been administered a therapeutically-effective dose of a system of the embodiments described herein. In some embodiments, use of the system results in no or minimal detectable off-target methylation or off-target activity, when assessed in an in vitro assay. In some embodiments, use of the system results in off-target methylation or off-target activity that is less than about 10%, less than about 9%, less than about 8%, less than about 7%, less than about 6%, less than about 5%, less than about 4%, less than about 3%, less than about 2%, or less than about 1% in the cells. In other embodiments, use of the system results in no or minimal detectable off-target methylation or off-target activity, when assessed in a subject that has been administered a therapeutically-effective dose of a system of the embodiments described herein.

In other embodiments, the disclosure provides gene repressor systems wherein the fusion protein comprises a first, a second, and a third transcriptional repressor domain, wherein the third transcriptional repressor domain is different from the first and the second transcriptional repressor domains. In some embodiments, the present disclosure provides dXR:gRNA systems wherein the dXR comprises a KRAB domain of any of the embodiments described herein as the first repressor domain, a DNMT3A catalytic domain as the second repressor domain and a DNMT3L domain as the third repressor domain. It has been discovered that such dXR fusion proteins, when used in the dXR:gRNA systems, result in epigenetic long-term repression of transcription of target nucleic acid (and such fusion proteins are alternatively referred to herein as "ELXR"). In the foregoing, the DNMT3L helps maintains the methylation pattern after DNA replication. In an exemplary embodiment of the foregoing, the catalytically-dead Class 2 protein is a class 2 Type V CRISPR protein, for example a dCasX selected from the group of sequences of SEQ ID NOS: 17-36 and 59353-59358 as set forth in Table 4 or a sequence variant having at least about 70%, at least about 80%, at least about 85%, at least about 90% at least about 91%, at least about 92%, at least about 93% at least about 94% at least about 95%, at least about 96%, at least about 97%, at least about 98%, or at least about 99% identity thereto, the first repressor domain is a KRAB repressor domain selected from the group of sequences of SEQ ID NOS: 889-2100 and 2332-33239, or sequence variants having at least about 70%, at least about 80%, at least about 85%, at least about 90% at least about 91%, at least about 92%, at least about 93% at least about 94% at least about 95%, at least about 96%, at least about 97%, at least about 98%, or at least about 99% identity thereto, the second repressor domain is a DNMT3A catalytic domain of DNMT3A, or a sequence variant thereof, including the sequences of SEQ ID NOS: 33625-57543 and 59450, or sequence variants having at least about 70%, at least about 80%, at least about 85%, at least about 90% at least about 91%, at least about 92%, at least about 93% at least about 94% at least about 95%, at least about 96%, at least about 97%, at least about 98%, or at least about 99% identity thereto, and the third repressor domain is a DNMT3L interaction domain is the sequence of SEQ ID NO: 59625, or a sequence variant having at least about 70%, at least about 80%, at least about 85%, at least about 90% at least about 91%, at least about 92%, at least about 93% at least about 94% at least about 95%, at least about 96%, at least about 97%, at least about 98%, or at least about 99% identity thereto, wherein the fusion protein comprises one or more linker peptides described herein, and wherein the fusion protein is capable of forming an RNP with a gRNA of the system that binds to the target nucleic acid. In a particular embodiment, the present disclosure provides systems comprising a first, a second, and a third repressor domain operably linked to a dCasX comprising the sequence of SEQ ID NO: 18, or a sequence having at least about 65%, at least about 70%, at least about 75%, at least about 80%, at least about 85%, at least about 90% at least about 91%, at least about 92%, at least about 93% at least about 94% at least about 95%, at least about 96%, at least about 97%, at least about 98%, or at least about 99% identity thereto, wherein the first domain comprises a KRAB domain comprising one or more motifs selected from the group consisting of a) $PX_1X_2X_3X_4X_5X_6EX_7$, wherein $X_1$ is A, D, E, or N, $X_2$ is L or V, $X_3$ is I or V, $X_4$ is S, T, or F, $X_5$ is H, K, L, Q, R or W, $X_6$ is L or M, and $X_7$ is G, K, Q, or R; b) $X_1X_2X_3X_4GX_5X_6X_7X_8X_9$, wherein $X_1$ is L or V, $X_2$ is A, G, L, T or V, $X_3$ is A, F, or S, $X_4$ is L or V, $X_5$ is C, F, H, I, L or Y, $X_6$ is A, C, P, Q, or S, $X_7$ is A, F, G, I, S, or V, $X_8$ is A, P, S, or T, and $X_9$ is K or R; c) $QX_1X_2LYRX_3VMX_4$ (SEQ ID NO: 59345), wherein $X_1$ is K or R, $X_2$ is A, D, E, G, N, S, or T, $X_3$ is D, E, or S, and $X_4$ is L or R; d) $X_1X_2X_3FX_4DVX_5X_6X_7FX_8X_9X_{10}X_{11}$ (SEQ ID NO: 59346), wherein $X_1$ is A, L, P, or S, $X_2$ is L or V, $X_3$ is S or T, $X_4$ is A, E, G, K, or R, $X_5$ is A or T, $X_6$ is I or V, $X_7$ is D, E, N, or Y, $X_8$ is S or T, $X_9$ is E, P, Q, R, or W, $X_{10}$ is E or N, and $X_{11}$ is E or Q; e) $X_1X_2X_3PX_4X_5X_6X_7X_8X_9X_{10}$, wherein $X_1$ is E, G, or R, $X_2$ is E or K, $X_3$ is A, D, or E, $X_4$ is C or W, $X_5$ is I, K, L, M, T, or V, $X_6$ is I, L, P, or V, $X_7$ is D, E, K, or V, $X_8$ is E, G, K, P, or R, $X_9$ is A, D, R, G, K, Q, or V, and $X_{10}$ is D, E, G, I, L, R, S, or V; f) $LYX_1X_2VMX_3EX_4X_5X_6X_7X_8X_9X_{10}$ (SEQ ID NO: 59348), wherein $X_1$ is K or R, $X_2$ is D or E, $X_3$ is L, Q, or R, $X_4$ is N or T, $X_5$ is F or Y, $X_6$ is A, E, G, Q, R, or S, $X_7$ is H, L, or N, $X_8$ is L or V, $X_9$ is A, G, I, L, T, or V, and $X_{10}$ is A, F, or S; g) $FX_1DVX_2X_3X_4FX_5X_6X_7EWX_8$ (SEQ ID NO: 59349), wherein $X_1$ is A, E, G, K, or R, $X_2$ is A, S, or T, $X_3$ is I or V, $X_4$ is D, E, N, or Y, $X_5$ is S or T, $X_6$ is E, L, P, Q, R, or W, $X_7$ is D or E, and $X_8$ is A, E, G, Q, or R; h) $X_1PX_2X_3X_4X_5$ $X_6LEX_7X_8X_9X_{10}X_{11}X_{12}$, wherein $X_1$ is K or R, $X_2$ is A, D, E, or N, $X_3$ is I, L, M, or V, $X_4$ is I or V, $X_5$ is F, S, or T, $X_6$ is H, K, L, Q, R, or W, $X_7$ is K, Q, or R, $X_8$ is E, G, or R, $X_9$ is D, E, or K, $X_{10}$ is A, D, or E, $X_{11}$ is L or P, and $X_{12}$ is C or W; or i) $X_1LX_2X_3X_4QX_5X_6$, wherein $X_1$ is C, H, L, Q, or W, $X_2$ is D, G, N, R, or S, $X_3$ is L, P, S, or T, $X_4$ is A, S, or T, $X_5$ is K or R, and $X_6$ is A, D, E, K, N, S, or T, and the KRAB domain comprises a sequence selected from the group consisting of SEQ ID NOS: 57746-59342, or a sequence having at least about 70%, at least about 80%, at least about 85%, at least about 90% at least about 91%, at least about 92%, at least about 93% at least about 94% at least about 95%, at least about 96%, at least about 97%, at least about 98%, or at least about 99% identity thereto, the second repressor domain is a DNMT3A catalytic domain comprising a sequence selected from the group consisting of SEQ ID NOS: 33625-57543 and 59450, or sequence variants having at least about 70%, at least about 80%, at least about 85%, at least about 90% at least about 91%, at least about 92%, at least about 93% at least about 94% at least about 95%, at least about 96%, at least about 97%, at least about 98%, or at least about 99% identity thereto, and the third repressor is a DNMT3L interaction domain comprising the sequence of SEQ ID NO: 59625, or sequence variants having at least about 70%, at least about 80%, at least about 85%, at least about 90% at least about 91%, at least about 92%, at least about 93% at least about 94% at least about 95%, at least about 96%, at least about 97%, at least about 98%, or at least about 99% identity thereto, and wherein the fusion protein comprises one or more linker peptides described herein, and wherein the fusion protein is capable of forming an RNP with a gRNA of the system that binds to the target nucleic acid. In a particular embodiment, the present disclosure provides systems comprising a first, a second, and a third repressor domain operably linked to a dCasX comprising the sequence of SEQ ID NO: 18, or a sequence having at least about 65%, at least about 70%, at least about 75%, at least about 80%, at least about 85%, at least about 90% at least about 91%, at least about 92%, at least about 93% at least about 94% at least about 95%, at least about 96%, at least about 97%, at least about 98%, or at least about 99% identity thereto, wherein the first domain comprises a KRAB domain comprising one or more motifs selected from the group consisting of a) $PX_1X_2X_3X_4X_5X_6EX_7$, wherein $X_1$ is A, D, E, or N, $X_2$ is L or V, $X_3$ is I or V, $X_4$ is S, T, or F, $X_5$ is H, K, L, Q, R or W, $X_6$ is L or M, and $X_7$ is G, K, Q, or R; b) $X_1X_2X_3X_4GX_5X_6X_7X_8X_9$, wherein $X_1$ is L or V, $X_2$ is A, G, L, T or V, $X_3$ is A, F, or S, $X_4$ is L or V, $X_5$ is C, F, H, I, L or Y, $X_6$ is A, C, P, Q, or S, $X_7$ is A, F, G, I, S, or V, $X_8$ is A, P, S, or T, and $X_9$ is K or R; c) $QX_1X_2LYRX_3VMX_4$(SEQ ID NO: 59345), wherein $X_1$ is K or R, $X_2$ is A, D, E, G, N, S, or T, $X_3$ is D, E, or S, and $X_4$ is L or R; d) $X_1X_2X_3FX_4DVX_5X_6X_7FX_8X_9X_{10}X_{11}$ (SEQ ID NO: 59346), wherein $X_1$ is A, L, P, or S, $X_2$ is L or V, $X_3$ is S or T, $X_4$ is A, E, G, K, or R, $X_5$ is A or T, $X_6$ is I or V, $X_7$ is D, E, N, or Y, $X_8$ is S or T, $X_9$ is E, P, Q, R, or W, $X_{10}$ is E or N, and $X_{11}$ is E or Q; e) $X_1X_2X_3PX_4X_5X_6X_7X_8X_9X_{10}$, wherein $X_1$ is E, G, or R, $X_2$ is E or K, $X_3$ is A, D, or E, $X_4$ is C or W, $X_5$ is I, K, L, M, T, or V, $X_6$ is I, L, P, or V, $X_7$ is D, E, K, or V, $X_8$ is E, G, K, P, or R, $X_9$ is A, D, R, G, K, Q, or V, and $X_{10}$ is D, E, G, I, L, R, S, or V; f) $LYX_1X_2VMX_3EX_4X_5X_6X_7X_8X_9X_{10}$ (SEQ ID NO: 59348), wherein $X_1$ is K or R, $X_2$ is D or E, $X_3$ is L, Q, or R, $X_4$ is N or T, $X_5$ is F or Y, $X_6$ is A, E, G, Q, R, or S, $X_7$ is H, L, or N, $X_8$ is L or V, $X_9$ is A, G, I, L, T, or V, and $X_{10}$ is A, F, or S; g) $FX_1DVX_2X_3X_4FX_5X_6X_7EWX_8$ (SEQ ID NO: 59349), wherein $X_1$ is A, E, G, K, or R, $X_2$ is A, S, or T, $X_3$ is I or V, $X_4$ is D, E, N, or Y, $X_5$ is S or T, $X_6$ is E, L, P, Q, R, or W, $X_7$ is D or E, and $X_8$ is A, E, G, Q, or R; h) $X_1PX_2X_3X_4X_5$ $X_6LEX_7X_8X_9X_{10}X_{11}X_{12}$, wherein $X_1$ is K or R, $X_2$ is A, D, E, or N, $X_3$ is I, L, M, or V, $X_4$ is I or V, $X_5$ is F, S, or T, $X_6$ is H, K, L, Q, R, or W, $X_7$ is K, Q, or R, $X_8$ is E, G, or R, $X_9$ is D, E, or K, $X_{10}$ is A, D, or E, $X_{11}$ is L or P, and $X_{12}$ is C or W; or i) $X_1LX_2X_3X_4QX_5X_6$, wherein $X_1$ is C, H, L, Q, or W, $X_2$ is D, G, N, R, or S, $X_3$ is L, P, S, or T, $X_4$ is A, S, or T, $X_5$ is K or R, and $X_6$ is A, D, E, K, N, S, or T, and the KRAB domain comprises a sequence selected from the group consisting of SEQ ID NOS: 57746-57840, or a sequence having at least about 70%, at least about 80%, at least about 85%, at least about 90% at least about 91%, at least about 92%, at least about 93% at least about 94% at least about 95%, at least about 96%, at least about 97%, at least about 98%, or at least about 99% identity thereto, and the second repressor domain is a DNMT3A catalytic domain comprising a sequence selected from the group consisting of SEQ ID NOS: 33625-57543 and 59450, or sequence variants having at least about 70%, at least about 80%, at least about 85%, at least about 90% at least about 91%, at least about 92%, at least about 93% at least about 94% at least about 95%, at least about 96%, at least about 97%, at least about 98%, or at least about 99% identity thereto, and the third repressor is a DNMT3L interaction domain comprising the sequence of SEQ ID NO: 59625, or a sequence having at least about 70%, at least about 80%, at least about 85%, at least about 90% at least about 91%, at least about 92%, at least about 93% at least about 94% at least about 95%, at least about 96%, at least about 97%, at least about 98%, or at least about 99% identity thereto, wherein the fusion protein comprises one or more linker peptides described herein, and wherein the fusion protein is capable of forming an RNP with a gRNA of the system that binds to the target nucleic acid. In a particular embodiment, the present disclosure provides systems comprising a first, a second, and a third repressor domain operably linked to a dCasX comprising the sequence of SEQ ID NO: 18, or a sequence having at least about 70%, at least about 80%, at least about 85%, at least about 90% at least about 91%, at least about 92%, at least about 93% at least about 94% at least about 95%, at least about 96%, at least about 97%, at least about 98%, or at least about 99% identity thereto, wherein the KRAB domain comprises one or more motifs selected from the group consisting of a) $PX_1X_2X_3X_4X_5X_6EX_7$, wherein $X_1$ is A, D, E, or N, $X_2$ is L or V, $X_3$ is I or V, $X_4$ is S, T, or F, $X_5$ is H, K, L, Q, R or W, $X_6$ is L or M, and $X_7$ is G, K, Q, or R; b) $X_1X_2X_3X_4GX_5X_6X_7X_8X_9$, wherein $X_1$ is L or V, $X_2$ is A, G, L, T or V, $X_3$ is A, F, or S, $X_4$ is L or V, $X_5$ is C, F, H, I, L or Y, $X_6$ is A, C, P, Q, or S, $X_7$ is A, F, G, I, S, or V, $X_8$ is A, P, S, or T, and $X_9$ is K or R; c) $QX_1X_2LYRX_3VMX_4$ (SEQ ID NO: 59345), wherein $X_1$ is K or R, $X_2$ is A, D, E, G, N, S, or T, $X_3$ is D, E, or S, and $X_4$ is L or R; d) $X_1X_2X_3FX_4DVX_5X_6X_7FX_8X_9X_{10}X_1$ (SEQ ID NO: 59346), wherein $X_1$ is A, L, P, or S, $X_2$ is L or V, $X_3$ is S or T, $X_4$ is A, E, G, K, or R, $X_5$ is A or T, $X_6$ is I or V, $X_7$ is D, E, N, or Y, $X_8$ is S or T, $X_9$ is E, P, Q, R, or W, $X_{10}$ is E or N, and $X_{11}$ is E or Q; e) $X_1X_2X_3PX_4X_5X_6X_7X_8X_9X_{10}$, wherein $X_1$ is E, G, or R, $X_2$ is E or K, $X_3$ is A, D, or E, $X_4$ is C or W, $X_5$ is I, K, L, M, T, or V, $X_6$ is I, L, P, or V, $X_7$ is D, E, K, or V, $X_8$ is E, G, K, P, or R, $X_9$ is A, D, R, G, K, Q, or V, and $X_{10}$ is D, E, G, I, L, R, S, or V; f) $LYX_1X_2VMX_3EX_4X_5X_6X_7X_8X_9X_{10}$ (SEQ ID NO: 59348), wherein $X_1$ is K or R, $X_2$ is D or E, $X_3$ is L, Q, or R, $X_4$ is N or T, $X_5$ is F or Y, $X_6$ is A, E, G, Q, R, or S, $X_7$ is H, L, or N, $X_8$ is L or V, $X_9$ is A, G, I, L, T, or V, and $X_{10}$ is A, F, or S; g) $FX_1DVX_2X_3X_4FX_5X_6X_7EWX_8$ (SEQ ID NO: 59349), wherein $X_1$ is A, E, G, K, or R, $X_2$ is A, S, or T, $X_3$ is I or V, $X_4$ is D, E, N, or Y, $X_5$ is S or T, $X_6$ is E, L, P, Q, R, or W, $X_7$ is D or E, and $X_8$ is A, E, G, Q, or R; h) $X_1PX_2X_3X_4X_5$ $X_6LEX_7X_8X_9X_{10}X_{11}X_{12}$, wherein $X_1$ is K or R, $X_2$ is A, D, E, or N, $X_3$ is I, L, M, or V, $X_4$ is I or V, $X_5$ is F, S, or T, $X_6$ is H, K, L, Q, R, or W, $X_7$ is K, Q, or R, $X_8$ is E, G, or R, $X_9$ is D, E, or K, $X_{10}$ is A, D, or E, $X_{11}$ is L or P, and $X_{12}$ is C or W; or i) $X_1LX_2X_3X_4QX_5X_6$, wherein $X_1$ is C, H, L, Q, or W, $X_2$ is D, G, N, R, or S, $X_3$ is L, P, S, or T, $X_4$ is A, S, or T, $X_5$ is K or R, and $X_6$ is A, D, E, K, N, S, or T, and the KRAB domain comprises a sequence selected from the group consisting of SEQ ID NOS: 57746-57755, or a sequence having at least about 70%, at least about 80%, at least about 85%, at least about 90% at least about 91%, at least about 92%, at least about 93% at least about 94% at least about 95%, at least about 96%, at least about 97%, at least about 98%, or at least about 99% identity thereto, and the second repressor domain is a DNMT3A catalytic domain comprising a sequence selected from the group consisting of SEQ ID NOS: 33625-57543 and 59450, or a sequence having at least about 70%, at least about 80%, at least about 85%, at least about 90% at least about 91%, at least about 92%, at least about 93% at least about 94% at least about 95%, at least about 96%, at least about 97%, at least about 98%, or at least about 99% identity thereto, and the third repressor is a DNMT3L interaction domain comprising the sequence of SEQ ID NO: 59625, or a sequence having at least about 70%, at least about 80%, at least about 85%, at least about 90% at least about 91%, at least about 92%, at least about 93% at least about 94% at least about 95%, at least about 96%, at least about 97%, at least about 98%, or at least about 99% identity thereto, and wherein the fusion protein comprises one or more linker peptides described herein, and wherein the fusion protein is capable of forming an RNP with a gRNA of the system that binds to the target nucleic acid. In another particular embodiment, the present disclosure provides systems comprising a first, a second, and a third repressor domain operably linked to a dCasX comprising the sequence of SEQ ID NO: 25, or a sequence having at least about 70%, at least about 80%, at least about 85%, at least about 90% at least about 91%, at least about 92%, at least about 93% at least about 94% at least about 95%, at least about 96%, at least about 97%, at least about 98%, or at least about 99% identity thereto, wherein the KRAB domain comprises one or more motifs selected from the group consisting of a) $PX_1X_2X_3X_4X_5X_6EX_7$, wherein $X_1$ is A, D, E, or N, $X_2$ is L or V, $X_3$ is I or V, $X_4$ is S, T, or F, $X_5$ is H, K, L, Q, R or W, $X_6$ is L or M, and $X_7$ is G, K, Q, or R; b) $X_1X_2X_3X_4GX_5X_6X_7X_8X_9$, wherein $X_1$ is L or V, $X_2$ is A, G, L, T or V, $X_3$ is A, F, or S, $X_4$ is L or V, $X_5$ is C, F, H, I, L or Y, $X_6$ is A, C, P, Q, or S, $X_7$ is A, F, G, I, S, or V, $X_8$ is A, P, S, or T, and $X_9$ is K or R; c) $QX_1X_2LYRX_3VMX_4$ (SEQ ID NO: 59345), wherein $X_1$ is K or R, $X_2$ is A, D, E, G, N, S, or T, $X_3$ is D, E, or S, and $X_4$ is L or R; d) $X_1X_2X_3FX_4DVX_5X_6X_7FX_8X_9X_{10}X_1$ (SEQ ID NO: 59346), wherein $X_1$ is A, L, P, or S, $X_2$ is L or V, $X_3$ is S or T, $X_4$ is A, E, G, K, or R, $X_5$ is A or T, $X_6$ is I or V, $X_7$ is D, E, N, or Y, $X_8$ is S or T, $X_9$ is E, P, Q, R, or W, $X_{10}$ is E or N, and $X_{11}$ is E or Q; e) $X_1X_2X_3PX_4X_5X_6X_7X_8X_9X_{10}$, wherein $X_1$ is E, G, or R, $X_2$ is E or K, $X_3$ is A, D, or E, $X_4$ is C or W, $X_5$ is I, K, L, M, T, or V, $X_6$ is I, L, P, or V, $X_7$ is D, E, K, or V, $X_8$ is E, G, K, P, or R, $X_9$ is A, D, R, G, K, Q, or V, and $X_{10}$ is D, E, G, I, L, R, S, or V; f) $LYX_1X_2VMX_3EX_4X_5X_6X_7X_8X_9X_{10}$ (SEQ ID NO: 59348), wherein $X_1$ is K or R, $X_2$ is D or E, $X_3$ is L, Q, or R, $X_4$ is N or T, $X_5$ is F or Y, $X_6$ is A, E, G, Q, R, or S, $X_7$ is H, L, or N, $X_8$ is L or V, $X_9$ is A, G, I, L, T, or V, and $X_{10}$ is A, F, or S; g) $FX_1DVX_2X_3X_4FX_5X_6X_7EWX_8$ (SEQ ID NO: 59349), wherein $X_1$ is A, E, G, K, or R, $X_2$ is A, S, or T, $X_3$ is I or V, $X_4$ is D, E, N, or Y, $X_5$ is S or T, $X_6$ is E, L, P, Q, R, or W, $X_7$ is D or E, and $X_8$ is A, E, G, Q, or R; h) $X_1PX_2X_3X_4X_5$ $X_6LEX_7X_8X_9X_{10}X_{11}X_{12}$, wherein $X_1$ is K or R, $X_2$ is A, D, E, or N, $X_3$ is I, L, M, or V, $X_4$ is I or V, $X_5$ is F, S, or T, $X_6$ is H, K, L, Q, R, or W, $X_7$ is K, Q, or R, $X_8$ is E, G, or R, $X_9$ is D, E, or K, $X_{10}$ is A, D, or E, $X_{11}$ is L or P, and $X_{12}$ is C or W; or i) $X_1LX_2X_3X_4QX_5X_6$, wherein $X_1$ is C, H, L, Q, or W, $X_2$ is D, G, N, R, or S, $X_3$ is L, P, S, or T, $X_4$ is A, S, or T, $X_5$ is K or R, and $X_6$ is A, D, E, K, N, S, or T, and the KRAB domain comprises a sequence selected from the group consisting of SEQ ID NOS: 57746-57755, or a sequence having at least about 70%, at least about 80%, at least about 85%, at least about 90% at least about 91%, at least about 92%, at least about 93% at least about 94% at least about 95%, at least about 96%, at least about 97%, at least about 98%, or at least about 99% identity thereto, and the second repressor domain is a DNMT3A catalytic domain comprising a sequence selected from the group consisting of SEQ ID NOS: 33625-57543 and 59450, or a sequence having at least about 70%, at least about 80%, at least about 85%, at least about 90% at least about 91%, at least about 92%, at least about 93% at least about 94% at least about 95%, at least about 96%, at least about 97%, at least about 98%, or at least about 99% identity thereto, and the third repressor is a DNMT3L interaction domain comprising the sequence of SEQ ID NO: 59625, or a sequence having at least about 70%, at least about 80%, at least about 85%, at least about 90% at least about 91%, at least about 92%, at least about 93% at least about 94% at least about 95%, at least about 96%, at least about 97%, at least about 98%, or at least about 99% identity thereto, and wherein the fusion protein comprises one or more linker peptides described herein, and wherein the fusion protein is capable of forming an RNP with a gRNA of the system that binds to the target nucleic acid. In another particular embodiment, the present disclosure provides systems comprising a first, a second, and a third repressor domain operably linked to a dCasX comprising the sequence of SEQ ID NO: 59357, or a sequence having at least about 70%, at least about 80%, at least about 85%, at least about 90% at least about 91%, at least about 92%, at least about 93% at least about 94% at least about 95%, at least about 96%, at least about 97%, at least about 98%, or at least about 99% identity thereto, wherein the KRAB domain comprises one or more motifs selected from the group consisting of a) $PX_1X_2X_3X_4X_5X_6EX_7$, wherein $X_1$ is A, D, E, or N, $X_2$ is L or V, $X_3$ is I or V, $X_4$ is S, T, or F, $X_5$ is H, K, L, Q, R or W, $X_6$ is L or M, and $X_7$ is G, K, Q, or R; b) $X_1X_2X_3X_4GX_5X_6X_7X_8X_9$, wherein $X_1$ is L or V, $X_2$ is A, G, L, T or V, $X_3$ is A, F, or S, $X_4$ is L or V, $X_5$ is C, F, H, I, L or Y, $X_6$ is A, C, P, Q, or S, $X_7$ is A, F, G, I, S, or V, $X_8$ is A, P, S, or T, and $X_9$ is K or R; c) $QX_1X_2LYRX_3VMX_4$ (SEQ ID NO: 59345), wherein $X_1$ is K or R, $X_2$ is A, D, E, G, N, S, or T, $X_3$ is D, E, or S, and $X_4$ is L or R; d) $X_1X_2X_3FX_4DVX_5X_6X_7FX_8X_9X_{10}X_{11}$ (SEQ ID NO: 59346), wherein $X_1$ is A, L, P, or S, $X_2$ is L or V, $X_3$ is S or T, $X_4$ is A, E, G, K, or R, $X_5$ is A or T, $X_6$ is I or V, $X_7$ is D, E, N, or Y, $X_8$ is S or T, $X_9$ is E, P, Q, R, or W, $X_{10}$ is E or N, and $X_{11}$ is E or Q; e) $X_1X_2X_3PX_4X_5X_6X_7X_8X_9X_{10}$, wherein $X_1$ is E, G, or R, $X_2$ is E or K, $X_3$ is A, D, or E, $X_4$ is C or W, $X_5$ is I, K, L, M, T, or V, $X_6$ is I, L, P, or V, $X_7$ is D, E, K, or V, $X_8$ is E, G, K, P, or R, $X_9$ is A, D, R, G, K, Q, or V, and $X_{10}$ is D, E, G, I, L, R, S, or V; f) $LYX_1X_2VMX_3EX_4X_5X_6X_7X_8X_9X_{10}$ (SEQ ID NO: 59348), wherein $X_1$ is K or R, $X_2$ is D or E, $X_3$ is L, Q, or R, $X_4$ is N or T, $X_5$ is F or Y, $X_6$ is A, E, G, Q, R, or S, $X_7$ is H, L, or N, $X_8$ is L or V, $X_9$ is A, G, I, L, T, or V, and $X_{10}$ is A, F, or S; g) $FX_1DVX_2X_3X_4FX_5X_6X_7EWX_8$ (SEQ ID NO: 59349), wherein $X_1$ is A, E, G, K, or R, $X_2$ is A, S, or T, $X_3$ is I or V, $X_4$ is D, E, N, or Y, $X_5$ is S or T, $X_6$ is E, L, P, Q, R, or W, $X_7$ is D or E, and $X_8$ is A, E, G, Q, or R; h) $X_1PX_2X_3X_4X_5$ $X_6LEX_7X_8X_9X_{10}X_{11}X_{12}$, wherein $X_1$ is K or R, $X_2$ is A, D, E, or N, $X_3$ is I, L, M, or V, $X_4$ is I or V, $X_5$ is F, S, or T, $X_6$ is H, K, L, Q, R, or W, $X_7$ is K, Q, or R, $X_8$ is E, G, or R, $X_9$ is D, E, or K, $X_{10}$ is A, D, or E, $X_{11}$ is L or P, and $X_{12}$ is C or W; or i) $X_1LX_2X_3X_4QX_5X_6$, wherein $X_1$ is C, H, L, Q, or W, $X_2$ is D, G, N, R, or S, $X_3$ is L, P, S, or T, $X_4$ is A, S, or T, $X_5$ is K or R, and $X_6$ is A, D, E, K, N, S, or T, and the KRAB domain comprises a sequence selected from the group consisting of SEQ ID NOS: 57746-57755, or a sequence having at least about 70%, at least about 80%, at least about 85%, at least about 90% at least about 91%, at least about 92%, at least about 93% at least about 94% at least about 95%, at least about 96%, at least about 97%, at least about 98%, or at least about 99% identity thereto, and the second repressor domain is a DNMT3A catalytic domain comprising a sequence selected from the group consisting of SEQ ID NOS: 33625-57543 and 59450, or a sequence having at least about 70%, at least about 80%, at least about 85%, at least about 90% at least about 91%, at least about 92%, at least about 93% at least about 94% at least about 95%, at least about 96%, at least about 97%, at least about 98%, or at least about 99% identity thereto, and the third repressor is a DNMT3L interaction domain comprising the sequence of SEQ ID NO: 59625, or a sequence having at least about 70%, at least about 80%, at least about 85%, at least about 90% at least about 91%, at least about 92%, at least about 93% at least about 94% at least about 95%, at least about 96%, at least about 97%, at least about 98%, or at least about 99% identity thereto, and wherein the fusion protein comprises one or more linker peptides described herein, and wherein the fusion protein is capable of forming an RNP with a gRNA of the system that binds to the target nucleic acid. In another particular embodiment, the present disclosure provides systems comprising a first, a second, and a third repressor domain operably linked to a dCasX comprising the sequence of SEQ ID NO: 59358, or a sequence having at least about 70%, at least about 80%, at least about 85%, at least about 90% at least about 91%, at least about 92%, at least about 93% at least about 94% at least about 95%, at least about 96%, at least about 97%, at least about 98%, or at least about 99% identity thereto, wherein the KRAB domain comprises one or more motifs selected from the group consisting of a) $PX_1X_2X_3X_4X_5X_6EX_7$, wherein $X_1$ is A, D, E, or N, $X_2$ is L or V, $X_3$ is I or V, $X_4$ is S, T, or F, $X_5$ is H, K, L, Q, R or W, $X_6$ is L or M, and $X_7$ is G, K, Q, or R; b) $X_1X_2X_3X_4GX_5X_6X_7X_8X_9$, wherein $X_1$ is L or V, $X_2$ is A, G, L, T or V, $X_3$ is A, F, or S, $X_4$ is L or V, $X_5$ is C, F, H, I, L or Y, $X_6$ is A, C, P, Q, or S, $X_7$ is A, F, G, I, S, or V, $X_8$ is A, P, S, or T, and $X_9$ is K or R; c) $QX_1X_2LYRX_3VMX_4$ (SEQ ID NO: 59345), wherein $X_1$ is K or R, $X_2$ is A, D, E, G, N, S, or T, $X_3$ is D, E, or S, and $X_4$ is L or R; d) $X_1X_2X_3FX_4DVX_5X_6X_7FX_8X_9X_{10}X_{11}$ (SEQ ID NO: 59346), wherein $X_1$ is A, L, P, or S, $X_2$ is L or V, $X_3$ is S or T, $X_4$ is A, E, G, K, or R, $X_5$ is A or T, $X_6$ is I or V, $X_7$ is D, E, N, or Y, $X_8$ is S or T, $X_9$ is E, P, Q, R, or W, $X_{10}$ is E or N, and $X_{11}$ is E or Q; e) $X_1X_2X_3PX_4X_5X_6X_7X_8X_9X_{10}$, wherein $X_1$ is E, G, or R, $X_2$ is E or K, $X_3$ is A, D, or E, $X_4$ is C or W, $X_5$ is I, K, L, M, T, or V, $X_6$ is I, L, P, or V, $X_7$ is D, E, K, or V, $X_8$ is E, G, K, P, or R, $X_9$ is A, D, R, G, K, Q, or V, and $X_{10}$ is D, E, G, I, L, R, S, or V; f) $LYX_1X_2VMX_3EX_4X_5X_6X_7X_8X_9X_{10}$ (SEQ ID NO: 59348), wherein $X_1$ is K or R, $X_2$ is D or E, $X_3$ is L, Q, or R, $X_4$ is N or T, $X_5$ is F or Y, $X_6$ is A, E, G, Q, R, or S, $X_7$ is H, L, or N, $X_8$ is L or V, $X_9$ is A, G, I, L, T, or V, and $X_{10}$ is A, F, or S; g) $FX_1DVX_2X_3X_4FX_5X_6X_7EWX_8$ (SEQ ID NO: 59349), wherein $X_1$ is A, E, G, K, or R, $X_2$ is A, S, or T, $X_3$ is I or V, $X_4$ is D, E, N, or Y, $X_5$ is S or T, $X_6$ is E, L, P, Q, R, or W, $X_7$ is D or E, and $X_8$ is A, E, G, Q, or R; h)

$X_1PX_2X_3X_4X_5$ $X_6LEX_7X_8X_9X_{10}X_{11}X_{12}$, wherein $X_1$ is K or R, $X_2$ is A, D, E, or N, $X_3$ is I, L, M, or V, $X_4$ is I or V, $X_5$ is F, S, or T, $X_6$ is H, K, L, Q, R, or W, $X_7$ is K, Q, or R, $X_8$ is E, G, or R, $X_9$ is D, E, or K, $X_{10}$ is A, D, or E, $X_{11}$ is L or P, and $X_{12}$ is C or W; or i) $X_1LX_2X_3X_4QX_5X_6$, wherein $X_1$ is C, H, L, Q, or W, $X_2$ is D, G, N, R, or S, $X_3$ is L, P, S, or T, $X_4$ is A, S, or T, $X_5$ is K or R, and $X_6$ is A, D, E, K, N, S, or T, and the KRAB domain comprises a sequence selected from the group consisting of SEQ ID NOS: 57746-57755, or a sequence having at least about 70%, at least about 80%, at least about 85%, at least about 90% at least about 91%, at least about 92%, at least about 93% at least about 94% at least about 95%, at least about 96%, at least about 97%, at least about 98%, or at least about 99% identity thereto, and the second repressor domain is a DNMT3A catalytic domain comprising a sequence selected from the group consisting of SEQ ID NOS: 33625-57543 and 59450, or a sequence having at least about 70%, at least about 80%, at least about 85%, at least about 90% at least about 91%, at least about 92%, at least about 93% at least about 94% at least about 95%, at least about 96%, at least about 97%, at least about 98%, or at least about 99% identity thereto, and the third repressor is a DNMT3L interaction domain comprising the sequence of SEQ ID NO: 59625, or a sequence having at least about 70%, at least about 80%, at least about 85%, at least about 90% at least about 91%, at least about 92%, at least about 93% at least about 94% at least about 95%, at least about 96%, at least about 97%, at least about 98%, or at least about 99% identity thereto, and wherein the fusion protein comprises one or more linker peptides described herein, and wherein the fusion protein is capable of forming an RNP with a gRNA of the system that binds to the target nucleic acid. In some embodiments of the system, the fusion protein components of the system are configured according to a configuration as schematically portrayed in FIG. 7. In some embodiments each of the repressor domains and the dCasX are operably linked, in some cases via a linker, as described herein. In some embodiments, the dXR fusion protein has a configuration of, N-terminal to C-terminal (with reference to the components of Table 45) of configuration 1 (NLS-Linker4-DNMT3A-Linker2-DNMT3L-Linker1-Linker3-dCasX-Linker3-KRAB-NLS), configuration 2 (NLS-Linker3-dCasX-Linker3-KRAB-NLS-Linker1-DNMT3A-Linker2-DNMT3L), configuration 3 (NLS-Linker3-dCasX-Linker1-DNMT3A-Linker2-DNMT3L-Linker3-KRAB-NLS), configuration 4 (NLS-KRAB-Linker3-DNMT3A-Linker2-DNMT3L-Linker1-dCasX-Linker3-NLS), or configuration 5 (NLS-DNMT3A-Linker2-DNMT3L-Linker3-KRAB-Linker1-dCasX-Linker3-NLS). In some embodiments, the dXR fusion protein comprises a sequence selected from the group consisting of SEQ ID NOS: 59508-59517, 59528-59537, 59548-59557, and 59673-59842, or a sequence having or a sequence having at least about 70%, at least about 80%, at least about 85%, at least about 90% at least about 91%, at least about 92%, at least about 93% at least about 94% at least about 95%, at least about 96%, at least about 97%, at least about 98%, or at least about 99% identity thereto, and wherein the fusion protein is in configuration 1, 4 or 5.

Figure 7:
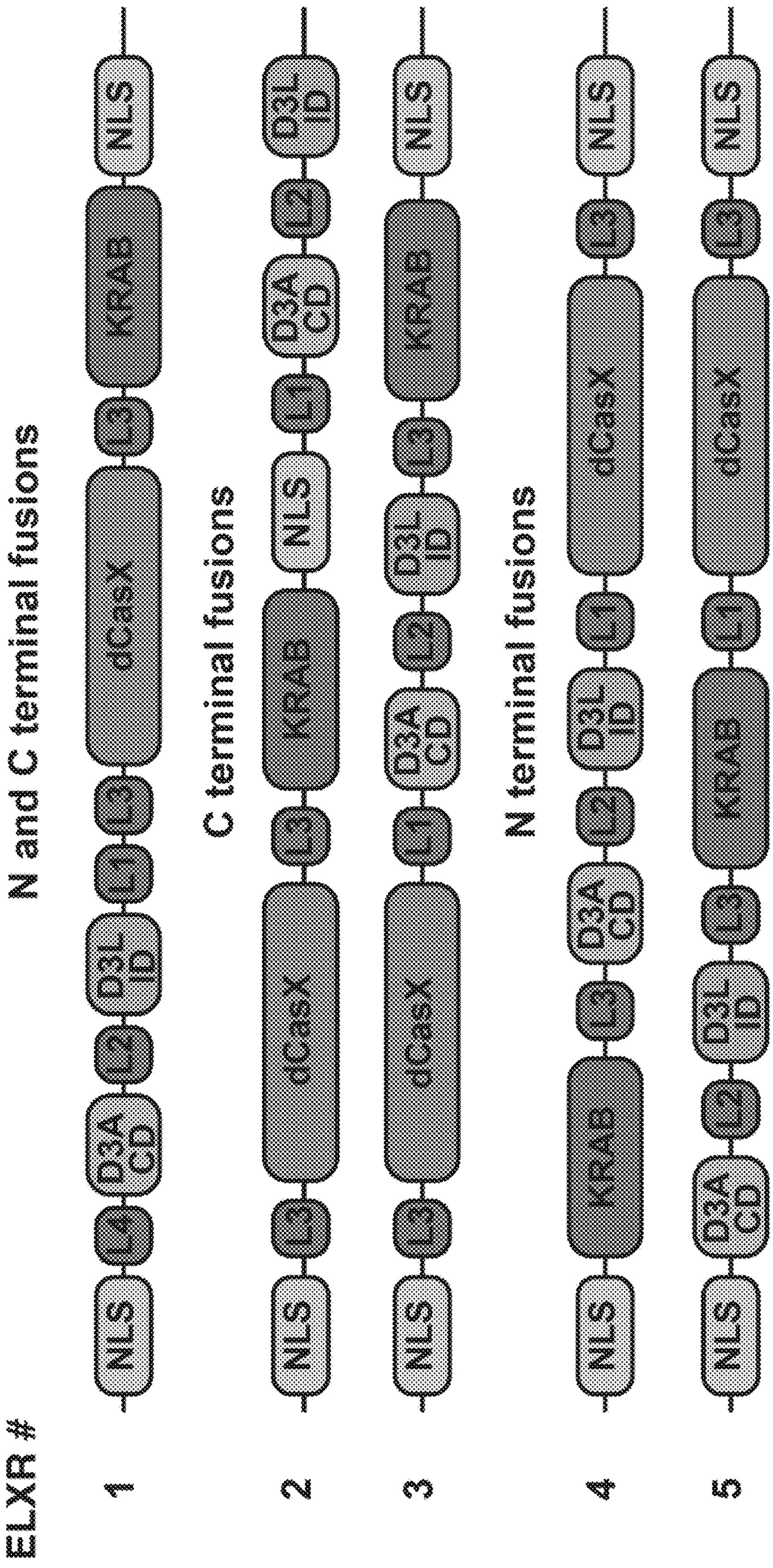
FIG. 7 illustrates the schematics of various configurations of the epigenetic long-term CasX repressor (ELXR) molecules tested for gene repression activity. D3A and D3L denote DNA methyltransferase 3 alpha (DNMT3A) and DNMT3A-like protein (DNMT3L), respectively, as described in Example 6. CD=catalytic domain, ID=interaction domain. L1-L4 are linkers. NLS is the nuclear localization signal. See Tables 24 and 25 for ELXR sequences.
Figure 45:
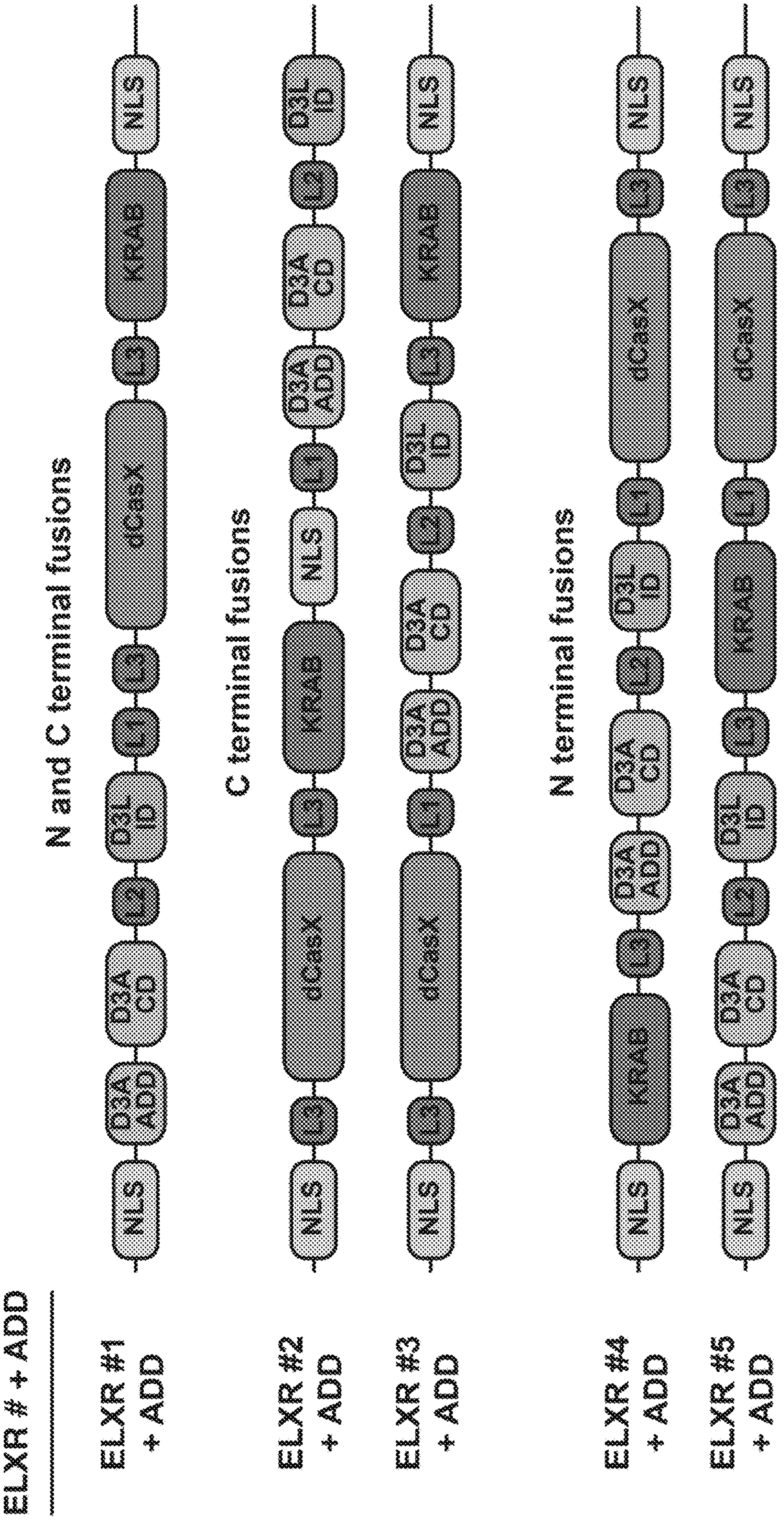
FIG. 45 illustrates the schematics of various configurations of ELXR molecules with the incorporation of the DNMT3A ADD. "D3A ADD", "D3A CD", and "D3L ID" denote the ADD domain of DNMT3A, the catalytic domain of DNMT3A, and the interaction domain of DNMT3L, respectively. L1-L3 are linkers. NLS is the nuclear localization signal.

In some embodiments, the dXR fusion protein comprises an ADD domain as a fourth domain, wherein the C-terminus of the ADD domain is operably to the N-terminus of the DNMT3A catalytic domain, representative configurations of which are schematically portrayed in FIG. 45. In some embodiments, the dXR comprises a dCasX and a first, second, third, and fourth repressor, and the dXR comprises a sequence selected from the group consisting of SEQ ID NOS: 59508-59567 and 59673-60012, or a sequence having or a sequence having at least about 70%, at least about 80%, at least about 85%, at least about 90% at least about 91%, at least about 92%, at least about 93% at least about 94% at least about 95%, at least about 96%, at least about 97%, at least about 98%, or at least about 99% identity thereto, and wherein the fusion protein comprises one or more linker peptides described herein, and wherein the fusion protein is capable of forming an RNP with a gRNA of the system that binds to the target nucleic acid. In some embodiments of the system comprising a dCasX variant, a first, second, third repressor domain, including the constructs of configurations 1-5, upon binding of an RNP of the fusion protein and the gRNA to the target nucleic acid, the gene is epigenetically modified and transcription of the gene is repressed. In some embodiment, transcription of the gene is repressed by at least about 10%, at least about 20%, at least about 30%, at least about 40%, at least about 50%, at least about 60%, at least about 70%, at least about 75%, at least about 80%, at least about 85%, at least about 90%, at least about 95%, or at least 99%, when assayed in an in vitro assay, including cell-based assays. In some embodiments, the repression of transcription of the gene by the system compositions, including the constructs of configurations 1-5, is sustained for at least about 8 hours, at least about 1 day, at least about 7 days, at least about 2 weeks, at least about 3 weeks, at least about 1 month, or at least about 2 months, when assayed in an in vitro assay, including cell-based assays. In a particular embodiment, dXR configurations 4 and 5, when used in the dXR:gRNA system, result in less off-target methylation or off-target activity in an in vitro assay compared to configuration 1 (as shown in FIGS. 7 and 45). In some embodiments, use of the dXR configurations 4 and 5 (as shown in FIGS. 7 and 45), when used in the dXR:gRNA system, results in off-target methylation or off-target activity that is less than about 10%, less than about 9%, less than about 8%, less than about 7%, less than about 6%, less than about 5%, less than about 4%, less than about 3%, less than about 2%, or less than about 1% in the cells.

In still other embodiments, the present disclosure provides dXR:gRNA systems wherein the dXR comprises a dCasX and a first, second, third, and fourth repressor domain. In some embodiments, the dXR comprises a dCasX selected from the group of sequences of SEQ ID NOS: 17-36 and 59353-59358 as set forth in Table 4 or a sequence variant having at least about 70%, at least about 80%, at least about 85%, at least about 90% at least about 91%, at least about 92%, at least about 93% at least about 94% at least about 95%, at least about 96%, at least about 97%, at least about 98%, or at least about 99% identity thereto, the first repressor domain is a KRAB repressor domain selected from the group of sequences of SEQ ID NOS: 889-2100 and 2332-33239, or sequence variants having at least about 70%, at least about 80%, at least about 85%, at least about 90% at least about 91%, at least about 92%, at least about 93% at least about 94% at least about 95%, at least about 96%, at least about 97%, at least about 98%, or at least about 99% identity thereto, the second repressor domain is DNMT3A catalytic domain selected from the group of sequences of SEQ ID NOS: 33625-57543 and 59450, or sequence variants having at least about 70%, at least about 80%, at least about 85%, at least about 90% at least about 91%, at least about 92%, at least about 93% at least about 94% at least about 95%, at least about 96%, at least about 97%, at least about 98%, or at least about 99% identity thereto, the third repressor domain is a DNMT3L interaction domain having a sequence of SEQ ID NO: 59625, or sequence variants having at least about 70%, at least about 80%, at least about 85%, at least about 90% at least about 91%, at least about 92%, at least about 93% at least about 94% at least about 95%, at least about 96%, at least about 97%, at least about 98%, or at least about 99% identity thereto, and the fourth domain is a DNMT3A ADD domain of SEQ ID NO: 59452, or a sequence variant having at least about 70%, at least about 80%, at least about 85%, at least about 90% at least about 91%, at least about 92%, at least about 93% at least about 94% at least about 95%, at least about 96%, at least about 97%, at least about 98%, or at least about 99% identity thereto. In a particular embodiment, the dXR comprises a dCasX comprises a sequence of SEQ ID NO: 18 as set forth in Table 4 or a sequence variant having at least about 70%, at least about 80%, at least about 85%, at least about 90% at least about 91%, at least about 92%, at least about 93% at least about 94% at least about 95%, at least about 96%, at least about 97%, at least about 98%, or at least about 99% identity thereto, the first repressor domain is a KRAB repressor domain selected from the group of sequences of SEQ ID NOS: 889-2100 and 2332-33239, or sequence variants having at least about 70%, at least about 80%, at least about 85%, at least about 90% at least about 91%, at least about 92%, at least about 93% at least about 94% at least about 95%, at least about 96%, at least about 97%, at least about 98%, or at least about 99% identity thereto, the second repressor domain is DNMT3A catalytic domain selected from the group of sequences of SEQ ID NOS: 33625-57543 and 59450, or sequence variants having at least about 70%, at least about 80%, at least about 85%, at least about 90% at least about 91%, at least about 92%, at least about 93% at least about 94% at least about 95%, at least about 96%, at least about 97%, at least about 98%, or at least about 99% identity thereto, the third repressor domain is a DNMT3L interaction domain having a sequence of SEQ ID NO: 59625, or sequence variants having at least about 70%, at least about 80%, at least about 85%, at least about 90% at least about 91%, at least about 92%, at least about 93% at least about 94% at least about 95%, at least about 96%, at least about 97%, at least about 98%, or at least about 99% identity thereto, and the fourth domain is a DNMT3A ADD domain of SEQ ID NO: 59452, or a sequence variant having at least about 70%, at least about 80%, at least about 85%, at least about 90% at least about 91%, at least about 92%, at least about 93% at least about 94% at least about 95%, at least about 96%, at least about 97%, at least about 98%, or at least about 99% identity thereto. In another particular embodiment, the dXR comprises a dCasX comprises a sequence of SEQ ID NO: 25 as set forth in Table 4 or a sequence variant having at least about 70%, at least about 80%, at least about 85%, at least about 90% at least about 91%, at least about 92%, at least about 93% at least about 94% at least about 95%, at least about 96%, at least about 97%, at least about 98%, or at least about 99% identity thereto, the first repressor domain is a KRAB repressor domain selected from the group of sequences of SEQ ID NOS: 889-2100 and 2332-33239, or sequence variants having at least about 70%, at least about 80%, at least about 85%, at least about 90% at least about 91%, at least about 92%, at least about 93% at least about 94% at least about 95%, at least about 96%, at least about 97%, at least about 98%, or at least about 99% identity thereto, the second repressor domain is DNMT3A catalytic domain selected from the group of sequences of SEQ ID NOS: 33625-57543 and 59450, or sequence variants having at least about 70%, at least about 80%, at least about 85%, at least about 90% at least about 91%, at least about 92%, at least about 93% at least about 94% at least about 95%, at least about 96%, at least about 97%, at least about 98%, or at least about 99% identity thereto, the third repressor domain is a DNMT3L interaction domain having a sequence of SEQ ID NO: 59625, or sequence variants having at least about 70%, at least about 80%, at least about 85%, at least about 90% at least about 91%, at least about 92%, at least about 93% at least about 94% at least about 95%, at least about 96%, at least about 97%, at least about 98%, or at least about 99% identity thereto, and the fourth domain is a DNMT3A ADD domain of SEQ ID NO: 59452, or a sequence variant having at least about 70%, at least about 80%, at least about 85%, at least about 90% at least about 91%, at least about 92%, at least about 93% at least about 94% at least about 95%, at least about 96%, at least about 97%, at least about 98%, or at least about 99% identity thereto. In another particular embodiment, the dXR comprises a dCasX comprises a sequence of SEQ ID NO: 59357 as set forth in Table 4 or a sequence variant having at least about 70%, at least about 80%, at least about 85%, at least about 90% at least about 91%, at least about 92%, at least about 93% at least about 94% at least about 95%, at least about 96%, at least about 97%, at least about 98%, or at least about 99% identity thereto, the first repressor domain is a KRAB repressor domain selected from the group of sequences of SEQ ID NOS: 889-2100 and 2332-33239, or sequence variants having at least about 70%, at least about 80%, at least about 85%, at least about 90% at least about 91%, at least about 92%, at least about 93% at least about 94% at least about 95%, at least about 96%, at least about 97%, at least about 98%, or at least about 99% identity thereto, the second repressor domain is DNMT3A catalytic domain selected from the group of sequences of SEQ ID NOS: 33625-57543 and 59450, or sequence variants having at least about 70%, at least about 80%, at least about 85%, at least about 90% at least about 91%, at least about 92%, at least about 93% at least about 94% at least about 95%, at least about 96%, at least about 97%, at least about 98%, or at least about 99% identity thereto, the third repressor domain is a DNMT3L interaction domain having a sequence of SEQ ID NO: 59625, or sequence variants having at least about 70%, at least about 80%, at least about 85%, at least about 90% at least about 91%, at least about 92%, at least about 93% at least about 94% at least about 95%, at least about 96%, at least about 97%, at least about 98%, or at least about 99% identity thereto, and the fourth domain is a DNMT3A ADD domain of SEQ ID NO: 59452, or a sequence variant having at least about 70%, at least about 80%, at least about 85%, at least about 90% at least about 91%, at least about 92%, at least about 93% at least about 94% at least about 95%, at least about 96%, at least about 97%, at least about 98%, or at least about 99% identity thereto. In another particular embodiment, the dXR comprises a dCasX comprises a sequence of SEQ ID NO: 59358 as set forth in Table 4 or a sequence variant having at least about 70%, at least about 80%, at least about 85%, at least about 90% at least about 91%, at least about 92%, at least about 93% at least about 94% at least about 95%, at least about 96%, at least about 97%, at least about 98%, or at least about 99% identity thereto, the first repressor domain is a KRAB repressor domain selected from the group of sequences of SEQ ID NOS: 889-2100 and 2332-33239, or sequence variants having at least about 70%, at least about 80%, at least about 85%, at least about 90% at least about 91%, at least about 92%, at least about 93% at least about 94% at least about 95%, at least about 96%, at least about 97%, at least about 98%, or at least about 99% identity thereto, the second repressor domain is DNMT3A catalytic domain selected from the group of sequences of SEQ ID NOS: 33625-57543 and 59450, or sequence variants having at least about 70%, at least about 80%, at least about 85%, at least about 90% at least about 91%, at least about 92%, at least about 93% at least about 94% at least about 95%, at least about 96%, at least about 97%, at least about 98%, or at least about 99% identity thereto, the third repressor domain is a DNMT3L interaction domain having a sequence of SEQ ID NO: 59625, or sequence variants having at least about 70%, at least about 80%, at least about 85%, at least about 90% at least about 91%, at least about 92%, at least about 93% at least about 94% at least about 95%, at least about 96%, at least about 97%, at least about 98%, or at least about 99% identity thereto, and the fourth domain is a DNMT3A ADD domain of SEQ ID NO: 59452, or a sequence variant having at least about 70%, at least about 80%, at least about 85%, at least about 90% at least about 91%, at least about 92%, at least about 93% at least about 94% at least about 95%, at least about 96%, at least about 97%, at least about 98%, or at least about 99% identity thereto. The ADD domain is known to have two key functions: 1) it allosterically regulates the catalytic activity of DNMT3A by serving as a methyltransferase auto-inhibitory domain, and 2) it recognizes unmethylated H3K4 (H3K4me0). Without wishing to be bound by theory, it is thought that the interaction of the ADD domain with the H3K4me0 mark unveils the catalytic site of DNMT3A, thereby recruiting an active DNMT3A to chromatin to implement de novo methylation at these sites. In a surprising finding, it has been discovered that the addition of the DNMT3A ADD domain to the dXR constructs comprising the DNMT3A catalytic and DNMT3L interaction domains greatly enhances the repression of the target nucleic acid in comparison to dXR constructs lacking the ADD domain. Exemplary data for the improved repression are presented in the Examples.

In a particular embodiment, the present disclosure provides systems comprising a first, a second, a third, and a fourth repressor domain operably linked to a dCasX comprising the sequence of SEQ ID NO: 18, or a sequence having at least about 65%, at least about 70%, at least about 75%, at least about 80%, at least about 85%, at least about 90% at least about 91%, at least about 92%, at least about 93% at least about 94% at least about 95%, at least about 96%, at least about 97%, at least about 98%, or at least about 99% identity thereto, wherein the KRAB domain comprises one or more motifs selected from the group consisting of a) $PX_1X_2X_3X_4X_5X_6EX_7$, wherein $X_1$ is A, D, E, or N, $X_2$ is L or V, $X_3$ is I or V, $X_4$ is S, T, or F, $X_5$ is H, K, L, Q, R or W, $X_6$ is L or M, and $X_7$ is G, K, Q, or R; b) $X_1X_2X_3X_4GX_5X_6X_7X_8X_9$, wherein $X_1$ is L or V, $X_2$ is A, G, L, T or V, $X_3$ is A, F, or S, $X_4$ is L or V, $X_5$ is C, F, H, I, L or Y, $X_6$ is A, C, P, Q, or S, $X_7$ is A, F, G, I, S, or V, $X_8$ is A, P, S, or T, and $X_9$ is K or R; c) $QX_1X_2LYRX_3VMX_4$(SEQ ID NO: 59345), wherein $X_1$ is K or R, $X_2$ is A, D, E, G, N, S, or T, $X_3$ is D, E, or S, and $X_4$ is L or R; d) $X_1X_2X_3FX_4DVX_5X_6X_7FX_8X_9X_{10}X_{11}$ (SEQ ID NO: 59346), wherein $X_1$ is A, L, P, or S, $X_2$ is L or V, $X_3$ is S or T, $X_4$ is A, E, G, K, or R, $X_5$ is A or T, $X_6$ is I or V, $X_7$ is D, E, N, or Y, $X_8$ is S or T, $X_9$ is E, P, Q, R, or W, $X_{10}$ is E or N, and $X_{11}$ is E or Q; e) $X_1X_2X_3PX_4X_5X_6X_7X_8X_9X_{10}$, wherein $X_1$ is E, G, or R, $X_2$ is E or K, $X_3$ is A, D, or E, $X_4$ is C or W, $X_5$ is I, K, L, M, T, or V, $X_6$ is I, L, P, or V, $X_7$ is D, E, K, or V, $X_8$ is E, G, K, P, or R, $X_9$ is A, D, R, G, K, Q, or V, and $X_{10}$ is D, E, G, I, L, R, S, or V; f) $LYX_1X_2VMX_3EX_4X_5X_6X_7X_8X_9X_{10}$ (SEQ ID NO: 59348), wherein $X_1$ is K or R, $X_2$ is D or E, $X_3$ is L, Q, or R, $X_4$ is N or T, $X_5$ is F or Y, $X_6$ is A, E, G, Q, R, or S, $X_7$ is H, L, or N, $X_8$ is L or V, $X_9$ is A, G, I, L, T, or V, and $X_{10}$ is A, F, or S; g) $FX_1DVX_2X_3X_4FX_5X_6X_7EWX_8$ (SEQ ID NO: 59349), wherein $X_1$ is A, E, G, K, or R, $X_2$ is A, S, or T, $X_3$ is I or V, $X_4$ is D, E, N, or Y, $X_5$ is S or T, $X_6$ is E, L, P, Q, R, or W, $X_7$ is D or E, and $X_8$ is A, E, G, Q, or R; h) $X_1PX_2X_3X_4X_5\ X_6LEX_7X_8X_9X_{10}X_{11}X_{12}$, wherein $X_1$ is K or R, $X_2$ is A, D, E, or N, $X_3$ is I, L, M, or V, $X_4$ is I or V, $X_5$ is F, S, or T, $X_6$ is H, K, L, Q, R, or W, $X_7$ is K, Q, or R, $X_8$ is E, G, or R, $X_9$ is D, E, or K, $X_{10}$ is A, D, or E, $X_{11}$ is L or P, and $X_{12}$ is C or W; or i) $X_1LX_2X_3X_4QX_5X_6$, wherein $X_1$ is C, H, L, Q, or W, $X_2$ is D, G, N, R, or S, $X_3$ is L, P, S, or T, $X_4$ is A, S, or T, $X_5$ is K or R, and $X_6$ is A, D, E, K, N, S, or T, and the KRAB domain comprises a sequence selected from the group consisting of SEQ ID NOS: 57746-59342, or a sequence having at least about 70%, at least about 80%, at least about 85%, at least about 90% at least about 91%, at least about 92%, at least about 93% at least about 94% at least about 95%, at least about 96%, at least about 97%, at least about 98%, or at least about 99% identity thereto, and the second repressor domain is a DNMT3A catalytic domain sequence selected from the group consisting of SEQ ID NOS: 33625-57543 and 59450, or sequence variants having at least about 70%, at least about 80%, at least about 85%, at least about 90% at least about 91%, at least about 92%, at least about 93% at least about 94% at least about 95%, at least about 96%, at least about 97%, at least about 98%, or at least about 99% identity thereto, the third repressor is a DNMT3L interaction domain comprising the sequence of SEQ ID NO: 59625, or a sequence variant having at least about 70%, at least about 80%, at least about 85%, at least about 90% at least about 91%, at least about 92%, at least about 93% at least about 94% at least about 95%, at least about 96%, at least about 97%, at least about 98%, or at least about 99% identity thereto, and the fourth repressor is an ADD domain comprising the sequence of SEQ ID NO: 59452, or a sequence variant having at least about 70%, at least about 80%, at least about 85%, at least about 90% at least about 91%, at least about 92%, at least about 93% at least about 94% at least about 95%, at least about 96%, at least about 97%, at least about 98%, or at least about 99% identity thereto, wherein the fusion protein comprises one or more linker peptides described herein, and wherein the fusion protein is capable of forming an RNP with a gRNA of the system that binds to the target nucleic acid. The present disclosure provides systems comprising a first, a second, a third, and a fourth repressor domain operably linked to a dCasX comprising the sequence of SEQ ID NO: 18, or a sequence having at least about 65%, at least about 70%, at least about 75%, at least about 80%, at least about 85%, at least about 90% at least about 91%, at least about 92%, at least about 93% at least about 94% at least about 95%, at least about 96%, at least about 97%, at least about 98%, or at least about 99% identity thereto, wherein the first repressor domain comprises a KRAB domain comprising one or more motifs selected from the group consisting of a) $PX_1X_2X_3X_4X_5X_6EX_7$, wherein $X_1$ is A, D, E, or N, $X_2$ is L or V, $X_3$ is I or V, $X_4$ is S, T, or F, $X_5$ is H, K, L, Q, R or W, $X_6$ is L or M, and $X_7$ is G, K, Q, or R; b) $X_1X_2X_3X_4GX_5X_6X_7X_8X_9$, wherein $X_1$ is L or V, $X_2$ is A, G, L, T or V, $X_3$ is A, F, or S, $X_4$ is L or V, $X_5$ is C, F, H, I, L or Y, $X_6$ is A, C, P, Q, or S, $X_7$ is A, F, G, I, S, or V, $X_8$ is A, P, S, or T, and $X_9$ is K or R; c) $QX_1X_2LYRX_3VMX_4$ (SEQ ID NO: 59345), wherein $X_1$ is K or R, $X_2$ is A, D, E, G, N, S, or T, $X_3$ is D, E, or S, and $X_4$ is L or R; d) $X_1X_2X_3FX_4DVX_5X_6X_7FX_8X_9X_{10}X_{11}$ (SEQ ID NO:

59346), wherein $X_1$ is A, L, P, or S, $X_2$ is L or V, $X_3$ is S or T, $X_4$ is A, E, G, K, or R, $X_5$ is A or T, $X_6$ is I or V, $X_7$ is D, E, N, or Y, $X_8$ is S or T, $X_9$ is E, P, Q, R, or W, $X_{10}$ is E or N, and $X_{11}$ is E or Q; e) $X_1X_2X_3PX_4X_5X_6X_7X_8X_9X_{10}$, wherein $X_1$ is E, G, or R, $X_2$ is E or K, $X_3$ is A, D, or E, $X_4$ is C or W, $X_5$ is I, K, L, M, T, or V, $X_6$ is I, L, P, or V, $X_7$ is D, E, K, or V, $X_8$ is E, G, K, P, or R, $X_9$ is A, D, R, G, K, Q, or V, and $X_{10}$ is D, E, G, I, L, R, S, or V; f) $LYX_1X_2VMX_3EX_4X_5X_6X_7X_8X_9X_{10}$ (SEQ ID NO: 59348), wherein $X_1$ is K or R, $X_2$ is D or E, $X_3$ is L, Q, or R, $X_4$ is N or T, $X_5$ is F or Y, $X_6$ is A, E, G, Q, R, or S, $X_7$ is H, L, or N, $X_8$ is L or V, $X_9$ is A, G, I, L, T, or V, and $X_{10}$ is A, F, or S; g) $FX_1DVX_2X_3X_4FX_5X_6X_7EWX_8$ (SEQ ID NO: 59349), wherein $X_1$ is A, E, G, K, or R, $X_2$ is A, S, or T, $X_3$ is I or V, $X_4$ is D, E, N, or Y, $X_5$ is S or T, $X_6$ is E, L, P, Q, R, or W, $X_7$ is D or E, and $X_8$ is A, E, G, Q, or R; h) $X_1PX_2X_3X_4X_5X_6LEX_7X_8X_9X_{10}X_{11}X_{12}$, wherein $X_1$ is K or R, $X_2$ is A, D, E, or N, $X_3$ is I, L, M, or V, $X_4$ is I or V, $X_5$ is F, S, or T, $X_6$ is H, K, L, Q, R, or W, $X_7$ is K, Q, or R, $X_8$ is E, G, or R, $X_9$ is D, E, or K, $X_{10}$ is A, D, or E, $X_{11}$ is L or P, and $X_{12}$ is C or W; or i) $X_1LX_2X_3X_4QX_5X_6$, wherein $X_1$ is C, H, L, Q, or W, $X_2$ is D, G, N, R, or S, $X_3$ is L, P, S, or T, $X_4$ is A, S, or T, $X_5$ is K or R, and $X_6$ is A, D, E, K, N, S, or T, and the KRAB domain comprises a sequence selected from the group consisting of SEQ ID NOS: 57746-57840, or a sequence having at least about 70%, at least about 80%, at least about 85%, at least about 90% at least about 91%, at least about 92%, at least about 93% at least about 94% at least about 95%, at least about 96%, at least about 97%, at least about 98%, or at least about 99% identity thereto, the second repressor domain is a DNMT3A catalytic domain comprising a sequence selected from the group consisting of SEQ ID NOS: 33625-57543 and 59450, or sequence variants having at least about 70%, at least about 80%, at least about 85%, at least about 90% at least about 91%, at least about 92%, at least about 93% at least about 94% at least about 95%, at least about 96%, at least about 97%, at least about 98%, or at least about 99% identity thereto, the third repressor is a DNMT3L interaction domain comprising the amino acid sequence of SEQ ID NO: 59625, or a sequence variant having at least about 70%, at least about 80%, at least about 85%, at least about 90% at least about 91%, at least about 92%, at least about 93% at least about 94% at least about 95%, at least about 96%, at least about 97%, at least about 98%, or at least about 99% identity thereto, and the fourth repressor is an ADD domain comprising the sequence of SEQ ID NO: 59452, or a sequence variant having at least about 70%, at least about 80%, at least about 85%, at least about 90% at least about 91%, at least about 92%, at least about 93% at least about 94% at least about 95%, at least about 96%, at least about 97%, at least about 98%, or at least about 99% identity thereto, wherein the fusion protein comprises one or more linker peptides described herein, and wherein the fusion protein is capable of forming an RNP with a gRNA of the system that binds to the target nucleic acid. The present disclosure provides systems comprising a first, a second, a third, and a fourth repressor domain operably linked to a dCasX comprising the sequence of SEQ ID NO: 18, or a sequence having at least about 65%, at least about 70%, at least about 75%, at least about 80%, at least about 85%, at least about 90% at least about 91%, at least about 92%, at least about 93% at least about 94% at least about 95%, at least about 96%, at least about 97%, at least about 98%, or at least about 99% identity thereto, wherein the first repressor domain comprises a KRAB domain comprising one or more motifs selected from the group consisting of a) $PX_1X_2X_3X_4X_5X_6EX_7$, wherein $X_1$ is A, D, E, or N, $X_2$ is L or V, $X_3$ is I or V, $X_4$ is S, T, or F, $X_5$ is H, K, L, Q, R or W, $X_6$ is L or M, and $X_7$ is G, K, Q, or R; b) $X_1X_2X_3X_4GX_5X_6X_7X_8X_9$, wherein $X_1$ is L or V, $X_2$ is A, G, L, T or V, $X_3$ is A, F, or S, $X_4$ is L or V, $X_5$ is C, F, H, I, L or Y, $X_6$ is A, C, P, Q, or S, $X_7$ is A, F, G, I, S, or V, $X_8$ is A, P, S, or T, and $X_9$ is K or R; c) $QX_1X_2LYRX_3VMX_4$ (SEQ ID NO: 59345), wherein $X_1$ is K or R, $X_2$ is A, D, E, G, N, S, or T, $X_3$ is D, E, or S, and $X_4$ is L or R; d) $X_1X_2X_3FX_4DVX_5X_6X_7FX_8X_9X_{10}X_1$ (SEQ ID NO: 59346), wherein $X_1$ is A, L, P, or S, $X_2$ is L or V, $X_3$ is S or T, $X_4$ is A, E, G, K, or R, $X_5$ is A or T, $X_6$ is I or V, $X_7$ is D, E, N, or Y, $X_8$ is S or T, $X_9$ is E, P, Q, R, or W, $X_{10}$ is E or N, and $X_{11}$ is E or Q; e) $X_1X_2X_3PX_4X_5X_6X_7X_8X_9X_{10}$, wherein $X_1$ is E, G, or R, $X_2$ is E or K, $X_3$ is A, D, or E, $X_4$ is C or W, $X_5$ is I, K, L, M, T, or V, $X_6$ is I, L, P, or V, $X_7$ is D, E, K, or V, $X_8$ is E, G, K, P, or R, $X_9$ is A, D, R, G, K, Q, or V, and $X_{10}$ is D, E, G, I, L, R, S, or V; f) $LYX_1X_2VMX_3EX_4X_5X_6X_7X_8X_9X_{10}$ (SEQ ID NO: 59348), wherein $X_1$ is K or R, $X_2$ is D or E, $X_3$ is L, Q, or R, $X_4$ is N or T, $X_5$ is F or Y, $X_6$ is A, E, G, Q, R, or S, $X_7$ is H, L, or N, $X_8$ is L or V, $X_9$ is A, G, I, L, T, or V, and $X_{10}$ is A, F, or S; g) $FX_1DVX_2X_3X_4FX_5X_6X_7EWX_8$ (SEQ ID NO: 59349), wherein $X_1$ is A, E, G, K, or R, $X_2$ is A, S, or T, $X_3$ is I or V, $X_4$ is D, E, N, or Y, $X_5$ is S or T, $X_6$ is E, L, P, Q, R, or W, $X_7$ is D or E, and $X_8$ is A, E, G, Q, or R; h) $X_1PX_2X_3X_4X_5$ $X_6LEX_7X_8X_9X_{10}X_{11}X_{12}$, wherein $X_1$ is K or R, $X_2$ is A, D, E, or N, $X_3$ is I, L, M, or V, $X_4$ is I or V, $X_5$ is F, S, or T, $X_6$ is H, K, L, Q, R, or W, $X_7$ is K, Q, or R, $X_8$ is E, G, or R, $X_9$ is D, E, or K, $X_{10}$ is A, D, or E, $X_{11}$ is L or P, and $X_{12}$ is C or W; or i) $X_1LX_2X_3X_4QX_5X_6$, wherein $X_1$ is C, H, L, Q, or W, $X_2$ is D, G, N, R, or S, $X_3$ is L, P, S, or T, $X_4$ is A, S, or T, $X_5$ is K or R, and $X_6$ is A, D, E, K, N, S, or T, and the KRAB domain comprises a sequence selected from the group consisting of SEQ ID NOS: 57746-57755, or a sequence having at least about 70%, at least about 80%, at least about 85%, at least about 90% at least about 91%, at least about 92%, at least about 93% at least about 94% at least about 95%, at least about 96%, at least about 97%, at least about 98%, or at least about 99% identity thereto, the second repressor domain is a DNMT3A catalytic domain comprising a sequence selected from the group consisting of SEQ ID NOS: 33625-57543 and 59450, or sequence variants having at least about 70%, at least about 80%, at least about 85%, at least about 90% at least about 91%, at least about 92%, at least about 93% at least about 94% at least about 95%, at least about 96%, at least about 97%, at least about 98%, or at least about 99% identity thereto, the third repressor is a DNMT3L interaction domain comprising the sequence of SEQ ID NOS: 59625, or a sequence variant having at least about 70%, at least about 80%, at least about 85%, at least about 90% at least about 91%, at least about 92%, at least about 93% at least about 94% at least about 95%, at least about 96%, at least about 97%, at least about 98%, or at least about 99% identity thereto, and the fourth repressor is an ADD domain comprising the sequence of SEQ ID NO: 59452, or sequence variants having at least about 70%, at least about 80%, at least about 85%, at least about 90% at least about 91%, at least about 92%, at least about 93% at least about 94% at least about 95%, at least about 96%, at least about 97%, at least about 98%, or at least about 99% identity thereto, and wherein the fusion protein comprises one or more linker peptides described herein, and wherein the fusion protein is capable of forming an RNP with a gRNA of the system that binds to the target nucleic acid. In some embodiments, the dXR fusion protein comprise an ADD domain and a DNMT3A catalytic domain, wherein the C terminus of the ADD domain is operably to the N terminus of the DNMT3A catalytic domain. In some embodiments each of the repressor domains and the dCasX are operably linked, in some cases via a linker, as described herein. In some embodiments, the dXR fusion protein has a configuration of, N-terminal to C-terminal of configuration 1 (NLS-ADD-DNMT3A-Linker2-DNMT3A-Linker1-Linker3-dCasX-Linker3-KRAB-NLS), configuration 2 (NLS-Linker3-dCasX-Linker3-KRAB-NLS-Linker1-ADD-DNMT3A-Linker2-DNMT3L), configuration 3 (NLS-Linker3-dCasX-Linker1-ADD-DNMT3A-Linker2-DNMT3L-Linker3-KRAB-NLS), configuration 4 (NLS-KRAB-Linker3-ADD-DNMT3A-Linker2-DNMT3L-Linker1-dCasX-Linker3-NLS), or configuration 5 (NLS-ADD-DNMT3A-Linker2-DNMT3L-Linker3-KRAB-Linker1-dCasX-Linker3-NLS). In some embodiments of the system, the fusion protein components of the system are configured as schematically portrayed in FIG. 45. In some embodiments, the dXR fusion protein comprises a sequence selected from the group consisting of SEQ ID NOS: 59518-59526, 59538-59547, 59558-59567 and 59843-60012, or a sequence having or a sequence having at least about 70%, at least about 80%, at least about 85%, at least about 90% at least about 91%, at least about 92%, at least about 93% at least about 94% at least about 95%, at least about 96%, at least about 97%, at least about 98%, or at least about 99% identity thereto, and wherein the fusion protein is in configuration 1, 4 or 5.

In some embodiments of the system comprising a dCasX variant, a first, second, third, and fourth repressor domain, upon binding of an RNP of the fusion protein and the gRNA to the target nucleic acid, a gene encoded by the target nucleic acid is epigenetically-modified and transcription of the gene is repressed. In some embodiment, transcription of the gene is repressed by at least about 10%, at least about 20%, at least about 30%, at least about 40%, at least about 50%, at least about 60%, at least about 70%, at least about 75%, at least about 80%, at least about 85%, at least about 90%, at least about 95%, or at least 99%, when assayed in an in vitro assay, including cell-based assays. In some embodiments, the repression of transcription of the gene by the system compositions is sustained for at least about 8 hours, at least about 1 day, at least about 7 days, at least 2 weeks, at least about 3 weeks, at least about 1 month, or at least about 2 months, when assayed in an in vitro assay, including cell-based assays. In a particular embodiment, dXR configurations 4 and 5, when used in the dXR:gRNA system, result in less off-target methylation or off-target activity in an in vitro assay compared to configuration 1. In some embodiments, use of the dXR configurations 4 and 5, when used in the dXR:gRNA system, results in off-target methylation or off-target activity that is less than about 10%, less than about 9%, less than about 8%, less than about 7%, less than about 6%, less than about 5%, less than about 4%, less than about 3%, less than about 2%, or less than about 1% in the cells.

In some embodiments, the transcriptional repressor domains are linked to each other, or to the catalytically-dead CRISPR protein or catalytically-dead Class 2, Type V CRISPR protein (e.g., dCasX) within the fusion protein by linker peptide sequences. In some cases, the one or more transcriptional repressor domains are linked at or near the C-terminus of the catalytically-dead Class 2, Type V CRISPR protein (e.g., dCasX) by linker peptide sequences. In other cases, the one or more transcriptional repressor domains are linked at or near the N-terminus of the catalytically-dead Class 2, Type V CRISPR protein (e.g., dCasX) by linker peptide sequences. In still other cases, a first transcriptional repressor domain is linked at or near the C-terminus of the catalytically-dead Class 2, Type V CRISPR protein (e.g., dCasX) by linker peptide sequences and a second, third, and, optionally, a fourth transcriptional repressor domain is linked at or near the N-terminus of the catalytically-dead Class 2, Type V CRISPR protein. Representative, but non-limiting configurations are schematically portrayed in FIG. 7, FIG. 38, and FIG. 45. In the foregoing, the linker peptide is selected from the group consisting of RS, (G)n (SEQ ID NO: 33240), (GS)n (SEQ ID NO: 33241), (GGS)n (SEQ ID NO: 33242), (GSGGS)n (SEQ ID NO: 33243), (GGSGGS)n (SEQ ID NO: 33244), (GGGS)n (SEQ ID NO: 33245), GGSG (SEQ ID NO: 33246), GGSGG (SEQ ID NO: 33247), GSGSG (SEQ ID NO: 33248), GSGGG (SEQ ID NO: 33249), GGGSG (SEQ ID NO: 33250), GSSSG (SEQ ID NO: 33251), (GP)n (SEQ ID NO: 33252), GPGP (SEQ ID NO: 33253), GGSGGGS (SEQ ID NO: 33254), GSGSGGG (SEQ ID NO: 57628), GGCGGTTCCGGCGGAGGAAGC (SEQ ID NO: 57624), GGCGGTTCCGGCGGAGGTTCC (SEQ ID NO: 57625), GGATCAGGCTCTGGAGGTGGA (SEQ ID NO: 57627), GGAGGGCCGAGCTCTGGCGCACCCCCACCAAGTG-GAGGGTCTCCTGCCGGGTCCCC AACATCTACT-GAAGAAGGCACCAGCGAATCCGCAACGCCCG-AGTCAGGCCCTGGTA CCTCCACAGAACCATCT-GAAGGTAGTGCGCCTGGTTCCCCAGCTG-GAAGCCCTACTT CCACCGAAGAAGGCACGT-CAACCGAACCAAGTGAAGGATCTGCCCCTGGG-ACCAGC ACTGAACCATCTGAG (SEQ ID NO: 57620), SSGNSNANSRGPSFSSGLVPLSLRGSH (SEQ ID NO: 57623), GGPSSGAPPPSGGSPAGSPTSTEEGTSESAT-PESGPGTSTEPSEGSAPGSPAGSPTSTEEGT STEPSEGSAPGTSTEPSE (SEQ ID NO: 57621), TCTAGCGGCAATAGTAACGCTAACAGCCGCGG-GCCGAGCTTCAGCAGCGGCCTGGT GCCGT-TAAGCTTGCGCGGCAGCCAT (SEQ ID NO: 57622), GGP, PPP, PPAPPA (SEQ ID NO: 33255), PPPGPPP (SEQ ID NO: 33256), PPPG (SEQ ID NO: 33257), PPP(GGGS)n (SEQ ID NO: 33258), (GGGS)nPPP (SEQ ID NO: 33259), AEAAAKEAAAKEAAAKA (SEQ ID NO:33260), AEAAAKEAAAKA (SEQ ID NO: 33261), SGSETPGTS-ESATPES (SEQ ID NO: 33262), and TPPKTKRKVEFE (SEQ ID NO: 33263), wherein n is an integer of 1 to 5.

IV. Guide Ribonucleic Acids (gRNA) of the Systems

In another aspect, the disclosure provides guide ribonucleic acids (gRNAs) utilized in the gene repressor systems of the disclosure that have utility, with the other components of the gene repressor systems, in the repression of transcription of genes targeted by the design of the gRNA. The present disclosure provides specifically-designed gRNAs with targeting sequences (or "spacers") that are complementary to (and are therefore able to hybridize with) the target nucleic acid as a component of the gene repression systems, wherein the gRNA is capable of forming a ribonucleoprotein (RNP) complex with the catalytically-dead CRISPR protein (e.g., dCasX) of a fusion protein. In the case of a dCasX variant with linked repressor domains employed in the systems of the disclosure, the dCasX variant has specificity to a protospacer adjacent motif (PAM) sequence comprising a TC motif in the complementary non-target strand, and wherein the PAM sequence is located 1 nucleotide 5' of the sequence in the non-target strand that is complementary to the target nucleic acid sequence in the target strand of the target nucleic acid. The use of a pre-complexed RNP confers advantages in the delivery of the system components to a cell or target nucleic acid sequence for repression of transcription of the target nucleic acid sequence. The dCasX variant protein component of the RNP provides the site-specific activity that is guided to a target site (e.g., stabilized at a target site) within a target nucleic acid sequence by virtue of its association with the guide RNA comprising a targeting sequence complementary to the desired specific location of the target nucleic acid and proximal to the PAM sequence.

It is envisioned that in some embodiments, multiple gRNAs (e.g., multiple gRNAs) are delivered by the system for the repression at different regions of a gene, increasing the efficiency and/or duration of repression, as described more fully, below.

a. Reference gRNA and gRNA Variants

In designing gRNA for incorporation into the gene repressor systems of the disclosure, comprehensive approaches termed Deep Mutational Evolution (DME), deep mutational scanning (DMS), error prone PCR, cassette mutagenesis, random mutagenesis, staggered extension PCR, gene shuffling, or domain swapping, were utilized to, in a systematic way, introduce mutations and variations in the nucleic acid sequence of, first, naturally-occurring gRNA ("reference gRNA"), resulting in gRNA variants with improved properties, then re-applying the approaches to gRNA variants to further evolve and improve the resulting gRNA variants. gRNA variants also include variants comprising one or more chemical modifications. The activity of reference gRNAs may be used as a benchmark against which the activity of gRNA variants are compared, thereby measuring improvements in function or other characteristics of the gRNA variants. In other embodiments, a reference gRNA or gRNA variant may be subjected to one or more deliberate, targeted mutations in order to produce a gRNA variant, for example a rationally-designed variant.

The gRNAs of the disclosure comprise two segments; a targeting sequence and a protein-binding segment. The targeting segment of a gRNA includes a nucleotide sequence (referred to interchangeably as a guide sequence, a spacer, a targeter, or a targeting sequence) that is complementary to (and therefore hybridizes with) a specific sequence (a target site) within the target nucleic acid sequence (e.g., a target ssRNA, a target ssDNA, a strand of a double stranded target nucleic acid, etc.), described more fully below. The targeting sequence of a gRNA is capable of binding to a target nucleic acid sequence, including a coding sequence, a complement of a coding sequence, a non-coding sequence, and to regulatory elements. The protein-binding segment (or "activator" or "protein-binding sequence") interacts with (e.g., binds to) a dCasX protein as a complex, forming an RNP (described more fully, below). The protein-binding segment is alternatively referred to herein as a "scaffold", which is comprised of several regions, described more fully, below.

In the case of a dual guide RNA (dgRNA), the targeter and the activator portions each have a duplex-forming segment, where the duplex forming segment of the targeter and the duplex-forming segment of the activator have complementarity with one another and hybridize to one another to form a double stranded duplex (dsRNA duplex for a gRNA). The term "targeter" or "targeter RNA" is used herein to refer to a crRNA-like molecule (crRNA: "CRISPR RNA") of a CasX dual guide RNA (and therefore of a CasX single guide RNA when the "activator" and the "targeter" are linked together; e.g., by intervening nucleotides). The crRNA has a 5' region that anneals with the tracrRNA followed by the nucleotides of the targeting sequence. Thus, for example, a guide RNA (dgRNA or sgRNA) comprises a guide sequence and a duplex-forming segment of a crRNA, which can also be referred to as a crRNA repeat. A corresponding tracrRNA-like molecule (activator) also comprises a duplex-forming stretch of nucleotides that forms the other half of the dsRNA duplex of the protein-binding segment of the guide RNA. Thus, a targeter and an activator, as a corresponding pair, hybridize to form a dual guide RNA, referred to herein as a "dual-molecule gRNA" or a "dgRNA". Site-specific binding of a target nucleic acid sequence (e.g., genomic DNA) by the dCasX protein and linked repressor domain(s) can occur at one or more locations (e.g., a sequence of a target nucleic acid) determined by base-pairing complementarity between the targeting sequence of the gRNA and the target nucleic acid sequence. Thus, for example, the gRNA of the disclosure have sequences complementarity to and therefore can hybridize with the target nucleic acid that is adjacent to a sequence complementary to a TC PAM motif or a PAM sequence, such as ATC, CTC, GTC, or TTC. Because the targeting sequence of a guide sequence hybridizes with a sequence of a target nucleic acid sequence, a targeting sequence can be modified by a user to hybridize with a specific target nucleic acid sequence, so long as the location of the PAM sequence is considered. In other embodiments, the activator and targeter of the gRNA are covalently linked to one another (rather than hybridizing to one another) and comprise a single molecule, referred to herein as a "single-molecule gRNA," "one-molecule guide RNA," "single guide RNA", "single guide RNA", a "single-molecule guide RNA," a "sgRNA", or a "one-molecule guide RNA".

Collectively, the assembled gRNAs of the disclosure comprise four distinct regions, or domains: the RNA triplex, the scaffold stem, the extended stem, and the targeting sequence that, in the embodiments of the disclosure is specific for a target nucleic acid and is located on the 3' end of the gRNA. The RNA triplex, the scaffold stem, and the extended stem, together, are referred to as the "scaffold" of the gRNA. The foregoing components of the gRNA are described in WO2020247882A1 and WO2022120095, incorporated by reference herein.

b. Targeting Sequence

In some embodiments of the gRNAs of the disclosure, the extended stem loop is followed by a region that forms part of the triplex, and then the targeting sequence (or "spacer") at the 3' end of the gRNA, with the scaffold being that region of the guide 5' relative to the targeting sequence. The targeting sequence targets the CasX ribonucleoprotein holo complex to a specific region of the target nucleic acid sequence of the gene to be repressed, 3' relative to the binding of the RNP. Thus, for example, gRNA targeting sequences of the disclosure have sequences complementarity to, and therefore can hybridize to, a portion of the gene in a nucleic acid in a eukaryotic cell (e.g., a eukaryotic chromosome, chromosomal sequence, a eukaryotic RNA, etc.) as a component of the RNP when the TC PAM motif or any one of the PAM sequences TTC, ATC, GTC, or CTC is located 1 nucleotide 5' to the non-target strand sequence complementary to the target sequence. The targeting sequence of a gRNA can be modified so that the gRNA can target a desired sequence of any desired target nucleic acid sequence, so long as the PAM sequence location is taken into consideration. In some embodiments, the PAM motif sequence recognized by the nuclease of the RNP is TC. In other embodiments, the PAM sequence recognized by the nuclease of the RNP is NTC. In other embodiments, the PAM sequence recognized by the nuclease of the RNP is TTC. In other embodiments, the PAM sequence recognized by the nuclease of the RNP is ATC. In other embodiments, the PAM sequence recognized by the nuclease of the RNP is CTC. In other embodiments, the PAM sequence recognized by the nuclease of the RNP is GTC.

The gene repressor systems of the present disclosure can be designed to target any region of, or proximal to, a gene or region of a gene for which repression of transcription is sought. When the entirety of the gene is to be repressed, designing a guide with a targeting sequence complementary to a sequence encompassing or proximal to the transcription start site (TSS) is contemplated by the disclosure. The TSS selection occurs at different positions within the promoter region, depending on promoter sequence and initiating-substrate concentration. The core promoter serves as a binding platform for the transcription machinery, which comprises Pol II and its associated general transcription factors (GTFs) (Haberle, V. et al. Eukaryotic core promoters and the functional basis of transcription initiation (Nat Rev Mol Cell Biol. 19(10):621 (2018)). Variability in TSS selection has been proposed to involve DNA 'scrunching' and 'anti-scrunching,' the hallmarks of which are: (i) forward and reverse movement of the RNA polymerase leading edge, but not trailing edge, relative to DNA, and (ii) expansion and contraction of the transcription bubble. In some embodiments, the target nucleic acid sequence bound by an RNP of the dXR:gRNA system is within 1 kb of a transcription start site (TSS) in the gene. In some embodiments, the target nucleic acid sequence bound by an RNP of the system is within 20 bp, 50 bp, 100 bp, 150 bp, 200 bp, 250 bp, 500 bps, or 1 kb upstream of a TSS of the gene. In some embodiments, the target nucleic acid sequence bound by an RNP of the system is within 20 bp, 50 bp, 100 bp, 150 bp, 200 bp, 250 bp, 500 bps or 1 kb downstream of a TSS of the gene. In some embodiments, the target nucleic acid sequence bound by an RNP of the system is within 500 bps upstream to 500 bps downstream, or 300 bps upstream to 300 bps downstream of a TSS of the gene. In some embodiments, the target nucleic acid sequence bound by an RNP of the system is within 20 bp, 50 bp, 100 bp, 150 bp, 200 bp, 250 bp, 500 bps, or 1 kb of an enhancer of the gene. In some embodiments, the target nucleic acid sequence bound by an RNP of the system of the disclosure is within 1 kb 3' to a 5' untranslated region of the gene. In other embodiments, the target nucleic acid sequence bound by an RNP of the system is within the open reading frame of the gene, inclusive of introns (if any). In some embodiments, the targeting sequence of a gRNA of the system of the disclosure is designed to be specific for an exon of the gene of the target nucleic acid. In a particular embodiment, the targeting sequence of a gRNA of the system of the disclosure is designed to be specific for exon 1 of the gene of the target nucleic acid. In other embodiments, the targeting sequence of a gRNA of the system of the disclosure is designed to be specific for an intron of the gene of the target nucleic acid. In other embodiments, the targeting sequence of the gRNA of the system of the disclosure is designed to be specific for an intron-exon junction of the gene of the target nucleic acid. In other embodiments, the targeting sequence of the gRNA of the system of the disclosure is designed to be specific for a regulatory element of the gene of the target nucleic acid. In other embodiments, the targeting sequence of the gRNA of the system of the disclosure is designed to be complementary to a sequence of an intergenic region of the gene of the target nucleic acid. In other embodiments, the targeting sequence of a gRNA of the system of the disclosure is specific for a junction of the exon, an intron, and/or a regulatory element of the gene. In those cases where the targeting sequence is specific for a regulatory element, such regulatory elements include, but are not limited to promoter regions, enhancer regions, intergenic regions, 5' untranslated regions (5' UTR), 3' untranslated regions (3' UTR), conserved elements, and regions comprising cis-regulatory elements. The promoter region is intended to encompass nucleotides within 5 kb of the initiation point of the encoding sequence or, in the case of gene enhancer elements or conserved elements, can be thousands of bp, hundreds of thousands of bp, or even millions of bp away from the encoding sequence of the gene of the target nucleic acid. In the foregoing, the targets are those in which the encoding gene of the target is intended to be repressed such that the gene product is not expressed or is expressed at a lower level in a cell. In some embodiments, upon binding of the RNP of the system of the disclosure to the binding location of the target nucleic acid, the system is capable of repressing transcription of the gene 5' to the binding location of the RNP. In other embodiments, upon binding of the RNP of the system to the binding location of the target nucleic acid, the system is capable of repressing transcription of the gene 3' to the binding location of the RNP. In some embodiments, upon binding of the RNP of the system to the binding location of the target nucleic acid, the system is capable of repressing transcription of the gene by at least about 10%, at least about 20%, at least about 30%, at least about 40%, at least about 50%, at least about 60%, at least about 70%, at least about 75%, at least about 80%, at least about 85%, at least about 90%, at least about 95%, or at least 99% greater compared to an untreated gene, when assessed in an in vitro assay. In some embodiments, upon binding of the RNP of the system to the binding location of the target nucleic acid, the system is capable of repressing transcription of the gene for at least about 8 hours, at least about 1 day, at least about 7 days, at least about 2 weeks, at least about 3 weeks, at least about 1 month, at least about 2 months, or at least about 6 months, or at least about 1 year.

In some embodiments, the targeting sequence of a gRNA of the system has between 14 and 20 consecutive nucleotides. In some embodiments, the targeting sequence has 14, 15, 16, 17, 18, 19, or 20 consecutive nucleotides. In some embodiments, the targeting sequence of the gRNA of the system consists of 20 consecutive nucleotides. In some embodiments, the targeting sequence consists of 19 consecutive nucleotides. In some embodiments, the targeting sequence consists of 18 consecutive nucleotides. In some embodiments, the targeting sequence consists of 17 consecutive nucleotides. In some embodiments, the targeting sequence consists of 16 consecutive nucleotides. In some embodiments, the targeting sequence consists of 15 consecutive nucleotides. In some embodiments, the targeting sequence has 14, 15, 16, 17, 18, 19, or 20 consecutive nucleotides and the targeting sequence can comprise 0 to 5, 0 to 4, 0 to 3, or 0 to 2 mismatches relative to the target nucleic acid sequence and retain sufficient binding specificity such that the RNP comprising the gRNA comprising the targeting sequence can form a complementary bond with respect to the target nucleic acid.

In some embodiments, dXR:gRNA a repressor system of the disclosure comprises a first gRNA and further comprises a second (and optionally a third, fourth, fifth, or more) gRNA, wherein the second gRNA or additional gRNA has a targeting sequence complementary to a different or overlapping portion of the target nucleic acid sequence compared to the targeting sequence of the first gRNA such that multiple points in the target nucleic acid are targeted, increasing the ability of the system to effectively repress transcription. It will be understood that in such cases, the second or additional gRNA is complexed with an additional copy of the dXR. By selection of the targeting sequences of the gRNA, defined regions of the target nucleic acid sequence can be repressed using the systems described herein.

c. gRNA Scaffolds

With the exception of the targeting sequence region, the remaining regions of the gRNA are referred to herein as the scaffold. In some embodiments, the gRNA scaffolds are variants of reference gRNA wherein mutations, insertions, deletions or domain substitutions are introduced to confer desirable properties on the gRNA.

In some embodiments, a reference gRNA comprises a sequence isolated or derived from Deltaproteobacteria. In some embodiments, the sequence is a CasX tracrRNA sequence.

Exemplary CasX reference tracrRNA sequences isolated or derived from Deltaproteobacteria may include: ACAUCUGGCGCGUUUAUUCCAUUACUUUG-GAGCCAGUCCCAGCGACUAUGUCGU AUGGACGAAGCGCUUAUUUAUCGGAGA (SEQ ID NO: 6) and ACAUCUGGCGCGUUUAUUCCAUUAC-UUUGGAGCCAGUCCCAGCGACUAUGUCGU AUGGACGAAGCGCUUAUUUAUCGG (SEQ ID NO: 7). Exemplary crRNA sequences isolated or derived from Deltaproteobacteria may comprise a sequence of CCGAUA-AGUAAAACGCAUCAAAG (SEQ ID NO: 33271).

In some embodiments, a reference guide RNA comprises a sequence isolated or derived from Planctomycetes. In some embodiments, the sequence is a CasX tracrRNA sequence. Exemplary reference tracrRNA sequences isolated or derived from Planctomycetes may include: UACUGGCGCUUUUAUCUCAUUAC-UUUGAGAGCCAUCACCAGCGACUAUGUCGUA UGGGUAAAGCGCUUAUUUAUCGGAGA (SEQ ID NO: 8) and UACUGGCGCUUUUAUCUCAUUAC-UUUGAGAGCCAUCACCAGCGACUAUG UCGUAUGGGUAAAGCGCUUAUUUAUCGG (SEQ ID NO: 9). Exemplary crRNA sequences isolated or derived from Planctomycetes may comprise a sequence of UCUCCGAUAAAUAAGAAGCAU-CAAAG (SEQ ID NO: 33272).

In some embodiments, a reference gRNA comprises a sequence isolated or derived from *Candidatus Sungbacteria*. In some embodiments, the sequence is a CasX tracrRNA sequence. Exemplary CasX reference tracrRNA sequences isolated or derived from *Candidatus Sungbacteria* may comprise sequences of: GUUUACACACUCCCUCU-CAUAGGGU (SEQ ID NO: 10), GUUUACACACUCC-CUCUCAUGAGGU (SEQ ID NO: 11), UUUUA-CAUACCCCCUCUCAUGGGAU (SEQ ID NO: 12) and GUUUACACACUCCCUCUCAUGGGGG (SEQ ID NO: 13). Table 1 provides the sequences of reference gRNA tracr, cr and scaffold sequences that, in some embodiments, are modified to create the gRNA of the systems. In some embodiments, the disclosure provides gRNA variant sequences wherein the gRNA has a scaffold comprising a sequence having one or more nucleotide modifications relative to a reference gRNA sequence having a sequence of any one of SEQ ID NOS: 4-16 of Table 1. It will be understood that in those embodiments wherein a vector comprises a DNA encoding sequence for a gRNA, that thymine (T) bases can be substituted for the uracil (U) bases of any of the gRNA sequence embodiments described herein.

TABLE 1

Reference gRNA tracr, cr and scaffold sequences

| SEQ ID NO. | Nucleotide Sequence |
|---|---|
| 4 | ACAUCUGGCGCGUUUAUUCCAUUACUUUGGAGCCAGUCCCAGCGACUAUGUCGUAUGGACGAAGC GCUUAUUUAUCGGAGAGAAACCGAUAAGUAAAACGCAUCAAAG |
| 5 | UACUGGCGCUUUUAUCUCAUUACUUUGAGAGCCAUCACCAGCGACUAUGUCGUAUGGGUAAAGCG CUUAUUUAUCGGAGAGAAAUCCGAUAAAUAAGAAGCAUCAAAG |
| 6 | ACAUCUGGCGCGUUUAUUCCAUUACUUUGGAGCCAGUCCCAGCGACUAUGUCGUAUGGACGAAGC GCUUAUUUAUCGGAGA |
| 7 | ACAUCUGGCGCGUUUAUUCCAUUACUUUGGAGCCAGUCCCAGCGACUAUGUCGUAUGGACGAAGC GCUUAUUUAUCGG |
| 8 | UACUGGCGCUUUUAUCUCAUUACUUUGAGAGCCAUCACCAGCGACUAUGUCGUAUGGGUAAAGCG CUUAUUUAUCGGAGA |
| 9 | UACUGGCGCUUUUAUCUCAUUACUUUGAGAGCCAUCACCAGCGACUAUGUCGUAUGGGUAAAGCG CUUAUUUAUCGG |
| 10 | GUUUACACACUCCCUCUCAUAGGGU |
| 11 | GUUUACACACUCCCUCUCAUGAGGU |
| 12 | UUUUACAUACCCCCUCUCAUGGGAU |
| 13 | GUUUACACACUCCCUCUCAUGGGGG |
| 14 | CCAGCGACUAUGUCGUAUGG |
| 15 | GCGCUUAUUUAUCGGAGAGAAAUCCGAUAAAUAAGAAGC |
| 16 | GGCGCUUUUAUCUCAUUACUUUGAGAGCCAUCACCAGCGACUAUGUCGUAUGGGUAAAGCGCUUA UUUAUCGGA |

d. gRNA Variants

In another aspect, the disclosure relates to guide ribonucleic acid variants (referred to herein as "gRNA variant"), which comprise one or more modifications relative to a reference gRNA scaffold. As used herein, "scaffold" refers to all parts to the gRNA necessary for gRNA function with the exception of the spacer sequence.

In some embodiments, a gRNA variant comprises one or more nucleotide substitutions, insertions, deletions, or swapped or replaced regions relative to a reference gRNA sequence of the disclosure. In some embodiments, a mutation can occur in any region of a reference gRNA scaffold to produce a gRNA variant. In some embodiments, the scaffold of the gRNA variant sequence has at least 50%, at least 60%, or at least 70%, at least 80%, at least 85%, at least about 90%, at least about 95%, at least about 96%, at least about 97%, at least about 98%, or at least about 99% identity to the sequence of SEQ ID NO: 4 or SEQ ID NO: 5.

In some embodiments, a gRNA variant comprises one or more nucleotide changes within one or more regions of the reference gRNA scaffold that improve a characteristic of the reference gRNA. Exemplary regions include the RNA triplex, the pseudoknot, the scaffold stem loop, and the extended stem loop. In some cases, the variant scaffold stem further comprises a bubble. In other cases, the variant scaffold further comprises a triplex loop region. In still other cases, the variant scaffold further comprises a 5' unstructured region. In some embodiments, the gRNA variant scaffold comprises a scaffold stem loop having at least 60% sequence identity, at least 70% sequence identity, at least 80% sequence identity, at least 90% sequence identity, at least 95% sequence identity, or at least 99% sequence identity to SEQ ID NO: 14. In some embodiments, the gRNA variant scaffold comprises a scaffold stem loop having at least 60% sequence identity to SEQ ID NO: 14. In other embodiments, the gRNA variant comprises a scaffold stem loop having the sequence of CCAGCGACUAUGUCGUAGUGG (SEQ ID NO: 33273). In other embodiments, the disclosure provides a gRNA scaffold comprising, relative to SEQ ID NO: 5, a C18G substitution, a G55 insertion, a U1 deletion, and a modified extended stem loop in which the original 6 nt loop and 13 most-loop-proximal base pairs (32 nucleotides total) are replaced by a Uvsx hairpin (4 nt loop and 5 loop-proximal base pairs; 14 nucleotides total) and the loop-distal base of the extended stem was converted to a fully base-paired stem contiguous with the new Uvsx hairpin by deletion of the A99 and substitution of G65U. In the foregoing embodiment, the gRNA scaffold comprises the sequence ACUGGCGCUUUUAUCUGAUUACUUUGAGAGCCAUCACCAGCGACUAUGUCGUAG UGGGUAAAGCUCCCUCUUCGGAGGGAGCAUCAAAG (SEQ ID NO: 33274).

All gRNA variants that have one or more improved characteristics, or add one or more new functions when the variant gRNA is compared to a reference gRNA described herein, are envisaged as within the scope of the disclosure. A representative example of such a gRNA variant appropriate for the gene repressor systems is gRNA variant 174 (SEQ ID NO: 2238). Another representative example of such a gRNA variant appropriate for the gene repressor systems is gRNA variant 235 (SEQ ID NO: 2292). In some embodiments, the gRNA variant adds a new function to the RNP comprising the gRNA variant. In some embodiments, the gRNA variant has an improved characteristic selected from: improved stability; improved solubility; improved transcription of the gRNA; improved resistance to nuclease activity; increased folding rate of the gRNA; decreased side product formation during folding; increased productive folding; improved binding affinity to a dXR fusion protein and linked repressor domain(s); improved binding affinity to a target nucleic acid when complexed with a dXR fusion protein and linked repressor domain(s); and improved ability to utilize a greater spectrum of one or more PAM sequences, including ATC, CTC, GTC, or TTC, in the binding of target nucleic acid when complexed with a dXR fusion protein, and any combination thereof. In some cases, the one or more of the improved characteristics of the gRNA variant is at least about 1.1 to about 100,000-fold improved relative to the reference gRNA of SEQ ID NO: 4 or SEQ ID NO: 5. In other cases, the one or more improved characteristics of the gRNA variant is at least about 1.1, at least about 10, at least about 100, at least about 1000, at least about 10,000, at least about 100,000-fold or more improved relative to the reference gRNA of SEQ ID NO: 4 or SEQ ID NO: 5. In other cases, the one or more of the improved characteristics of the gRNA variant is about 1.1 to 100,00-fold, about 1.1 to 10,00-fold, about 1.1 to 1,000-fold, about 1.1 to 500-fold, about 1.1 to 100-fold, about 1.1 to 50-fold, about 1.1 to 20-fold, about 10 to 100,00-fold, about 10 to 10,00-fold, about 10 to 1,000-fold, about 10 to 500-fold, about 10 to 100-fold, about 10 to 50-fold, about 10 to 20-fold, about 2 to 70-fold, about 2 to 50-fold, about 2 to 30-fold, about 2 to 20-fold, about 2 to 10-fold, about 5 to 50-fold, about 5 to 30-fold, about 5 to 10-fold, about 100 to 100,00-fold, about 100 to 10,00-fold, about 100 to 1,000-fold, about 100 to 500-fold, about 500 to 100,00-fold, about 500 to 10,00-fold, about 500 to 1,000-fold, about 500 to 750-fold, about 1,000 to 100,00-fold, about 10,000 to 100,00-fold, about 20 to 500-fold, about 20 to 250-fold, about 20 to 200-fold, about 20 to 100-fold, about 20 to 50-fold, about 50 to 10,000-fold, about 50 to 1,000-fold, about 50 to 500-fold, about 50 to 200-fold, or about 50 to 100-fold, improved relative to the reference gRNA of SEQ ID NO: 4 or SEQ ID NO: 5. In other cases, the one or more improved characteristics of the gRNA variant is about 1.1-fold, 1.2-fold, 1.3-fold, 1.4-fold, 1.5-fold, 1.6-fold, 1.7-fold, 1.8-fold, 1.9-fold, 2-fold, 3-fold, 4-fold, 5-fold, 6-fold, 7-fold, 8-fold, 9-fold, 10-fold, 11-fold, 12-fold, 13-fold, 14-fold, 15-fold, 16-fold, 17-fold, 18-fold, 19-fold, 20-fold, 25-fold, 30-fold, 40-fold, 45-fold, 50-fold, 55-fold, 60-fold, 70-fold, 80-fold, 90-fold, 100-fold, 110-fold, 120-fold, 130-fold, 140-fold, 150-fold, 160-fold, 170-fold, 180-fold, 190-fold, 200-fold, 210-fold, 220-fold, 230-fold, 240-fold, 250-fold, 260-fold, 270-fold, 280-fold, 290-fold, 300-fold, 310-fold, 320-fold, 330-fold, 340-fold, 350-fold, 360-fold, 370-fold, 380-fold, 390-fold, 400-fold, 425-fold, 450-fold, 475-fold, or 500-fold improved relative to the reference gRNA of SEQ ID NO: 4 or SEQ ID NO: 5.

In some embodiments, a gRNA variant can be created by subjecting a reference gRNA to a one or more mutagenesis methods, such as the mutagenesis methods described herein, below, which may include Deep Mutational Evolution (DME), deep mutational scanning (DMS), error prone PCR, cassette mutagenesis, random mutagenesis, staggered extension PCR, gene shuffling, or domain swapping, in order to generate the gRNA variants of the disclosure. The activity of reference gRNAs may be used as a benchmark against which the activity of gRNA variants are compared, thereby measuring improvements in function of gRNA variants. In other embodiments, a reference gRNA may be subjected to one or more deliberate, targeted mutations, substitutions, or domain swaps in order to produce a gRNA variant, for example a rationally designed variant. Exemplary gRNA variants produced by such methods are presented in Table 2.

In some embodiments, the gRNA variant comprises one or more modifications compared to a reference guide ribonucleic acid scaffold sequence, wherein the one or more modification is selected from: at least one nucleotide substitution in a region of the reference gRNA; at least one nucleotide deletion in a region of the reference gRNA; at least one nucleotide insertion in a region of the reference gRNA; a substitution of all or a portion of a region of the reference gRNA; a deletion of all or a portion of a region of the reference gRNA; or any combination of the foregoing. In some cases, the modification is a substitution of 1 to 15 consecutive or non-consecutive nucleotides in the reference gRNA in one or more regions. In other cases, the modification is a deletion of 1 to 10 consecutive or non-consecutive nucleotides in the reference gRNA in one or more regions. In other cases, the modification is an insertion of 1 to 10 consecutive or non-consecutive nucleotides in the reference gRNA in one or more regions. In other cases, the modification is a substitution of the scaffold stem loop or the extended stem loop with an RNA stem loop sequence from a heterologous RNA source with proximal 5' and 3' ends. In some cases, a gRNA variant of the disclosure comprises two or more modifications in one region relative to a reference gRNA. In other cases, a gRNA variant of the disclosure comprises modifications in two or more regions. In other cases, a gRNA variant comprises any combination of the foregoing modifications described in this paragraph.

In some embodiments, a 5' G is added to a gRNA variant sequence, relative to a reference gRNA, for expression in vivo, as transcription from a U6 promoter is more efficient and more consistent with regard to the start site when the +1 nucleotide is a G. In other embodiments, two 5' Gs are added to generate a gRNA variant sequence for in vitro transcription to increase production efficiency, as T7 polymerase strongly prefers a G in the +1 position and a purine in the +2 position. In some cases, the 5' G bases are added to the reference scaffolds of Table 1. In other cases, the 5' G bases are added to the variant scaffolds of Table 2.

Table 2 provides exemplary gRNA variant scaffold sequences. In some embodiments, the gRNA variant scaffold comprises any one of the sequences listed in Table 2, or a sequence having at least about 50%, at least about 60%, at least about 70%, at least about 80%, at least about 90%, at least about 95%, at least about 95%, at least about 96%, at least about 97%, at least about 98%, at least about 99% sequence identity thereto. It will be understood that in those embodiments wherein a vector comprises a DNA encoding sequence for a gRNA, that thymine (T) bases can be substituted for the uracil (U) bases of any of the gRNA sequence embodiments described herein.

TABLE 2

Exemplary gRNA Variant Scaffold Sequences

| SEQ ID NO. | Guide No. | Sequence |
|---|---|---|
| 2238 | 174 | ACUGGCGCUUUUAUCUGAUUACUUUGAGAGCCAUCACCAGCGACUAUGUCGUAGUG GGUAAAGCUCCCUCUUCGGAGGGAGCAUCAAAG |
| 2239 | 175 | ACUGGCGCCUUUAUCUCAUUACUUUGAGAGCCAUCACCAGCGACUAUGUCGUAUGG GUAAAGCGCUUACGGACUUCGGUCCGUAAGAAGCAUCAAAG |
| 2240 | 176 | GCUGGCGCUUUUAUCUGAUUACUUUGAGAGCCAUCACCAGCGACUAUGUCGUAGUG GGUAAAGCUCCCUCUUCGGAGGGAGCAUCAAAG |
| 2241 | 177 | ACUGGCGCUUUUAUCUGAUUACUUUGAGAGCCAUCACCAGCGACUAUGUCGUAUGG GUAAAGCUCCCUCUUCGGAGGGAGCAUCAAAG |
| 2242 | 181 | ACUGGCGCCUUUAUCUGAUUACUUUGAGAGCCAUCACCAGCGACUAUGUCGUAUGG GUAAAGCGCUUACGGACUUCGGUCCGUAAGAAGCAUCAAAG |
| 2243 | 182 | ACUGGCGCUUUUAUCUGAUUACUUUGAGAGCCAUCACCAGCGACUAUGUCGUAUGG GUAAAGCGCUUACGGACUUCGGUCCGUAAGAAGCAUCAAAG |
| 2244 | 183 | ACUGGCGCUUUUAUCUGAUUACUUUGAGAGCCAUCACCAGCGACUAUGUCGUAGUG GGUAAAGCGCUUACGGACUUCGGUCCGUAAGAAGCAUCAAAG |
| 2245 | 184 | ACUGGCGCUUUUAUCUGAUUACUUUGAGAGCCAUCACCAGCGACUAUGUCGUAUUG GGUAAAGCUCCCUCUUCGGAGGGAGCAUCAAAG |
| 2246 | 185 | ACUGGCGCUUUUAUCUGAUUACUUUGAGAGCCAUCACCAGCGACUAUGUCGUAUUG GGUAAAGCGCUUACGGACUUCGGUCCGUAAGAAGCAUCAAAG |
| 2247 | 186 | ACUGGCGCCUUUAUCAUCAUUACUUUGAGAGCCAUCACCAGCGACUAUGUCGUAUG GGUAAAGCGCUUACGGACUUCGGUCCGUAAGAAGCAUCAAAG |
| 2248 | 187 | ACUGGCGCUUUUAUCUGAUUACUUUGAGAGCCAUCACCAGCGACUAUGUCGUAGUG GGUAAAGCGCCCUCUUCGGAGGGAAGCAUCAAAG |
| 2249 | 188 | ACUGGCGCUUUUAUCUGAUUACUUUGAGAGCCAUCACCAGCGACUAUGUCGUAGUG GGUAAAGCUCACAUGAGGAUCACCCAUGUGAGCAUCAAAG |
| 2250 | 189 | ACUGGCACUUUUACCUGAUUACUUUGAGAGCCAACACCAGCGACUAUGUCGUAGUG GGUAAAGCUCCCUCUUCGGAGGGAGCAUCAAAG |
| 2251 | 190 | ACUGGCACUUUUAUCUGAUUACUUUGAGAGCCAUCACCAGCGACUAUGUCGUAGUG GGUAAAGCUCCCUCUUCGGAGGGAGCAUCAAAG |

TABLE 2-continued

Exemplary gRNA Variant Scaffold Sequences

| SEQ ID NO. | Guide No. | Sequence |
|---|---|---|
| 2252 | 191 | ACUGGCCCUUUUAUCUGAUUACUUUGAGAGCCAUCACCAGCGACUAUGUCGUAGUG GGUAAAGCUCCCUCUUCGGAGGGAGCAUCAAAG |
| 2253 | 192 | ACUGGCGCUUUUACCUGAUUACUUUGAGAGCCAUCACCAGCGACUAUGUCGUAGUG GGUAAAGCUCCCUCUUCGGAGGGAGCAUCAAAG |
| 2254 | 193 | ACUGGCGCUUUUAUCUGAUUACUUUGAGAGCCAACACCAGCGACUAUGUCGUAGUG GGUAAAGCUCCCUCUUCGGAGGGAGCAUCAAAG |
| 2255 | 195 | ACUGGCACCUUUACCUGAUUACUUUGAGAGCCAACACCAGCGACUAUGUCGUAUGG GUAAAGCGCUUACGGACUUCGGUCCGUAAGAAGCAUCAAAG |
| 2256 | 196 | ACUGGCACCUUUAUCUGAUUACUUUGAGAGCCAUCACCAGCGACUAUGUCGUAUGG GUAAAGCGCUUACGGACUUCGGUCCGUAAGAAGCAUCAAAG |
| 2257 | 197 | ACUGGCCCCUUUAUCUGAUUACUUUGAGAGCCAUCACCAGCGACUAUGUCGUAUGG GUAAAGCGCUUACGGACUUCGGUCCGUAAGAAGCAUCAAAG |
| 2258 | 198 | ACUGGCGCCUUUAUCUGAUUACUUUGAGAGCCAACACCAGCGACUAUGUCGUAUGG GUAAAGCGCUUACGGACUUCGGUCCGUAAGAAGCAUCAAAG |
| 2259 | 199 | GCUGGCGCUUUUAUCUGAUUACUUUGAGAGCCAUCACCAGCGACUAUGUCGUAGUG GGUAAAGCUCCCUCUUCGGAGGGAGCAUCAAAG |
| 2260 | 200 | GACUGGCGCUUUUAUCUGAUUACUUUGAGAGCCAUCACCAGCGACUAUGUCGUAGU GGGUAAAGCUCCCUCUUCGGAGGGAGCAUCAAAG |
| 2261 | 201 | ACUGGCGCCUUUAUCUGAUUACUUUGGAGAGCCAUCACCAGCGACUAUGUCGUAGU GGGUAAAGCUCCCUCUUCGGAGGGAGCAUCAAAG |
| 2262 | 202 | ACUGGCGCAUUUAUCUGAUUACUUUGUGAGCCAUCACCAGCGACUAUGUCGUAGUG GGUAAAGCUCCCUCUUCGGAGGGAGCAUCAAAG |
| 2263 | 203 | ACUGGCGCCUUUAUCUGAUUACUUUGAGAGCCAUCACCAGCGACUAUGUCGUAGUG GGUAAAGCUCCCUCUUCGGAGGGAGCAUCAAAG |
| 2264 | 204 | ACUGGCGCUUUUAUCUGAUUACUUUGGAGAGCCAUCACCAGCGACUAUGUCGUAGU GGGUAAAGCUCCCUCUUCGGAGGGAGCAUCAAAG |
| 2265 | 205 | ACUGGCGCAUUUAUCUGAUUACUUUGAGAGCCAUCACCAGCGACUAUGUCGUAGUG GGUAAAGCUCCCUCUUCGGAGGGAGCAUCAAAG |
| 2266 | 206 | ACUGGCGCUUUUAUCUGAUUACUUUGUGAGCCAUCACCAGCGACUAUGUCGUAGUG GGUAAAGCUCCCUCUUCGGAGGGAGCAUCAAAG |
| 2267 | 207 | ACUGGCGCUUUUAUUCUGAUUACUUUGAGAGCCAUCACCAGCGACUAUGUCGUAGU GGGUAAAGCUCCCUCUUCGGAGGGAGCAUCAAAG |
| 2268 | 208 | ACGGCGCUUUUAUCUGAUUACUUUGAGAGCCAUCACCAGCGACUAUGUCGUAGUGG GUAAAGCUCCCUCUUCGGAGGGAGCAUCAAAG |
| 2269 | 209 | ACUGGCGCUUUUAUAUGAUUACUUUGAGAGCCAUCACCAGCGACUAUGUCGUAGUG GGUAAAGCUCCCUCUUCGGAGGGAGCAUCAAAG |
| 2270 | 210 | ACUGGCGCUUUUAUCUUGAUUACUUUGAGAGCCAUCACCAGCGACUAUGUCGUAGU GGGUAAAGCUCCCUCUUCGGAGGGAGCAUCAAAG |
| 2271 | 211 | ACUGGCGCUUUUAUCUGAUUACUUUGAGAGCCAGCACCAGCGACUAUGUCGUAGUG GGUAAAGCUCCCUCUUCGGAGGGAGCAUCAAAG |
| 2272 | 212 | ACUGGCGCUGUUAUCUGAUUACUUCGAGAGCCAUCACCAGCGACUAUGUCGUAGUG GGUAAAGCUCCCUCUUCGGAGGGAGCAUCGAAG |
| 2273 | 213 | ACUGGCGCUCUUAUCUGAUUACUUCGAGAGCCAUCACCAGCGACUAUGUCGUAGUG GGUAAAGCUCCCUCUUCGGAGGGAGCAUCGAAG |
| 2274 | 214 | ACUGGCGCUUGUAUCUGAUUACUCUGAGAGCCAUCACCAGCGACUAUGUCGUAGUG GGUAAAGCUCCCUCUUCGGAGGGAGCAUCAGAG |
| 2275 | 215 | ACUGGCGCUUCUAUCUGAUUACUCUGAGAGCCAUCACCAGCGACUAUGUCGUAGUG GGUAAAGCUCCCUCUUCGGAGGGAGCAUCAGAG |
| 2276 | 216 | ACUGGCGCUUUGAUCUGAUUACCUUGAGAGCCAUCACCAGCGACUAUGUCGUAGUG GGUAAAGCUCCCUCUUCGGAGGGAGCAUCAAGG |

TABLE 2-continued

Exemplary gRNA Variant Scaffold Sequences

| SEQ ID NO. | Guide No. | Sequence |
|---|---|---|
| 2277 | 217 | ACUGGCGCUUUCAUCUGAUUACCUUGAGAGCCAUCACCAGCGACUAUGUCGUAGUGGGUAAAGCUCCCUCUUCGGAGGGAGCAUCAAGG |
| 2278 | 218 | ACUGGCGCUGUUAUCUGAUUACUUUGAGAGCCAUCACCAGCGACUAUGUCGUAGUGGGUAAAGCUCCCUCUUCGGAGGGAGCAUCAAAG |
| 2279 | 219 | ACUGGCGCUUUUAUCUGAUUACUUUGAGAGCCAUCACCAGCGACUAUGUCGUAGUGGGUAAAGCUCCCUCUUCGGAGGGAGCAUCGAAG |
| 2280 | 220 | ACUGGCGCUUUUAUCUGAUUACUUCGAGAGCCAUCACCAGCGACUAUGUCGUAGUGGGUAAAGCUCCCUCUUCGGAGGGAGCAUCAAAG |
| 2281 | 221 | ACUGGCACUUCUAUCUGAUUACUCUGAGAGCCAUCACCAGCGACUAUGUCGUAUGGGUAAAGCCGCUUACGGACUUCGGUCCGUAAGAGGCAUCAGAG |
| 2282 | 222 | ACUGGCACUUCUAUCUGAUUACUCUGAGAGCCAUCACCAGCGACUAUGUCGUAGUGGGUAAAGCUCCCUCUUCGGAGGGAGCAUCAGAG |
| 2283 | 223 | ACUGGCACCUUUAUCUGAUUACUUUGAGAGCCAUCACCAGCGACUAUGUCGUAUGGGUAAAGCCGCUUACGGACUUCGGUCCGUAAGAGGCAUCAAAG |
| 2284 | 224 | ACUGGCACUUGUAUCUGAUUACUCUGAGAGCCAUCACCAGCGACUAUGUCGUAUGGGUAAAGCCGCUUACGGACUUCGGUCCGUAAGAGGCAUCAGAG |
| 2285 | 225 | ACUGGCACUUGUAUCUGAUUACUCUGAGAGCCAUCACCAGCGACUAUGUCGUAGUGGGUAAAGCUCCCUCUUCGGAGGGAGCAUCAGAG |
| 2286 | 229 | ACUGGCACUUUUAUCUGAUUACUUUGAGAGCCAUCACCAGCGACUAUGUCGUAUGGGUAAAGCGCUUACGGACUUCGGUCCGUAAGAAGCAUCAAAG |
| 2287 | 230 | ACUGGCACUUCUAUCUGAUUACUCUGAGAGCCAUCACCAGCGACUAUGUCGUAUGGGUAAAGCGCUUACGGACUUCGGUCCGUAAGAAGCAUCAGAG |
| 2288 | 231 | ACUGGCGCUUCUAUCUGAUUACUCUGAGAGCCAUCACCAGCGACUAUGUCGUAUGGGUAAAGCCGCUUACGGACUUCGGUCCGUAAGAGGCAUCAGAG |
| 2289 | 232 | ACUGGCACUUCUAUCUGAUUACUCUGAGCGCCAUCACCAGCGACUAUGUCGUAUGGGUAAAGCCGCUUACGGACUUCGGUCCGUAAGAGGCAUCAGAG |
| 2290 | 233 | ACUGGCGCUUCUAUCUGAUUACUCUGAGCGCCAUCACCAGCGACUAUGUCGUAUGGGUAAAGCCGCUUACGGACUUCGGUCCGUAAGAGGCAUCAGAG |
| 2291 | 234 | ACUGGCGCUUCUAUCUGAUUACUCUGAGCGCCAUCACCAGCGACUAUGUCGUAUGGGUAAAGCGCCUUACGGACUUCGGUCCGUAAGGAGCAUCAGAG |
| 2292 | 235 | ACUGGCGCUUCUAUCUGAUUACUCUGAGCGCCAUCACCAGCGACUAUGUCGUAGUGGGUAAAGCCGCUUACGGACUUCGGUCCGUAAGAGGCAUCAGAG |
| 2293 | 236 | ACGGGACUUUCUAUCUGAUUACUCUGAAGUCCCUCACCAGCGACUAUGUCGUAUGGGUAAAGCCGCUUACGGACUUCGGUCCGUAAGAGGCAUCAGAG |
| 2294 | 237 | ACCUGUAGUUCUAUCUGAUUACUCUGACUACAGUCACCAGCGACUAUGUCGUAUGGGUAAAGCCGCUUACGGACUUCGGUCCGUAAGAGGCAUCAGAG |
| 2295 | 238 | ACUGGCGCUUUUAUCUGAUUACUUUGAGAGCCAUCACCAGCGACUAUGUCGUAGUGGGUAAAGCUGCACGGUGGGCGCAGCUUCGGCUGACGGUACACCGUGCAGCAUCAAAG |
| 2296 | 239 | ACUGGCGCUUUUAUCUGAUUACUUUGAGAGCCAUCACCAGCGACUAUGUCGUAGUGGGUAAAGCUGCACGGUGGGCGCAGCUUCGGCUGACGGUACACCGGUGGGCGCAGCUUCGGCUGACGGUACACCGUGCAGCAUCAAAG |
| 2297 | 240 | ACUGGCGCUUUUAUCUGAUUACUUUGAGAGCCAUCACCAGCGACUAUGUCGUAGUGGGUAAAGCUGCACGGUGGGCGCAGCUUCGGCUGACGGUACACCGGUGGGCGCAGCUUCGGCUGACGGUACACCGGUGGGCGCAGCUUCGGCUGACGGUACACCGUGCAGCAUCAAAG |
| 2298 | 241 | ACUGGCGCUUUUAUCUGAUUACUUUGAGAGCCAUCACCAGCGACUAUGUCGUAGUGGGUAAAGCUGCACGGUGGGCGCAGCUUCGGCUGACGGUACACCGGUGGGCGCAGCUUCGGCUGACGGUACACCGGUGGGCGCAGCUUCGGCUGACGGUACACCGGUGGGCGCAGCUUCGGCUGACGGUACACCGUGCAGCAUCAAAG |

TABLE 2-continued

Exemplary gRNA Variant Scaffold Sequences

| SEQ ID NO. | Guide No. | Sequence |
|---|---|---|
| 2299 | 242 | ACUGGCGCUUUUAUCUGAUUACUUUGAGAGCCAUCACCAGCGACUAUGUCGUAGUGGGUAAAGCUGCACGGUGGGCGCAGCUUCGGCUGACGGUACACCGGUGGGCGCAGCUUCGGCUGACGGUACACCGGUGGGCGCAGCUUCGGCUGACGGUACACCGGUGGGCGCAGCUUCGGCUGACGGUACACCGGUGGGCGCAGCUUCGGCUGACGGUACACCGUGCAGCAUCAAAG |
| 2300 | 243 | ACUGGCGCUUUUAUCUGAUUACUUUGAGAGCCAUCACCAGCGACUAUGUCGUAGUGGGUAAAGCUGCACCUAGCGGAGGCUAGGUGCAGCAUCAAAG |
| 2301 | 244 | ACUGGCGCUUUUAUCUGAUUACUUUGAGAGCCAUCACCAGCGACUAUGUCGUAGUGGGUAAAGCUGCACCUCGGCUUGCUGAAGCGCGCACGGCAAGAGGCGAGGUGCAGCAUCAAAG |
| 2302 | 245 | ACUGGCGCUUUUAUCUGAUUACUUUGAGAGCCAUCACCAGCGACUAUGUCGUAGUGGGUAAAGCUGCACCUCUCUCGACGCAGGACUCGGCUUGCUGAAGCGCGCACGGCAAGAGGCGAGGGGCGGCGACUGGUGAGUACGCCAAAAAUUUUGACUAGCGGAGGCUAGAAGGAGAGAGGUGCAGCAUCAAAG |
| 2303 | 246 | ACUGGCGCUUUUAUCUGAUUACUUUGAGAGCCAUCACCAGCGACUAUGUCGUAGUGGGUAAAGCUGCACGGUGCCCGUCUGUUGUGUCGAGAGACGCCAAAAAUUUUGACUAGCGGAGGCUAGAAGGAGAGAGAUGGGUGCCGUGCAGCAUCAAAG |
| 2304 | 247 | ACUGGCGCUUUUAUCUGAUUACUUUGAGAGCCAUCACCAGCGACUAUGUCGUAGUGGGUAAAGCUGCACAUGGAGAGGAGAUGUGCAGCAUCAAAG |
| 2305 | 248 | ACUGGCGCUUUUAUCUGAUUACUUUGAGAGCCAUCACCAGCGACUAUGUCGUAGUGGGUAAAGCUGCACAUGGAGAUGUGCAGCAUCAAAG |
| 2306 | 249 | ACUGGCGCUUUUAUCUGAUUACUUUGAGAGCCAUCACCAGCGACUAUGUCGUAGUGGGUAAAGCUUGGGCGCAGCGUCAAUGACGCUGACGGUACAAGCAUCAAAG |
| 2307 | 250 | ACUGGCGCUUUUAUCUGAUUACUUUGAGAGCCAUCACCAGCGACUAUGUCGUAGUGGGUAAAGCUGCACUAUGGGCGCAGCGUCAAUGACGCUGACGGUACAGGCCACAUGAGGAUCACCCAUGUGGUAUAGUGCAGCAUCAAAG |
| 2308 | 251 | ACUGGCGCUUUUAUCUGAUUACUUUGAGAGCCAUCACCAGCGACUAUGUCGUAGUGGGUAAAGCUGCACUAUGGGCGCAGCUCAUGAGGAUCACCCAUGAGCUGACGGUACAGGCCACAUGAGGAUCACCCAUGUGGUAUAGUGCAGCAUCAAAG |
| 2309 | 252 | ACUGGCGCUUUUAUCUGAUUACUUUGAGAGCCAUCACCAGCGACUAUGUCGUAGUGGGUAAAGCUGCACUAUGGGCGCAGCGUCAAUGACGCUGACGGUACAGGCCACAUGGCAGUCGUAACGACGCGGGUGGUAUAGUGCAGCAUCAAAG |
| 2310 | 253 | ACUGGCGCUUUUAUCUGAUUACUUUGAGAGCCAUCACCAGCGACUAUGUCGUAGUGGGUAAAGCUGCACUAUGGGCGCAGCAAACAUGGCAGUCCUAAGGACGCGGGUUUUGCUGACGGUACAGGCCACAUGGCAGUCGUAACGACGCGGGUGGUAUAGUGCAGCAUCAAAG |
| 2311 | 254 | ACUGGCGCUUUUAUCUGAUUACUUUGAGAGCCAUCACCAGCGACUAUGUCGUAGUGGGUAAAGCUGCACUAUGGGCGCAGACAUGGCAGUCGUAACGACGCGGGUCUGACGGUACAGGCCACAUGAGGAUCACCCAUGUGGUAUAGUGCAGCAUCAAAG |
| 2312 | 255 | ACUGGCGCUUUUAUCUGAUUACUUUGAGAGCCAUCACCAGCGACUAUGUCGUAGUGGGUAAAGCUGCACUAAGGAGUUUAUAUGGAAACCCUUAGUGCAGCAUCAAAG |
| 2313 | 256 | ACUGGCGCUUUUAUCUGAUUACUUUGAGAGCCAUCACCAGCGACUAUGUCGUAGUGGGUAAAGCUCAGGAAGCACUAUGGGCGCAGCGUCAAUGACGCUGACGGUACAGGCCAGACAAUUAUUGUCUGGUAUAGUGCAGCAGCAGAACAAUUUGCUGAGGGCUAUUGAGGCGCAACAGCAUCUGUUGCAACUCACAGUCUGGGGCAUCAAGCAGCUCCAGGCAAGAAUCCUGAGCAUCAAAG |
| 2314 | 257 | ACUGGCGCUUUUAUCUGAUUACUUUGAGAGCCAUCACCAGCGACUAUGUCGUAGUGGGUAAAGCUGCACGCCCUGAAGAAGGGCGUGCAGCAUCAAAG |
| 2315 | 258 | ACUGGCGCUUUUAUCUGAUUACUUUGAGAGCCAUCACCAGCGACUAUGUCGUAGUGGGUAAAGCUGCACGGCUCGUGUAGCUCAUUAGCUCCGAGCCGUGCAGCAUCAAAG |
| 2316 | 259 | ACUGGCGCUUUUAUCUGAUUACUUUGAGAGCCAUCACCAGCGACUAUGUCGUAGUGGGUAAAGCUGCACCCGUGUGCAUCCGCAGUGUCGGAUCCACGGGUGCAGCAUCAAAG |
| 2317 | 260 | ACUGGCGCUUUUAUCUGAUUACUUUGAGAGCCAUCACCAGCGACUAUGUCGUAGUGGGUAAAGCUGCACGGAAUCCAUUGCACUCCGGAUUUCACUAGGUGCAGCAUCAAAG |

TABLE 2-continued

| Exemplary gRNA Variant Scaffold Sequences | | |
|---|---|---|
| SEQ ID NO. | Guide No. | Sequence |
| 2318 | 261 | ACUGGCGCUUUUAUCUGAUUACUUUGAGAGCCAUCACCAGCGACUAUGUCGUAGUGGGUAAAGCUGCACAUGCAUGUCUAAGACAGCAUGUGCAGCAUCAAAG |
| 2319 | 262 | ACUGGCGCUUUUAUCUGAUUACUUUGAGAGCCAUCACCAGCGACUAUGUCGUAGUGGGUAAAGCUGCACAAAACAUAAGGAAAACCUAUGUUGUGCAGCAUCAAAG |
| 2320 | 263 | ACUGGCGCUUCUAUCUGAUUACUCUGAGCGCCAUCACCAGCGACUAUGUCGUAGUGGGUAAAGCCGCUUACGGACUAUGGGCGCAGCGUCAAUGACGCUGACGGUACAGGCCAGACAAUUAUUGUCUGGUAUAGUCCGUAAGAGGCAUCAGAG |
| 2321 | 264 | ACUGGCGCUUCUAUCUGAUUACUCUGAGCGCCAUCACCAGCGACUAUGUCGUAGUGGGUAAAGCCGCUUACGGGUGGGCGCAGCGUCAAUGACGCUGACGGUACAGGCCAGACAAUUAUUGUCUGGUACCCGUAAGAGGCAUCAGAG |
| 2322 | 265 | ACUGGCGCUUCUAUCUGAUUACUCUGAGCGCCAUCACCAGCGACUAUGUCGUAGUGGGUAAAGCCGCUUACGGUAUGGGCGCAGCGUCAAUGACGCUGACGGUACAGGCCACAUGAGGAUCACCCAUGUGGUAUACCGUAAGAGGCAUCAGAG |
| 2323 | 266 | ACUGGCGCUUUUAUCUGAUUACUUUGAGAGCCAUCACCAGCGACUAUGUCGUAGUGGGUAAAGCUCCCUAUGGGCGCAGCGUCAAUGACGCUGACGGUACAGGCCACAUGAGGAUCACCCAUGUGGUAUAGGGAGCAUCAAAG |
| 2324 | 267 | ACUGGCGCUUCUAUCUGAUUACUCUGAGCGCCAUCACCAGCGACUAUGUCGUAGUGGGUAAAGCCGCUUACGGUAUGGGCGCAGCUCAUGAGGAUCACCCAUGAGCUGACGGUACAGGCCACAUGAGGAUCACCCAUGUGGUAUACCGUAAGAGGCAUCAGAG |
| 2325 | 268 | ACUGGCGCUUUUAUCUGAUUACUUUGAGAGCCAUCACCAGCGACUAUGUCGUAGUGGGUAAAGCUCCCUAUGGGCGCAGCUCAUGAGGAUCACCCAUGAGCUGACGGUACAGGCCACAUGAGGAUCACCCAUGUGGUAUAGGGAGCAUCAAAG |
| 2326 | 269 | ACUGGCGCUUCUAUCUGAUUACUCUGAGCGCCAUCACCAGCGACUAUGUCGUAGUGGGUAAAGCCGCUUACGGUAUGGGCGCAGCGUCAAUGACGCUGACGGUACAGGCCACAUGGCAGUCGUAACGACGCGGGUGGUAUACCGUAAGAGGCAUCAGAG |
| 2327 | 270 | ACUGGCGCUUUUAUCUGAUUACUUUGAGAGCCAUCACCAGCGACUAUGUCGUAGUGGGUAAAGCUCCCUAUGGGCGCAGCGUCAAUGACGCUGACGGUACAGGCCACAUGGCAGUCGUAACGACGCGGGUGGUAUAGGGAGCAUCAAAG |
| 2328 | 271 | ACUGGCGCUUCUAUCUGAUUACUCUGAGCGCCAUCACCAGCGACUAUGUCGUAGUGGGUAAAGCCGCUUACGGUAUGGGCGCAGCAAACAUGGCAGUCCUAAGGACGCGGGUUUUGCUGACGGUACAGGCCACAUGGCAGUCGUAACGACGCGGGUGGUAUACCGUAAGAGGCAUCAGAG |
| 2329 | 272 | ACUGGCGCUUUUAUCUGAUUACUUUGAGAGCCAUCACCAGCGACUAUGUCGUAGUGGGUAAAGCUCCCUAUGGGCGCAGCAAACAUGGCAGUCCUAAGGACGCGGGUUUUGCUGACGGUACAGGCCACAUGGCAGUCGUAACGACGCGGGUGGUAUAGGGAGCAUCAAAG |
| 2330 | 273 | ACUGGCGCUUCUAUCUGAUUACUCUGAGCGCCAUCACCAGCGACUAUGUCGUAGUGGGUAAAGCCGCUUACGGUAUGGGCGCAGACAUGGCAGUCGUAACGACGCGGGUCUGACGGUACAGGCCACAUGAGGAUCACCCAUGUGGUAUACCGUAAGAGGCAUCAGAG |
| 2331 | 274 | ACUGGCGCUUUUAUCUGAUUACUUUGAGAGCCAUCACCAGCGACUAUGUCGUAGUGGGUAAAGCUCCCUAUGGGCGCAGACAUGGCAGUCGUAACGACGCGGGUCUGACGGUACAGGCCACAUGAGGAUCACCCAUGUGGUAUAGGGAGCAUCAAAG |
| 57544 | 275 | ACUGGCGCUUUUAUCUGAUUACUUUGAGAGCCAUCACCAGCGACUAUGUCGUAGUGGGUAAAGCUGCACUAUGGGCGCAGCACCUGAGGAUCACCCAGGUGCUGACGGUACAGGCCACCUGAGGAUCACCCAGGUGGUAUAGUGCAGCAUCAAAG |
| 57545 | 276 | ACUGGCGCUUUUAUCUGAUUACUUUGAGAGCCAUCACCAGCGACUAUGUCGUAGUGGGUAAAGCUGCACUAUGGGCGCAGCGCAUGAGGAUCACCCAUGCGCUGACGGUACAGGCCGCAUGAGGAUCACCCAUGCGGUAUAGUGCAGCAUCAAAG |
| 57546 | 277 | ACUGGCGCUUUUAUCUGAUUACUUUGAGAGCCAUCACCAGCGACUAUGUCGUAGUGGGUAAAGCUGCACUAUGGGCGCAGCGCCUGAGGAUCACCCAGGCGCUGACGGUACAGGCCGCCUGAGGAUCACCCAGGCGGUAUAGUGCAGCAUCAAAG |
| 57547 | 278 | ACUGGCGCUUUUAUCUGAUUACUUUGAGAGCCAUCACCAGCGACUAUGUCGUAGUGGGUAAAGCUGCACUAUGGGCGCAGCGCCUGAGCAUCAGCCAGGCGCUGACGGUACAGGCCGCCUGAGCAUCAGCCAGGCGGUAUAGUGCAGCAUCAAAG |

TABLE 2-continued

Exemplary gRNA Variant Scaffold Sequences

| SEQ ID NO. | Guide No. | Sequence |
|---|---|---|
| 57548 | 279 | ACUGGCGCUUUUAUCUGAUUACUUUGAGAGCCAUCACCAGCGACUAUGUCGUAGUGGGUAAAGCUGCACUAUGGGCGCAGCACAUGAGCAUCAGCCAUGUGCUGACGGUACAGGCCACAUGAGCAUCAGCCAUGUGGUAUAGUGCAGCAUCAAAG |
| 57549 | 280 | ACUGGCGCUUUUAUCUGAUUACUUUGAGAGCCAUCACCAGCGACUAUGUCGUAGUGGGUAAAGCUGCACUAUGGGCGCAGCACAUGAGUAUCAACCAUGUGCUGACGGUACAGGCCACAUGAGUAUCAACCAUGUGGUAUAGUGCAGCAUCAAAG |
| 57550 | 281 | ACUGGCGCUUUUAUCUGAUUACUUUGAGAGCCAUCACCAGCGACUAUGUCGUAGUGGGUAAAGCUGCACUAUGGGCGCAGCACAUGAGAAUCAGCCAUGUGCUGACGGUACAGGCCACAUGAGAAUCAGCCAUGUGGUAUAGUGCAGCAUCAAAG |
| 57551 | 282 | ACUGGCGCUUUUAUCUGAUUACUUUGAGAGCCAUCACCAGCGACUAUGUCGUAGUGGGUAAAGCUGCACUAUGGGCGCAGCCCUUGAGGAUCACCCAUGUGCUGACGGUACAGGCCCCUUGAGGAUCACCCAUGUGGUAUAGUGCAGCAUCAAAG |
| 57552 | 283 | ACUGGCGCUUUUAUCUGAUUACUUUGAGAGCCAUCACCAGCGACUAUGUCGUAGUGGGUAAAGCUGCACUAUGGGCGCAGCACUUGAGGAUCACCCAUGUGCUGACGGUACAGGCCACUUGAGGAUCACCCAUGUGGUAUAGUGCAGCAUCAAAG |
| 57553 | 284 | ACUGGCGCUUUUAUCUGAUUACUUUGAGAGCCAUCACCAGCGACUAUGUCGUAGUGGGUAAAGCUGCACUAUGGGCGCAGCACCUGAGGAUCACCCAUGUGCUGACGGUACAGGCCACCUGAGGAUCACCCAUGUGGUAUAGUGCAGCAUCAAAG |
| 57554 | 285 | ACUGGCGCUUUUAUCUGAUUACUUUGAGAGCCAUCACCAGCGACUAUGUCGUAGUGGGUAAAGCUGCACUAUGGGCGCAGCACAUGAGGAUCACCUAUGUGCUGACGGUACAGGCCACAUGAGGAUCACCUAUGUGGUAUAGUGCAGCAUCAAAG |
| 57555 | 286 | ACUGGCGCUUUUAUCUGAUUACUUUGAGAGCCAUCACCAGCGACUAUGUCGUAGUGGGUAAAGCUGCACUAUGGGCGCAGCACAUUAGGAUCACCAAUGUGCUGACGGUACAGGCCACAUUAGGAUCACCAAUGUGGUAUAGUGCAGCAUCAAAG |
| 57556 | 287 | ACUGGCGCUUUUAUCUGAUUACUUUGAGAGCCAUCACCAGCGACUAUGUCGUAGUGGGUAAAGCUGCACUAUGGGCGCAGCACAUUAGGAUCACCGAUGUGCUGACGGUACAGGCCACAUUAGGAUCACCGAUGUGGUAUAGUGCAGCAUCAAAG |
| 57557 | 288 | ACUGGCGCUUUUAUCUGAUUACUUUGAGAGCCAUCACCAGCGACUAUGUCGUAGUGGGUAAAGCUGCACUAUGGGCGCAGCACAUUAGGAUCACCUAUGUGCUGACGGUACAGGCCACAUUAGGAUCACCUAUGUGGUAUAGUGCAGCAUCAAAG |
| 57558 | 289 | ACUGGCGCUUUUAUCUGAUUACUUUGAGAGCCAUCACCAGCGACUAUGUCGUAGUGGGUAAAGCUGCACUAUGGGCGCAGCACAUGAGGAUUACCCAUGUGCUGACGGUACAGGCCACAUGAGGAUUACCCAUGUGGUAUAGUGCAGCAUCAAAG |
| 57559 | 290 | ACUGGCGCUUUUAUCUGAUUACUUUGAGAGCCAUCACCAGCGACUAUGUCGUAGUGGGUAAAGCUGCACUAUGGGCGCAGCACAUGAGGAUAACCCAUGUGCUGACGGUACAGGCCACAUGAGGAUAACCCAUGUGGUAUAGUGCAGCAUCAAAG |
| 57560 | 291 | ACUGGCGCUUUUAUCUGAUUACUUUGAGAGCCAUCACCAGCGACUAUGUCGUAGUGGGUAAAGCUGCACUAUGGGCGCAGCACAUGAGGAUGACCCAUGUGCUGACGGUACAGGCCACAUGAGGAUGACCCAUGUGGUAUAGUGCAGCAUCAAAG |
| 57561 | 292 | ACUGGCGCUUUUAUCUGAUUACUUUGAGAGCCAUCACCAGCGACUAUGUCGUAGUGGGUAAAGCUGCACUAUGGGCGCAGCACAUGAGGACCACCCAUGUGCUGACGGUACAGGCCACAUGAGGACCACCCAUGUGGUAUAGUGCAGCAUCAAAG |
| 57562 | 293 | ACUGGCGCUUUUAUCUGAUUACUUUGAGAGCCAUCACCAGCGACUAUGUCGUAGUGGGUAAAGCUGCACUAUGGGCGCAGCAGAUGAGGAUCACCCAUGGGCUGACGGUACAGGCCAGAUGAGGAUCACCCAUGGGGUAUAGUGCAGCAUCAAAG |
| 57563 | 294 | ACUGGCGCUUUUAUCUGAUUACUUUGAGAGCCAUCACCAGCGACUAUGUCGUAGUGGGUAAAGCUGCACUAUGGGCGCAGCACAUGGGGAUCACCCAUGUGCUGACGGUACAGGCCACAUGGGGAUCACCCAUGUGGUAUAGUGCAGCAUCAAAG |
| 57564 | 295 | ACUGGCGCUUUUAUCUGAUUACUUUGAGAGCCAUCACCAGCGACUAUGUCGUAGUGGGUAAAGCUGCACUAUGGGCGCAGCACAUGAGGAUCACCCAUGUGCUGACGGUACAGGCCACAUGAGGAUCACCCAUGUGGUAUAGUGCAGCAUCAAAG |
| 57565 | 296 | ACUGGCGCUUUUAUCUGAUUACUUUGAGAGCCAUCACCAGCGACUAUGUCGUAGUGGGUAAAGCUCACCUGAGGAUCACCCAGGUGAGCAUCAAAG |
| 57566 | 297 | ACUGGCGCUUUUAUCUGAUUACUUUGAGAGCCAUCACCAGCGACUAUGUCGUAGUGGGUAAAGCUCGCAUGAGGAUCACCCAUGCGAGCAUCAAAG |

TABLE 2-continued

| Exemplary gRNA Variant Scaffold Sequences | | |
|---|---|---|
| SEQ ID NO. | Guide No. | Sequence |
| 57567 | 298 | ACUGGCGCUUUUAUCUGAUUACUUUGAGAGCCAUCACCAGCGACUAUGUCGUAGUG GGUAAAGCUCGCCUGAGGAUCACCCAGGCGAGCAUCAAAG |
| 57568 | 299 | ACUGGCGCUUUUAUCUGAUUACUUUGAGAGCCAUCACCAGCGACUAUGUCGUAGUG GGUAAAGCUCGCCUGAGCAUCAGCCAGGCGAGCAUCAAAG |
| 57569 | 300 | ACUGGCGCUUUUAUCUGAUUACUUUGAGAGCCAUCACCAGCGACUAUGUCGUAGUG GGUAAAGCUCACAUGAGCAUCAGCCAUGUGAGCAUCAAAG |
| 57570 | 301 | ACUGGCGCUUUUAUCUGAUUACUUUGAGAGCCAUCACCAGCGACUAUGUCGUAGUG GGUAAAGCUCACAUGAGUAUCAACCAUGUGAGCAUCAAAG |
| 57571 | 302 | ACUGGCGCUUUUAUCUGAUUACUUUGAGAGCCAUCACCAGCGACUAUGUCGUAGUG GGUAAAGCUCACAUGAGAAUCAGCCAUGUGAGCAUCAAAG |
| 57572 | 303 | ACUGGCGCUUUUAUCUGAUUACUUUGAGAGCCAUCACCAGCGACUAUGUCGUAGUG GGUAAAGCUCCCUUGAGGAUCACCCAUGUGAGCAUCAAAG |
| 57573 | 304 | ACUGGCGCUUUUAUCUGAUUACUUUGAGAGCCAUCACCAGCGACUAUGUCGUAGUG GGUAAAGCUCACUUGAGGAUCACCCAUGUGAGCAUCAAAG |
| 57574 | 305 | ACUGGCGCUUUUAUCUGAUUACUUUGAGAGCCAUCACCAGCGACUAUGUCGUAGUG GGUAAAGCUCACCUGAGGAUCACCCAUGUGAGCAUCAAAG |
| 57575 | 306 | ACUGGCGCUUUUAUCUGAUUACUUUGAGAGCCAUCACCAGCGACUAUGUCGUAGUG GGUAAAGCUCACAUGAGGAUCACCUAUGUGAGCAUCAAAG |
| 57576 | 307 | ACUGGCGCUUUUAUCUGAUUACUUUGAGAGCCAUCACCAGCGACUAUGUCGUAGUG GGUAAAGCUCACAUUAGGAUCACCAAUGUGAGCAUCAAAG |
| 57577 | 308 | ACUGGCGCUUUUAUCUGAUUACUUUGAGAGCCAUCACCAGCGACUAUGUCGUAGUG GGUAAAGCUCACAUUAGGAUCACCGAUGUGAGCAUCAAAG |
| 57578 | 309 | ACUGGCGCUUUUAUCUGAUUACUUUGAGAGCCAUCACCAGCGACUAUGUCGUAGUG GGUAAAGCUCACAUUAGGAUCACCUAUGUGAGCAUCAAAG |
| 57579 | 310 | ACUGGCGCUUUUAUCUGAUUACUUUGAGAGCCAUCACCAGCGACUAUGUCGUAGUG GGUAAAGCUCACAUGAGGAUUACCCAUGUGAGCAUCAAAG |
| 57580 | 311 | ACUGGCGCUUUUAUCUGAUUACUUUGAGAGCCAUCACCAGCGACUAUGUCGUAGUG GGUAAAGCUCACAUGAGGAUAACCCAUGUGAGCAUCAAAG |
| 57581 | 312 | ACUGGCGCUUUUAUCUGAUUACUUUGAGAGCCAUCACCAGCGACUAUGUCGUAGUG GGUAAAGCUCACAUGAGGAUGACCCAUGUGAGCAUCAAAG |
| 57582 | 313 | ACUGGCGCUUUUAUCUGAUUACUUUGAGAGCCAUCACCAGCGACUAUGUCGUAGUG GGUAAAGCUCACAUGAGGACCACCCAUGUGAGCAUCAAAG |
| 57583 | 314 | ACUGGCGCUUUUAUCUGAUUACUUUGAGAGCCAUCACCAGCGACUAUGUCGUAGUG GGUAAAGCUCAGAUGAGGAUCACCCAUGGGAGCAUCAAAG |
| 57584 | 315 | ACUGGCGCUUUUAUCUGAUUACUUUGAGAGCCAUCACCAGCGACUAUGUCGUAGUG GGUAAAGCUCACAUGGGGAUCACCCAUGUGAGCAUCAAAG |
| 59352 | 316 | ACUGGCGCUUCUAUCUGAUUACUCUGAGCGCCAUCACCAGCGACUAUGUCGUAGUG GGUAAAGCUCCCUCUUCGGAGGGAGCAUCAGAG |
| 57585 | 317 | ACUGGCGCUUCUAUCUGAUUACUCUGAGCGCCAUCACCAGCGACUAUGUCGUAGUG GGUAAAGCUCACAUGAGGAUCACCCAUGUGAGCAUCAGAG |
| 57586 | 318 | ACUGGCGCUUCUAUCUGAUUACUCUGAGCGCCAUCACCAGCGACUAUGUCGUAGUG GGUAAAGCUGCACUAUGGGCGCAGCGUCAAUGACGCUGACGGUACAGGCCACAUGA GGAUCACCCAUGUGGUAUAGUGCAGCAUCAGAG |
| 57587 | 319 | ACUGGCGCUUCUAUCUGAUUACUCUGAGCGCCAUCACCAGCGACUAUGUCGUAGUG GGUAAAGCUGCACUAUGGGCGCAGCUCAUGAGGAUCACCCAUGAGCUGACGGUACA GGCCACAUGAGGAUCACCCAUGUGGUAUAGUGCAGCAUCAGAG |

TABLE 2-continued

Exemplary gRNA Variant Scaffold Sequences

| SEQ ID NO. | Guide No. | Sequence |
|---|---|---|
| 57588 | 320 | ACUGGCGCUUCUAUCUGAUUACUCUGAGCGCCAUCACCAGCGACUAUGUCGUAGUG GGUAAAGCUGCACUAUGGGCGCAGACAUGGCAGUCGUAACGACGCGGGUCUGACGG UACAGGCCACAUGAGGAUCACCCAUGUGGUAUAGUGCAGCAUCAGAG |
| 57589 | 321 | ACUGGCGCUUUUAUCUGAUUACUUUGAGAGCCAUCACCAGCGACUAUGUCGUAGUG GGUAAAGCUGCACUAUGGGGCCACAUGAGGAUCACCCAUGUGGUGUACAGCGCAGC GUCAAUGACGCUGACGAUAGUGCAGCAUCAAAG |

In some embodiments, a gRNA variant of the gene repressor systems comprises a sequence of any one of SEQ ID NOs: 2238-2331, 57544-57589, and 59352, set forth in Table 2. In some embodiments, a gRNA variant comprises a sequence of any one of SEQ ID NOS: 2238, 2241, 2244, 2248, 2249, or 2259-2280. In some embodiments, a gRNA variant comprises a sequence of any one of SEQ ID NOS: 2238, 2241, 2244, 2248, 2249, or 2259-2280. In some embodiments, a gRNA variant comprises a sequence of any one of SEQ ID NOS: 2281-2331. In some embodiments, a gRNA variant comprises a sequence of any one of SEQ ID NOS: 57544-57589 and 59352. In some embodiments, a gRNA variant comprises one or more chemical modifications to the sequence.

Additional representative gRNA variant scaffold sequences for use with the gene repressor systems of the instant disclosure are included as SEQ ID NOS: 2101-2237.

e. gRNA 316

Guide scaffolds can be made by several methods, including recombinantly or by solid-phase RNA synthesis. However, the length of the scaffold can affect the manufacturability when using solid-phase RNA synthesis, with longer lengths resulting in increased manufacturing costs, decreased purity and yield, and higher rates of synthesis failures. For use in lipid nanoparticle (LNP) formulations, solid-phase RNA synthesis of the scaffold is preferred in order to generate the quantities needed for commercial development. While previous experiments had identified gRNA scaffold 235 (SEQ ID NO: 2292) as having enhanced properties relative to gRNA scaffold 174 (SEQ ID NO: 2238) its increased length rendered its use for LNP formulations problematic. Accordingly, alternative sequences were sought. In some embodiments, the disclosure provides gRNA wherein the gRNA and linked targeting sequence has a sequence less than about 120 nucleotides, less than about 110 nucleotides, or less than about 100 nucleotides.

In one embodiment, a scaffold was designed wherein the scaffold 235 sequence was modified by a domain swap in which the extended stem loop of scaffold 174 replaced the extended stem loop of the 235 scaffold, resulting in the chimeric RNA scaffold 316 having the sequence ACUGGCGCUUCUAUCUGAUUACUCUGAGCGCCAUCACCAGCGACUAUGUCGUAGU GGGUAAAGCUCCCUCUUCGGAGGGAGCAUCAGAG (SEQ ID NO: 59352), having 89 nucleotides, compared with the 99 nucleotides of gRNA scaffold 235. In addition to improvements in manufacturability, the 316 scaffold was determined to perform comparably or more favorably than gRNA scaffold 174 in editing assays, as described in the Examples. The resulting 316 scaffold had the further advantage in that the extended stem loop did not contain CpG motifs; an enhanced property described more fully, below.

f. Chemically-Modified Scaffolds

In another aspect, the present disclosure relates to gRNAs having chemical modifications. In some embodiments, the chemical modification is addition of a 2'O-methyl group to one or more nucleotides of the sequence. In some embodiments, the chemical modification is substitution of a phosphorothioate bond between two or more nucleotides of the sequence.

g. Stem Loop Modifications

In some embodiments, the gRNA variant of the gene repressor systems comprises an exogenous extended stem loop, with such differences from a reference gRNA described as follows. In some embodiments, an exogenous extended stem loop has little or no identity to the reference stem loop regions disclosed herein (e.g., SEQ ID NO: 15). In some embodiments, an exogenous stem loop is at least 10 bp, at least 20 bp, at least 30 bp, at least 40 bp, at least 50 bp, at least 60 bp, at least 70 bp, at least 80 bp, at least 90 bp, at least 100 bp, at least 200 bp, at least 300 bp, at least 400 bp, at least 500 bp, at least 600 bp, at least 700 bp, at least 800 bp, at least 900 bp, or at least 1,000 bp. In some embodiments, the gRNA variant comprises an extended stem loop region comprising at least 10, at least 100, at least 500, or at least 1000 nucleotides. In some embodiments, the heterologous stem loop increases the stability of the gRNA. In some embodiments, the heterologous RNA stem loop is capable of binding a protein, an RNA structure, a DNA sequence, or a small molecule. In some embodiments, an exogenous stem loop region comprises one or more RNA stem loops or hairpins, for example a thermostable RNA such as MS2 binding (or tagging) sequence (ACAUGAGGAUCACCCAUGU (SEQ ID NO: 33276), Qβ hairpin (AUGCAUGUCUAAGACAGCAU (SEQ ID NO: 33277)), U1 hairpin II (GGAAUCCAUUGCACUCCGGAUUUCACUAG (SEQ ID NO: 33278)), Uvsx (CCUCUUCGGAGG (SEQ ID NO: 33279)), PP7 (AAGGAGUUUAUAUGGAAACCCUU (SEQ ID NO: 33280)), Phage replication loop (AGGUGGGACGACCUCUCGGUCGUCCUAUCU (SEQ ID NO: 33281)), Kissing loop. a (UGCUCGCUCCGUUCGAGCA (SEQ ID NO: 33282)), Kissing loop_b1 (UGCUCGACGCGUCCUCGAGCA (SEQ ID NO: 33283)), Kissing loop_b2 (UGCUCGUUUGCGGCUACGAGCA (SEQ ID NO: 33284)), G quadriplex M3q (AGGGAGGGAGGGAGAGG (SEQ ID NO: 33285)), G quadriplex telomere basket (GGUUAGGGUUAGGGUUAGG (SEQ ID NO: 33286)), Sarcin-ricin loop (CUGCUCAGUACGAGAGGAACCGCAG (SEQ ID NO: 33287)), Pseudoknots (UACACUGGGAUCGCUGAAUUAGAGAUCGGCGUCCUUUCAUUCUAUAUACUUUGG AGUUUUAAAAUGUCUCUAAGUACA (SEQ ID NO: 33288)), transactivation response element (TAR) (GGCUCGUGUAGCU- CAUUAGCUCCGAGCC (SEQ ID NO: 57741)), iron responsive element (IRE) CCGUGUGCAUCCGCAGUGUCGGAUCCACGG (SEQ ID NO: 57742)), transactivation response element (TAR) GGCUCGUGUAGCUCAUUAGCUCCGAGCC (SEQ ID NO: 57743)), phage GA hairpin (AAAACAUAAGGAAAACCUAUGUU (SEQ ID NO: 57744)), phage AN hairpin (GCCCUGAAGAAGGGC (SEQ ID NO: 57745)), or sequence variants thereof. In some embodiments, one of the foregoing hairpin sequences is incorporated into the stem loop to help traffic the incorporation of the gRNA (and an associated CasX in an RNP complex) into a budding XDP (described more fully, below).

In some embodiments, a sgRNA variant of the gene repressor systems of the disclosure comprises one or more additional changes to a previously generated variant, the previously generated variant itself serving as the reference sequence. In some embodiments, a sgRNA variant comprises one or more additional changes to a sequence of SEQ ID NO: 2238, SEQ ID NO: 2239, SEQ ID NO: 2240, SEQ ID NO: 2241, SEQ ID NO: 2241, SEQ ID NO: 2274, SEQ ID NO: 2275, SEQ ID NO: 2279, or SEQ ID NO: 59352.

In exemplary embodiments, a sgRNA variant comprises one or more additional changes to a sequence of SEQ ID NO: 2238 (Variant Scaffold 174, referencing Table 2).

In exemplary embodiments, a sgRNA variant comprises one or more additional changes to a sequence of SEQ ID NO: 2239 (Variant Scaffold 175, referencing Table 2).

In exemplary embodiments, a sgRNA variant comprises one or more additional changes to a sequence of SEQ ID NO: 2275 (Variant Scaffold 215, referencing Table 2).

In exemplary embodiments, a sgRNA variant comprises one or more additional changes to a sequence of SEQ ID NO: 2292 (Variant Scaffold 235, referencing Table 2).

In exemplary embodiments, a sgRNA variant comprises one or more additional changes to a sequence of SEQ ID NO: 59352 (Variant Scaffold 316, referencing Table 2).

h. Complex Formation with dCasX Protein

In some embodiments, a gRNA variant of the disclosure has an improved affinity for a dCasX and linked repressor domain(s) when compared to a reference gRNA, thereby improving its ability to form a ribonucleoprotein (RNP) complex with the dCasX protein and linked repressor domain(s). Improving ribonucleoprotein complex formation may, in some embodiments, improve the efficiency with which functional RNPs are assembled. In some embodiments, greater than 90%, greater than 93%, greater than 95%, greater than 96%, greater than 97%, greater than 98% or greater than 99% of RNPs comprising a gRNA variant and a spacer are competent for binding to a target nucleic acid.

Exemplary nucleotide changes that can improve the ability of gRNA variants to form a complex with dXR may, in some embodiments, include replacing the scaffold stem with a thermostable stem loop. Without wishing to be bound by any theory, replacing the scaffold stem with a thermostable stem loop could increase the overall binding stability of the gRNA variant with the dXR. Alternatively, or in addition, removing a large section of the stem loop could change the gRNA variant folding kinetics and make a functional folded gRNA easier and quicker to structurally-assemble, for example by lessening the degree to which the gRNA variant can get "tangled" in itself. In some embodiments, choice of scaffold stem loop sequence could change with different spacers that are utilized for the gRNA. In some embodiments, scaffold sequence can be tailored to the spacer and therefore the target sequence. Biochemical assays can be used to evaluate the binding affinity of dXR for the gRNA variant to form the RNP, including the assays of the Examples. For example, a person of ordinary skill can measure changes in the amount of a fluorescently tagged gRNA that is bound to an immobilized dXR, as a response to increasing concentrations of an additional unlabeled "cold competitor" gRNA. Alternatively, or in addition, fluorescence signal can be monitored to or seeing how it changes as different amounts of fluorescently-labeled gRNA are flowed over immobilized dXR. Alternatively, the ability to form an RNP can be assessed using in vitro assays against a defined target nucleic acid sequence.

i. Adding or Changing gRNA Function

In some embodiments, gRNA variants of the system can comprise larger structural changes that change the topology of the gRNA variant with respect to the reference gRNA, thereby allowing for different gRNA functionality. For example, in some embodiments a gRNA variant has swapped an endogenous stem loop of the reference gRNA scaffold with a previously identified stable RNA structure or a stem loop that can interact with a protein or RNA binding partner to recruit additional moieties to the dCasX variant or to recruit dCasX variant to a specific location, such as the inside of a XDP capsid, that has the binding partner to the said RNA structure. The RNA binding domain can be a retroviral Psi packaging element inserted into the gRNA or is a stem loop or hairpin (e.g., MS2 hairpin, Qβ hairpin, U1 hairpin II, Uvsx, or PP7 hairpin) with affinity to a protein selected from the group consisting of MS2 coat protein, PP7 coat protein, Qβ coat protein, U1A protein, or phage R-loop, which can facilitate the binding of gRNA to the dCasX variant. Similar RNA components with affinity to protein structures incorporated into the dCasX variant include kissing loop, a, kissing loop_b1, kissing loop_b2, G quadriplex M3q, G quadriplex telomere basket, sarcin-ricin loop, and pseudoknots. In some embodiments, the gRNA variants of the disclosure comprise multiple components of the foregoing, or multiple copies of the same component.

V. CRISPR Proteins of the Gene Repressor Systems

Provided herein are gene repressor systems comprising fusion proteins comprising catalytically dead CRISPR proteins. In some embodiments, the catalytically-dead CRISPR protein is a catalytically-dead class 2 CRISPR protein. Class 2 systems are distinguished from Class 1 systems in that they have a single multi-domain effector protein and are further divided into a Type II, Type V, or Type VI system, described in Makarova, et al. Evolutionary classification of CRISPR-Cas systems: a burst of class 2 and derived variants. *Nature Rev. Microbiol.* 18:67 (2020), incorporated herein by reference. In some embodiments, the catalytically-dead CRISPR protein is a Class 2, Type II CRISPR/Cas nucleases such as Cas9. In other cases, the catalytically-dead CRISPR is a Class 2, Type V CRISPR/Cas nucleases such as a Cas12a (Cpf1), Cas12b (C2c1), Cas12c (C2c3), Cas12d (CasY), Cas12e (CasX), Cas12f, Cas12g, Cas12h, Cas12i, Cas12j, Cas12k, Cas12l, Cas14, and/or CasΦ.

The nucleases of Type V systems differ from Type II effectors (e.g., Cas9), which contain two nuclear domains that are each responsible for the cleavage of one strand of the target DNA, with the HNH nuclease inserted inside the Ruv-C like nuclease domain sequence. The Type V nucleases possess a single RNA-guided RuvC domain-containing effector but no HNH domain, and they recognize a T-rich protospacer adjacent motif (PAM) 5' upstream to the target region on the non-targeted strand, which is different from Cas9 systems which rely on G-rich PAM at 3'side of target sequences. Type V nucleases generate staggered double-stranded breaks distal to the PAM sequence, unlike Cas9, which generates a blunt end in the proximal site close to the PAM. In addition, Type V nucleases degrade ssDNA in trans when activated by target dsDNA or ssDNA binding in cis. In some embodiments, the Type V nucleases utilized in the XDP embodiments recognize a 5' TC PAM motif and produce staggered ends cleaved by the RuvC domain. The Type V systems (e.g., Cas12) only contain a RuvC-like nuclease domain that cleaves both strands. Type VI (Cas13) are unrelated to the effectors of Type II and V systems and contain two HEPN domains and target RNA.

The term "CasX protein", as used herein, refers to a family of proteins, and encompasses all naturally occurring CasX proteins ("reference CasX"), as well as CasX variants possessing one or more improved characteristics relative to a naturally-occurring reference CasX protein. In the context of the present disclosure, catalytically-dead CasX variants are prepared from reference CasX and CasX variant proteins, and exemplary dCasX variant sequences are presented in SEQ ID NOS: 17-36 and 59353-59358 as set forth in Table 4. The CasX and dCasX proteins of the disclosure comprise at least one of the following domains: a non-target strand binding (NTSB) domain, a target strand loading (TSL) domain, a helical I domain, a helical II domain, an oligonucleotide binding domain (OBD), and a RuvC domain (the last of which may be modified or deleted to create the catalytically dead CasX variant), described more fully, below.

a. Reference CasX Proteins

The disclosure provides reference CasX proteins that are naturally-occurring and that were the starting material for the aforementioned protocols for introducing sequence modifications for generation of the dCasX variants. For example, reference CasX proteins can be isolated from naturally occurring prokaryotes, such as Deltaproteobacteria, Planctomycetes, or *Candidatus Sungbacteria* species. A reference CasX protein (sometimes referred to herein as a reference CasX polypeptide) is a type II CRISPR/Cas endonuclease belonging to the CasX (sometimes referred to as Cas12e) family of proteins that is capable of interacting with a guide RNA to form a ribonucleoprotein (RNP) complex.

In some cases, a reference CasX protein is isolated or derived from Deltaproteobacteria having a sequence of:

```
                                                     (SEQ ID NO: 1)
  1 MEKRINKIRK KLSADNATKP VSRSGPMKTL LVRVMTDDLK KRLEKRRKKP EVMPQVISNN

 61 AANNLRMLLD DYTKMKEAIL QVYWQEFKDD HVGLMCKFAQ PASKKIDQNK LKPEMDEKGN

121 LTTAGFACSQ CGQPLFVYKL EQVSEKGKAY TNYFGRCNVA EHEKLILLAQ LKPEKDSDEA

181 VTYSLGKFGQ RALDFYSIHV TKESTHPVKP LAQIAGNRYA SGPVGKALSD ACMGTIASFL

241 SKYQDIIIEH QKVVKGNQKR LESLRELAGK ENLEYPSVTL PPQPHTKEGV DAYNEVIARV

301 RMWVNLNLWQ KLKLSRDDAK PLLRLKGFPS FPVVERRENE VDWWNTINEV KKLIDAKRDM

361 GRVFWSGVTA EKRNTILEGY NYLPNENDHK KREGSLENPK KPAKRQFGDL LLYLEKKYAG

421 DWGKVFDEAW ERIDKKIAGL TSHIEREEAR NAEDAQSKAV LTDWLRAKAS FVLERLKEMD

481 EKEFYACEIQ LQKWYGDLRG NPFAVEAENR VVDISGFSIG SDGHSIQYRN LLAWKYLENG

541 KREFYLLMNY GKKGRIRFTD GTDIKKSGKW QGLLYGGGKA KVIDLTFDPD DEQLIILPLA

601 FGTRQGREFI WNDLLSLETG LIKLANGRVI EKTIYNKKIG RDEPALFVAL TFERREVVDP

661 SNIKPVNLIG VDRGENIPAV IALTDPEGCP LPEFKDSSGG PTDILRIGEG YKEKQRAIQA

721 AKEVEQRRAG GYSRKFASKS RNLADDMVRN SARDLFYHAV THDAVLVFEN LSRGFGRQGK

781 RTFMTERQYT KMEDWLTAKL AYEGLTSKTY LSKTLAQYTS KTCSNCGFTI TTADYDGMLV

841 RLKKTSDGWA TTLNNKELKA EGQITYYNRY KRQTVEKELS AELDRLSEES GNNDISKWTK

901 GRRDEALFLL KKRFSHRPVQ EQFVCLDCGH EVHADEQAAL NIARSWLFLN SNSTEFKSYK

961 SGKQPFVGAW QAFYKRRLKE VWKPNA.
```

In some cases, a reference CasX protein is isolated or derived from Planctomycetes having a sequence of:

```
                                                     (SEQ ID NO: 2)
  1 MQEIKRINKI RRRLVKDSNT KKAGKTGPMK TLLVRVMTPD LRERLENLRK KPENIPQPIS

 61 NTSRANLNKL LTDYTEMKKA ILHVYWEEFQ KDPVGLMSRV AQPAPKNIDQ RKLIPVKDGN

121 ERLTSSGFAC SQCCQPLYVY KLEQVNDKGK PHTNYFGRCN VSEHERLILL SPHKPEANDE

181 LVTYSLGKFG QRALDFYSIH VTRESNHPVK PLEQIGGNSC ASGPVGKALS DACMGAVASF

241 LTKYQDIILE HQKVIKKNEK RLANLKDIAS ANGLAFPKIT LPPQPHTKEG IEAYNNVVAQ

301 IVIWVNLNLW QKLKIGRDEA KPLQRLKGFP SFPLVERQAN EVDWWDMVCN VKKLINEKKE
```

-continued

```
361 DGKVFWQNLA GYKRQEALLP YLSSEEDRKK GKKFARYQFG DLLLHLEKKH GEDWGKVYDE

421 AWERIDKKVE GLSKHIKLEE ERRSEDAQSK AALTDWLRAK ASFVIEGLKE ADKDEFCRCE

481 LKLQKWYGDL RGKPFAIEAE NSILDISGFS KQYNCAFIWQ KDGVKKLNLY LIINYFKGGK

541 LRFKKIKPEA FEANRFYTVI NKKSGEIVPM EVNENFDDPN LIILPLAFGK RQGREFIWND

601 LLSLETGSLK LANGRVIEKT LYNRRTRQDE PALFVALTFE RREVLDSSNI KPMNLIGIDR

661 GENIPAVIAL TDPEGCPLSR FKDSLGNPTH ILRIGESYKE KQRTIQAAKE VEQRRAGGYS

721 RKYASKAKNL ADDMVRNTAR DLLYYAVTQD AMLIFENLSR GFGRQGKRTF MAERQYTRME

781 DWLTAKLAYE GLPSKTYLSK TLAQYTSKTC SNCGFTITSA DYDRVLEKLK KTATGWMTTI

841 NGKELKVEGQ ITYYNRYKRQ NVVKDLSVEL DRLSEESVNN DISSWTKGRS GEALSLLKKR

901 FSHRPVQEKF VCLNCGFETH ADEQAALNIA RSWLFLRSQE YKKYQTNKTT GNTDKRAFVE

961 TWQSFYRKKL KEVWKPAV.
```

In some cases, a reference CasX protein is isolated or derived from *Candidatus Sungbacteria* having a sequence of

```
                                                  (SEQ ID NO: 3)
  1 MDNANKPSTK SLVNTTRISD HFGVTPGQVT RVFSFGIIPT KRQYAIIERW FAAVEAARER

 61 LYGMLYAHFQ ENPPAYLKEK FSYETFFKGR PVLNGLRDID PTIMTSAVFT ALRHKAEGAM

121 AAFHTNHRRL FEEARKKMRE YAECLKANEA LLRGAADIDW DKIVNALRTR LNTCLAPEYD

181 AVIADFGALC AFRALIAETN ALKGAYNHAL NQMLPALVKV DEPEEAEESP RLRFFNGRIN

241 DLPKFPVAER ETPPDTETII RQLEDMARVI PDTAEILGYI HRIRHKAARR KPGSAVPLPQ

301 RVALYCAIRM ERNPEEDPST VAGHFLGEID RVCEKRRQGL VRTPFDSQIR ARYMDIISFR

361 ATLAHPDRWT EIQFLRSNAA SRRVRAETIS APFEGFSWTS NRINPAPQYG MALAKDANAP

421 ADAPELCICL SPSSAAFSVR EKGGDLIYMR PTGGRRGKDN PGKEITWVPG SFDEYPASGV

481 ALKLRLYFGR SQARRMLINK TWGLLSDNPR VFAANAELVG KKRNPQDRWK LFFHMVISGP

541 PPVEYLDFSS DVRSRARTVI GINRGEVNPL AYAVVSVEDG QVLEEGLLGK KEYIDQLIET

601 RRRISEYQSR EQTPPRDLRQ RVRHLQDTVL GSARAKIHSL IAFWKGILAI ERLDDQFHGR

661 EQKIIPKKTY LANKTGFMNA LSFSGAVRVD KKGNPWGGMI EIYPGGISRT CTQCGTVWLA

721 RRPKNPGHRD AMVVIPDIVD DAAATGFDNV DCDAGTVDYG ELFTLSREWV RLTPRYSRVM

781 RGTLGDLERA IRQGDDRKSR QMLELALEPQ PQWGQFFCHR CGFNGQSDVL AATNLARRAI

841 SLIRRLPDID TPPTP.
```

b. Catalytically-Dead CasX Variant Proteins (dCasX Variant)

In the gene repressor systems, the CasX protein is catalytically dead (dCasX) but retains the ability to bind a target nucleic acid. The present disclosure provides catalytically-dead variants (interchangeably referred to herein as "dCasX variant" or "dCasX variant protein"), wherein the catalytically-dead CasX variants comprise at least one modification in at least one domain relative to the catalytically-dead versions of sequences of SEQ ID NOS:1-3 (described, supra). An exemplary catalytically dead CasX protein comprises one or more mutations in the active site of the RuvC domain of the CasX protein. In some embodiments, a catalytically dead reference CasX protein comprises substitutions at residues 672, 769 and/or 935 with reference to SEQ ID NO: 1. In one embodiment, a catalytically-dead reference CasX protein comprises substitutions of D672A, E769A and/or D935A with reference to SEQ ID NO: 1. In other embodiments, a catalytically-dead reference CasX protein comprises substitutions at amino acids 659, 756 and/or 922 with reference to SEQ ID NO: 2. In some embodiments, a catalytically-dead reference CasX protein comprises D659A, E756A and/or D922A substitutions with reference to of SEQ ID NO: 2. An exemplary RuvC domain of the dCasX of the disclosure comprises amino acids 661-824 and 935-986 of SEQ ID NO: 1, or amino acids 648-812 and 922-978 of SEQ ID NO: 2, with one or more amino acid modifications relative to said RuvC cleavage domain sequence, wherein the dCasX variant exhibits one or more improved characteristics compared to the reference dCasX. In further embodiments, a catalytically-dead CasX variant protein comprises deletions of all or part of the RuvC domain of the reference CasX protein. It will be understood that the same foregoing substitutions or deletions can similarly be introduced into any of the CasX variants of SEQ ID NOS: 33352-33624 or 57647-57735 of the disclosure, relative to the corresponding positions (allowing for any insertions or deletions) of the starting variant, resulting in a dCasX variant (see, e.g., Table 4 for exemplary sequences).

In some embodiments, the dCasX variant with linked repressor domain exhibits at least one improved characteristic compared to the reference dCasX protein with linked repressor domain configured in a comparable fashion, e.g. a catalytically dead version of a CasX variant of any one of SEQ ID NOS: 33352-33624 or 57647-57735. All variants that improve one or more functions or characteristics of the dCasX variant protein when with linked repressor domain compared to a reference dCasX protein with linked repressor domain described herein are envisaged as being within the scope of the disclosure. In some embodiments, the modification is a mutation in one or more amino acids of the reference dCasX. In some embodiments, the modification is a mutation in one or more amino acids of a dCasX variant that has been subjected to additional mutations or alterations in the sequence. In other embodiments, the modification is a substitution of one or more domains of the reference dCasX with one or more domains from a different CasX. In some embodiments, insertion includes the insertion of a part or all of a domain from a different CasX protein. Mutations can occur in any one or more domains of the reference dCasX protein or dCasX variant, and may include, for example, deletion of part or all of one or more domains, or one or more amino acid substitutions, deletions, or insertions in any domain. The domains of CasX proteins include the non-target strand binding (NTSB) domain, the target strand loading (TSL) domain, the helical I domain, the helical II domain, the oligonucleotide binding domain (OBD), and the RuvC DNA cleavage domain, which can further comprise subdomains, described below. Any change in amino acid sequence of a reference dCasX protein that leads to an improved characteristic of the protein is considered a dCasX variant protein of the disclosure. For example, dCasX variants can comprise one or more amino acid substitutions, insertions, deletions, or swapped domains, or any combinations thereof, relative to a reference dCasX protein sequence.

Suitable mutagenesis methods for generating dCasX variant proteins of the disclosure may include, for example, Deep Mutational Evolution (DME), deep mutational scanning (DMS), error prone PCR, cassette mutagenesis, random mutagenesis, staggered extension PCR, gene shuffling, or domain swapping. In some embodiments, the dCasX variants are designed, for example by selecting one or more desired mutations in a reference dCasX. In certain embodiments, the activity of a reference dCasX protein is used as a benchmark against which the activity of one or more dCasX variants are compared, thereby measuring improvements in function of the dCasX variants.

In some embodiments of the dCasX variants described herein, the at least one modification comprises: (a) a substitution of 1 to 100 consecutive or non-consecutive amino acids in the dCasX variant; (b) a deletion of 1 to 100 consecutive or non-consecutive amino acids in the dCasX variant; (c) an insertion of 1 to 100 consecutive or non-consecutive amino acids in the dCasX; or (d) any combination of (a)-(c). In some embodiments, the at least one modification comprises: (a) a substitution of 5-10 consecutive or non-consecutive amino acids in the dCasX variant; (b) a deletion of 1-5 consecutive or non-consecutive amino acids in the dCasX variant; (c) an insertion of 1-5 consecutive or non-consecutive amino acids in the dCasX; or (d) any combination of (a)-(c).

Any amino acid can be substituted for any other amino acid in the substitutions described herein. The substitution can be a conservative substitution (e.g., a basic amino acid is substituted for another basic amino acid). The substitution can be a non-conservative substitution (e.g., a basic amino acid is substituted for an acidic amino acid or vice versa). For example, a proline in a reference dCasX protein can be substituted for any of arginine, histidine, lysine, aspartic acid, glutamic acid, serine, threonine, asparagine, glutamine, cysteine, glycine, alanine, isoleucine, leucine, methionine, phenylalanine, tryptophan, tyrosine or valine to generate a dCasX variant protein of the disclosure.

Any permutation of the substitution, insertion and deletion embodiments described herein can be combined to generate a dCasX variant protein of the disclosure. For example, a dCasX variant protein can comprise at least one substitution and at least one deletion relative to a reference dCasX protein sequence, at least one substitution and at least one insertion relative to a reference dCasX protein sequence, at least one insertion and at least one deletion relative to a reference dCasX protein sequence, or at least one substitution, one insertion and one deletion relative to a reference dCasX protein sequence.

In some embodiments, the dCasX variant protein comprises between 700 and 1200 amino acids, between 800 and 1100 amino acids or between 900 and 1000 amino acids.

The dCasX and linked repressor domains of the disclosure have an enhanced ability to efficiently bind target nucleic acid, when complexed with a gRNA as an RNP, utilizing PAM TC motif, including PAM sequences selected from TTC, ATC, GTC, or CTC, compared to an RNP of a reference dCasX protein and reference gRNA. In the foregoing, the PAM sequence is located at least 1 nucleotide 5' to the non-target strand of the protospacer having identity with the targeting sequence of the gRNA in an assay system compared to the binding of an RNP comprising a reference dCasX protein and reference gRNA in a comparable assay system.

In some embodiments, an RNP comprising the dCasX variant protein with linked repressor domains and a gRNA of the disclosure, at a concentration of 20 pM or less, is capable of binding a double stranded DNA target with an efficiency of at least 70%, at least 80%, at least 85%, at least 90% or at least 95%. In one embodiment, an RNP of a dCasX variant with linked repressor domains and a gRNA variant exhibits greater binding of a target sequence in the target nucleic acid compared to an RNP comprising a reference dCasX protein with linked repressor domains and a reference gRNA in a comparable assay system, wherein the PAM sequence of the target nucleic acid is TTC. In another embodiment, an RNP of a dCasX variant with linked repressor domains and gRNA variant exhibits greater binding affinity of a target sequence in the target nucleic acid compared to an RNP comprising a reference dCasX protein with linked repressor domains and a reference gRNA in a comparable assay system, wherein the PAM sequence of the target nucleic acid is ATC. In another embodiment, an RNP of a dCasX variant with linked repressor domains and gRNA variant exhibits greater binding affinity of a target sequence in the target nucleic acid compared to an RNP comprising a reference dCasX protein with linked repressor domains and a reference gRNA in a comparable assay system, wherein the PAM sequence of the target nucleic acid is CTC. In another embodiment, an RNP of a dCasX variant with linked repressor domains and gRNA variant exhibits greater binding affinity of a target sequence in the target nucleic acid compared to an RNP comprising a reference dCasX protein with linked repressor domains and a reference gRNA in a comparable assay system, wherein the PAM sequence of the target nucleic acid is GTC. In the foregoing embodiments, the increased binding affinity for the one or more PAM sequences is at least 1.5-fold greater or more compared to the binding affinity of an RNP of any one of the reference dCasX proteins (modified from SEQ ID NOS:1-3) with linked repressor domains and the gRNA of Table 1 for the PAM sequences.

c. dCasX Variant Proteins with Domains from Multiple Source Proteins

In certain embodiments, the disclosure provides a chimeric dCasX variant protein for use in the dXR systems comprising protein domains from two or more different CasX proteins, such as two or more naturally occurring CasX proteins, or two or more CasX variant protein sequences as described herein. As used herein, a "chimeric dCasX protein" refers to a catalytically-dead CasX containing at least two domains isolated or derived from different sources, such as two naturally occurring proteins, which may, in some embodiments, be isolated from different species. For example, in some embodiments, a chimeric dCasX variant protein comprises a first domain from a first CasX protein and a second domain from a second, different CasX protein. In some embodiments, the first domain can be selected from the group consisting of the NTSB, TSL, helical I-I, helical I-II, helical II, OBD-I, OBD-II, RuvC-I and RuvC-II domains. In some embodiments, the second domain is selected from the group consisting of the NTSB, TSL, helical I-I, helical I-II, helical II, OBD-I, OBD-II, RuvC-I and RuvC-II domains with the second domain being different from the foregoing first domain. A chimeric dCasX variant protein may comprise an NTSB, TSL, helical I-I, helical I-II, helical II, OBD-I, and OBD-II domains from a CasX protein of SEQ ID NO: 2, and a RuvC-I and/or RuvC-II domain from a CasX protein of SEQ ID NO: 1, or vice versa, in which mutations or other sequence alterations are introduced to create the catalytically dead variant with improved properties of the variant, relative to the reference dCasX protein. As an example of the foregoing, the chimeric RuvC domain comprises amino acids 661 to 824 of SEQ ID NO: 1 and amino acids 922 to 978 of SEQ ID NO: 2. As an alternative example of the foregoing, a chimeric RuvC domain comprises amino acids 648 to 812 of SEQ ID NO: 2 and amino acids 935 to 986 of SEQ ID NO: 1. In a particular embodiment, a dCasX for use in the dXR comprises an NTSB domain and helical I-II domain from SEQ ID NO: 1 and a helical I-I domain from SEQ ID NO:2; the latter being a chimeric domain. Coordinates of CasX domains in the reference CasX proteins of SEQ ID NO: 1 and SEQ ID NO: 2 are provided in Table 3 below.

TABLE 3

Domain coordinates in Reference CasX proteins

| Domain Name | Coordinates in SEQ ID NO: 1 | Coordinates in SEQ ID NO: 2 |
|---|---|---|
| OBD-I | 1-55 | 1-57 |
| helical I-I | 56-99 | 58-101 |
| NTSB | 100-190 | 102-191 |
| helical I-II | 191-331 | 192-332 |
| helical II | 332-508 | 333-500 |
| OBD-II | 509-659 | 501-646 |
| RuvC-I | 660-823 | 647-810 |
| TSL | 824-933 | 811-920 |
| RuvC-II | 934-986 | 921-978 |

TABLE 3-continued

*OBD I and II, helical I-I and I-II, and RuvC I and II are also sometimes referred to as OBD a and b, helical I a and b, and RuvC a and b.

In some embodiments, an improved characteristic of the dCasX variant is at least about 1.1 to about 100,000-fold improved relative to the reference dCasX protein. In some embodiments, an improved characteristic of the CasX variant is at least about 1.1 to about 10,000-fold improved, at least about 1.1 to about 1,000-fold improved, at least about 1.1 to about 500-fold improved, at least about 1.1 to about 400-fold improved, at least about 1.1 to about 300-fold improved, at least about 1.1 to about 200-fold improved, at least about 1.1 to about 100-fold improved, at least about 1.1 to about 50-fold improved, at least about 1.1 to about 40-fold improved, at least about 1.1 to about 30-fold improved, at least about 1.1 to about 20-fold improved, at least about 1.1 to about 10-fold improved, at least about 1.1 to about 9-fold improved, at least about 1.1 to about 8-fold improved, at least about 1.1 to about 7-fold improved, at least about 1.1 to about 6-fold improved, at least about 1.1 to about 5-fold improved, at least about 1.1 to about 4-fold improved, at least about 1.1 to about 3-fold improved, at least about 1.1 to about 2-fold improved, at least about 1.1 to about 1.5-fold improved, at least about 1.5 to about 3-fold improved, at least about 1.5 to about 4-fold improved, at least about 1.5 to about 5-fold improved, at least about 1.5 to about 10-fold improved, at least about 5 to about 10-fold improved, at least about 10 to about 20-fold improved, at least 10 to about 30-fold improved, at least 10 to about 50-fold improved or at least 10 to about 100-fold improved than the reference CasX protein. In some embodiments, an improved characteristic of the dCasX variant is at least about 10 to about 1000-fold improved relative to the reference dCasX protein.

In some embodiments, a dCasX variant protein utilized in the gene repressor systems of the disclosure comprises a sequence of SEQ ID NOS: 33352-33624 or 57647-57735 and one or more insertions, substitutions or deletions thereto as described supra that inactivate the catalytic domain of the CasX variant to produce a dCasX variant. In some embodiments, a dCasX variant protein utilized in the gene repressor systems of the disclosure comprises a sequence of SEQ ID NOS: 17-36 and 59353-59358 as set forth in Table 4. In some embodiments, a dCasX variant protein consists of a sequence of SEQ ID NOS: 17-36 and 59353-59358 as set forth in Table 4. In other embodiments, a dCasX variant protein comprises a sequence at least 70% identical, at least 75% identical, at least 80% identical, at least 81% identical, at least 82% identical, at least 83% identical, at least 84% identical, at least 85% identical, at least 86% identical, at least 86% identical, at least 87% identical, at least 88% identical, at least 89% identical, at least 89% identical, at least 90% identical, at least 91% identical, at least 92% identical, at least 93% identical, at least 94% identical, at least 95% identical, at least 96% identical, at least 97% identical, at least 98% identical, at least 99% identical, at least 99.5% identical to a sequence of SEQ ID NOS: 17-36 and 59353-59358 as set forth in Table 4.

TABLE 4 dCasX Variant Sequences

| SEQ ID NO | dCasX | Amino Acid Sequence |
| --- | --- | --- |
| 17 | dCasX533 | QEIKRINKIRRRLVKDSNTKKAGKTRGPMKTLLVRVMTPDLRERLENLRKKPENIPQPI<br>SNTSRANLNKLLTDYTEMKKAILHVYWEEFQKDPVGLMSRVAQPASKKIDQNKLKPEMD<br>EKGNLTTAGFACSQCGQPLFVYKLEQVSEKGKAYTNYFGRCNVAEHEKLILLAQLKPEK<br>DSDEAVTYSLGKFGQRALDFYSIHVTKESTHPVKPLAQIAGNRYASYPVGKALSDACMG<br>TIASFLSKYQDIIIEHQKVVKGNQKRLESLRELAGKENLEYPSVTLPPQPHTKEGVDAY<br>NEVIARVRMWVNLNLWQKLKLSRDDAKPLLRLKGFPSFPLVERQANEVDWWDMVCNVKK<br>LINEKKEDGKVFWQNLAGYKRQEALRPYLSSEEDRKKGKKFARYQLGDLLLHLEKKHGE<br>DWGKVYDEAWERIDKKVEGLSKHIKLEEERRSEDAQSKAALTDWLRAKASFVIEGLKEA<br>DKDEFCRCELKLQKWYGDLRGKPFAIEAENSILDISGFSKQYNCAFIWQKDGVKKLNLY<br>LIINYFKGGKLRFKKIKPEAFEANRFYTVINKKSGEIVPMEVNFNFDDPNLIILPLAFG<br>KRQGREFIWNDLLSLETGSLKLANGRVIEKTLYNRRTRQDEPALFVALTFERREVLDSS<br>NIKPMNLIGVARGENIPAVIALTDPEGCPLSRFKDSLGNPTHILRIGESYKEKQRTIQA<br>KKEVEQRRAGGYSRKYASKAKNLADDMVRNTARDLLYYAVTQDAMLIFANLSRGFGRQG<br>KRTFMAERQYTRMEDWLTAKLAYEGLPSKTYLSKTLAQYTSKTCSNCGFTITSADYDRV<br>LEKLKKTATGWMTTINGKELKVEGQITYYNRYKRQNVVKDLSVELDRLSEESVNNDISS<br>WTKGRSGEALSLLKKRFSHRPVQEKFVCLNCGFETHAAEQAALNIARSWLFLRSQEYKK<br>YQTNKTTGNTDKRAFVETWQSFYRKKLKEVWKPAV |
| 18 | dCasX491 | QEIKRINKIRRRLVKDSNTKKAGKTGPMKTLLVRVMTPDLRERLENLRKKPENIPQPIS<br>NTSRANLNKLLTDYTEMKKAILHVYWEEFQKDPVGLMSRVAQPASKKIDQNKLKPEMDE<br>KGNLTTAGFACSQCGQPLFVYKLEQVSEKGKAYTNYFGRCNVAEHEKLILLAQLKPEKD<br>SDEAVTYSLGKFGQRALDFYSIHVTKESTHPVKPLAQIAGNRYASGPVGKALSDACMGT<br>IASFLSKYQDIIIEHQKVVKGNQKRLESLRELAGKENLEYPSVTLPPQPHTKEGVDAYN<br>EVIARVRMWVNLNLWQKLKLSRDDAKPLLRLKGFPSFPLVERQANEVDWWDMVCNVKKL<br>INEKKEDGKVFWQNLAGYKRQEALRPYLSSEEDRKKGKKFARYQLGDLLLHLEKKHGED<br>WGKVYDEAWERIDKKVEGLSKHIKLEEERRSEDAQSKAALTDWLRAKASFVIEGLKEAD<br>KDEFCRCELKLQKWYGDLRGKPFAIEAENSILDISGFSKQYNCAFIWQKDGVKKLNLYL<br>IINYFKGGKLRFKKIKPEAFEANRFYTVINKKSGEIVPMEVNENFDDPNLIILPLAFGK<br>RQGREFIWNDLLSLETGSLKLANGRVIEKTLYNRRTRQDEPALFVALTFERREVLDSSN<br>IKPMNLIGVARGENIPAVIALTDPEGCPLSRFKDSLGNPTHILRIGESYKEKQRTIQAK<br>KEVEQRRAGGYSRKYASKAKNLADDMVRNTARDLLYYAVTQDAMLIFANLSRGFGRQGK<br>RTFMAERQYTRMEDWLTAKLAYEGLSKTYLSKTLAQYTSKTCSNCGFTITSADYDRVLE<br>KLKKTATGWMTTINGKELKVEGQITYYNRYKRQNVVKDLSVELDRLSEESVNNDISSWT<br>KGRSGEALSLLKKRFSHRPVQEKFVCLNCGFETHAAEQAALNIARSWLFLRSQEYKKYQ<br>TNKTTGNTDKRAFVETWQSFYRKKLKEVWKPAV |
| 19 | dCasX532 | QEIKRINKIRRRLVKDSNTKKAGKTRGPMKTLLVRVMTPDLRERLENLRKKPENIPQPI<br>SNTSRANLNKLLTDYTEMKKAILHVYWEEFQKDPVGLMSRVAQPASKKIDQNKLKPEMD<br>EKGNLTTAGFACSQCGQPLFVYKLEQVSEKGKAYTNYFGRCNVAEHEKLILLAQLKPEK<br>DSDEAVTYSLGKFGQRALDFYSIHVTKESTHPVKPLAQIAGNRYASGPVGKALSDACMG<br>TIASFLSKYQDIIIEHQKVVKGNQKRLESLRELAGKENLEYPSVTLPPQPHTKEGVDAY<br>NEVIARVRMWVNLNLWQKLKLSRDDAKPLLRLKGFPSFPLVERQANEVDWWDMVCNVKK<br>LINEKKEDGKVFWQNLAGYKRQEALRPYLSSEEDRKKGKKFARYQLGDLLLHLEKKHGE<br>DWGKVYDEAWERIDKKVEGLSKHIKLEEERRSEDAQSKAALTDWLRAKASFVIEGLKEA<br>DKDEFCRCELKLQKWYGDLRGKPFAIEAENSILDISGFSKQYNCAFIWQKDGVKKLNLY<br>LIINYFKGGKLRFKKIKPEAFEANRFYTVINKKSGEIVPMEVNFNFDDPNLIILPLAFG<br>KRQGREFIWNDLLSLETGSLKLANGRVIEKTLYNRRTRQDEPALFVALTFERREVLDSS<br>NIKPMNLIGVARGENIPAVIALTDPEGCPLSRFKDSLGNPTHILRIGESYKEKQRTIQA<br>KKEVEQRRAGGYSRKYASKAKNLADDMVRNTARDLLYYAVTQDAMLIFANLSRGFGRQG<br>KRTEMAERQYTRMEDWLTAKLAYEGLPSKTYLSKTLAQYTSKTCSNCGFTITSADYDRV<br>LEKLKKTATGWMTTINGKELKVEGQITYYNRYKRQNVVKDLSVELDRLSEESVNNDISS<br>WTKGRSGEALSLLKKRFSHRPVQEKFVCLNCGFETHAAEQAALNIARSWLFLRSQEYKK<br>YQTNKTTGNTDKRAFVETWQSFYRKKLKEVWKPAV |
| 20 | dCasX529 | QEIKRINKIRRRLVKDSNTKKAGKTGPMKTLLVRVMTPDLRERLENLRKKPENIPQPIS<br>NTSRANLNKLLTDYTEMKKAILHVYWEEFQKDPVGLMSRVAQPASKKIDQNKLKPEMDE<br>KGNLTTAGFACSQCGQPLFVYKLEQVSEKGKAYTNYFGRCNVAEHEKLILLAQLKPEKD<br>SDEAVTYSLGKFGQRALDFYSIHVTKESTHPVKPLAQIAGNRYASNPVGKALSDACMGT<br>IASFLSKYQDIIIEHQKVVKGNQKRLESLRELAGKENLEYPSVTLPPQPHTKEGVDAYN<br>EVIARVRMWVNLNLWQKLKLSRDDAKPLLRLKGFPSFPLVERQANEVDWWDMVCNVKKL<br>INEKKEDGKVFWQNLAGYKRQEALRPYLSSEEDRKKGKKFARYQLGDLLLHLEKKHGED<br>WGKVYDEAWERIDKKVEGLSKHIKLEEERRSEDAQSKAALTDWLRAKASFVIEGLKEAD<br>KDEFCRCELKLQKWYGDLRGKPFAIEAENSILDISGFSKQYNCAFIWQKDGVKKLNLYL<br>IINYFKGGKLRFKKIKPEAFEANRFYTVINKKSGEIVPMEVNFNFDDPNLIILPLAFGK<br>RQGREFIWNDLLSLETGSLKLANGRVIEKTLYNRRTRQDEPALFVALTFERREVLDSSN<br>IKPMNLIGVARGENIPAVIALTDPEGCPLSRFKDSLGNPTHILRIGESYKEKQRTIQAK<br>KEVEQRRAGGYSRKYASKAKNLADDMVRNTARDLLYYAVTQDAMLIFANLSRGFGRQGK<br>RTFMAERQYTRMEDWLTAKLAYEGLPSKTYLSKTLAQYTSKTCSNCGFTITSADYDRVL<br>EKLKKTATGWMTTINGKELKVEGQITYYNRYKRQNVVKDLSVELDRLSEESVNNDISSW<br>TKGRSGEALSLLKKRFSHRPVQEKFVCLNCGFETHAAEQAALNIARSWLFLRSQEYKKY<br>QTNKTTGNTDKRAFVETWQSFYRKKLKEVWKPAV |
| 21 | dCasX531 | QEIKRINKIRRRLVKDSNTKKAGKTGPMKTLLVRVMTPDLRERLENLRKKPENIPQPIS<br>NTSRANLNKLLTDYTEMKKAILHVYWEEFQKDPVGLMSRVAQPASKKIDQNKLKPEMDE |

TABLE 4-continued dCasX Variant Sequences

| SEQ ID NO | dCasX | Amino Acid Sequence |
|---|---|---|
| | | KGNLTTAGFACSQCGQPLFVYKLEQVSEKGKAYTNYFGRCNVAEHEKLILLAQLKPEKD<br>SDEAVTYSLGKFGQRALDFYSIHVTKESTHPVKPLAQIAGNRYASGPVGKALSDACMGT<br>IASFLSKYQDIIIEHQKVVKGNQKRLESLRELAGKENLEYPSVTLPPQPHTKEGVDAYN<br>EVIARVRMWVNLNLWQKLKLSRDDAKPLLRLKGFPSFPLVERQANEVDWWDMVCNVKKL<br>INEKKEDGKVFWQNLAGYKRQEALRPYLSSEEDRKKGKKFARYQLGDLLLHLEKKHGED<br>WGKVYDEAWERIDKKVEGLSKHIKLEEERRSEDAQSKAALTDWLRAKASFVIEGLKEAD<br>KDEFCRCELKLQKWYGDLRGKPFAIEAENSILDISGFSKQYNCAFIWQKDGVKKLNLYL<br>IINYFKGYGKLRFKKIKPEAFEANRFYTVINKKSGEIVPMEVNFNFDDPNLIILPLAFG<br>KRQGREFIWNDLLSLETGSLKLANGRVIEKTLYNRRTRQDEPALFVALTFERREVLDSS<br>NIKPMNLIGVARGENIPAVIALTDPEGCPLSRFKDSLGNPTHILRIGESYKEKQRTIQA<br>KKEVEQRRAGGYSRKYASKAKNLADDMVRNTARDLLYYAVTQDAMLIFANLSRGFGRQG<br>KRTFMAERQYTRMEDWLTAKLAYEGLPSKTYLSKTLAQYTSKTCSNCGFTITSADYDRV<br>LEKLKKTATGWMTTINGKELKVEGQITYYNRYKRQNVVKDLSVELDRLSEESVNNDISS<br>WTKGRSGEALSLLKKRFSHRPVQEKFVCLNCGFETHAAEQAALNIARSWLFLRSQEYKK<br>YQTNKTTGNTDKRAFVETWQSFYRKKLKEVWKPAV |
| 22 | dCasX530 | QEIKRINKIRRRLVKDSNTKKAGKTGPMKTLLVRVMTPDLRERLENLRKKPENIPQPIS<br>NTSRANLNKLLTDYTEMKKAILHVYWEEFQKDPVGLMSRVAQPASKKIDQNKLKPEMDE<br>KGNLTTAGFACSQCGQPLFVYKLEQVSEKGKAYTNYFGRCNVAEHEKLILLAQLKPEKD<br>SDEAVTYSLGKFGQRALDFYSIHVTKESTHPVKPLAQIAGNRYASGPVGKALSDACMGT<br>IASFLSKYQDIIIEHQKVVKGNQKRLESLRELAGKENLEYPSVTLPPQPHTKEGVDAYN<br>EVIARVRMWVNLNLWQKLKLSRDDAKPLLRLKGFPSFPLVERQANEVDWWDMVCNVKKL<br>INEKKEDGKVFWQNLAGYKRQEALRPYLSSEEDRKKGKKFARYQLGDLLLHLEKKHGED<br>WGKVYDEAWERIDKKVEGLSKHIKLEEERRSEDAQSKAALTDWLRAKASFVIEGLKEAD<br>KDEFCRCELKLQKWYGDLRGKPFAIEAENSILDISGFSKQYNCAFIWQKDGVKKLNLYL<br>IINYFKGWGKLRFKKIKPEAFEANRFYTVINKKSGEIVPMEVNENFDDPNLIILPLAFG<br>KRQGREFIWNDLLSLETGSLKLANGRVIEKTLYNRRTRQDEPALFVALTFERREVLDSS<br>NIKPMNLIGVARGENIPAVIALTDPEGCPLSRFKDSLGNPTHILRIGESYKEKQRTIQA<br>KKEVEQRRAGGYSRKYASKAKNLADDMVRNTARDLLYYAVTQDAMLIFANLSRGFGRQG<br>KRTFMAERQYTRMEDWLTAKLAYEGLPSKTYLSKTLAQYTSKTCSNCGFTITSADYDRV<br>LEKLKKTATGWMTTINGKELKVEGQITYYNRYKRQNVVKDLSVELDRLSEESVNNDISS<br>WTKGRSGEALSLLKKRFSHRPVQEKFVCLNCGFETHAAEQAALNIARSWLFLRSQEYKK<br>YQTNKTTGNTDKRAFVETWQSFYRKKLKEVWKPAV |
| 23 | dCasX528 | QEIKRINKIRRRLVKDSNTKKAGKTGPMKTLLVRVMTPDLRERLENLRKKPENIPQPIS<br>NTSRANLNKLLTDYTEMKKAILHVYWEEFQKDPVGLMSRVAQPASKKIDQNKLKPEMDE<br>KGNLTTAGFACSQCGQPLFVYKLEQVSEKGKAYTNYFGRCNVAEHEKLILLAQLKPEKD<br>SDEAVTYSLGKFGQRALDFYSIHVTKESTHPVKPLAQIAGNRYASYPVGKALSDACMGT<br>IASFLSKYQDIIIEHQKVVKGNQKRLESLRELAGKENLEYPSVTLPPQPHTKEGVDAYN<br>EVIARVRMWVNLNLWQKLKLSRDDAKPLLRLKGFPSFPLVERQANEVDWWDMVCNVKKL<br>INEKKEDGKVFWQNLAGYKRQEALRPYLSSEEDRKKGKKFARYQLGDLLLHLEKKHGED<br>WGKVYDEAWERIDKKVEGLSKHIKLEEERRSEDAQSKAALTDWLRAKASFVIEGLKEAD<br>KDEFCRCELKLQKWYGDLRGKPFAIEAENSILDISGFSKQYNCAFIWQKDGVKKLNLYL<br>IINYFKGGKLRFKKIKPEAFEANRFYTVINKKSGEIVPMEVNENFDDPNLIILPLAFGK<br>RQGREFIWNDLLSLETGSLKLANGRVIEKTLYNRRTRQDEPALFVALTFERREVLDSSN<br>IKPMNLIGVARGENIPAVIALTDPEGCPLSRFKDSLGNPTHILRIGESYKEKQRTIQAK<br>KEVEQRRAGGYSRKYASKAKNLADDMVRNTARDLLYYAVTQDAMLIFANLSRGFGRQGK<br>RTFMAERQYTRMEDWLTAKLAYEGLPSKTYLSKTLAQYTSKTCSNCGFTITSADYDRVL<br>EKLKKTATGWMTTINGKELKVEGQITYYNRYKRQNVVKDLSVELDRLSEESVNNDISSW<br>TKGRSGEALSLLKKRFSHRPVQEKFVCLNCGFETHAAEQAALNIARSWLFLRSQEYKKY<br>QTNKTTGNTDKRAFVETWQSFYRKKLKEVWKPAV |
| 24 | dCasX527 | QEIKRINKIRRRLVKDSNTKKAGKTRGPMKTLLVRVMTPDLRERLENLRKKPENIPQPI<br>SNTSRANLNKLLTDYTEMKKAILHVYWEEFQKDPVGLMSRVAQPASKKIDQNKLKPEMD<br>EKGNLTTAGFACSQCGQPLFVYKLEQVSEKGKAYTNYFGRCNVAEHEKLILLAQLKPEK<br>DSDEAVTYSLGKFGQRALDFYSIHVTKESTHPVKPLAQIAGNRYASGPVGKALSDACMG<br>TIASFLSKYQDIIIEHQKVVKGNQKRLESLRELAGKENLEYPSVTLPPQPHTKEGVDAY<br>NEVIARVRMWVNLNLWQKLKLSRDDAKPLLRLKGFPSFPLVERQANEVDWWDMVCNVKK<br>LINEKKEDGKVFWQNLAGYKRQEALRPYLSSEEDRKKGKKFARYQLGDLLLHLEKKHGE<br>DWGKVYDEAWERIDKKVEGLSKHIKLEEERRSEDAQSKAALTDWLRAKASFVIEGLKEA<br>DKDEFCRCELKLQKWYGDLRGKPFAIEAENSILDISGFSKQYNCAFIWQKDGVKKLNLY<br>LIINYFKGGKLRFKKIKPEAFEANRFYTVINKKSGEIVPMEVNFNFDDPNLIILPLAFG<br>KRQGREFIWNDLLSLETGSLKLANGRVIEKTLYNRRTRQDEPALFVALTFERREVLDSS<br>NIKPMNLIGVARGENIPAVIALTDPEGCPLSRFKDSLGNPTHILRIGESYKEKQRTIQA<br>KKEVEQRRAGGYSRKYASKAKNLADDMVRNTARDLLYYAVTQDAMLIFANLSRGFGRQG<br>KRTEMAERQYTRMEDWLTAKLAYEGLSKTYLSKTLAQYTSKTCSNCGFTITSADYDRVL<br>EKLKKTATGWMTTINGKELKVEGQITYYNRYKRQNVVKDLSVELDRLSEESVNNDISSW<br>TKGRSGEALSLLKKRFSHRPVQEKFVCLNCGFETHAAEQAALNIARSWLFLRSQEYKKY<br>QTNKTTGNTDKRAFVETWQSFYRKKLKEVWKPAV |
| 25 | dCasX515 | QEIKRINKIRRRLVKDSNTKKAGKTGPMKTLLVRVMTPDLRERLENLRKKPENIPQPIS<br>NTSRANLNKLLTDYTEMKKAILHVYWEEFQKDPVGLMSRVAQPASKKIDQNKLKPEMDE<br>KGNLTTAGFACSQCGQPLFVYKLEQVSEKGKAYTNYFGRCNVAEHEKLILLAQLKPEKD<br>SDEAVTYSLGKFGQRALDFYSIHVTKESTHPVKPLAQIAGNRYASGPVGKALSDACMGT |

TABLE 4-continued dCasX Variant Sequences

| SEQ ID NO | dCasX | Amino Acid Sequence |
|---|---|---|
| | | IASFLSKYQDIIIEHQKVVKGNQKRLESLRELAGKENLEYPSVTLPPQPHTKEGVDAYN |
| | | EVIARVRMWVNLNLWQKLKLSRDDAKPLLRLKGFPSFPLVERQANEVDWWDMVCNVKKL |
| | | INEKKEDGKVFWQNLAGYKRQEALRPYLSSEEDRKKGKKFARYQLGDLLLHLEKKHGED |
| | | WGKVYDEAWERIDKKVEGLSKHIKLEEERRSEDAQSKAALTDWLRAKASFVIEGLKEAD |
| | | KDEFCRCELKLQKWYGDLRGKPFAIEAENSILDISGFSKQYNCAFIWQKDGVKKLNLYL |
| | | IINYFKGGKLRFKKIKPEAFEANRFYTVINKKSGEIVPMEVNFNFDDPNLIILPLAFGK |
| | | RQGREFIWNDLLSLETGSLKLANGRVIEKTLYNRRTRQDEPALFVALTFERREVLDSSN |
| | | IKPMNLIGVARGENIPAVIALTDPEGCPLSRFKDSLGNPTHILRIGESYKEKQRTIQAK |
| | | KEVEQRRAGGYSRKYASKAKNLADDMVRNTARDLLYYAVTQDAMLIFANLSRGFGRQGK |
| | | RTFMAERQYTRMEDWLTAKLAYEGLPSKTYLSKTLAQYTSKTCSNCGFTITSADYDRVL |
| | | EKLKKTATGWMTTINGKELKVEGQITYYNRYKRQNVVKDLSVELDRLSEESVNNDISSW |
| | | TKGRSGEALSLLKKRFSHRPVQEKFVCLNCGFETHAAEQAALNIARSWLFLRSQEYKKY |
| | | QTNKTTGNTDKRAFVETWQSFYRKKLKEVWKPAV |
| 26 | dCasX514 | QEIKRINKIRRRLVKDSNTKKAGKTGPMKTLLVRVMTPDLRERLENLRKKPENIPQPIS |
| | | NTSRANLNKLLTDYTEMKKAILHVYWEEFQKDPVGLMSRVAQPASKKIDQNKLKPEMDE |
| | | KGNLTTAGFACSQCGQPLFVYKLEQVSEKGKAYTNYFGRCNVAEHEKLILLAQLKPEKD |
| | | SDEAVTYSLGKFGQRALDFYSIHVTKESTHPVKPLAQIAGNRYASGPVGKALSDACMGT |
| | | IASFLSKYQDIIIEHQKVVKGNQKRLESLRELAGKENLEYPSVTLPPQPHTKEGVDAYN |
| | | EVIARVRMWVNLNLWQKLKLSRDDAKPLLRLKGFPSFPLVERQANEVDWWDMVCNVKKL |
| | | INEKKEDGKVFWQNLAGYKRQEALRPYLSSEEDRKKGKKFARYQLGDLLLHLEKKHGED |
| | | WGKVYDEAWERIDKKVEGLSKHIKLEEERRSEDAQSKAALTDWLRAKASFVIEGLKEAD |
| | | KDEFCRCELKLQKWYGDLRGKPFAIEAENSILDISGFSKQYNCAFIWQKDGVKKLNLYL |
| | | IINYFKGGKLRFKKIKPEAFEANRFYTVINKKSGEIVPMEVNFNFDDPNLIILPLAFGK |
| | | RQGREFIWNDLLSLETGSLKLANGRVIEKTLYNRRTRQDEPALFVALTFERREVLDSSN |
| | | IKPMNLIGVARGENIPAVIALTDPEGCPLSRFKDSLGNPTHILRIGESYKEKQRTIQAK |
| | | KEVEQRRAGGYSRKYASKAKNLADDMVRNTARDLLYYAVTQDAMLIFANLSRGFGRQGK |
| | | RTFMAERQYTRMEDWLTAKLAYEGLSKTYLSKTLAQYTSKTCSNCGFTIHTSADYDRVL |
| | | EKLKKTATGWMTTINGKELKVEGQITYYNRYKRQNVVKDLSVELDRLSEESVNNDISSW |
| | | TKGRSGEALSLLKKRFSHRPVQEKFVCLNCGFETHAAEQAALNIARSWLFLRSQEYKKY |
| | | QTNKTTGNTDKRAFVETWQSFYRKKLKEVWKPAV |
| 27 | dCasX516 | QEIKRINKIRRRLVKDSNTKKAGKTGPMKTLLVRVMTPDLRERLENLRKKPENIPQPIS |
| | | NTSRANLNKLLTDYTEMKKAILHVYWEEFQKDPVGLMSRVAQPASKKIDQNKLKPEMDE |
| | | KGNLTTAGFACSQCGQPLFVYKLEQVSEKGKAYTNYFGRCNVAEHEKLILLAQLKPEKD |
| | | SDEAVTYSLGKFGQRALDFYSIHVTKESTHPVKPLAQIAGNRYASGPVGKALSDACMGT |
| | | IASFLSKYQDIIIEHQKVVKGNQKRLESLRELAGKENLEYPSVTLPPQPHTKEGVDAYN |
| | | EVIARVRMWVNHNLWQKLKLSRDDAKPLLRLKGFPSFPLVERQANEVDWWDMVCNVKKL |
| | | INEKKEDGKVFWQNLAGYKRQEALRPYLSSEEDRKKGKKFARYQLGDLLLHLEKKHGED |
| | | WGKVYDEAWERIDKKVEGLSKHIKLEEERRSEDAQSKAALTDWLRAKASFVIEGLKEAD |
| | | KDEFCRCELKLQKWYGDLRGKPFAIEAENSILDISGFSKQYNCAFIWQKDGVKKLNLYL |
| | | IINYFKGGKLRFKKIKPEAFEANRFYTVINKKSGEIVPMEVNENFDDPNLIILPLAFGK |
| | | RQGREFIWNDLLSLETGSLKLANGRVIEKTLYNRRTRQDEPALFVALTFERREVLDSSN |
| | | IKPMNLIGVARGENIPAVIALTDPEGCPLSRFKDSLGNPTHILRIGESYKEKQRTIQAK |
| | | KEVEQRRAGGYSRKYASKAKNLADDMVRNTARDLLYYAVTQDAMLIFANLSRGFGRQGK |
| | | RTFMAERQYTRMEDWLTAKLAYEGLSKTYLSKTLAQYTSKTCSNCGFTITSADYDRVLE |
| | | KLKKTATGWMTTINGKELKVEGQITYYNRYKRQNVVKDLSVELDRLSEESVNNDISSWT |
| | | KGRSGEALSLLKKRFSHRPVQEKFVCLNCGFETHAAEQAALNIARSWLFLRSQEYKKYQ |
| | | TNKTTGNTDKRAFVETWQSFYRKKLKEVWKPAV |
| 28 | dCasX517 | QEIKRINKIRRRLVKDSNTKKAGKTGPMKTLLVRVMTPDLRERLENLRKKPENIPQPIS |
| | | NTSRANLNKLLTDYTEMKKAILHVYWEEFQKDPVGLMSRVAQPASKKIDQNKLKPEMDE |
| | | KGNLTTAGFACSQCGQPLFVYKLEQVSEKGKAYTNYFGRCNVAEHEKLILLAQLKPEKD |
| | | SDEAVTYSLGKFGQRALDFYSIHVTKESTHPVKPLAQIAGNRYASGAPVGKALSDACMG |
| | | TIASFLSKYQDIIIEHQKVVKGNQKRLESLRELAGKENLEYPSVTLPPQPHTKEGVDAY |
| | | NEVIARVRMWVNLNLWQKLKLSRDDAKPLLRLKGFPSFPLVERQANEVDWWDMVCNVKK |
| | | LINEKKEDGKVFWQNLAGYKRQEALRPYLSSEEDRKKGKKFARYQLGDLLLHLEKKHGE |
| | | DWGKVYDEAWERIDKKVEGLSKHIKLEEERRSEDAQSKAALTDWLRAKASFVIEGLKEA |
| | | DKDEFCRCELKLQKWYGDLRGKPFAIEAENSILDISGFSKQYNCAFIWQKDGVKKLNLY |
| | | LIINYFKGGKLRFKKIKPEAFEANRFYTVINKKSGEIVPMEVNFNFDDPNLIILPLAFG |
| | | KRQGREFIWNDLLSLETGSLKLANGRVIEKTLYNRRTRQDEPALFVALTFERREVLDSS |
| | | NIKPMNLIGVARGENIPAVIALTDPEGCPLSRFKDSLGNPTHILRIGESYKEKQRTIQA |
| | | KKEVEQRRAGGYSRKYASKAKNLADDMVRNTARDLLYYAVTQDAMLIFANLSRGFGRQG |
| | | KRTFMAERQYTRMEDWLTAKLAYEGLSKTYLSKTLAQYTSKTCSNCGFTITSADYDRVL |
| | | EKLKKTATGWMTTINGKELKVEGQITYYNRYKRQNVVKDLSVELDRLSEESVNNDISSW |
| | | TKGRSGEALSLLKKRFSHRPVQEKFVCLNCGFETHAAEQAALNIARSWLFLRSQEYKKY |
| | | QTNKTTGNTDKRAFVETWQSFYRKKLKEVWKPAV |
| 29 | dCasX518 | RQEIKRINKIRRRLVKDSNTKKAGKTGPMKTLLVRVMTPDLRERLENLRKKPENIPQPI |
| | | SNTSRANLNKLLTDYTEMKKAILHVYWEEFQKDPVGLMSRVAQPASKKIDQNKLKPEMD |
| | | EKGNLTTAGFACSQCGQPLFVYKLEQVSEKGKAYTNYFGRCNVAEHEKLILLAQLKPEK |
| | | DSDEAVTYSLGKFGQRALDFYSIHVTKESTHPVKPLAQIAGNRYASGPVGKALSDACMG |
| | | TIASFLSKYQDIIIEHQKVVKGNQKRLESLRELAGKENLEYPSVTLPPQPHTKEGVDAY |
| | | NEVIARVRMWVNLNLWQKLKLSRDDAKPLLRLKGFPSFPLVERQANEVDWWDMVCNVKK |

TABLE 4-continued dCasX Variant Sequences

| SEQ ID NO | dCasX | Amino Acid Sequence |
|---|---|---|
| | | LINEKKEDGKVFWQNLAGYKRQEALRPYLSSEEDRKKGKKFARYQLGDLLLHLEKKHGE<br>DWGKVYDEAWERIDKKVEGLSKHIKLEEERRSEDAQSKAALTDWLRAKASFVIEGLKEA<br>DKDEFCRCELKLQKWYGDLRGKPFAIEAENSILDISGFSKQYNCAFIWQKDGVKKLNLY<br>LIINYFKGGKLRFKKIKPEAFEANRFYTVINKKSGEIVPMEVNENFDDPNLIILPLAFG<br>KRQGREFIWNDLLSLETGSLKLANGRVIEKTLYNRRTRQDEPALFVALTFERREVLDSS<br>NIKPMNLIGVARGENIPAVIALTDPEGCPLSRFKDSLGNPTHILRIGESYKEKQRTIQA<br>KKEVEQRRAGGYSRKYASKAKNLADDMVRNTARDLLYYAVTQDAMLIFANLSRGFGRQG<br>KRTEMAERQYTRMEDWLTAKLAYEGLSKTYLSKTLAQYTSKTCSNCGFTITSADYDRVL<br>EKLKKTATGWMTTINGKELKVEGQITYYNRYKRQNVVKDLSVELDRLSEESVNNDISSW<br>TKGRSGEALSLLKKRFSHRPVQEKFVCLNCGFETHAAEQAALNIARSWLFLRSQEYKKY<br>QTNKTTGNTDKRAFVETWQSFYRKKLKEVWKPAV |
| 30 | dCasX519 | QEIKRINKIRRRLVKDSNTKKAGKTGPMKTLLVRVMTPDLRERLENLRKKPENIPQPIS<br>NTSRANLNKLLTDYTEMKKAILHVYWEEFQKDPVGLMSRVAQPASKKIDQNKLKPEMDE<br>KGNLTTAGFACSQCGQPLFVYKLEQVSEKGKAYTNYFGRCNVAEHEKLILLAQLKPEKD<br>SDEAVTYSLGKFGQRALDFYSIHVTKESTHPVKPLAQIAGNRYASGPVGKALSDACMGT<br>IASFLSKYQDIIIEHQKVVKGNQKRLESLRELAGKENLEYPSVTLPPQPHTKEGVDAYN<br>EVIARVRMWVNLNLWQKLKLSRDDAKPLLRLKGFPSFPLVERQANEVDWWDMVCNVKKL<br>INEKKEDGKVFWQNLAGYKRQEALRPYLSSEEDRKKGKKFARYQLGDLLLHLEKKHGED<br>WGKVYDEAWERIDKKVEGLSKHIKLEEERRSEDAQSKAALTDWLRAKASFVIEGLKEAD<br>KDEFCRCELKLQKWYGDLRGKPFAIEAENSILDISGFSKQYNCAFIWQKDGVKKLNLYL<br>IINYFKGGKLRFKKIKPEAFEANRFYTVINKKSGEIVPMEVNENFDDPNLIILPLAFGK<br>RQGREFIWNDLLSLETGSLKLANGRVIEKTLYNRRTRQDEPALFVALTFERREVLDSSN<br>IKPMNLIGVARGENIPAVIALTDPEGCPLSRFKDSLGNPTHIQLRIGESYKEKQRTIQA<br>KKEVEQRRAGGYSRKYASKAKNLADDMVRNTARDLLYYAVTQDAMLIFANLSRGFGRQG<br>KRTFMAERQYTRMEDWLTAKLAYEGLSKTYLSKTLAQYTSKTCSNCGFTITSADYDRVL<br>EKLKKTATGWMTTINGKELKVEGQITYYNRYKRQNVVKDLSVELDRLSEESVNNDISSW<br>TKGRSGEALSLLKKRFSHRPVQEKFVCLNCGFETHAAEQAALNIARSWLFLRSQEYKKY<br>QTNKTTGNTDKRAFVETWQSFYRKKLKEVWKPAV |
| 31 | dCasX520 | QEIKRINKIRRRLVKDSNTKKAGKTGPMKTLLVRVMTPDLRERLENLRKKPENIPQPIS<br>NTSRANLNKLLTDYTEMKKAILHVYWEEFQKDPVGLMSRVAQPASKKIDQNKLKPEMDE<br>KGNLTTAGFACSQCGQPLFVYKLEQVSEKGKAYTNYFGRCNVAEHEKLILLAQLKPEKD<br>SDEAVTYSLGKFGQRALDFYSIHVTKESTHPVKPLAQIAGNRYASGPVGKALSDACMGT<br>IASFLSKYQDIIIEHQKVVKGNQKRLESLRELAGKENLEYPSVTLPPQPHTKEGVDAYN<br>EVIARVRMWVNLNLWQKLKLSRDDAKPLLRLKGFPSFPLVERQANEVDWWDMVCNVKKL<br>INEKKEDGKVFWQNLAGYKRQEALRPYLSSEEDRKKGKKFARYQLGDLLLHLEKKHGED<br>WGKVYDEAWERIDKKVEGLSKHIKLEEERRSEDAQSKAALTDWLRAKASFVIEGLKEAD<br>KDEFCRCELKLQKWYGDLRGKPFAIEAENSILDISGFSKQYNCAFIWQKDGVKKLNLYL<br>IINYFKGGKLRFKKIKPEAFEANRFYTVINKKSGEIVPMEVNENFDDPNLIILPLAFGK<br>RQGREFIWNDLLSLETGSLKLANGRVIEKTLYNRRTRQDEPALFVALTFERREVLDSSN<br>IKPMNLIGVARGENIPAVIALTDPEGCPLSRFKDSLGNPTHILRIGESYKEKQRTTQAK<br>KEVEQRRAGGYSRKYASKAKNLADDMVRNTARDLLYYAVTQDAMLIFANLSRGFGRQGK<br>RTFMAERQYTRMEDWLTAKLAYEGLSKTYLSKTLAQYTSKTCSNCGFTITSADYDRVLE<br>KLKKTATGWMTTINGKELKVEGQITYYNRYKRQNVVKDLSVELDRLSEESVNNDISSWT<br>KGRSGEALSLLKKRFSHRPVQEKFVCLNCGFETHAAEQAALNIARSWLFLRSQEYKKYQ<br>TNKTTGNTDKRAFVETWQSFYRKKLKEVWKPAV |
| 32 | dCasX522 | QEIKRINKIRRRLVKDSNTKKAGKTGPMKTLLVRVMTPDLRERLENLRKKPENIPQPIS<br>NTSRANLNKLLTDYTEMKKAILHVYWEEFQKDPVGLMSRVAQPASKKIDQNKLKPEMDE<br>KGNLTTAGFACSQCGQPLFVYKLEQVSEKGKAYTNYFGRCNVAEHEKLILLAQLKPEKD<br>SDEAVTYSLGKFGQRALDFYSIHVTKESTHPVKPLAQIAGNRYASGPVGKALSDACMGT<br>IASFLSKYQDIIIEHQKVVKGNQKRLESLRELAGKENLEYPSVTLPPQPHTKEGVDAYN<br>EVIARVRMWVNLNLWQKLKLSRDDAKPLLRLKGFPSFPLVERQANEVDWWDMVCNVKKL<br>INEKKEDGKVFWQNLAGYKRQEALRPYLSSEEDRKKGKKFARYQLGDLLLHLEKKHGED<br>WGKVYDEAWERIDKKVEGLSKHIKLEEERRSEDAQSKAALTDWLRAKASFVIEGLKEAD<br>KDEFCRCELKLQKWYGDLRGKPFAIEAENSILDISGFSKQYNCAFIWQKDGVKKLNLYL<br>IINYFKGGKLRFKKIKPEAFEANRFYTVINKKSGEIVPMEVNENFDDPNLIILPLAFGK<br>RQGREFIWNDLLSLETGSLKLANGRVIEKTLYNRRTRQDEPALFVALTFERREVLDSSN<br>IKPMNLIGVARGENIPAVIALTDPEGCPLSRFKRSLGNPTHILRIGESYKEKQRTIQAK<br>KEVEQRRAGGYSRKYASKAKNLADDMVRNTARDLLYYAVTQDAMLIFANLSRGFGRQGK<br>RTFMAERQYTRMEDWLTAKLAYEGLSKTYLSKTLAQYTSKTCSNCGFTITSADYDRVLE<br>KLKKTATGWMTTINGKELKVEGQITYYNRYKRQNVVKDLSVELDRLSEESVNNDISSWT<br>KGRSGEALSLLKKRFSHRPVQEKFVCLNCGFETHAAEQAALNIARSWLFLRSQEYKKYQ<br>TNKTTGNTDKRAFVETWQSFYRKKLKEVWKPAV |
| 33 | dCasX523 | QEIKRINKIRRRLVKDSNTKKAGKTYPMKTLLVRVMTPDLRERLENLRKKPENIPQPIS<br>NTSRANLNKLLTDYTEMKKAILHVYWEEFQKDPVGLMSRVAQPASKKIDQNKLKPEMDE<br>KGNLTTAGFACSQCGQPLFVYKLEQVSEKGKAYTNYFGRCNVAEHEKLILLAQLKPEKD<br>SDEAVTYSLGKFGQRALDFYSIHVTKESTHPVKPLAQIAGNRYASGPVGKALSDACMGT<br>IASFLSKYQDIIIEHQKVVKGNQKRLESLRELAGKENLEYPSVTLPPQPHTKEGVDAYN<br>EVIARVRMWVNLNLWQKLKLSRDDAKPLLRLKGFPSFPLVERQANEVDWWDMVCNVKKL<br>INEKKEDGKVFWQNLAGYKRQEALRPYLSSEEDRKKGKKFARYQLGDLLLHLEKKHGED<br>WGKVYDEAWERIDKKVEGLSKHIKLEEERRSEDAQSKAALTDWLRAKASFVIEGLKEAD |

TABLE 4-continued dCasX Variant Sequences

| SEQ ID NO | dCasX | Amino Acid Sequence |
|---|---|---|
| | | KDEFCRCELKLQKWYGDLRGKPFAIEAENSILDISGFSKQYNCAFIWQKDGVKKLNLYL |
| | | IINYFKGGKLRFKKIKPEAFEANRFYTVINKKSGEIVPMEVNENFDDPNLIILPLAFGK |
| | | RQGREFIWNDLLSLETGSLKLANGRVIEKTLYNRRTRQDEPALFVALTFERREVLDSSN |
| | | IKPMNLIGVARGENIPAVIALTDPEGCPLSRFKDSLGNPTHILRIGESYKEKQRTIQAK |
| | | KEVEQRRAGGYSRKYASKAKNLADDMVRNTARDLLYYAVTQDAMLIFANLSRGFGRQGK |
| | | RTFMAERQYTRMEDWLTAKLAYEGLSKTYLSKTLAQYTSKTCSNCGFTITSADYDRVLE |
| | | KLKKTATGWMTTINGKELKVEGQITYYNRYKRQNVVKDLSVELDRLSEESVNNDISSWT |
| | | KGRSGEALSLLKKRFSHRPVQEKFVCLNCGFETHAAEQAALNIARSWLFLRSQEYKKYQ |
| | | TNKTTGNTDKRAFVETWQSFYRKKLKEVWKPAV |
| 34 | dCasX524 | QEIKRINKIRRRLVKDSNTKKAGKTGPMKTLLVRVMTPDLRERLENLRKKPENIPQPIS |
| | | NTSRANLNKLLTDYTEMKKAILHVYWEEFQKDPVGLMSRVAQPASKKIDQNKLKPEMDE |
| | | KGNLTTAGFACSQCGQPLFVYKLEQVSEKGKAYTNYFGRCNVAEHEKLILLAQLKPEKD |
| | | SDEAVTYSLGKFGQRALDFYSIHVTKESTHPVKPLAQIAGNRYASGPVGKALSDACMGT |
| | | IASFLSKYQDIIIEHQKVVKGNQKRLESLRELAGKENLEYPSVTLPPQPHTKEGVDAYN |
| | | EVIARVRMWVNLNLWQKLKLSRDDAKPLLRLKGFPSFPLVERQANEVDWWDMVCNVKKL |
| | | INEKKEDGKVFWQNLAGYKRQEALRPYLSSEEDRKKGKKFARYQLGDLLLHLEKKHGED |
| | | WGKVYDEAWERIDKKVEGLSKHIKLEEERRSEDAQSKAALTDWLRAKASFVIEGLKEAD |
| | | KDEFCRCELKLQKWYGDLRGKPFAIEAENSILDISGFSKQYNCAFIWQKDGVKKLNLYL |
| | | IINYFKGGKLRFKKIKPEAFEANRFYTVINKKSGEIVPMEVNFNFDDPNLIILPLAFGK |
| | | RQGREFIWNDLLSLETGSLKLANGRVIEKTLYNRRTRQDEPALFVALTFERREVLDSSN |
| | | IKPMNLIGVARGENIPAVIALTDPEGCPLSRFKDSLGNPTHILRIGESYKEKQRTIQAK |
| | | KEVEQRRAGGYSRKYASKAKNLADDMVRNTARDLLYYAVTQDAMLIFANLSRGFGRQGK |
| | | RTFMAERQYTRMEDWLTAKLAYEGLSKTYLSKTLAQYTSKTCSNCGFTIHSADYDRVLE |
| | | KLKKTATGWMTTINGKELKVEGQITYYNRYKRQNVVKDLSVELDRLSEESVNNDISSWT |
| | | KGRSGEALSLLKKRFSHRPVQEKFVCLNCGFETHAAEQAALNIARSWLFLRSQEYKKYQ |
| | | TNKTTGNTDKRAFVETWQSFYRKKLKEVWKPAV |
| 35 | dCasX525 | QEIKRINKIRRRLVKDSNTKKAGKTGPMKTLLVRVMTPDLRERLENLRKKPENIPQPIS |
| | | NTSRANLNKLLTDYTEMKKAILHVYWEEFQKDPVGLMSRVAQPASKKIDQNKLKPEMDE |
| | | KGNLTTAGFACSQCGQPLFVYKLEQVSEKGKAYTNYFGRCNVAEHEKLILLAQLKPEKD |
| | | SDEAVTYSLGKFGQRALDFYSIHVTKESTHPVKPLAQIAGNRYASGPVGKALSDACMGT |
| | | IASFLSKYQDIIIEHQKVVKGNQKRLESLRELAGKENLEYPSVTLPPQPHTKEGVDAYN |
| | | EVIARVRMWVNLNLWQKLKLSRDDAKPLLRLKGFPSFPLVERQANEVDWWDMVCNVKKL |
| | | INEKKEDGKVFWQNLAGYKRQEALRPYLSSEEDRKKGKKFARYQLGDLLLHLEKKHGED |
| | | WGKVYDEAWERIDKKVEGLSKHIKLEEERRSEDAQSKAALTDWLRAKASFVIEGLKEAD |
| | | KDEFCRCELKLQKWYGDLRGKPFAIEAENSILDISGFSKQYNCAFIWQKDGVKKLNLYL |
| | | IINYFKGGKLRFKKIKPEAFEANRFYTVINKKSGEIVPMEVNENFDDPNLIILPLAFGK |
| | | RQGREFIWNDLLSLETGSLKLANGRVIEKTLYNRRTRQDEPALFVALTFERREVLDSSN |
| | | IKPMNLIGVARGENIPAVIALTDPEGCPLSRFKDSLGNPTHILRIGESYKEKQRTIQAK |
| | | KEVEQRRAGGYSRKYASKAKNLADDMVRNTARDLLYYAATQDAMLIFANLSRGFGRQGK |
| | | RTFMAERQYTRMEDWLTAKLAYEGLSKTYLSKTLAQYTSKTCSNCGFTITSADYDRVLE |
| | | KLKKTATGWMTTINGKELKVEGQITYYNRYKRQNVVKDLSVELDRLSEESVNNDISSWT |
| | | KGRSGEALSLLKKRFSHRPVQEKFVCLNCGFETHAAEQAALNIARSWLFLRSQEYKKYQ |
| | | TNKTTGNTDKRAFVETWQSFYRKKLKEVWKPAV |
| 36 | dCasX526 | QEIKRINKIRRRLVKDSNTKKAGKTGPMKTLLVRVMTPDLRERLENLRKKPENIPQPIS |
| | | NTSRANLNKLLTDYTEMKKAILHVYWEEFQKDPVGLMSRVAQPASKKIDQNKLKPEMDE |
| | | KGNLTTAGFACSQCGQPLFVYKLEQVSEKGKAYTNYFGRCNVAEHEKLILLAQLKPEKD |
| | | SDEAVTYSLGKFGQRALDFYSIHVTKESTHPVKPLAQIAGNRYASGPVGKALSDACMGT |
| | | IASFLSKYQDIIIEHQKVVKGNQKRLESLRELAGKENLEYPSVTLPPQPHTKEGVDAYN |
| | | EVIARVRMWVNLNLWQKLKLSRDDAKPLLRLKGFPSFPLVERQANEVDWWDMVCNVKKL |
| | | INEKKEDGKVFWQNLAGYKRQEALRPYLSSEEDRKKGKKFARYQLGDLLLHLEKKHGED |
| | | WGKVYDEAWERIDKKVEGLSKHIKLEEERRSEDAQSKAALTDWLRAKASFVIEGLKEAD |
| | | KDEFCRCELKLQKWYGDLRGKPFAIEAENSILDISGFSKQYNCAFIWQKDGVKKLNLYL |
| | | IINYFKGGKLRFKKIKPEAFEANRFYTVINKKSGEIVPMEVNENFDDPNLIILPLAFGK |
| | | RQGREFIWNDLLSLETGSLKLANGRVIEKTLYNRRTRQDEPALFVALTFERREVLDSSN |
| | | IKPMNLIGVARGENIPAVIALTDPEGCPLSRFKDSLGNPTHILRIGESYKEKQRTIQAA |
| | | KEVEQRRAGGYSRKYASKAKNLADDMVRNTARDLLYYAVTQDAMLIFANLSRGFGRQGK |
| | | RTFMAERQYTRMEDWLTAKLAYEGLSKTYLSKTLAQYTSKTCSNCGFTITSADYDRVLE |
| | | KLKKTATGWMTTINGKELKVEGQITYYNRYKRQNVVKDLSVELDRLSEESVNNDISSWT |
| | | KGRSGEALSLLKKRFSHRPVQEKFVCLNCGFETHAAEQAALNIARSWLFLRSQEYKKYQ |
| | | TNKTTGNTDKRAFVETWQSFYRKKLKEVWKPAV |
| 59353 | dCasX535 | QEIKRINKIRRRLVKDSNTKKAGKTGPMKTLLVRVMTPDLRERLENLRKKPENIPQPIS |
| | | NTSRANLNKLLTDYTEMKKAILHVYWEEFQKDPVGLMSRVAQPASKKIDQNKLKPEMDE |
| | | KGNLTTAGFACSQCGQPLFVYKLEQVSEKGKAYTNYFGRCNVAEHEKLILLAQLKPEKD |
| | | SDEAVTYSLGKFGQRALDFYSIHVTKESTHPVKPLAQIAGNRYASSPVGKALSDACMGT |
| | | IASFLSKYQDIIIEHQKVVKGNQKRLESLRELAGKENLEYPSVTLPPQPHTKEGVDAYN |
| | | EVIARVRMWVNLNLWQKLKLSRDDAKPLLRLKGFPSFPLVERQANEVDWWDMVCNVKKL |
| | | INEKKEDGKVFWQNLAGYKRQEALRPYLSSEEDRKKGKKFARYQLGDLLLHLEKKHGED |
| | | WGKVYDEAWERIDKKVEGLSKHIKLEEERRSEDAQSKAALTDWLRAKASFVIEGLKEAD |
| | | KDEFCRCELKLQKWYGDLRGKPFAIEAENSILDISGFSKQYNCAFIWQKDGVKKLNLYL |
| | | IINYFKGGKLRFKKIKPEAFEANRFYTVINKKSGEIVPMEVNENFDDPNLIILPLAFGK |

TABLE 4-continued dCasX Variant Sequences

| SEQ ID NO | dCasX | Amino Acid Sequence |
|---|---|---|
| | | RQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAV |
| 59354 | dCasX593 | QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRWWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAV |
| 59355 | dCasX668 | QEIKRINKIRRRLVKDSNTKKAGKTRGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASSPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNENFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAV |
| 59356 | dCasX672 | QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLIKLAQLKPEKDSDEAVTYSLGKFGQRALDFYSIHVTKESTHPVKPLAQIAGNRYASSPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAV |
| 59357 | dCasX676 | QEIKRINKIRRRLVKDSNTKKAGKTRGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLIKLAQLKPEKDSDEAVTYSLGKFGQRALDFYSIHVTKESTHPVKPLAQIAGNRYASSPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNENFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQA |

TABLE 4-continued dCasX Variant Sequences

| SEQ ID NO | dCasX | Amino Acid Sequence |
|---|---|---|
| | | KKEVEQRRAGGYSRKYASKAKNLADDMVRNTARDLLYYAVTQDAMLIFANLSRGFGRQG<br>KRTFMAERQYTRMEDWLTAKLAYEGLPSKTYLSKTLAQYTSKTCSNCGFTITSADYDRV<br>LEKLKKTATGWMTTINGKELKVEGQITYYNRYKRQNVVKDLSVELDRLSEESVNNDISS<br>WTKGRSGEALSLLKKRFSHRPVQEKFVCLNCGFETHAAEQAALNIARSWLFLRSQEYKK<br>YQTNKTTGNTDKRAFVETWQSFYRKKLKEVWKPAV |
| 59358 | dCasX812 | QEIKRINKIRRRLVKDSNTKKAGKTGPMKTLLVRVMTPDLRERLENLRKKPENIPQPIS<br>NTSRANLNKLLTDYTEMKKAILHVYWEEFQKDPVGLMSRVAQPASKKIDQNKLKPEMDE<br>KGNLTTAGFACSQCGQPLFVYKLEQVSEKGKAYTNYFGRCNVAEHEKLILLAQLKPEKD<br>SDEAVTYSLGKFGQRALDFYSIHVTKESTHPVKPLAQIAGNRYASGPVGKALSDACMGT<br>IASFLSKYQDIIIEHQKVVKGNQKRLESLRELAGKENLEYPSVTLPPQPHTKEGVDAYN<br>EVIARVRMWVNLNLWQKLKLSRDDAKPLLRLKKFPSFPLVERQANEVDWWDMVCNVKKL<br>INEKKEDGKVFWQNLAGYKRQEALRPYLSSEEDRKKGKKFARYQLGDLLLHLEKKHGED<br>WGKVYDEAWERIDKKVEGLSKHIKLEEERRSEDAQSKAALTDWLRAKASFVIEGLKEAD<br>KDEFCRCELKLQKWYGDLRGKPFAIEAENSILDISGFSKQYNCAFIWQKDGVKKLNLYL<br>IINYFKGGKLRFKKIKPEAFEANRFYTVINKKSGEIVPMEVNENFDDPNLIILPLAFGK<br>RQGREFIWNDLLSLETGSLKLANGRVIEKTLYNRRTRQDEPALFVALTFERREVLDSSN<br>IKPMNLIGVARGENIPAVIALTDPEGCPLSRFKDSLGNPTHILRIGESYKEKQRTIQAK<br>KEVEQRRAGGYSRKYASKAKNLADDMVRNTARDLLYYAVTQDAMLIFANLSRGFGRQGK<br>RTFMAERQYTRMEDWLTAKLAYEGLPSKTYLSKTLAQYTSKTCSNCGFTITSADYDRVL<br>EKLKKTATGWMTTINGKELKVEGQITYYNRYKRQNVVKDLSVELDRLSEESVNNDISSW<br>TKGRSGEALSLLKKRFSHRPVQEKFVCLNCGFETHAAEQAALNIARSWLFLRSQEYKKY<br>QTNKTTGNTDKRAFVETWQSFYRKKLKEVWKPAV |

d. Affinity for the gRNA

In some embodiments, a dCasX with linked repressor domains has improved affinity for the gRNA relative to a reference dCasX protein, leading to the formation of the ribonucleoprotein complex. Increased affinity of the dXR for the gRNA may, for example, result in a lower $K_d$ for the generation of a RNP complex, which can, in some cases, result in a more stable ribonucleoprotein complex formation. In some embodiments, the $K_d$ of a dXR for a gRNA is increased relative to a reference dCasX protein by a factor of at least about 1.1, at least about 1.2, at least about 1.3, at least about 1.4, at least about 1.5, at least about 1.6, at least about 1.7, at least about 1.8, at least about 1.9, at least about 2, at least about 3, at least about 4, at least about 5, at least about 6, at least about 7, at least about 8, at least about 9, at least about 10, at least about 15, at least about 20, at least about 25, at least about 30, at least about 35, at least about 40, at least about 45, at least about 50, at least about 60, at least about 70, at least about 80, at least about 90, or at least about 100. In some embodiments, the dCasX variant has about 1.1 to about 10-fold increased binding affinity to the gRNA compared to the catalytically-dead variant of reference CasX protein of SEQ ID NO: 2.

In some embodiments, increased affinity of the dCasX with linked repressor domains for the gRNA results in increased stability of the ribonucleoprotein complex when delivered to mammalian cells, including in vivo delivery to a subject. This increased stability can affect the function and utility of the complex in the cells of a subject, as well as result in improved pharmacokinetic properties in blood, when delivered to a subject. In some embodiments, increased affinity of the dXR, and the resulting increased stability of the ribonucleoprotein complex, allows for a lower dose of the dXR to be delivered to the subject or cells while still having the desired activity; for example in vivo or in vitro gene repression. The increased ability to form RNP and keep them in stable form can be assessed using in vitro assays known in the art.

In some embodiments, a higher affinity (tighter binding) of a dCasX variant protein and linked repressor domain to a gRNA allows for a greater amount of repression events when both the dCasX variant protein and the gRNA remain in an RNP complex. Increased repression events can be assessed using repression assays described herein.

Methods of measuring dXR fusion protein binding affinity for a gRNA include in vitro methods using purified dXR fusion protein and gRNA. The binding affinity for reference dXR can be measured by fluorescence polarization if the gRNA or dXR fusion protein is tagged with a fluorophore. Alternatively, or in addition, binding affinity can be measured by biolayer interferometry, electrophoretic mobility shift assays (EMSAs), or filter binding. Additional standard techniques to quantify absolute affinities of RNA binding proteins such as the reference dCasX and variant proteins of the disclosure for specific gRNAs such as reference gRNAs and variants thereof include, but are not limited to, isothermal calorimetry (ITC), and surface plasmon resonance (SPR), as well as the methods of the Examples.

e. Improved Specificity for a Target Site

In some embodiments, a dCasX variant protein with linked repressor domains has improved specificity for a target nucleic acid sequence relative to a reference dCasX protein with linked repressor domains. As used herein, "specificity," sometimes referred to as "target specificity," refers to the degree to which a CRISPR/Cas system ribonucleoprotein complex binds off-target sequences that are similar, but not identical to the target nucleic acid sequence; e.g., a dXR RNP with a higher degree of specificity would exhibit reduced off-target methylation of sequences relative to a reference dXR protein. The specificity, and the reduction of potentially deleterious off-target effects, of CRISPR/Cas system proteins can be vitally important in order to achieve an acceptable therapeutic index for use in mammalian subjects.

In some embodiments, a dCasX variant protein with linked repressor domains has improved specificity for a target site within the target sequence that is complementary to the targeting sequence of the gRNA. Without wishing to be bound by theory, it is possible that amino acid changes in the helical I and II domains that increase the specificity of the dXR for the target nucleic acid strand can increase the specificity of the dXR for the target nucleic acid overall. In some embodiments, amino acid changes that increase specificity of dXRs for target nucleic acid may also result in decreased affinity of dXRs for DNA.

f. Protospacer and PAM Sequences

Herein, the protospacer is defined as the DNA sequence complementary to the targeting sequence of the guide RNA and the DNA complementary to that sequence, referred to as the target strand and non-target strand, respectively. As used herein, the PAM is a nucleotide sequence proximal to the protospacer that, in conjunction with the targeting sequence of the gRNA, helps the orientation and positioning of the CasX on the DNA strand.

PAM sequences may be degenerate, and specific RNP constructs may have different preferred and tolerated PAM sequences that support different efficiencies of binding and, in the case of catalytically-active nucleases, cleavage. Following convention, unless stated otherwise, the disclosure refers to both the PAM and the protospacer sequence and their directionality according to the orientation of the non-target strand. This does not imply that the PAM sequence of the non-target strand, rather than the target strand, is determinative of cleavage or mechanistically involved in target recognition. For example, when reference is to a TTC PAM, it may in fact be the complementary GAA sequence that is required for target binding, or it may be some combination of nucleotides from both strands. In the case of the CasX proteins disclosed herein, the PAM is located 5' of the protospacer with a single nucleotide separating the PAM from the first nucleotide of the protospacer. Thus, in the case of reference CasX, a TTC PAM should be understood to mean a sequence following the formula 5'- . . . NNTTCN (protospacer)NNNNNN . . . 3' where 'N' is any DNA nucleotide and '(protospacer)' is a DNA sequence having identity with the targeting sequence of the guide RNA. In the case of a CasX variant with expanded PAM recognition, a TTC, CTC, GTC, or ATC PAM should be understood to mean a sequence following the formulae: 5'- . . . NNTTCN (protospacer)NNNNNN . . . 3'; 5'- . . . NNCTCN(protospacer)NNNNNN . . . 3'; 5'- . . . NNGTCN(protospacer) NNNNNN . . . 3'; or 5'- . . . NNATCN(protospacer) NNNNNN . . . 3'. Alternatively, a TC PAM should be understood to mean a sequence following the formula 5'- . . . NNNTCN(protospacer)NNNNNN . . . 3'.

In some embodiments, a dCasX variant exhibits greater repression efficiency and/or binding of a target sequence in the target nucleic acid when any one of the PAM sequences TTC, ATC, GTC, or CTC is located 1 nucleotide 5' to the non-target strand of the protospacer having identity with the targeting sequence of the gRNA in a cellular assay system compared to the repression efficiency and/or binding of an RNP comprising a reference dCasX protein in a comparable assay system. In some embodiments, the PAM sequence is TTC. In some embodiments, the PAM sequence is ATC. In some embodiments, the PAM sequence is CTC. In some embodiments, the PAM sequence is GTC.

g. dCasX Fusion Proteins

In some embodiments, the disclosure provides dXR fusion proteins comprising a heterologous protein.

In some cases, a heterologous polypeptide (a fusion partner) for use with a dXR provides for subcellular localization, i.e., the heterologous polypeptide contains a subcellular localization sequence (e.g., a nuclear localization signal (NLS) for targeting to the nucleus, a sequence to keep the fusion protein out of the nucleus, e.g., a nuclear export sequence (NES), a sequence to keep the fusion protein retained in the cytoplasm, a mitochondrial localization signal for targeting to the mitochondria, a chloroplast localization signal for targeting to a chloroplast, an ER retention signal, and the like).

Figure 38:
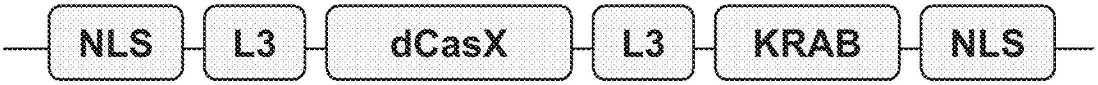
FIG. 38 illustrates the schematic of a generic dXR configuration as described in Example 1. NLS is the nuclear localization signal, L3 is linker 3 (see Table 24 for AA sequence).

In some cases, a dXR fusion protein includes (is fused to) a nuclear localization signal (NLS). In some cases, a dXR fusion protein is fused to 2 or more, 3 or more, 4 or more, or 5 or more 6 or more, 7 or more, 8 or more NLSs. In some cases, one or more NLSs (2 or more, 3 or more, 4 or more, or 5 or more NLSs) are positioned at or near (e.g., within 50 amino acids of) the N-terminus and/or the C-terminus of the dXR fusion protein. In some cases, one or more NLSs (2 or more, 3 or more, 4 or more, or 5 or more NLSs) are positioned at or near (e.g., within 50 amino acids of) the N-terminus of the dXR fusion protein. In some cases, one or more NLSs (2 or more, 3 or more, 4 or more, or 5 or more NLSs) are positioned at or near (e.g., within 50 amino acids of) the C-terminus of the dXR fusion protein. In some cases, one or more NLSs (3 or more, 4 or more, or 5 or more NLSs) are positioned at or near (e.g., within 50 amino acids of) both the N-terminus and the C-terminus of the dXR fusion protein. In some cases, an NLS is positioned at the N-terminus and an NLS is positioned at the C-terminus of the dXR fusion protein. Representative configurations of dXR with NLS are shown in FIGS. 7, 38, and 45.

In some cases, non-limiting examples of NLSs suitable for use with a dXR include sequences having at least about 80%, at least about 90%, or at least about 95% identity or are identical to sequences derived from: the NLS of the SV40 virus large T-antigen, having the amino acid sequence PKKKRKV (SEQ ID NO: 33289); the NLS from nucleoplasmin (e.g., the nucleoplasmin bipartite NLS with the sequence KRPAATKKAGQAKKKK (SEQ ID NO: 33290); the c-myc NLS having the amino acid sequence PAAKRVKLD (SEQ ID NO: 33291) or RQRRNELKRSP (SEQ ID NO: 33292); the hRNPAI M9 NLS having the sequence NQSSNFGPMKGGNFGGRSSGPYGGGGQYFAKPRNQGGY (SEQ ID NO: 33293); the sequence RMRIZFKNKGKDTAELRRRRVEVSVELRKAKKDEQILKRRNV (SEQ ID NO: 33294) of the IBB domain from importin-alpha; the sequences VSRKRPRP (SEQ ID NO: 33295) and PPKKARED (SEQ ID NO: 33296) of the myoma T protein; the sequence PQPKKKPL (SEQ ID NO: 33297) of human p53; the sequence SALIKKKKKMAP (SEQ ID NO: 33298) of mouse c-abl IV; the sequences DRLRR (SEQ ID NO: 33299) and PKQKKRK (SEQ ID NO: 33300) of the influenza virus NS1; the sequence RKLKKKIKKL (SEQ ID NO: 33301) of the Hepatitis virus delta antigen; the sequence REKKKFLKRR (SEQ ID NO: 33302) of the mouse Mxl protein; the sequence KRKGDEVDGVDEVAKKKSKK (SEQ ID NO: 33303) of the human poly(ADP-ribose) polymerase; the sequence RKCLQAGMNLEARKTKK (SEQ ID NO: 33304) of the steroid hormone receptors (human) glucocorticoid; the sequence PRPRKIPR (SEQ ID NO: 33305) of Boma disease virus P protein (BDV-P1); the sequence PPRKKRTVV (SEQ ID NO: 33306) of hepatitis C virus nonstructural protein (HCV-NS5A); the sequence NLSKKKKRKREK (SEQ ID NO: 33307) of LEF1; the sequence RRPSRPFRKP (SEQ ID NO: 33308) of ORF57 simirae; the sequence KRPRSPSS (SEQ ID NO: 33309) of EBV LANA; the sequence KRGINDRNFWRGENERKTR (SEQ ID NO: 33310) of Influenza A protein; the sequence PRPPKMARYDN (SEQ ID NO: 33311) of human RNA helicase A (RHA); the sequence KRSFSKAF (SEQ ID NO: 33312) of nucleolar RNA helicase II; the sequence KLKIKRPVK (SEQ ID NO: 33313) of TUS-protein; the sequence PKKKRKVPPPPAAKRVKLD (SEQ ID NO: 33314) associated with importin-alpha; the sequence PKTRRRPRRSQRKRPPT (SEQ ID NO: 33315) from the Rex protein in HTLV-1; the sequence SRRRKANPTKLSENAKKLAKEVEN (SEQ ID NO: 33316) from the EGL-13 protein of *Caenorhabditis elegans*; and the sequences KTRRRPRRSQRKRPPT (SEQ ID NO: 33317), RRKKRRPRRKKRR (SEQ ID NO: 33318), PKKKSRKPKKKSRK (SEQ ID NO: 33319), HKKKHPDASVNFSEFSK (SEQ ID NO: 33320), QRPGPYDRPQRPGPYDRP (SEQ ID NO: 33321), LSPSLSPLLSPSLSPL (SEQ ID NO: 33322), RGKGGKGLGKGGAKRHRK (SEQ ID NO: 33323), PKRGRGRPKRGRGR (SEQ ID NO: 33324), PKKKRKVPPPPAAKRVKLD (SEQ ID NO: 33325), PKKKRKVPPPPKKKRKV (SEQ ID NO: 33326), PAKRARRGYKC (SEQ ID NO: 33327), KLGPRKATGRW (SEQ ID NO: 33328), PRRKREE (SEQ ID NO: 33329), PYRGRKE (SEQ ID NO: 33330), PLRKRPRR (SEQ ID NO: 33331), PLRKRPRRGSPLRKRPRR (SEQ ID NO: 33332), PAAKRVKLDGGKRTADGSEFESPKKKRKV (SEQ ID NO: 33333), PAAKRVKLDGGKRTADGSEFESPKKKRKVGIHGVPAA (SEQ ID NO: 33334), PAAKRVKLDGGKRTADGSEFESPKKKRKVAEAAAKEAAAKEAAAKA (SEQ ID NO: 33335), PAAKRVKLDGGKRTADGSEFESPKKKRKVPG (SEQ ID NO: 33336), KRKGSPERGERKRHW (SEQ ID NO: 33337), KRTADSQHSTPPKTKRKVEFEPKKKRKV (SEQ ID NO: 33338), and PKKKRKVGGSKRTADSQHSTPPKTKRKVEFEPKKKRKV (SEQ ID NO: 33339). In some embodiments, the one or more NLS are linked to the dXR or to adjacent NLS with a linker peptide wherein the linker peptide is selected from the group consisting of RS, (G)n (SEQ ID NO: 33240), (GS)n (SEQ ID NO: 33241), (GGS)n (SEQ ID NO: 33242), (GSGGS)n (SEQ ID NO: 33243), (GGSGGS)n (SEQ ID NO: 33244), (GGGS)n (SEQ ID NO: 33245), GGSG (SEQ ID NO: 33246), GGSGG (SEQ ID NO: 33247), GSGSG (SEQ ID NO: 33248), GSGGG (SEQ ID NO: 33249), GGGSG (SEQ ID NO: 33250), GSSSG (SEQ ID NO: 33251), (GP)n (SEQ ID NO: 33252), GPGP (SEQ ID NO: 33253), GGSGGGS (SEQ ID NO: 33254), GSGSGGG (SEQ ID NO: 57628), GGCGGTTCCGGCGGAGGAAGC (SEQ ID NO: 57624), GGCGGTTCCGGCGGAGGTTCC (SEQ ID NO: 57625), GGATCAGGCTCTGGAGGTGGA (SEQ ID NO: 57627), GGAGGGCCGAGCTCTGGCGCACCCCCACCAAGTGGAGGGTCTCCTGCCGGGTCCCC AACATCTACTGAAGAAGGCACCAGCGAATCCGCAACGCCCGAGTCAGGCCCTGGTA CCTCCACAGAACCATCTGAAGGTAGTGCGCCTGGTTCCCCAGCTGGAAGCCCTACTT CCACCGAAGAAGGCACGTCAACCGAACCAAGTGAAGGATCTGCCCCTGGGACCAGC ACTGAACCATCTGAG (SEQ ID NO: 57620), SSGNSNANSRGPSFSSGLVPLSLRGSH (SEQ ID NO: 57623), GGPSSGAPPPSGGSPAGSPTSTEEGTSESATPESGPGTSTEPSEGSAPGSPAGSPTSTEEGT STEPSEGSAPGTSTEPSE (SEQ ID NO: 57621), TCTAGCGGCAATAGTAACGCTAACAGCCGCGGGCCGAGCTTCAGCAGCGGCCTGGT GCCGTTAAGCTTGCGCGGCAGCCAT (SEQ ID NO: 57622), GGP, PPP, PPAPPA (SEQ ID NO: 33255), PPPGPPP (SEQ ID NO: 33256), PPPG (SEQ ID NO: 33257), PPP(GGGS)n (SEQ ID NO: 33258), (GGGS)nPPP (SEQ ID NO: 33259), AEAAAKEAAAKEAAAKA (SEQ ID NO:33260), AEAAAKEAAAKA (SEQ ID NO: 33261), SGSETPGTSESATPES (SEQ ID NO: 33262), and TPPKTKRKVEFE (SEQ ID NO: 33263), wherein n is an integer of 1 to 5.

In general, NLS (or multiple NLSs) are of sufficient strength to drive accumulation of a reference or dCasX variant fusion protein in the nucleus of a eukaryotic cell. Detection of accumulation in the nucleus may be performed by any suitable technique. For example, a detectable marker may be fused to a reference or dCasX variant fusion protein such that location within a cell may be visualized. Cell nuclei may also be isolated from cells, the contents of which may then be analyzed by any suitable process for detecting protein, such as immunohistochemistry, Western blot, or enzyme activity assay. Accumulation in the nucleus may also be determined indirectly.

In some embodiments, a dXR comprising an N-terminal NLS comprises a sequence of any one of SEQ ID NOS: 37-112 as set forth in Tables 5 and 6 and SEQ ID NOS: 59359-59432 as set forth in Table 7.

TABLE 5

N-terminal NLS sequences

| NLS Amino Acid Sequence* | NLS ID | SEQ ID NO |
|---|---|---|
| **PKKKRKV**SR | 1 | 37 |
| **PKKKRKV**GGS**PKKKRKV**GGS**PKKKRKV**GGS**PKKKRKV**SR | 2 | 38 |
| **PKKKRKV**GGS**PKKKRKV**GGS**PKKKRKV**GGS**PKKKRKV**GGS**PKKKRKV**GGS**PKKKRKV**SR | 3 | 39 |
| **PAAKRVKLD**SR | 4 | 40 |
| **PAAKRVKLD**GGS**PAAKRVKLD**SR | 5 | 41 |
| **PAAKRVKLD**GGS**PAAKRVKLD**GGS**PAAKRVKLD**GGS**PAAKRVKLD**SR | 6 | 42 |
| **PAAKRVKLD**GGS**PAAKRVKLD**GGS**PAAKRVKLD**GGS**PAAKRVKLD**GGS**PAAKRVKLD**GGS**PAAKRVKLD**SR | 7 | 43 |
| **KRPAATKKAGQAKKKK**SR | 8 | 44 |
| **KRPAATKKAGQAKKKK**GGS**KRPAATKKAGQAKKKK**SR | 9 | 45 |

TABLE 5-continued

| N-terminal NLS sequences | | |
|---|---|---|
| NLS Amino Acid Sequence* | NLS ID | SEQ ID NO |
| **PAAKRVKLD**GGS**PKKKRKV**SR | 10 | 46 |
| **PAAKKKKLD**GGS**PKKKRKV**SR | 11 | 47 |
| **PAAKKKKLD**SR | 12 | 48 |
| **PAAKKKKLD**GGS**PAAKKKKLD**GGS**PAAKKKKLD**SR | 13 | 49 |
| **PAAKKKKLD**GGS**PAAKKKKLD**GGS**PAAKKKKLD**GGS**PAAKKKKLD**SR | 14 | 50 |
| **PAKRARRGYKC**SR | 15 | 51 |
| **PAKRARRGYKC**GS**PAKRARRGYKC**SR | 16 | 52 |
| **PRRKREE**SR | 17 | 53 |
| **PYRGRKE**SR | 18 | 54 |
| **PLRKRPRR**SR | 19 | 55 |
| **PLRKRPRR**GS**PLRKRPRR**SR | 20 | 56 |
| **PAAKRVKLD**GG**KRTADGSEFESPKKKRKV**GGS | 21 | 57 |
| **PAAKRVKLD**GG**KRTADGSEFESPKKKRKV**PPPPG | 22 | 58 |
| **PAAKRVKLD**GG**KRTADGSEFESPKKKRKV**GIHGVPAAPG | 23 | 59 |
| **PAAKRVKLD**GG**KRTADGSEFESPKKKRKV**GGGSGGGSPG | 24 | 60 |
| **PAAKRVKLD**GG**KRTADGSEFESPKKKRKV**PGGGSGGGSPG | 25 | 61 |
| **PAAKRVKLD**GG**KRTADGSEFESPKKKRKV**AEAAAKEAAAKEAAAKAPG | 26 | 62 |
| **PAAKRVKLD**GG**KRTADGSEFESPKKKRKV**PG | 27 | 63 |
| **PAAKRVKLD**GGS**PKKKRKV**GGS | 28 | 64 |
| **PAAKRVKLD**PPPPKKKRKVPG | 29 | 65 |
| **PAAKRVKLD**PG | 30 | 66 |
| **PAAKRVKLD**GGGSGGGSGGGS | 31 | 67 |
| **PAAKRVKLD**PPP | 32 | 68 |
| **PAAKRVKLD**GGGSGGGSGGGSPPP | 33 | 69 |
| **PKKKRKV**PPP | 34 | 70 |
| **PKKKRKV**GGS | 35 | 71 |

*Sequences in bold are NLS, while unbolded sequences are linkers.

TABLE 6

| C-terminal NLS sequences | | |
|---|---|---|
| NLS Amino Acid Sequence | NLS ID | SEQ ID NO |
| GS**PKKKRKV** | 1 | 72 |
| GS**PKKKRKV**GGS**PKKKRKV**GGS**PKKKRKV**GGS**PKKKRKV** | 2 | 73 |
| GS**PKKKRKV**GGS**PKKKRKV**GGS**PKKKRKV**GGS**PKKKRKV**GGS**PKKKRKV**GGS**PKKKRKV** | 3 | 74 |
| GS**PAAKRVKLD** | 4 | 75 |
| GS**PAAKRVKLD**GGS**PAAKRVKLD** | 5 | 76 |
| GS**PAAKRVKLD**GGS**PAAKRVKLD**GGS**PAAKRVKLD**GGS**PAAKRVKLD** | 6 | 77 |

TABLE 6-continued

| C-terminal NLS sequences | | |
|---|---|---|
| NLS Amino Acid Sequence | NLS ID | SEQ ID NO |
| GS**PAAKRVKLD**GGS**PAAKRVKLD**GGS**PAAKRVKLD**GGS**PAAKRVKLD**GGS**PAAKRVKLD** GGS**PAAKRVKLD** | 7 | 78 |
| GS**KRPAATKKAGQAKKKK** | 8 | 79 |
| **KRPAATKKAGQAKKKK**GGS**KRPAATKKAGQAKKKK** | 9 | 80 |
| GSPAAKRVKLGGSPAAKRVKLGGS**PKKKRKV**GGS**PKKKRKV** | 10 | 81 |
| GS**KLGPRKATGRW**GS | 11 | 82 |
| GS**KRKGSPERGERKRHW**GS | 12 | 83 |
| GS**PKKKRKV**GSGS**KRPAATKKAGQAKKKK**LE | 13 | 84 |
| GP**KRTADSQHSTPPKTKRKV**EFE**PKKKRKV** | 14 | 85 |
| GGGSGGGS**KRTADSQHSTPPKTKRKV**EFE**PKKKRKV** | 15 | 86 |
| AEAAAKEAAAKEAAAKA**KRTADSQHSTPPKTKRKV**EFE**PKKKRKV** | 16 | 87 |
| GPPKKKRKVGGS**KRTADSQHSTPPKTKRKV**EFE**PKKKRKV** | 17 | 88 |
| GPAEAAAKEAAAKEAAAKA**PAAKRVKLD** | 18 | 89 |
| GPGGGSGGGSGGGS**PAAKRVKLD** | 19 | 90 |
| GP**PKKKREV**PPP**PAAKRVKLD** | 20 | 91 |
| GP**PAAKRVKLD** | 21 | 92 |
| VGS**KRPAATKKAGQAKKKK** | 24 | 95 |
| TGGGPGGGAAAGSGS**PKKKRKV**GSGS**KRPAATKKAGQAKKKK**LE | 25 | 96 |
| TGGGPGGGAAAGSGS**PKKKRKV**GSGS | 27 | 98 |
| PPP**PKKKRKV**PPP | 28 | 99 |
| GGS**PKKKRKV**PPP | 29 | 100 |
| PPP**PKKKRKV** | 30 | 101 |
| GGS**PKKKRKV** | 31 | 102 |
| GGS**PKKKRKV**GGSGGSGGS | 32 | 103 |
| GGS**PKKKRKV**GGS**PKKKRKV** | 33 | 104 |
| GGSGGSGGS**PKKKRKV**GGS**PKKKRKV** | 34 | 105 |
| VGGGSGGGSGGGS**PAAKRVKLD** | 35 | 106 |
| VPPP**PAAKRVKLD** | 36 | 107 |
| VPPPGGGSGGGSGGGS**PAAKRVKLD** | 37 | 108 |
| VGS**PAAKRVKLD** | 41 | 112 |

* Sequences in bold are NLS, while unbolded sequences are linkers.

TABLE 7

| Additional NLS sequences | | | |
|---|---|---|---|
| N-terminal NLS Sequences | SEQ ID NO | C-terminal NLS Sequences | SEQ ID NO |
| PKKKRKVGGSPKKKRKVSRQEIKRINKI RRRLVKDSNTKKAGKTGP | 59359 | TLESPAAKRVKLDGGSPAAKRVKLD GGSPAAKRVKLDGGSPAAKRVKLDG GSPAAKRVKLDGGSPAAKRVKLDTL | 59396 |

TABLE 7-continued

| Additional NLS sequences | | | |
|---|---|---|---|
| N-terminal NLS Sequences | SEQ ID NO | C-terminal NLS Sequences | SEQ ID NO |
| | | ESKRPAATKKAGQAKKKKGGSKRPAATKKAGQAKKKKGGSKRPAATKKAGQAKKKKGGSKRPAATKKAGQAKKKK | |
| PKKKRKVGGSPKKKRKVGGSPKKKRKVGGSPKKKRKVSRQEIKRINKIRRRLVKDSNTKKAGKTGP | 59360 | TLESKRPAATKKAGQAKKKKTLESKRPAATKKAGQAKKKKGGSKRPAATKKAGQAKKKKGGSKRPAATKKAGQAKKKKGGSKRPAATKKAGQAKKKKGGSKRPAATKKAGQAKKKKGGSKRPAATKKAGQAKKKK | 59397 |
| PKKKRKVGGSPKKKRKVGGSPKKKRKVGGSPKKKRKVGGSPKKKRKVGGSPKKKRKVSRQEIKRINKIRRRLVKDSNTKKAGKTGP | 59361 | TLESKRPAATKKAGQAKKKKGGSKRPAATKKAGQAKKKKTLESPKKKRKVGGSPKKKRKVGGSPKKKRKVGGSPKKKRKV | 59398 |
| PAAKRVKLDGGSPAAKRVKLDSRQEIKRINKIRRRLVKDSNTKKAGKTGP | 59362 | TLEGGSPKKKRKVTLESPKKKRKVGGSPKKKRKVGGSPKKKRKVGGSPKKKRKV | 59399 |
| PAAKRVKLDGGSPAAKRVKLDGGSPAAKRVKLDGGSPAAKRVKLDSRQEIKRINKIRRRLVKDSNTKKAGKTGP | 59363 | TLEGGSPKKKRKVTLESPAAKRVKLDGGSPAAKRVKLDGGSPAAKRVKLDGGSPAAKRVKLD | 59400 |
| PAAKRVKLDGGSPAAKRVKLDGGSPAAKRVKLDGGSPAAKRVKLDGGSPAAKRVKLDGGSPAAKRVKLDSRQEIKRINKIRRRLVKDSNTKKAGKTGP | 59364 | TLEGGSPKKKRKVTLESPAAKRVKLDGGSPAAKRVKLDGGSPAAKRVKLDGGSPAAKRVKLDGGSPAAKRVKLDGGSPAAKRVKLD | 59401 |
| KRPAATKKAGQAKKKKSRDISRQEIKRINKIRRRLVKDSNTKKAGKTGP | 59365 | TLEGGSPKKKRKVTLESKRPAATKKAGQAKKKK | 59402 |
| KRPAATKKAGQAKKKKSRQEIKRINKIRRRLVKDSNTKKAGKTGP | 59366 | TLEGGSPKKKRKVTLESKRPAATKKAGQAKKKKGGSKRPAATKKAGQAKKKK | 59403 |
| KRPAATKKAGQAKKKKGGSKRPAATKKAGQAKKKKSRDISRQEIKRINKIRRRLVKDSNTKKAGKTGP | 59367 | TLEGGSPKKKRKVTLEGGSPKKKRKV | 59404 |
| KRPAATKKAGQAKKKKGGSKRPAATKKAGQAKKKKGGSKRPAATKKAGQAKKKKGGSKRPAATKKAGQAKKKKSRDISRQEIKRINKIRRRLVKDSNTKKAGKTGP | 59368 | TLEVGPKRTADSQHSTPPKTKRKVEFEPKKKRKVTLEGGSPKKKRKV | 59405 |
| KRPAATKKAGQAKKKKGGSKRPAATKKAGQAKKKKGGSKRPAATKKAGQAKKKKGGSKRPAATKKAGQAKKKKGGSKRPAATKKAGQAKKKKSRDISRQEIKRINKIRRRLVKDSNTKKAGKTGP | 59369 | TLEVGGGSGGGSKRTADSQHSTPPKTKRKVEFEPKKKRKVTLEGGSPKKKRKV | 59406 |
| PKKKRKVGGSPKKKRKVGGSPKKKRKVGGSPKKKRKVSRDISRQEIKRINKIRRRLVKDSNTKKAGKTGP | 59370 | TLEVAEAAAKEAAAKEAAAKAKRTADSQHSTPPKTKRKVEFEPKKKRKVTLEGGSPKKKRKV | 59407 |
| PAAKRVKLDGGSPAAKRVKLDGGSPAAKRVKLDGGSPAAKRVKLDSRDISRQEIKRINKIRRRLVKDSNTKKAGKTGP | 59371 | TLEVGPPKKKRKVGGSKRTADSQHSTPPKTKRKVEFEPKKKRKVTLEGGSPKKKRKV | 59408 |
| PAAKRVKLDGGSPAAKRVKLDGGSPAAKRVKLDGGSPAAKRVKLDGGSPAAKRVKLDGGSPAAKRVKLDSRDISRQEIKRINKIRRRLVKDSNTKKAGKTGP | 59372 | TLEVGPAEAAAKEAAAKEAAAKAPAAKRVKLDTLEGGSPKKKRKV | 59409 |
| PAAKRVKLDGGKRTADGSEFESPKKKRKVGGSSRDISRQEIKRINKIRRRLVKDSNTKKAGKTGP | 59373 | TLEVGPGGGSGGGSGGGSPAAKRVKLDTLEVGPKRTADSQHSTPPKTKRKVEFEPKKKRKV | 59410 |
| PAAKRVKLDGGKRTADGSEFESPKKKRKVPPPPGSRDISRQEIKRINKIRRRLVKDSNTKKAGKTGP | 59374 | TLEVGPPKKKRKVPPPPAAKRVKLDTLEVGGGSGGGSKRTADSQHSTPPKTKRKVEFEPKKKRKV | 59411 |

TABLE 7-continued

Additional NLS sequences

| N-terminal NLS Sequences | SEQ ID NO | C-terminal NLS Sequences | SEQ ID NO |
|---|---|---|---|
| PAAKRVKLDGGKRTADGSEFESPKKKRKVGIHGVPAAPGSRDISRQEIKRINKIRRRLVKDSNTKKAGKTGP | 59375 | TLEVGPPAAKRVKLDTLEVAEAAAKEAAAKEAAAKAKRTADSQHSTPPKTKRKVEFEPKKKRKV | 59412 |
| PAAKRVKLDGGKRTADGSEFESPKKKRKVGGGSGGGSPGSRDISRQEIKRINKIRRRLVKDSNTKKAGKTGP | 59376 | TLEVGP KRTADSQHSTPPKTKRKVEFEPKKKRKVTLEVGPPKKKRKVGGSKRTADSQHSTPPKTKRKVEFEPKKKRKV | 59413 |
| PAAKRVKLDGGKRTADGSEFESPKKKRKVPGGGSGGGSPGSRDISRQEIKRINKIRRRLVKDSNTKKAGKTGP | 59377 | TLEVGGGSGGGSKRTADSQHSTPPKTKRKVEFEPKKKRKVTLEVGPAEAAAKEAAAKEAAAKAPAAKRVKLD | 59414 |
| PAAKRVKLDGGKRTADGSEFESPKKKRKVAEAAAKEAAAKEAAAKAPGSRDISRQEIKRINKIRRRLVKDSNTKKAGKTGP | 59378 | GSKRPAATKKAGQAKKKKTLEVGPGGGSGGGSGGGSPAAKRVKLD | 59415 |
| PAAKRVKLDGGKRTADGSEFESPKKKRKVPGSRDISRQEIKRINKIRRRLVKDSNTKKAGKTGP | 59379 | GSKRPAATKKAGQAKKKKTLEVGPPKKKRKVPPPPAAKRVKLD | 59416 |
| PAAKRVKLDGGSPKKKRKVGGSSRDISRQEIKRINKIRRRLVKDSNTKKAGKTGP | 59380 | GSKRPAATKKAGQAKKKKTLEVGPPAAKRVKLD | 59417 |
| PAAKRVKLDPPPPKKKRKVPGSRDISRQEIKRINKIRRRLVKDSNTKKAGKTGP | 59381 | GSPKKKRKVTLEVGPKRTADSQHSTPPKTKRKVEFEPKKKRKV | 59418 |
| PAAKRVKLDPGRSRDISRQEIKRINKIRRRLVKDSNTKKAGKTGP | 59382 | GSKRPAATKKAGQAKKKKTLEVGGGSGGGSKRTADSQHSTPPKTKRKVEFEPKKKRKV | 59419 |
| PKKKRKVSRDISRQEIKRINKIRRRLVKDSNTKKAGKTGP | 59383 | GSKRPAATKKAGQAKKKKGSKRPAATKKAGQAKKKK | 59420 |
| PKKKRKVSRQEIKRINKIRRRLVKDSNTKKAGKTGP | 59384 | GSPKKKRKVGSPKKKRKV | 59421 |
| PAAKRVKLDSRQEIKRINKIRRRLVKDSNTKKAGKTGP | 59385 | GGGSGGGSKRTADSQHSTPPKTKRKVEFEPKKKRKVGSKRPAATKKAGQAKKKK | 59422 |
| TSPKKKRKVALEYPYDVPDYA | 59386 | GPPKKKRKVGGSKRTADSQHSTPPKTKRKVEFEPKKKRKVGSKRPAATKKAGQAKKKK | 59423 |
| TLESKRPAATKKAGQAKKKKAPGEYPYDVPDYA | 59387 | TGGGPGGGAAAGSGSPKKKRKVGSGSGSKRPAATKKAGQAKKKK | 59424 |
| GSKRPAATKKAGQAKKKKYPYDVPDYA | 59388 | GPKRTADSQHSTPPKTKRKVEFEPKKKRKVGSKRPAATKKAGQAKKKK | 59425 |
| TLESKRPAATKKAGQAKKKKGGSKRPAATKKAGQAKKKKAPGEYPYDVPDYATSPKKKRKVALEYPYDVPDYA | 59389 | AEAAAKEAAAKEAAAKAKRTADSQHSTPPKTKRKVEFEPKKKRKVGSPKKKRKV | 59426 |
| TLESKRPAATKKAGQAKKKKGGSKRPAATKKAGQAKKKKGGSKRPAATKKAGQAKKKKTSPKKKRKVALEYPYDVPDYA | 59390 | GPPKKKRKVPPPPAAKRVKLDGGGSGGGSKRTADSQHSTPPKTKRKVEFEPKKKRKV | 59427 |
| TLESKRPAATKKAGQAKKKKGGSKRPAATKKAGQAKKKKGGSKRPAATKKAGQAKKKKGGSKRPAATKKAGQAKKKKGGSKRPAATKKAGQAKKKKTSPKKKRKVALEYPYDVPDYA | 59391 | GSPAAKRVKLDGGSPAAKRVKLDGGSPAAKRVKLDGGSPAAKRVKLDGGSPAAKRVKLDGGSPAAKRVKLDGPPKKKKRKVGGSKRTADSQHSTPPKTKRKVEFEPKKKRKV | 59428 |
| TLESPKKKRKVGGSPKKKRKVGGSPKKKRKVGGSPKKKRKVTLESKRPAATKKAGQAKKKKAPGEYPYDVPDYA | 59392 | GSPAAKRVKLGGSPAAKRVKLGGSPKKKRKVGGSPKKKRKVTGGGPGGGAAAGSGSPKKKRKVGSGS | 59429 |
| APAAKRVKLDSR | 59393 | GSKRPAATKKAGQAKKKKGGSKRPAATKKAGQAKKKKGPKRTADSQHSTPPKTKRKVEFEPKKKRKV | 59430 |

TABLE 7-continued

| Additional NLS sequences | | | |
|---|---|---|---|
| N-terminal NLS Sequences | SEQ ID NO | C-terminal NLS Sequences | SEQ ID NO |
| MAPKKKRKVSR | 59394 | GSKRPAATKKAGQAKKKKGGSKRPAATKKAGQAKKKKAEAAAKEAAAKEAAAKAKRTADSQHSTPPKTKRKVEFEPKKKRKV | 59431 |
| GSPKKKRKV | 59395 | | NO |

In some cases, a dXR fusion protein includes a "Protein Transduction Domain" or PTD (also known as a CPP—cell penetrating peptide), which refers to a protein, polynucleotide, carbohydrate, or organic or inorganic compound that facilitates traversing a lipid bilayer, micelle, cell membrane, organelle membrane, or vesicle membrane. A PTD attached to another molecule, which can range from a small polar molecule to a large macromolecule and/or a nanoparticle, facilitates the molecule traversing a membrane, for example going from an extracellular space to an intracellular space, or from the cytosol to within an organelle. In some embodiments, a PTD is covalently linked to the amino terminus of a dXR fusion protein. In some embodiments, a PTD is covalently linked to the carboxyl terminus of a dXR fusion protein. Examples of PTDs include but are not limited to peptide transduction domain of HIV TAT comprising YGRKKRRQRRR (SEQ ID NO: 33340), RKKRRQRR (SEQ ID NO: 33341); YARAAARQARA (SEQ ID NO: 33342); THRLPRRRRRR (SEQ ID NO: 33343); and GGRRARRRRRR (SEQ ID NO: 33344); a polyarginine sequence comprising a number of arginines sufficient to direct entry into a cell (e.g., 3, 4, 5, 6, 7, 8, 9, 10, or 10-50 arginines (SEQ ID NO: 33345)); a VP22 domain (Zender et al. (2002) Cancer Gene Ther. 9(6):489-96); an *Drosophila* Antennapedia protein transduction domain (Noguchi et al. (2003) Diabetes 52(7): 1732-1737); a truncated human calcitonin peptide (Trehin et al. (2004) Pharm. Research 21: 1248-1256); polylysine (Wender et al. (2000) Proc. Natl. Acad. Sci. USA 97: 13003-13008); RRQRRTSKLMKR (SEQ ID NO: 33346); Transportan GWTLNSAGYLLGKINLKALAALAKKIL (SEQ ID NO: 33347); KALAWEAKLAKALAKALAKHLAKALAKALKCEA (SEQ ID NO: 33348); and RQIKIWFQNRRMKWKK (SEQ ID NO: 33349).

In some embodiments, the individual components of the dXR may be linked via a linker polypeptide (e.g., one or more linker polypeptides). The linker polypeptide may have any of a variety of amino acid sequences. Proteins can be joined by a spacer peptide, generally of a flexible nature, although other chemical linkages are not excluded. Suitable linkers include polypeptides of between 4 amino acids and 40 amino acids in length, or between 4 amino acids and 25 amino acids in length. These linkers are generally produced by using synthetic, linker-encoding oligonucleotides to couple the proteins. Peptide linkers with a degree of flexibility can be used. The linking peptides may have virtually any amino acid sequence, bearing in mind that the preferred linkers will have a sequence that results in a generally flexible peptide. The use of small amino acids, such as glycine, serine, proline and alanine, are of use in creating a flexible peptide. The creation of such sequences is routine to those of skill in the art. A variety of different linkers are commercially available and are considered suitable for use. Example linker polypeptides include one or more linkers selected from the group consisting of RS, (G)n (SEQ ID NO: 33240), (GS)n (SEQ ID NO: 33241), (GGS)n (SEQ ID NO: 33242), (GSGGS)n (SEQ ID NO: 33243), (GGSGGS)n (SEQ ID NO: 33244), (GGGS)n (SEQ ID NO: 33245), GGSG (SEQ ID NO: 33246), GGSGG (SEQ ID NO: 33247), GSGSG (SEQ ID NO: 33248), GSGGG (SEQ ID NO: 33249), GGGSG (SEQ ID NO: 33250), GSSSG (SEQ ID NO: 33251), (GP)n (SEQ ID NO: 33252), GPGP (SEQ ID NO: 33253), GGSGGGS (SEQ ID NO: 33254), GGP, PPP, PPAPPA (SEQ ID NO: 33255), PPPGPPP (SEQ ID NO: 33256), PPPG (SEQ ID NO: 33257), PPP(GGGS)n (SEQ ID NO: 33258), (GGGS)nPPP (SEQ ID NO: 33259), AEAAAKEAAAKEAAAKA (SEQ ID NO: 33260), AEAAAKEAAAKA (SEQ ID NO: 33261), SGSETPGTSESATPES (SEQ ID NO: 33262), TPPKTKRKVEFE (SEQ ID NO: 33263), GSGSGGG (SEQ ID NO: 57628), GGCGGTTCCGGCGGAGGAAGC (SEQ ID NO: 57624), GGCGGTTCCGGCGGAGGTTCC (SEQ ID NO: 57625), GGATCAGGCTCTGGAGGTGGA (SEQ ID NO: 57627), GGAGGGCCGAGCTCTGGCGCACCCCCACCAAGTGGAGGGTCTCCTGCCGGGTCCCC AACATCTACTGAAGAAGGCACCAGCGAATCCGCAACGCCCGAGTCAGGCCCTGGTA CCTCCACAGAACCATCTGAAGGTAGTGCGCCTGGTTCCCCAGCTGGAAGCCCTACTT CCACCGAAGAAGGCACGTCAACCGAACCAAGTGAAGGATCTGCCCCTGGGACCAGC ACTGAACCATCTGAG (SEQ ID NO: 57620), SSGNSNANSRGPSFSSGLVPLSLRGSH (SEQ ID NO: 57623), GGPSSGAPPPSGGSPAGSPTSTEEGTSESATPESGPGTSTEPSEGSAPGSPAGSPTSTEEGT STEPSEGSAPGTSTEPSE (SEQ ID NO: 57621), and TCTAGCGGCAATAGTAACGCTAACAGCCGCGGGCCGAGCTTCAGCAGCGGCCTGGT GCCGTTAAGCTTGCGCGGCAGCCAT (SEQ ID NO: 57622), wherein n is an integer of 1 to 5. The ordinarily skilled artisan will recognize that design of a peptide conjugated to any elements described above can include linkers that are all or partially flexible, such that the linker can include a flexible linker as well as one or more portions that confer less flexible structure.

VI. gRNA and dCRISPR Protein-Repressor Domain Gene Repression Pairs

In another aspect, provided herein are compositions comprising a gene repression pair, the gene repression pair comprising a catalytically-dead CRISPR protein with one or more linked repressor domains and a guide RNA. In some embodiments, the gene repressor pair comprises a catalytically-dead Class 2 CRISPR-Cas with one or more linked repressor domains. In some embodiments, the gene repressor pair comprises a catalytically-dead Class 2, Type II, Type V, or Type VI CRISPR protein. In some embodiments, the gene repression pair includes Class 2, Type II CRISPR/Cas proteins such as a catalytically-dead Cas9. In other cases, the gene repression pair include Class 2, Type V CRISPR/Cas nucleases such as catalytically-dead Cas12a (Cpf1), Cas12b (C2c1), Cas12c (C2c3), Cas12d (CasY), Cas12e (CasX), Cas12f, Cas12g, Cas12h, Cas12i, Cas12j, Cas12k, Cas12l, Cas14, and/or CasΦ proteins.

In certain embodiments, the gene repression pair comprises a dCasX variant protein as described herein (e.g., any one of the sequences set forth in Table 4) linked to one or more repressor domains (e.g., any one of the sequences of SEQ ID NOS: 889-2100, 2332-33239, 33625-57543, and 59450, while the guide RNA is a gRNA variant as described herein (e.g., SEQ ID NOS: 2238-2331, 57544-57589 and 59352 or a sequence as set forth in Table 2), or sequence variants having at least 60%, or at least 70%, at least about 80%, or at least about 90%, or at least about 95%, or at least about 96%, or at least about 97%, or at least about 98%, or at least about 99% sequence identity thereto, wherein the gRNA comprises a targeting sequence complementary to the target nucleic acid. In some embodiments, the gene repression pair comprises a dCasX selected from any one of SEQ ID NOS: 17-36 and 59353-59358 as set forth in Table 4, one or more repressor domains linked to the dCasX selected from any one of the sequences of SEQ ID NOS: 889-2100, 2332-33239, 33625-57543 and 59450, and a gRNA selected from any one of SEQ ID NOS: 2238, 2239, and 2292. In some embodiments, the gene repression pair comprises a dCasX selected from any one of SEQ ID NOS: 17-36 and 59353-59358 as set forth in Table 4, one or more repressor domains linked to the dCasX selected from any one of the sequences of SEQ ID NOS: 355-888, 33625-57543, and 59450, and a gRNA selected from any one of SEQ ID NOS: 2238, 2239, and 2292, wherein the gRNA comprises a targeting sequence complementary to the target nucleic acid. In some embodiments, the gene repression pair comprises a dCasX selected from any one of SEQ ID NOS: 17-36 and 59353-59358, one or more repressor domains linked to the dCasX selected from any one of the sequences of SEQ ID NOS: 355-888, 33625-57543, and 59450, and a gRNA selected from any one of SEQ ID NOS: 2238-2331, 57544-57589 and 59352, wherein the gRNA comprises a targeting sequence complementary to the target nucleic acid.

In some embodiments, the gene repression pair comprises a dXR comprising a dCasX of SEQ ID NO:18, a KRAB domain sequence of SEQ ID NOS: 57746-57755, a DNMT3A catalytic domain of SEQ ID NOS: 33625-57543 and 59450, a DNMT3L interaction domain of SEQ ID NO: 59625, and an ADD domain of SEQ ID NO: 59452, wherein the dXR has the configuration of configurations 1, 4 or 5 of FIG. 45, and a gRNA of SEQ ID NOS: 2292 or 59352, wherein the gRNA comprises a targeting sequence complementary to the target nucleic acid.

In other embodiments, a gene repression pair comprises the dCasX protein selected from any one of SEQ ID NOS: 17-36 and 59353-59358 as set forth in Table 4 and one or more repressor domains linked to the dCasX, a first gRNA (a gRNA variant as described herein (e.g., SEQ ID NOS: 2238-2331, 57544-57589 and 59352, or a sequence as set forth in Table 2) with a targeting sequence, and a second gRNA variant and dXR, wherein the second gRNA variant has a targeting sequence complementary to a different or overlapping portion of the target nucleic acid compared to the targeting sequence of the first gRNA.

In some embodiments, wherein the gene repression pair comprises both a dCasX variant protein and the linked repressor domain and a gRNA variant as described herein, the one or more characteristics of the gene repression pair is improved beyond what can be achieved by varying the dCasX protein or the gRNA alone. In some embodiments, the dCasX variant protein and the gRNA variant act additively to improve one or more characteristics of the gene repression pair. In some embodiments, the dCasX variant protein and the gRNA variant act synergistically to improve one or more characteristics of the gene repression pair. In the foregoing embodiments, the improvement is at least about 2-fold, at least about 5-fold, at least about 10-fold, at least about 50-fold, at least about 100-fold, at least about 500-fold, at least about 1000-fold, at least about 5000-fold, at least about 10,000-fold, or at least about 100,000-fold compared to the characteristic of a reference dCasX protein and reference gRNA pair.

VII. Vectors

In some embodiments, provided herein are vectors comprising polynucleotides encoding the catalytically-dead CRISPR protein and linked repressor domains and gRNA variants described herein. In some cases, the vectors are utilized for the expression and recovery of the catalytically-dead CRISPR protein (e.g., dXR) and the gRNA components of the gene repression pair or the RNP. In other cases, the vectors are utilized for the delivery of the encoding polynucleotides to target cells for the repression of the target nucleic acid, as described more fully, below.

In some embodiments, provided herein are polynucleotides encoding the gRNA variants described herein. In some embodiments, said polynucleotides are DNA. In other embodiments, said polynucleotides are RNA. In other embodiments, said polynucleotides are mRNA. In some embodiments, provided herein are vectors comprising the polynucleotides sequences encoding the gRNA variants described herein. In some embodiments, the vectors comprising the polynucleotides include bacterial plasmids, viral vectors, and the like. In some embodiments, a dXR and a gRNA variant are encoded on the same vector. In some embodiments, a dXR and a gRNA variant are encoded on different vectors.

In some embodiments, the disclosure provides a vector comprising a nucleotide sequence encoding the components of the dXR:gRNA system. For example, in some embodiments provided herein is a recombinant expression vector comprising a) a nucleotide sequence encoding a dXR fusion protein; and b) a nucleotide sequence encoding a gRNA variant described herein. In some cases, the nucleotide sequence encoding the dXR fusion protein and/or the nucleotide sequence encoding the gRNA variant are operably linked to a promoter that is operable in a cell type of choice (e.g., a prokaryotic cell, a eukaryotic cell, a plant cell, an animal cell, a mammalian cell, a primate cell, a rodent cell, a human cell). Suitable promoters for inclusion in the vectors are described herein, below.

In some embodiments, the nucleotide sequence encoding the dXR fusion protein is codon optimized. This type of optimization can entail a mutation of a dCasX-encoding nucleotide sequence to mimic the codon preferences of the intended host organism or cell while encoding the same protein. Thus, the codons can be changed, but the encoded protein remains unchanged. For example, if the intended target cell was a human cell, a human codon-optimized dCasX variant-encoding nucleotide sequence could be used. As another non-limiting example, if the intended host cell were a mouse cell, then a mouse codon-optimized dCasX variant-encoding nucleotide sequence could be generated. As another non-limiting example, if the intended host cell were a bacterial cell, then a bacterial codon-optimized dXR fusion protein-encoding nucleotide sequence could be generated.

In some embodiments, a nucleotide sequence encoding a dXR fusion protein is mRNA, designed for incorporation into an LNP. In some embodiments, an mRNA encoding a dXR fusion protein of the disclosure is chemically modified, wherein the chemical modification is substitution of N1-methyl-pseudouridine for one or more uridine nucleotides of the sequence. In some embodiments, an mRNA encoding a dXR fusion protein of the disclosure is codon optimized. In some embodiments, an mRNA encoding a dXR fusion protein of the disclosure comprises one or more sequences selected from the group consisting of SEQ ID NOS: 59584, 59585, 59610, 59611, 59622 and 59623. In some embodiments, an mRNA encoding a dXR fusion protein of the disclosure comprises one or more sequences encoded by a sequence selected from the group consisting of 59444-59449, 59455-59456, 59488-59497, 59568-59583, 59595-59609, and 59612-59621.

In some embodiments, provided herein are one or more recombinant expression vectors such as (i) a nucleotide sequence that encodes a gRNA as described herein (e.g., operably linked to a promoter that is operable in a target cell such as a eukaryotic cell); and (ii) a nucleotide sequence encoding a dXR fusion protein (e.g., operably linked to a promoter that is operable in a target cell such as a eukaryotic cell). In some embodiments, the sequences encoding the gRNA and dXR fusion proteins are in different recombinant expression vectors, and in other embodiments the gRNA and dXR fusion proteins are in the same recombinant expression vector. In some embodiments, either the gRNA in the recombinant expression vector, the dXR fusion protein encoded by the recombinant expression vector, or both, are variants of a reference dCasX protein or gRNAs as described herein. In the case of the nucleotide sequence encoding the gRNA, the recombinant expression vector can be transcribed in vitro, for example using T7 promoter regulatory sequences and T7 polymerase in order to produce the gRNA, which can then be recovered by conventional methods; e.g., purification via gel electrophoresis. Once synthesized, the gRNA may be utilized in the gene repression pair to directly contact a target nucleic acid or may be introduced into a cell by any of the well-known techniques for introducing nucleic acids into cells (e.g., microinjection, electroporation, transfection, etc.).

Depending on the host/vector system utilized, any of a number of suitable transcription and translation control elements, including constitutive and inducible promoters, transcription enhancer elements, transcription terminators, etc. may be used in the expression vector.

In some embodiments, a nucleotide sequence encoding a dXR and/or gRNA is operably linked to a control element; e.g., a transcriptional control element, such as a promoter. In some embodiments, a nucleotide sequence encoding a dXR fusion protein is operably linked to a control element; e.g., a transcriptional control element, such as a promoter. In some cases, the promoter is a constitutively active promoter. In some cases, the promoter is a regulatable promoter. In some cases, the promoter is an inducible promoter. In some cases, the promoter is a tissue-specific promoter. In some cases, the promoter is a cell type-specific promoter. In some cases, the transcriptional control element (e.g., the promoter) is functional in a targeted cell type or targeted cell population. For example, in some cases, the transcriptional control element can be functional in eukaryotic cells, e.g., hematopoietic stem cells (e.g., mobilized peripheral blood (mPB) CD34(+) cell, bone marrow (BM) CD34(+) cell, etc.). By transcriptional activation, it is intended that transcription will be increased above basal levels in the target cell by 10-fold, by 100-fold, more usually by 1000-fold.

Non-limiting examples of Pol II promoters include, but are not limited to EF-1alpha, EF-1alpha core promoter, Jens Tornoe (JeT), promoters from cytomegalovirus (CMV), CMV immediate early (CMVIE), CMV enhancer, herpes simplex virus (HSV) thymidine kinase, early and late simian virus 40 (SV40), the SV40 enhancer, long terminal repeats (LTRs) from retrovirus, mouse metallothionein-I, adenovirus major late promoter (Ad MLP), CMV promoter full-length promoter, the minimal CMV promoter, the chicken β-actin promoter (CBA), CBA hybrid (CBh), chicken β-actin promoter with cytomegalovirus enhancer (CB7), chicken beta-Actin promoter and rabbit beta-Globin splice acceptor site fusion (CAG), the rous sarcoma virus (RSV) promoter, the HIV-Ltr promoter, the hPGK promoter, the HSV TK promoter, a 7SK promoter, the Mini-TK promoter, the human synapsin I (SYN) promoter which confers neuron-specific expression, beta-actin promoter, super core promoter 1 (SCP1), the Mecp2 promoter for selective expression in neurons, the minimal IL-2 promoter, the Rous sarcoma virus enhancer/promoter (single), the spleen focus-forming virus long terminal repeat (LTR) promoter, the TBG promoter, promoter from the human thyroxine-binding globulin gene (Liver specific), the PGK promoter, the human ubiquitin C promoter (UBC), the UCOE promoter (Promoter of HNRPA2B1-CBX3), the synthetic CAG promoter, the Histone H2 promoter, the Histone H3 promoter, the U1a1 small nuclear RNA promoter (226 nt), the U1a1 small nuclear RNA promoter (226 nt), the U1b2 small nuclear RNA promoter (246 nt) 26, the GUSB promoter, the CBh promoter, rhodopsin (Rho) promoter, silencing-prone spleen focus forming virus (SFFV) promoter, a human H1 promoter (H1), a POL1 promoter, the TTR minimal enhancer/promoter, the b-kinesin promoter, mouse mammary tumor virus long terminal repeat (LTR) promoter, the human eukaryotic initiation factor 4A (EIF4A1) promoter, the ROSA26 promoter, the glyceraldehyde 3-phosphate dehydrogenase (GAPDH) promoter, tRNA promoters, and truncated versions and sequence variants of the foregoing. In a particular embodiment, the Pol II promoter is EF-1alpha, wherein the promoter enhances transfection efficiency, the transgene transcription or expression of the CRISPR nuclease, the proportion of expression-positive clones and the copy number of the episomal vector in long-term culture. Non-limiting examples of Pol III promoters include, but are not limited to U6, mini U6, U6 truncated promoters, BiH1 (Bidirectional H1 promoter), BiU6, Bi7SK, BiH1 (Bidirectional U6, 7SK, and H1 promoters), gorilla U6, rhesus U6, human 7SK, human H1 promoter, and truncated versions and sequence variants thereof. In the foregoing embodiment, the Pol III promoter enhances the transcription of the gRNA.

Selection of the appropriate vector and promoter is well within the level of ordinary skill in the art. The expression vector may also contain a ribosome binding site for translation initiation and a transcription terminator. The expression vector may also include appropriate sequences for amplifying expression. The expression vector may also include nucleotide sequences encoding protein tags (e.g., 6×His tag, hemagglutinin tag, fluorescent protein, etc.) that can be fused to the dXR fusion protein, thus resulting in a chimeric CasX variant polypeptide.

Recombinant expression vectors of the disclosure can also comprise elements that facilitate robust expression of dXR and/or variant gRNAs of the disclosure. For example, recombinant expression vectors can include one or more of a polyadenylation signal (poly(A), an intronic sequence or a post-transcriptional regulatory element such as a woodchuck hepatitis post-transcriptional regulatory element (WPRE). Exemplary poly(A) sequences include hGH poly(A) signal (short), HSV TK poly(A) signal, synthetic polyadenylation signals, SV40 poly(A) signal, β-globin poly(A) signal and the like. In addition, vectors used for providing a nucleic acid encoding a gRNA and/or a dXR protein to a cell may include nucleic acid sequences that encode for selectable markers in the target cells, so as to identify cells that have taken up the gRNA and/or dXR protein. A person of ordinary skill in the art will be able to select suitable elements to include in the recombinant expression vectors described herein.

A recombinant expression vector sequence can be packaged into a virus or virus-like particle (also referred to herein as a "particle" or "virion") for subsequent infection and transformation of a cell, ex vivo, in vitro or in vivo. Such particles or virions will typically include proteins that encapsidate or package the vector genome. In some embodiments, a recombinant expression vector of the present disclosure is a recombinant adeno-associated virus (AAV) vector. In some embodiments, a recombinant expression vector of the present disclosure is a recombinant lentivirus vector. In some embodiments, a recombinant expression vector of the present disclosure is a recombinant retroviral vector.

a. Recombinant AAV for Delivery of dXR:rRNA

Adeno-associated virus (AAV) is a small (20 nm), non-pathogenic virus that is useful in treating human diseases in situations that employ a viral vector for delivery to a cell such as a eukaryotic cell, either in vivo or ex vivo for cells to be prepared for administering to a subject. A construct is generated, for example a construct encoding a fusion protein and gRNA embodiments as described herein, and is flanked with AAV inverted terminal repeat (ITR) sequences, thereby enabling packaging of the AAV vector into an AAV viral particle, with the assistance of the AAV cap coding region sequences, described below.

An "AAV" vector may refer to the naturally occurring wild-type virus itself or derivatives thereof. The term covers all subtypes, serotypes and pseudotypes, and both naturally occurring and recombinant forms, except where required otherwise. As used herein, the term "serotype" refers to an AAV which is identified by and distinguished from other AAVs based on capsid protein reactivity with defined antisera, e.g., there are many known serotypes of primate AAVs. In some embodiments, the AAV vector is selected from AAV1, AAV2, AAV3, AAV4, AAV5, AAV6, AAV7, AAV8, AAV9, AAV 10, AAV11, AAV12, AAV 44.9, AAV 9.45, AAV 9.61, AAV-Rh74 (Rhesus macaque-derived AAV), and AAVRh10, and modified capsids of these serotypes. For example, serotype AAV-2 is used to refer to an AAV which contains capsid proteins encoded from the cap gene of AAV-2 and a genome containing 5' and 3' ITR sequences from the same AAV-2 serotype. Pseudotyped AAV refers to an AAV that contains capsid proteins from one serotype and a viral genome including 5'-3' ITRs of a second serotype. Pseudotyped rAAV would be expected to have cell surface binding properties of the capsid serotype and genetic properties consistent with the ITR serotype. Pseudotyped recombinant AAV (rAAV) are produced using standard techniques described in the art. As used herein, for example, rAAV1 may be used to refer an AAV having both capsid proteins and 5'-3' ITRs from the same serotype or it may refer to an AAV having capsid proteins from serotype 1 and 5'-3' ITRs from a different AAV serotype, e.g., AAV serotype 2. For each example illustrated herein the description of the vector design and production describes the serotype of the capsid and 5'-3' ITR sequences.

An "AAV virus" or "AAV viral particle" refers to a viral particle composed of at least one AAV capsid protein (preferably by all of the capsid proteins of a wild-type AAV) and an encapsidated polynucleotide. If the particle additionally comprises a heterologous polynucleotide (i.e., a polynucleotide other than a wild-type AAV genome to be delivered to a mammalian cell, termed a "transgene"), it is typically referred to as "rAAV". An exemplary heterologous polynucleotide is a polynucleotide comprising a dXR protein and/or sgRNA of any of the embodiments described herein. Being naturally replication-defective and capable of transducing nearly every cell type in the human body, AAV represents a suitable vector for therapeutic use in gene therapy or vaccine delivery. Typically, when producing a recombinant AAV vector, the sequence between the two ITRs is replaced with one or more sequences of interest (e.g., a transgene), and the Rep and Cap sequences are provided in trans, making the ITRs the only viral DNA that remains in the vector. The resulting recombinant AAV vector genome construct comprises two cis-acting 130 to 145-nucleotide ITRs flanking an expression cassette encoding the transgene sequences of interest, providing at least 4.7 kb or more for packaging of foreign DNA that can include a transgene, one or more promoters and accessory elements, such that the total size of the vector is below 5 to 5.2 kb, which is compatible with packaging within the AAV capsid (it being understood that as the size of the construct exceeds this threshold, the packaging efficiency of the vector decreases). The transgene may be used, in the context of the present disclosure to repress transcription of a defective gene in the cells of a subject. In the context of CRISPR-mediated gene repression, however, the size limitation of the expression cassette is a challenge for most CRISPR systems (e.g., Cas9), given the large size of the nucleases. It has been discovered, however, that the small size of the dCasX and gRNA permits the creation of "all in one" constructs that can deliver dXR:gRNA capable of gene repression in cells.

By "adeno-associated virus inverted terminal repeats" or "AAV ITRs" is meant the art recognized regions found at each end of the AAV genome which function together in cis as origins of DNA replication and as packaging signals for the virus. AAV ITRs, together with the AAV rep coding region, provide for the efficient excision and rescue from, and integration of a nucleotide sequence interposed between two flanking ITRs into a mammalian cell genome. The nucleotide sequences of AAV ITR regions are known. See, for example Kotin, R. M. (1994) Human Gene Therapy 5:793-801; Berns, K. I. "Parvoviridae and their Replication" in Fundamental Virology, $2^{nd}$ Edition, (B. N. Fields and D. M. Knipe, eds.). As used herein, an AAV ITR need not have the wild-type nucleotide sequence depicted, but may be altered, e.g., by the insertion, deletion or substitution of nucleotides. Additionally, the AAV ITR may be derived from any of several AAV serotypes, including without limitation, AAV1, AAV2, AAV3, AAV4, AAV5, AAV6, AAV7, AAV8, AAV9, AAV10, AAV-Rh74, and AAVRh10, and modified capsids of these serotypes. Furthermore, 5' and 3' ITRs which flank a selected nucleotide sequence in an AAV vector need not necessarily be identical or derived from the same AAV serotype or isolate, so long as they function as intended, i.e., to allow for excision and rescue of the sequence of interest from a host cell genome or vector, and to allow integration of the heterologous sequence into the recipient cell genome when AAV Rep gene products are present in the cell. Use of AAV serotypes for integration of heterologous sequences into a host cell is known in the art (see, e.g., WO2018195555A1 and US20180258424A1, incorporated by reference herein). In one particular embodiment, the ITRs are derived from serotype AAV1. In another particular embodiment of the AAV of the disclosure, the ITRs are derived from serotype AAV2, the 5' ITR having sequence CCTGCAGGCAGCTGCGCGCTCGCTCGCT-CACTGAGGCCGCCCGGGCGTCGGGCGAC CTTTGGTCGCCCGGCCTCAGT-GAGCGAGCGAGCGCGCAGAGAGGGAGTGGC-CAACT CCATCACTAGGGGTTCCT (SEQ ID NO: 33350) and the 3' ITR having sequence AGGAACCCCTAGTGATGGAGTTGGC-CACTCCCTCTCTGCGCGCTCGCTCGCTCACTG AGGCCGGGCGAC-CAAAGGTCGCCCGACGCCCGGGCTTTGCCCGG-GCGGCCTCAGTG AGCGAGCGAGCGCGCAGCTGCCTGCAGG (SEQ ID NO: 33351).

By "AAV rep coding region" is meant the region of the AAV genome which encodes the replication proteins Rep 78, Rep 68, Rep 52 and Rep 40. These Rep expression products have been shown to possess many functions, including recognition, binding and nicking of the AAV origin of DNA replication, DNA helicase activity and modulation of transcription from AAV (or other heterologous) promoters. The Rep expression products are collectively required for replicating the AAV genome.

By "AAV cap coding region" is meant the region of the AAV genome which encodes the capsid proteins VP1, VP2, and VP3, or functional homologues thereof. These Cap expression products supply the packaging functions which are collectively required for packaging the viral genome.

In some embodiments, AAV capsids utilized for delivery of a transgene comprising the encoding sequences for the dXR and gRNA of the disclosure to a host cell can be derived from any of several AAV serotypes, including without limitation, AAV1, AAV2, AAV3, AAV4, AAV5, AAV6, AAV7, AAV8, AAV9, AAV10, AAV11, AAV12, AAV 44.9, AAV-Rh74 (Rhesus macaque-derived AAV), and AAVRh10, and the AAV ITRs are derived from AAV serotype 1 or serotype 2.

In order to produce rAAV viral particles, an AAV expression vector is introduced into a suitable host cell using known techniques, such as by transfection. Packaging cells are typically used to form virus particles; such cells include HEK293 cells (and other cells known in the art), which package adenovirus. A number of transfection techniques are generally known in the art; see, e.g., Sambrook et al. (1989) Molecular Cloning, a laboratory manual, Cold Spring Harbor Laboratories, New York. Particularly suitable transfection methods include calcium phosphate co-precipitation, direct microinjection into cultured cells, electroporation, liposome mediated gene transfer, lipid-mediated transduction, and nucleic acid delivery using high-velocity microprojectiles.

In some embodiments, host cells transfected with the above-described AAV expression vectors are rendered capable of providing AAV helper functions in order to replicate and encapsidate the nucleotide sequences flanked by the AAV ITRs to produce rAAV viral particles. AAV helper functions are generally AAV-derived coding sequences which can be expressed to provide AAV gene products that, in turn, function in trans for productive AAV replication. AAV helper functions are used herein to complement necessary AAV functions that are missing from the AAV expression vectors. Thus, AAV helper functions include one, or both of the major AAV ORFs (open reading frames), encoding the rep and cap coding regions, or functional homologues thereof. Accessory functions can be introduced into and then expressed in host cells using methods known to those of skill in the art. Commonly, accessory functions are provided by infection of the host cells with an unrelated helper virus. In some embodiments, accessory functions are provided using an accessory function vector. Depending on the host/vector system utilized, any of a number of suitable transcription and translation control elements, including constitutive and inducible promoters, transcription enhancer elements, transcription terminators, etc., may be used in the expression vector.

The present disclosure provides AAV comprising a transgene encoding a dXR and a gRNA, wherein the dXR comprises a dCasX and a KRAB domain as the single repressor, given the size limitations of the transgene. In some embodiments, the transgene encodes a dXR fusion protein of the systems comprising a single KRAB domain operably linked to the dCasX selected from the group of sequences of SEQ ID NOS: 17-36 and 59353-59358 as set forth in Table 4, wherein the KRAB domain is selected from the group of sequences consisting of SEQ ID NOS: 57746-59342, or a sequence having at least about 70%, at least about 75%, at least about 80%, at least about 85%, at least about 90% at least about 91%, at least about 92%, at least about 93% at least about 94% at least about 95%, at least about 96%, at least about 97%, at least about 98%, or at least about 99% identity thereto. In some embodiments, the transgene encodes a dXR fusion protein of the systems comprising a single KRAB domain operably linked to the dCasX selected from the group of sequences of SEQ ID NOS: 17-36 and 59353-59358 as set forth in Table 4, wherein the KRAB domain is selected from the group of sequences consisting of SEQ ID NOS: 57746-57840, or a sequence having at least about 70%, at least about 75%, at least about 80%, at least about 85%, at least about 90% at least about 91%, at least about 92%, at least about 93% at least about 94% at least about 95%, at least about 96%, at least about 97%, at least about 98%, or at least about 99% identity thereto. In some embodiments, the transgene encodes a dXR fusion protein of the systems comprising a single KRAB domain operably linked to the dCasX selected from the group of sequences of SEQ ID NOS: 17-36 and 59353-59358 as set forth in Table 4, wherein the KRAB domain is selected from the group of sequences consisting of SEQ ID NOS: 57746-57755, or a sequence having at least about 70%, at least about 75%, at least about 80%, at least about 85%, at least about 90% at least about 91%, at least about 92%, at least about 93% at least about 94% at least about 95%, at least about 96%, at least about 97%, at least about 98%, or at least about 99% identity thereto. In a particular embodiment, the transgene encodes a dXR fusion protein of the systems comprising a single KRAB domain operably linked to the dCasX of SEQ ID NOS: 18 as set forth in Table 4, wherein the KRAB domain is selected from the group of sequences consisting of SEQ ID NOS: 57746-57755, or a sequence having at least about 70%, at least about 75%, at least about 80%, at least about 85%, at least about 90% at least about 91%, at least about 92%, at least about 93% at least about 94% at least about 95%, at least about 96%, at least about 97%, at least about 98%, or at least about 99% identity thereto. The transgene of the foregoing embodiments further encodes a gRNA having a scaffold comprising a sequence of SEQ ID NO: 2292 or 59352, or a sequence having at least about 70%, at least about 80%, at least about 95%, at least about 96%, at least about 97%, at least about 98%, or at least about 99% sequence identity thereto, wherein the gRNA comprises a targeting sequence complementary to a target nucleic acid sequence of a gene targeted for repression. In the foregoing embodiments, the dXR and gRNA are each operably linked to a promoter, embodiments of which are described herein.

b. VLP and XDP for Delivery of dXR:gRNA

In other embodiments, retroviruses, for example, lentiviruses, may be suitable for use as vectors for delivery of the encoding nucleic acids of the gene repressor systems of the present disclosure. Commonly used retroviral vectors are "defective"; e.g. unable to produce viral proteins required for productive infection, and may be referred to a virus-like particles (VLP) or as a delivery particle (XDP), depending on the components utilized. Rather, replication of the vector requires growth in a packaging cell line. To generate viral particles comprising nucleic acids of interest, the retroviral nucleic acids comprising the nucleic acid are packaged into VLP or XDP capsids by a packaging cell line. Different packaging cell lines provide a different envelope protein (ecotropic, amphotropic or xenotropic) to be incorporated into the capsid, this envelope protein determining the specificity of the viral particle for the cells (ecotropic for murine and rat; amphotropic for most mammalian cell types including human, dog and mouse; and xenotropic for most mammalian cell types except murine cells). The appropriate packaging cell line may be used to ensure that the cells are targeted by the packaged viral particles. Methods of introducing subject vector expression vectors into packaging cell lines and of collecting the viral particles that are generated by the packaging lines are well known in the art.

In some embodiments, the disclosure provides vectors encoding or comprising a gene repressor system comprising a dXR fusion protein, wherein the dXR fusion protein comprises a first transcriptional repressor domain, and wherein the dXR comprises a catalytically-dead CasX of any of the embodiments described herein linked to a KRAB domain of any of the embodiments described herein as the first repressor domain.

In other embodiments, the disclosure provides vectors encoding or comprising a gene repressor system comprising a fusion protein, wherein the fusion protein comprises a catalytically-dead CasX of any of the embodiments described herein linked to a first, a second, and a third transcriptional repressor domain, wherein first transcriptional repressor domain is a KRAB domain of any of the embodiments described herein, the second domain is a DNMT3A catalytic domain of any of the embodiments described herein, the third transcriptional repressor domain is a DNMT3L interaction domain, and the fusion protein comprises one or more NLS and linker peptides. In some embodiments, the fusion protein is configured, from N-terminus to C-terminus: NLS-Linker4-DNMT3A CD-Linker2-DNMT3L ID-Linker 1-Linker3-dCasX-Linker3-KRAB-NLS; NLS-Linker3-dCasX-Linker3-KRAB-NLS-Linker1-DNMT3A CD-Linker2-DNMT3L ID; NLS-Linker3-dCasX-Linker1-DNMT3A CD-Linker2-DNMT3L ID-Linker3-KRAB-NLS; NLS-KRAB-Linker3-DNMT3A CD-Linker2-DNMT3L ID-Linker1-dCasX-Linker3-NLS, or NLS-DNMT3A CD-Linker2-DNMT3L ID-Linker3-KRAB-Linker1-dCasX-Linker3-NLS.

In other embodiments, the disclosure provides vectors encoding or comprising a gene repressor system comprising a fusion protein, wherein the fusion protein comprises a catalytically-dead CasX of any of the embodiments described herein linked to a first, a second, a third, and a fourth transcriptional repressor domain, wherein first transcriptional repressor domain is a KRAB domain of any of the embodiments described herein, the second domain is a DNMT3A catalytic domain of any of the embodiments described herein, the third transcriptional repressor domain a DNMT3L interaction domain, and the fourth transcriptional repressor domain is a ATRX-DNMT3-DNMT3L (ADD) domain linked N-terminal to the DNMT3A catalytic domain and the fusion protein comprises one or more NLS and linker peptides. In some embodiments, the fusion protein is configured, from N-terminus to C-terminus: NLS-Linker4-ADD-DNMT3A CD-Linker2-DNMT3L ID-Linker 1-Linker3-dCasX-Linker3-KRAB-NLS; NLS-Linker3-dCasX-Linker3-KRAB-NLS-Linker1-ADD-DNMT3A CD-Linker2-DNMT3L ID; NLS-Linker3-dCasX-Linker1-DNMT3A CD-Linker2-DNMT3L ID-Linker3-KRAB-NLS; NLS-KRAB-Linker3-ADD-DNMT3A CD-Linker2-DNMT3L ID-Linker1-dCasX-Linker3-NLS, or NLS-ADD-DNMT3A CD-Linker2-DNMT3L ID-Linker3-KRAB-Linker1-dCasX-Linker3-NLS.

In some embodiments, the present disclosure provides XDP comprising components selected from all or a portion of a retroviral gag polyprotein, a gag-poly polyprotein, dXR:gRNA RNPs, RNA trafficking components, and one or more tropism factors having binding affinity for a cell surface marker of a target cell to facilitates entry of the XDP into the target cell.

In some embodiments, the retroviral components of the XDP system are derived from a Orthretrovirinae virus or a Spumaretrovirinae virus wherein the Orthretrovirinae virus is selected from the group consisting of Alpharetrovirus, Betaretrovirus, Deltaretrovirus, Epsilonretrovirus, Gammaretrovirus, and Lentivirus, and the Spumaretrovirinae virus is selected from the group consisting of Bovispumavirus, Equispumavirus, Felispumavirus, Prosimiispumavirus, Simiispumavirus, and Spumavirus.

XDP for use with the dXR:gRNA system can be constructed in different configurations based on the components utilized. In some embodiments, XDP comprise one or more retroviral components selected from a Gag polyprotein, a Gag-transframe region-pol protease polyprotein (Gag-TFR-PR), matrix protein (MA), a nucleocapsid protein (NC), a capsid protein (CA), a p1 peptide, a p6 peptide, a p2A peptide, a p2B peptide, a p10 peptide, a p12 peptide, a p21/24 peptide, a p12/p3/p8 peptide, a p20 peptide, a protease cleavage site, and a protease capable of cleaving the protease cleavage sites, which can be encoded on one or more nucleic acids for the production of the XDP in the packaging cell. The remaining components, such as the encapsidated payload of dXR and the gRNA (complexed as RNPs), RNA trafficking components (described below) used to increase the incorporation of RNP into the XDP, and the tropism factor, can be incorporated into the nucleic acid encoding the retroviral components or can be encoded on separate nucleic acids. In some embodiments, the components of the XDP system are encoded on a single nucleic acid, on two nucleic acids, on three nucleic acids, on four nucleic acids, or on five nucleic acids which, in turn, are incorporated into plasmids used in the transfection to create the XDP in packaging cells. Representative, non-limiting configurations of plasmids used to make XDP in the packaging cells are presented in FIGS. 4 and 5. In a particular embodiment of the configuration of FIG. 4, the Gag polyprotein of plasmid 1 and the Gag-TFR-PR polyprotein of plasmid 2 are derived from Lentivirus (with an HIV-1 protease), the encoded MS2 of plasmid 1 comprises the sequence of SEQ ID NO: 33276, the encoded dXR fusion protein of plasmid 3 comprises any of the dXR embodiments described herein, the VSV-G plasmid encodes the VSV-G sequence of SEQ ID NO: 113, and the gRNA plasmid encodes a scaffold of SEQ ID NO: 2292 or 59352. In some embodiments, the components of the XDP system are capable of self-assembling into an XDP with the incorporated RNP of the dXR:gRNA when the one or more nucleic acids are introduced into a eukaryotic host cell and are expressed. In the foregoing embodiment, the dXR:gRNA RNP is encapsidated within the XDP upon self-assembly of the XDP. In a particular embodiment, the tropism factor is incorporated on the XDP surface upon self-assembly of the XDP. XDP compositions and methods of making XDP are described in WO2021113772A1 and PCT/US22/32579, incorporated by reference herein.

The polynucleotides encoding the Gag, dXR and gRNA of any of the embodiments described herein can further comprise paired components designed to assist the trafficking of the components out of the nucleus of the host cell and facilitate recruitment of the complexed CasX:gRNA into the budding XDP. Non-limiting examples of such non-covalent trafficking components include hairpin RNA or loops such as MS2 hairpin, PP7 hairpin, Qβ hairpin, boxB, transactivation response element (TAR), Rev response element, phage GA hairpin, and U1 hairpin II that have binding affinity for MS2 coat protein, PP7 coat protein, Q$ coat protein, protein N, protein Tat, Rev, phage GA coat protein, and U1A signal recognition particle, respectively, that are fused to the Gag polyprotein. It has been discovered that the incorporation of the binding partner inserted into the guide RNA and the packaging recruiter into the nucleic acid comprising the Gag polypeptide facilitates the packaging of the XDP particle due, in part, to the affinity of the CasX for the gRNA, resulting in an RNP, such that both the gRNA and CasX are associated with Gag during the encapsidation process of the XDP, increasing the proportion of XDP comprising RNP compared to a construct lacking the binding partner and packaging recruiter. In other embodiments, the gRNA can comprise Rev response element (RRE) or portions thereof that have binding affinity to Rev, which can be linked to the Gag polyprotein. In other embodiments, the gRNA can comprise one or more RRE and one or more MS2 hairpin sequences. The RRE can be selected from the group consisting of Stem IIB of Rev response element (RRE), Stem II-V of RRE, Stem II of RRE, Rev-binding element (RBE) of Stem IIB, and full-length RRE. In the foregoing embodiment, the components include sequences of UGGGCGCAGCGUCAAUGACGCUGACGGUACA (Stem IIB, SEQ ID NO: 57736), GCACUAUGGGCGCAGCGUCAAUGACGCUGACGGUACAGGCCAGACAAUUAUUGU CUGGUAUAGUGC (Stem II, SEQ ID NO: 57737), CAGGAAGCACUAUGGGCGCAGCGUCAAUGACGCUGACGGUACAGGCCAGACAAU UAUUGUCUGGUAUAGUGCAGCAGCAGAACAAUUUGCUGAGGGCUAUUGAGGCGC AACAGCAUCUGUUGCAACUCACAGUCUGGGGCAUCAAGCAGCUCCAGGCAAGAA UCCUG (Stem II-V, SEQ ID NO: 57738), GCUGACGGUACAGGC (RBE, SEQ ID NO: 57739), and AGGAGCUUUGUUCCUUGGGUUCUUGGGAGCAGCAGGAAGCACUAUGGGCGCAGC GUCAAUGACGCUGACGGUACAGGCCAGACAAUUAUUGUCUGGUAUAGUGCAGCA GCAGAACAAUUUGCUGAGGGCUAUUGAGGCGCAACAGCAUCUGUUGCAACUCAC AGUCUGGGGCAUCAAGCAGCUCCAGGCAAGAAUCCUGGCUGUGGAAAGAUACCU AAAGGAUCAACAGCUCCU (full-length RRE, SEQ ID NO: 57740). In other embodiments, the gRNA can comprise one or more RRE and one or more MS2 hairpin sequences. In a particular embodiment, the gRNA comprises an MS2 hairpin variant that is optimized to increase the binding affinity to the MS2 coat protein, thereby enhancing the incorporation of the gRNA and associated CasX into the budding XDP.

In some embodiments, the tropism factor incorporated on the XDP surface is selected from the group consisting of a glycoprotein, an antibody fragment, a receptor, and a ligand to a target cell marker. In one embodiment ofthe foregoing, the tropism factor is a glycoprotein having a sequence selected from the group consisting ofthe sequences set forth in Table 8, or a sequence having at least about 85%, at least about 90%, at least about 91%, at least about 92%, at least about 93%, at least about 94%, at least about 95%, at least about 96%, at least about 97%, at least about 98%, or at least about 99% sequence identity thereto. In a particular embodiment, the glycoprotein is VSV-G.

TABLE 8

Glycoproteins for XDP

| SEQ ID NO | Virus | Plasmid |
|---|---|---|
| 113 | Vesicular Stomatitis Virus | pGP2 |
| 114 | Human Immunodeficiency Virus | pGP3 |
| 115 | Avian leukosis virus | pGP4 |
| 116 | Rous Sarcoma Virus | pGP5 |
| 117 | Mouse mammary tumor virus | pGP6 |
| 118 | Human T-lymphotropic virus 1 | pGP7 |
| 119 | RD114 Endogenous Feline Retrovirus | pGP8 |
| 120 | Gibbon ape leukemia virus | pGP9 |
| 121 | Moloney Murine leukemia virus | pGP10 |
| 122 | Baboon Endogenous Virus | pGP11 |
| 123 | Human Foamy Virus | pGP12 |
| 124 | Pseudorabies virus | pGP13.1 |
| 125 | Pseudorabies virus | pGP13.2 |
| 126 | Pseudorabies virus | pGP13.3 |
| 127 | Pseudorabies virus | pGP13.4 |
| 128 | Herpes simplex virus 1 (HHV1) | pGP14.1 |
| 129 | Herpes simplex virus 1 (HHV1) | pGP14.2 |
| 130 | Herpes simplex virus 1 (HHV1) | pGP14.3 |
| 131 | Herpes simplex virus 1 (HHV1) | pGP14.4 |
| 132 | Hepatitis C Virus | pGP23 |

TABLE 8-continued

| SEQ ID NO | Virus | Plasmid |
|---|---|---|
| | Glycoproteins for XDP | |
| 133 | Rabies Virus | pGP29 |
| 134 | Mokola Virus | pGP30 |
| 135 | Measles Virus | pGP32.1 |
| 136 | Measles Virus | pGP32.2 |
| 137 | Ebola Zaire Virus | pGP41 |
| 138 | Dengue | pGP25 |
| 139 | Zika virus | pGP26 |
| 140 | West Nile Virus | pGP27 |
| 141 | Japanese Encephalitis Virus | pGP28 |
| 142 | Hepatitis G Virus | pGP24 |
| 143 | Mumps Virus F | pGP31.1 |
| 144 | Mumps Virus HN | pGP31.2 |
| 145 | Sendai Virus F | pGP33.1 |
| 146 | Sendai Virus HN | pGP33.2 |
| 147 | AcMNPV gp64 | pGP59 |
| 148 | Ross River Virus | pGP54 |
| 149 | Codon optimized rabies virus | pGP29.2 |
| 150 | Rabies virus (strain Nishigahara RCEH) (RABV) | pGP29.3 |
| 151 | Rabies virus (strain India) (RABV) | pGP29.4 |
| 152 | Rabies virus (strain CVS-11) (RABV) | pGP29.5 |
| 153 | Rabies virus (strain ERA) (RABV) | pGP29.6 |
| 154 | Rabies virus (strain SAD B19) (RABV) | pGP29.7 |
| 155 | Rabies virus (strain Vnukovo-32) (RABV) | pGP29.8 |
| 156 | Rabies virus (strain Pasteur vaccins/PV) (RABV) | pGP29.9 |
| 157 | Rabies virus (strain PM1503/AVO1) (RABV) | pGP29.1 |
| 158 | Rabies virus (strain China/DRV) (RABV) | pGP29.11 |
| 159 | Rabies virus (strain China/MRV) (RABV) | pGP29.12 |
| 160 | Rabies virus (isolate Human/Algeria/1991) (RABV) | pGP29.13 |
| 161 | Rabies virus (strain HEP-Flury) (RABV) | pGP29.14 |
| 162 | Rabies virus (strain silver-haired bat-associated) (RABV) (SHBRV) | pGP29.15 |
| 163 | HSV2 gB | pGP15.1 |
| 164 | HSV2 gD | pGP15.2 |
| 165 | HSV2 gH | pGP15.3 |
| 166 | HSV2 gL | pGP15.4 |
| 167 | Varicella gB | pGP16.1 |
| 168 | Varicella gK | pGP16.2 |
| 169 | Varicella gH | pGP16.3 |
| 170 | Varicella gL | pGP16.4 |
| 171 | Hepatitis B gL | pGP22.1 |
| 172 | Hepatitis B gM | pGP22.2 |
| 173 | Hepatitis B gS | pGP22.3 |
| 174 | Eastern equine encephalitis virus (EEEV) | pGP65 |
| 175 | Venezuelan equine encephalitis viruses (VEEV) | pGP66 |
| 176 | Western equine encephalitis virus (WEEV) | pGP67 |
| 177 | Semliki Forest virus | pGP68 |
| 178 | Sindbis virus | pGP69 |
| 179 | Chikungunya virus (CHIKV) | pGP70 |
| 180 | Bornavirus BoDV-1 | pGP58 |
| 181 | Tick-borne encephalitis virus (TBEV) | pGP71 |
| 182 | Usutu virus | pGP72 |
| 183 | St. Louis encephalitis virus | pGP73 |
| 184 | Yellow fever virus | pGP74 |
| 185 | Dengue virus 2 | pGP75 |
| 186 | Dengue virus 3 | pGP76 |
| 187 | Dengue virus 4 | pGP77 |
| 188 | Murray Valley encephalitis virus (MVEV) | pGP78 |
| 189 | Powassan virus | pGP79 |
| 190 | H5 Hemagglutinin | pGP80 |
| 191 | H7 Hemagglutinin | pGP81 |
| 192 | N1 Neuraminidase | pGP82 |
| 193 | Canine Distemper Virus | pGP83 |
| 194 | VSAV | pGP92 |
| 195 | ABVV | pGP99 |
| 196 | CARV | pGP98 |
| 197 | CHPV | pGP97 |
| 198 | COCV | pGP100 |
| 199 | VSIV | pGP91 |
| 200 | ISFV | pGP90 |
| 201 | JURV | pGP87 |
| 202 | MSPV | pGP89 |
| 203 | MARV | pGP88 |
| 204 | MORV | pGP101 |
| 205 | VSNJV | pGP84 |
| 206 | PERV | pGP85 |

TABLE 8-continued

| Glycoproteins for XDP | | |
|---|---|---|
| SEQ ID NO | Virus | Plasmid |
| 207 | PIRYV | pGP94 |
| 208 | RADV | pGP96 |
| 209 | YBV | pGP86 |
| 210 | VSV CEN AM - 94GUB | pGP93 |
| 211 | VSV South America 85CLB | pGP95 |
| 212 | Nipah Virus | pGP34.1 |
| 213 | Nipah Virus | pGP34.2 |
| 214 | Hendra Virus | pGP35.1 |
| 215 | Hendra Virus | pGP35.2 |
| 216 | Newcastle disease virus | pGP37.1 |
| 217 | Newcastle disease virus | pGP37.2 |
| 218 | RSV f0 | pGP55.1 |
| 219 | RSV G | pGP55.2 |
| 220 | Bovine respiratory syncytial virus (strain Rb94) (BRS) | pGP102 |
| 221 | Murine pneumonia virus (strain 15) (MPV) | pGP103 |
| 222 | Measles virus (strain Edmonston) (MeV) (Subacute sclerose panencephalitis virus) | pGP104 |
| 223 | Measles virus (strain Edmonston B) (MeV) (Subacute sclerose panencephalitis virus) | pGP105 |
| 224 | Human respiratory syncytial virus B (strain B1) | pGP106 |
| 225 | Rinderpest virus (strain RBOK) (RDV) | pGP107 |
| 226 | Simian virus 41 (SV41) | pGP108 |
| 227 | Mumps virus (strain Miyahara vaccine) (MuV) | pGP109 |
| 228 | Canine distemper virus (strain Onderstepoort) (CDV) | pGP110 |
| 229 | Human respiratory syncytial virus A (strain Long) | pGP111 |
| 230 | Sendai virus (strain Fushimi) (SeV) | pGP112 |
| 231 | Human respiratory syncytial virus A (strain RSS-2) | pGP113 |
| 232 | Rinderpest virus (strain RBT1) (RDV) | pGP114 |
| 233 | Measles virus (strain Leningrad-16) (MeV) (Subacute sclerose panencephalitis virus) | pGP115 |
| 234 | Human parainfluenza 2 virus (HPIV-2) | pGP116 |
| 235 | Avian metapneumovirus (isolate Canada goose/Minnesota/15a/2001) (AMPV) | pGP117 |
| 236 | Phocine distemper virus (PDV) | pGP118 |
| 237 | Sendai virus (strain Harris) (SeV) | pGP119 |
| 238 | Bovine parainfluenza 3 virus (BPIV-3) | pGP120 |
| 239 | Measles virus (strain Ichinose-B95a) (MeV) (Subacute sclerose panencephalitis virus) | pGP121 |
| 240 | Human parainfluenza 2 virus (strain Toshiba) (HPIV-2) | pGP122 |
| 241 | Newcastle disease virus (strain B1-Hitchner/47) (NDV) | pGP123 |
| 242 | Measles virus (strain Yamagata-1) (MeV) (Subacute sclerose panencephalitis virus) | pGP124 |
| 243 | Measles virus (strain IP-3-Ca) (MeV) (Subacute sclerose panencephalitis virus) | pGP125 |
| 244 | Measles virus (strain Edmonston-AIK-C vaccine) (MeV) (Subacute sclerose panencephalitis virus) | pGP126 |
| 245 | Turkey rhinotracheitis virus (TRTV) | pGP127 |
| 246 | Human parainfluenza 2 virus (strain Greer) (HPIV-2) | pGP128 |
| 247 | Hendra virus (isolate Horse/Autralia/Hendra/1994) | pGP129 |
| 248 | Human metapneumovirus (strain CAN97-83) (HMPV) | pGP130 |
| 249 | Bovine respiratory syncytial virus (strain Copenhagen) (BRS) | pGP131 |
| 250 | Sendai virus (strain Z) (SeV) (Sendai virus (strain HVJ)) | pGP132 |
| 251 | Human parainfluenza 3 virus (strain Wash/47885/57) (HPIV-3) (Human parainfluenza 3 virus (strain NIH 47885)) | pGP133 |
| 252 | Mumps virus (strain SBL-1) (MuV) | pGP134 |
| 253 | Measles virus (strain Edmonston-Zagreb vaccine) (MeV) (Subacute sclerose panencephalitis virus) | pGP135 |
| 254 | Human parainfluenza 1 virus (strain C39) (HPIV-1) | pGP136 |
| 255 | Sendai virus (strain Hamamatsu) (SeV) | pGP137 |
| 256 | Mumps virus (strain RW) (MuV) | pGP138 |
| 257 | Infectious hematopoietic necrosis virus (strain Oregon69) (IHNV) | pGP139 |
| 258 | Drosophila melanogaster sigma virus (isolate Drosophila/USA/AP30/2005) (DMelSV) | pGP140 |
| 259 | Hirame rhabdovirus (strain Korea/CA 9703/1997) (HIRRV) | pGP141 |
| 260 | Sonchus yellow net virus (SYNV) | pGP142 |
| 261 | European bat lyssavirus 1 (strain Bat/Germany/RV9/1968) (EBLV1) | pGP143 |
| 262 | Lagos bat virus (LBV) | pGP144 |
| 263 | Duvenhage virus (DUVV) | pGP145 |
| 264 | West Caucasian bat virus (WCBV) | pGP146 |
| 265 | European bat lyssavirus 2 (strain Human/Scotland/RV1333/2002) (EBLV2) | pGP147 |
| 266 | Irkut virus (IRKV) | pGP148 |
| 267 | Tupaia virus (isolate Tupaia/Thailand/—/1986) (TUPV) | pGP149 |

TABLE 8-continued

Glycoproteins for XDP

| SEQ ID NO | Virus | Plasmid |
|---|---|---|
| 268 | Rabies virus (strain ERA) (RABV) | pGP150 |
| 269 | Ovine respiratory syncytial virus (strain WSU 83-1578) (ORSV) | pGP151 |
| 270 | Human respiratory syncytial virus A (strain rsb5857) | pGP152 |
| 271 | Piry virus (PIRYV) | pGP153 |
| 272 | Human respiratory syncytial virus A (strain rsb6190) | pGP154 |
| 273 | Rabies virus (strain SAD B19) (RABV) | pGP155 |
| 274 | Australian bat lyssavirus (isolate Human/AUS/1998) (ABLV) | pGP156 |
| 275 | Rabies virus (strain Vnukovo-32) (RABV) | pGP157 |
| 276 | Aravan virus (ARAV) | pGP158 |
| 277 | Sigma virus | pGP159 |
| 278 | Viral hemorrhagic septicemia virus (strain 07-71) (VHSV) | pGP160 |
| 279 | Rabies virus (strain Pasteur vaccins/PV) (RABV) | pGP161 |
| 280 | Bovine respiratory syncytial virus (strain Rb94) (BRS) | pGP162 |
| 281 | Tibrogargan virus (strain CS132) (TIBV) | pGP163 |
| 282 | Infectious hematopoietic necrosis virus (strain Round Butte) (IHNV) | pGP164 |
| 283 | Human respiratory syncytial virus B (strain 18537) | pGP165 |
| 284 | Adelaide River virus (ARV) | pGP166 |
| 285 | Australian bat lyssavirus (isolate Bat/AUS/1996) (ABLV) | pGP167 |
| 286 | Bovine ephemeral fever virus (strain BB7721) (BEFV) | pGP168 |
| 287 | Isfahan virus (ISFV) | pGP169 |
| 288 | Rabies virus (strain silver-haired bat-associated) (RABV) (SHBRV) | pGP170 |
| 289 | Snakehead rhabdovirus (SHRV) | pGP171 |
| 290 | Infectious hematopoietic necrosis virus (strain WRAC) (IHNV) | pGP172 |
| 291 | Zaire ebolavirus (strain Kikwit-95) (ZEBOV) (Zaire Ebola virus) | pGP173 |
| 292 | Sudan ebolavirus (strain Maleo-79) (SEBOV) (Sudan Ebola virus) | pGP174 |
| 293 | Tai Forest ebolavirus (strain Cote d'Ivoire-94) (TAFV) (Cote d'Ivoire Ebola virus) | pGP175 |
| 294 | Reston ebolavirus (strain Philippines-96) (REBOV) (Reston Ebola virus) | pGP176 |
| 295 | Lake Victoria marburgvirus (strain Angola/2005) (MARV) | pGP177 |
| 296 | Zaire ebolavirus (strain Eckron-76) (ZEBOV) (Zaire Ebola virus) | pGP178 |
| 297 | Reston ebolavirus (strain Reston-89) (REBOV) (Reston Ebola virus) | pGP179 |
| 298 | Tai Forest ebolavirus (strain Cote d'Ivoire-94) (TAFV) (Cote d'Ivoire Ebola virus) | pGP180 |
| 299 | Lake Victoria marburgvirus (strain Ozolin-75) (MARV) (Marburg virus (strain South Africa/Ozolin/1975)) | pGP181 |
| 300 | Zaire ebolavirus (strain Mayinga-76) (ZEBOV) (Zaire Ebola virus) | pGP182 |
| 301 | Lake Victoria marburgvirus (strain Popp-67) (MARV) (Marburg virus (strain West Germany/Popp/1967)) | pGP183 |
| 302 | Sudan ebolavirus (strain Boniface-76) (SEBOV) (Sudan Ebola virus) | pGP184 |
| 303 | Reston ebolavirus (strain Reston-89) (REBOV) (Reston Ebola virus) | pGP185 |
| 304 | Sudan ebolavirus (strain Human/Uganda/Gulu/2000) (SEBOV) (Sudan Ebola virus) | pGP186 |
| 305 | Zaire ebolavirus (strain Gabon-94) (ZEBOV) (Zaire Ebola virus) | pGP187 |
| 306 | Reston ebolavirus (strain Reston-89) (REBOV) (Reston Ebola virus) | pGP188 |
| 307 | Simian virus 41 (SV41) | pGP189 |
| 308 | Newcastle disease virus (strain D26/76) (NDV) | pGP190 |
| 309 | Xenotropic MuLV-related virus (isolate VP42) (XMRV) | pGP191 |
| 310 | Xenotropic MuLV-related virus (isolate VP62) (XMRV) | pGP192 |
| 311 | Simian immunodeficiency virus (isolate F236/smH4) (SIV-sm) (Simian immunodeficiency virus sooty mangabey monkey) | pGP193 |
| 312 | Simian immunodeficiency virus (isolate Mm251) (SIV-mac) (Simian immunodeficiency virus rhesus monkey) | pGP194 |
| 313 | Simian immunodeficiency virus (isolate GB1) (SIV-mnd) (Simian immunodeficiency virus mandrill) | pGP195 |
| 314 | Simian immunodeficiency virus (isolate Mm142-83) (SIV-mac) (Simian immunodeficiency virus rhesus monkey) | pGP196 |

TABLE 8-continued

Glycoproteins for XDP

| SEQ ID NO | Virus | Plasmid |
|---|---|---|
| 315 | Simian immunodeficiency virus (isolate MB66) (SIV-cpz) (Chimpanzee immunodeficiency virus) | pGP197 |
| 316 | Simian immunodeficiency virus (isolate EK505) (SIV-cpz) (Chimpanzee immunodeficiency virus) | pGP198 |
| 317 | Feline immunodeficiency virus (strain UK2) (FIV) | pGP199 |
| 318 | Feline immunodeficiency virus (strain San Diego) (FIV) | pGP200 |
| 319 | Feline immunodeficiency virus (isolate Wo) (FIV) | pGP201 |
| 320 | Feline immunodeficiency virus (isolate Petaluma) (FIV) | pGP202 |
| 321 | Feline immunodeficiency virus (strain UK8) (FIV) | pGP203 |
| 322 | Feline immunodeficiency virus (strain UT-113) (FIV) | pGP204 |
| 323 | Mayoro Virus | pGP205 |
| 324 | Barmah Forest Virus | pGP206 |
| 325 | Aura virus | pGP207 |
| 326 | Bebaru Virus | pGP208 |
| 327 | Middleburg virus | pGP209 |
| 328 | Mucambo virus | pGP210 |
| 329 | Ndumu Virus | pGP211 |
| 330 | O'nyong-nyong virus | pGP212 |
| 331 | Pixuna virus | pGP213 |
| 332 | Tonate Virus | pGP214 |
| 333 | Trocara virus | pGP215 |
| 334 | Whataroa virus | pGP216 |
| 335 | Bussuquara virus | pGP217 |
| 336 | Jugra virus | pGP218 |

In some embodiments, the protease encoded in the nucleic acids utilized in the XDP system is selected from the group consisting of HIV-1 protease, tobacco etch virus protease (TEV), potyvirus HC protease, potyvirus P1 protease, PreScission (HRV3C protease), b virus NIa protease, B virus RNA-2-encoded protease, aphthovirus L protease, enterovirus 2A protease, rhinovirus 2A protease, picorna 3C protease, comovirus 24K protease, nepovirus 24K protease, RTSV (rice tungro spherical virus) 3C-like protease, parsnip yellow fleck virus protease, 3C-like protease, heparin, cathepsin, thrombin, factor Xa, metalloproteinase, and enterokinase.

In some embodiments, the present disclosure provides eukaryotic cells transfected with the plasmids encoding the XDP system of any one of the foregoing embodiments, wherein the cell is a packaging cell capable of facilitating the expression of the encoded dXR:gRNA and XDP components and the assembly of the XDP particles that encapsidate RNP of the dXR and gRNA. In some embodiments, the eukaryotic cell is selected from the group consisting of HEK293 cells, HEK293T cells, Lenti-X 293T cells, BHK cells, HepG2, Saos-2, HuH7, NS0 cells, SP2/0 cells, YO myeloma cells, A549 cells, P3X63 mouse myeloma cells, PER cells, PER.C6 cells, hybridoma cells, VERO, NIH3T3 cells, COS, WI38, MRC5, A549, HeLa cells, CHO cells, and HT1080 cells. In some embodiments, the packaging host cell can be modified to reduce or eliminate cell surface markers or receptors that would otherwise be incorporated into the XDP, thereby reducing an immune response to the cell surface markers or receptors by the subject receiving an administration of the XDP. Such markers can include receptors or proteins capable of being bound by MHC receptors or that would otherwise trigger an immune response in a subject. In some embodiments, the packaging host cell is modified to reduce or eliminate the expression of a cell surface marker selected from the group consisting of B2M, CIITA, PD1, and HLA-E KI, wherein the incorporation of the marker is reduced on the surface of the XDP. In some embodiments, the packaging host cell is modified to express one or more cell surface markers selected from the group consisting of CD46, CD47, CD55, CD59, CD24, CD58, SLAMF4, and SLAMF3 (serving as "don't eat me" signals), wherein the cell surface marker is incorporated onto the surface of the XDP, wherein said incorporation disables XDP engulfment and phagocytosis by host surveillance cells such as macrophages and monocytes.

For non-viral delivery, vectors can also be delivered wherein the vector or vectors encoding and/or comprising the dXR and gRNA are formulated in nanoparticles, wherein the nanoparticles contemplated include, but are not limited to nanospheres, liposomes, quantum dots, polyethylene glycol particles, hydrogels, and micelles. As described more fully, below, lipid nanoparticles are generally composed of an ionizable cationic lipid and three or more additional components, such as cholesterol, DOPE, polylactic acid-co-glycolic acid, and a polyethylene glycol (PEG) containing lipid. In some embodiments, mRNA encoding the dXR variants of the embodiments disclosed herein are formulated in a lipid nanoparticle. In some embodiments, the nanoparticle comprises the gRNA of the embodiments disclosed herein. In some embodiments, the nanoparticle comprises mRNA encoding the dXR and the gRNA. In some embodiments, the components of the dXR:gRNA system are formulated in separate nanoparticles for delivery to cells or for administration to a subject in need thereof.

c. Lipid Nanoparticles (LNP)

In another aspect, the present disclosure provides lipid nanoparticles (LNP) for delivery of a gRNA and an mRNA encoding a fusion protein of any of the system embodiments disclosed herein. In certain embodiments, a composition described herein comprises LNP encapsidating a gene repressor system of the disclosure (i.e., an mRNA encoding a fusion protein (e.g., a dXR) and a gRNA with a targeting sequence to the target nucleic acid) which represses transcription of a target gene.

In some embodiments, the LNP of the disclosure are tissue- or organ-specific, have excellent biocompatibility, and can deliver the systems comprising mRNA encoding the dXR and a gRNA with a targeting sequence to the target nucleic acid with high efficiency, and thus can be usefully used for the repression or silencing of the target nucleic acid of a gene in cells of a subject having a disease or disorder.

In their native forms, nucleic acid polymers are unstable in biological fluids and cannot penetrate the membrane of target cells to be delivered to the cytoplasm, thus requiring delivery systems capable of entering a cell. Lipid nanoparticles (LNP) have proven useful for both the protection and delivery of nucleic acids to tissues and cells. Furthermore, the use of mRNA in LNP to encode the CRISPR nuclease eliminates the possibility of undesirable genome integration compared to DNA vectors. Moreover, mRNA efficiently transfects both mitotic and non-mitotic cells, as it does not require entry into the nucleus since it exerts its function in the cytoplasmic compartment. LNP as a delivery platform offers the additional advantage of being able to co-formulate both the mRNA encoding the CRISPR nuclease and the gRNA into single LNP particles.

Accordingly, in various embodiments, the disclosure encompasses LNP and compositions that may be used for a variety of purposes, including the delivery of encapsulated dXR:gRNA systems to cells, both in vitro and in vivo. In some embodiments, the gRNA for use in the LNP is the sequence of SEQ ID NO: 59352. In some embodiments, the gRNA for use in the LNP comprises one or more chemical modifications to the sequence. In some embodiments, the mRNA for incorporation into the LNP of the disclosure encode any of the dXR embodiments described herein. In some embodiments, the mRNA for incorporation into the LNP of the disclosure are codon optimized. In some embodiments, an mRNA encoding a dXR fusion protein of the disclosure is chemically modified, wherein the chemical modification is substitution of N1-methyl-pseudouridine for one or more uridine nucleotides of the sequence. In some embodiments, an mRNA for incorporation into the LNP of the disclosure comprises one or more sequences selected from the group consisting of SEQ ID NOS: 59584-59585, 59610, 59611, 59622 and 59623. In some embodiments, In some embodiments, an mRNA for incorporation into the LNP of the disclosure comprises one or more sequences encoded by a sequence selected from the group consisting of 59444-59449, 59455-59456, 59488-59497, 59568-59583, 59595-59609, and 59612-59621.

In some embodiments, the disclosure encompasses LNP encapsidating a gRNA and an mRNA encoding a fusion protein of a dCasX linked to a first repressor domain, wherein the repressor domain is a KRAB domain of any of the embodiments described herein. In some embodiments, the disclosure encompasses LNP encapsidating a gRNA and an mRNA encoding a fusion protein of a dCasX linked to a first and a second repressor domain, wherein the first repressor domain is a KRAB domain and the second repressor domain is a DNMT3A catalytic domain. In some embodiments, the disclosure encompasses LNP encapsidating a gRNA and an mRNA encoding a fusion protein of a dCasX linked to a first, a second, and a third repressor domain, wherein the first repressor domain is a KRAB domain, the second repressor domain is a DNMT3A catalytic domain, and the third domain is a DNMT3L interaction domain. In some embodiments, the disclosure encompasses LNP encapsidating a gRNA and an mRNA encoding a fusion protein of a dCasX linked to a first, a second, a third, and a fourth repressor domain, wherein the first repressor domain is a KRAB domain, the second repressor domain is a DNMT3A catalytic domain, the third domain is a DNMT3L interaction domain, and the fourth domain is a DNMT3A ADD domain. In the foregoing embodiments, the components of the fusion protein can be arrayed in alternate configurations, as portrayed in FIG. 7 and FIG. 45. In certain embodiments, the disclosure encompasses methods of treating or preventing diseases or disorders in a subject in need thereof by contacting the subject with an LNP that encapsulates the dXR:gRNA systems of the embodiments described herein, wherein the dXR is an encoding mRNA and the gRNA comprises a targeting sequence complementary to a target nucleic acid in cells of the subject.

In some embodiments, the present disclosure provides LNP in which the gRNA and mRNA encoding the dXR are incorporated into single LNP particles. In certain embodiments, the LNP composition includes a ratio of gRNA to dXR mRNA of the embodiments described herein from about 25:1 to about 1:25, as measured by weight. In certain embodiments, the LNP formulation includes a ratio of gRNA to dXR mRNA, such as dXR mRNA from about 10:1 to about 1:10. In certain embodiments, the LNP formulation includes a ratio of gRNA to dXR mRNA from about 8:1 to about 1:8. In some embodiments, the LNP formulation includes a ratio of gRNA to dXR mRNA, from about 5:1 to about 1:5. In some embodiments, ratio range is about 3:1 to 1:3, about 2:1 to 1:2, about 5:1 to 1:2, about 5:1 to 1:1, about 3:1 to 1:2, about 3:1 to 1:1, about 3:1, about 2:1 to 1:1. In some embodiments, the gRNA to mRNA ratio is about 3:1 or about 2:1. In some embodiments the ratio of gRNA to dXR mRNA is about 1:1. The ratio may be about 25:1, 10:1, 5:1, 3:1, 1:1, 1:3, 1:5, 1:10, or 1:25.

In other embodiments, the present disclosure provides LNP in which the gRNA and mRNA encoding the dXR are incorporated into separate LNP particles, which can be formulated together in varying ratios for administration.

In some embodiments, the optimized mRNA of the disclosure encoding the CasX protein may be provided in a solution to be mixed with a lipid solution such that the mRNA may be encapsulated in the LNP. A suitable mRNA solution may be any aqueous solution containing mRNA to be encapsulated at various concentrations. For example, a suitable mRNA solution may contain an mRNA at a concentration of or greater than about 0.01 mg/ml, 0.05 mg/ml, 0.06 mg/ml, 0.07 mg/ml, 0.08 mg/ml, 0.09 mg/ml, 0.1 mg/ml, 0.15 mg/ml, 0.2 mg/ml, 0.3 mg/ml, 0.4 mg/ml, 0.5 mg/ml, 0.6 mg/ml, 0.7 mg/ml, 0.8 mg/ml, 0.9 mg/ml, 1.0 mg/ml, 1.25 mg/ml, 1.5 mg/ml, 1.75 mg/ml, or 2.0 mg/ml. In some embodiments, a suitable mRNA solution may contain an mRNA at a concentration ranging from about 0.01-2.0 mg/ml, 0.01-1.5 mg/ml, 0.01-1.25 mg/ml, 0.01-1.0 mg/ml, 0.01-0.9 mg/ml, 0.01-0.8 mg/ml, 0.01-0.7 mg/ml, 0.01-0.6 mg/ml, 0.01-0.5 mg/ml, 0.01-0.4 mg/ml, 0.01-0.3 mg/ml, 0.01-0.2 mg/ml, 0.01-0.1 mg/ml, 0.05-1.0 mg/ml, 0.05-0.9 mg/ml, 0.05-0.8 mg/ml, 0.05-0.7 mg/ml, 0.05-0.6 mg/ml, 0.05-0.5 mg/ml, 0.05-0.4 mg/ml, 0.05-0.3 mg/ml, 0.05-0.2 mg/ml, 0.05-0.1 mg/ml, 0.1-1.0 mg/ml, 0.2-0.9 mg/ml, 0.3-0.8 mg/ml, 0.4-0.7 mg/ml, or 0.5-0.6 mg/ml. In some embodiments, a suitable mRNA solution may contain an mRNA at a concentration up to about 5.0 mg/ml, 4.0 mg/ml, 3.0 mg/ml, 2.0 mg/ml, 1.0 mg/ml, 0.9 mg/ml, 0.8 mg/ml, 0.7 mg/ml, 0.6 mg/ml, 0.5 mg/ml, 0.4 mg/ml, 0.3 mg/ml, 0.2 mg/ml, 0.1 mg/ml, 0.05 mg/ml, 0.04 mg/ml, 0.03 mg/ml, 0.02 mg/ml, 0.01 mg/ml, or 0.05 mg/ml.

In some embodiments, the gRNA of the disclosure may be provided in a solution to be mixed with a lipid solution such that the gRNA may be encapsulated in the LNP. A suitable gRNA solution may be any aqueous solution containing gRNA to be encapsulated at various concentrations. For example, a suitable gRNA solution may contain a gRNA at a concentration of or greater than about 0.01 mg/ml, 0.05 mg/ml, 0.06 mg/ml, 0.07 mg/ml, 0.08 mg/ml, 0.09 mg/ml, 0.1 mg/ml, 0.15 mg/ml, 0.2 mg/ml, 0.3 mg/ml, 0.4 mg/ml, 0.5 mg/ml, 0.6 mg/ml, 0.7 mg/ml, 0.8 mg/ml, 0.9 mg/ml, 1.0 mg/ml, 1.25 mg/ml, 1.5 mg/ml, 1.75 mg/ml, or 2.0 mg/ml. In some embodiments, a suitable gRNA solution may contain an gRNA at a concentration ranging from about 0.01-2.0 mg/ml, 0.01-1.5 mg/ml, 0.01-1.25 mg/ml, 0.01-1.0 mg/ml, 0.01-0.9 mg/ml, 0.01-0.8 mg/ml, 0.01-0.7 mg/ml, 0.01-0.6 mg/ml, 0.01-0.5 mg/ml, 0.01-0.4 mg/ml, 0.01-0.3 mg/ml, 0.01-0.2 mg/ml, 0.01-0.1 mg/ml, 0.05-1.0 mg/ml, 0.05-0.9 mg/ml, 0.05-0.8 mg/ml, 0.05-0.7 mg/ml, 0.05-0.6 mg/ml, 0.05-0.5 mg/ml, 0.05-0.4 mg/ml, 0.05-0.3 mg/ml, 0.05-0.2 mg/ml, 0.05-0.1 mg/ml, 0.1-1.0 mg/ml, 0.2-0.9 mg/ml, 0.3-0.8 mg/ml, 0.4-0.7 mg/ml, or 0.5-0.6 mg/ml.

In some embodiments, a suitable gRNA solution may contain a gRNA at a concentration up to about 5.0 mg/ml, 4.0 mg/ml, 3.0 mg/ml, 2.0 mg/ml, 1.0 mg/ml, 0.9 mg/ml, 0.8 mg/ml, 0.7 mg/ml, 0.6 mg/ml, 0.5 mg/ml, 0.4 mg/ml, 0.3 mg/ml, 0.2 mg/ml, 0.1 mg/ml, 0.05 mg/ml, 0.04 mg/ml, 0.03 mg/ml, 0.02 mg/ml, 0.01 mg/ml, or 0.05 mg/ml.

Early formulations of LNP utilizing permanently cationic lipids resulted in LNPs with positive surface charge that proved toxic in vivo, plus were rapidly cleared by phagocytic cells. By changing to ionizable cationic lipids bearing tertiary or quaternary amines, especially those with pKa<7, resulting LNP achieve efficient encapsulation of nucleic acid polymers at low pH by interacting electrostatically with the negative charges of the phosphate backbone of mRNA or gRNA, that also result in largely neutral systems at physiological pH values, thus alleviating problems associated with permanently-charged cationic lipids. Herein, "ionizable lipid" means an amine-containing lipid which can be easily protonated, and for example, it may be a lipid of which charge state changes depending on the surrounding pH. The ionizable lipid may be protonated (positively charged) at a pH below the pKa of a cationic lipid, and it may be substantially neutral at a pH over the pKa. In one example, the LNP may comprise a protonated ionizable lipid and/or an ionizable lipid showing neutrality. In some embodiments, the LNP has a pKa of 5 to 8, 5.5 to 7.5, 6 to 7, or 6.5 to 7. The pKa of the LNP is important for in vivo stability and release of the nucleic acid payload of the LNP. In some embodiments, the LNP having the foregoing pKa ranges may be safely delivered to a target organ (for example, the liver, lung, heart, spleen, as well as to tumors) and/or target cell (hepatocyte, LSEC, cardiac cell, cancer cell, etc.) in vivo, and after endocytosis, exhibit a positive charge to release the encapsulated payload through electrostatic interaction with an anionic protein of the endosome membrane.

The ionizable lipid is an ionizable compound having characteristics similar to lipids generally, and through electrostatic interaction with a nucleic acid (for example, an mRNA or gRNA of the disclosure), may play a role of encapsulating the nucleic acid within the LNP with high efficiency.

According to the type of the amine comprised in the ionizable lipid, (i) the nucleic acid encapsulation efficiency, (ii) PDI (polydispersity index) and/or (iii) the nucleic acid delivery efficiency to tissue and/or cells constituting an organ (for example, hepatocytes or liver sinusoidal endothelial cells in the liver) of the LNP may be different. In certain embodiments, the ionizable cationic lipid comprises from about 46 mol % to about 66 mol % of the total lipid present in the particle.

The LNP comprising an ionizable lipid comprising an amine may have one or more kinds of the following characteristics: (1) encapsulating a drug or biologic with high efficiency; (2) uniform size of prepared particles (or having a low PDI value); and/or (3) superior nucleic acid delivery efficiency to organs such as liver, lung, heart, spleen, as well as to tumors, and/or cells constituting such organs (for example, hepatocytes, LSEC, cardiac cells, cancer cells, etc.).

The lipid composition of lipid nanoparticles usually consists of an ionizable amino lipid, a helper lipid (usually a phospholipid), cholesterol, and a polyethylene glycol-lipid conjugate (PEG-lipid) to improve the colloidal stability in biological environments by reducing a specific absorption of plasma proteins and forming a hydration layer over the nanoparticles, and are formulated at typical mole ratios of 50:10:37-39:1.5-2.5, with variations made to adjust individual properties. As the PEG-lipid forms the surface lipid, the size of the LNP can be readily varied by varying the proportion of surface (PEG) lipid to the core (ionizable cationic) lipids. In some embodiments, the PEG-lipid can be varied from ~1 to 5 mol % to modify particle properties such as size, stability, and circulation time. In particular, the cationic lipid form plays a crucial role both in nucleic acid encapsulation through electrostatic interactions and intracellular release by disrupting endosomal membranes. The mRNA and gRNA (with targeting sequences) are encapsulated within the LNP by the ionic interactions they form with the positively charged cationic (or ionizable) lipid. Non-limiting examples of ionizable cationic lipid components utilized in the LNP of the disclosure are selected from DLin-MC3-DMA (heptatriaconta-6,9,28,31-tetraen-19-yl4-(dimethylamino)butanoate), DLin-KC2-DMA (2,2-dilinoleyl-4-(2-dimethylaminoethyl)-[1,3]-dioxolane), and TNT (1,3,5-triazinane-2,4,6-trione) and TT (N1,N3,N5-tris(2-aminoethyl)benzene-1,3,5-tricarboxamide). Non-limiting examples of helper lipids utilized in the LNP of the disclosure are selected from DSPC (1,2-distearoyl-sn-glycero-3-phosphocholine), POPC (2-Oleoyl-1-palmitoyl-sn-glycero-3-phosphocholine) and DOPE (1,2-Dioleoyl-sn-glycero-3-phosphoethanolamine). Cholesterol and PEG-DMG ((R)-2,3-bis(octadecyloxy)propyl-1-(methoxy polyethylene glycol 2000) carbamate) or PEG-DSG (1,2-Distearoyl-rac-glycero-3-methylpolyoxyethylene glycol 2000) are components utilized for the stability, circulation, and size of the LNP.

In other embodiments, the ionizable cationic lipid in the nucleic acid-lipid particles of the disclosure may comprise, for example, one or more ionizable cationic lipids wherein the ionizable cationic lipid is a dialkyl lipid. In another embodiment, the ionizable cationic lipid is a trialkyl lipid. In one particular embodiment, the ionizable cationic lipid is selected from the group consisting of 1,2-dilinoleyloxy-N,N-dimethylaminopropane (DLinDMA), 1,2-dilinolenyloxy-N,N-dimethylaminopropane (DLinDMA), 1,2-di-.gamma.-linolenyloxy-N,N-dimethylaminopropane (gamma.-DLinDMA), 2,2-dilinoleyl-4-(2-dimethylaminoethyl)-[1,3]-dioxolane (DLin-K-C2-DMA), 2,2-dilinoleyl-4-dimethylaminomethyl-[1,3]-dioxolane (DLin-K-DMA), dilinoleylmethyl-3-dimethylaminopropionate (DLin-M-C2-DMA), or salts thereof and mixtures thereof. In a particular embodiment, the ionizable cationic lipid is selected from the group consisting of 1,2-dilinoleyloxy-N,N-dimethylaminopropane (DLinDMA), 1,2-dilinolenyloxy-N,N-dimethylaminopropane (DLenDMA), 1,2-di-.gamma.-linolenyloxy-N,N-dimethylaminopropane (.gamma.-DLenDMA; a salt thereof, or a mixture thereof. In some embodiments, the N/P ratio (nitrogen from the cationic/ionizable lipid and phosphate from the nucleic acid) is in the range of is about 3:1 to 7:1, or about 4:1 to 6:1, or is 3:1, or is 4:1, or is 5:1, or is 6:1, or is 7:1.

The phospholipid of the elements of the LNP according to one example plays a role of covering and protecting a core formed by interaction of the ionizable lipid and nucleic acid in the LNP, and may facilitate cell membrane permeation and endosomal escape during intracellular delivery of the nucleic acid by binding to the phospholipid bilayer of a target cell.

For the phospholipid, a phospholipid which can promote fusion of the LNP according to one example may be used without limitation, and for example, it may be one or more kinds selected from the group consisting of dioleoylphosphatidylethanolamine (DOPE), distearoylphosphatidylcholine (DSPC), palmitoyloleoylphosphatidylcholine (POPC), egg phosphatidylcholine (EPC), dioleoylphosphatidylcholine (DOPC), dipalmitoylphosphatidylcholine (DPPC), dioleoylphosphatidylglycerol (DOPG), dipalmitoylphosphatidylglycerol (DPPG), distearoylphosphatidylethanolamine (DSPE), phosphatidylethanolamine (PE), dipalmitoylphosphatidylethanolamine, 1,2-dioleoyl-sn-glycero-3-phosphoethanolamine, 1-palmitoyl-2-oleoyl-sn-glycero-3-phosphoethanolamine(POPE), 1-palmitoyl-2-dioleoyl-sn-glycero-3-phosphocholine(POPC), 1,2-dioleoyl-sn-glycero-3-[phospho-L-serine](DOPS), 1,2-dioleoyl-sn-glycero-3-[phospho-L-serine] and the like. In one example, the LNP comprising DOPE may be effective in mRNA delivery (excellent delivery efficacy).

The cholesterol of the elements of the LNP according to one example may provide morphological rigidity to lipid filling in the LNP and be dispersed in the core and surface of the nanoparticle to improve the stability of the nanoparticle.

Herein, "lipid-PEG (polyethyleneglycol) conjugate", "lipid-PEG", "PEG-lipid", "PEG-lipid", or "lipid-PEG" refers to a form in which lipid and PEG are conjugated, and means a lipid in which a polyethylene glycol (PEG) polymer which is a hydrophilic polymer is bound to one end. The lipid-PEG conjugate contributes to the particle stability in serum of the nanoparticle within the LNP, and plays a role of preventing aggregation between nanoparticles. In addition, the lipid-PEG conjugate may protect nucleic acids from degrading enzyme during in vivo delivery of the nucleic acids and enhance the stability of nucleic acids in vivo and increase the half-life of the drug or biologic encapsulated in the nanoparticle. Examples of PEG-lipid conjugates include, but are not limited to, PEG-DAG conjugates, PEG-DAA conjugates, and mixtures thereof. In certain embodiments, the PEG-lipid conjugate is selected from the group consisting of a PEG-diacylglycerol (PEG-DAG) conjugate, a PEG-dialkyloxypropyl (PEG-DAA) conjugate, a PEG-phospholipid conjugate, a PEG-ceramide (PEG-Cer) conjugate, and a mixture thereof. In certain embodiments, the PEG-lipid conjugate is a PEG-DAA conjugate. In certain embodiments, the PEG-DAA conjugate in the lipid particle may comprise a PEG-didecyloxypropyl ($C_{10}$) conjugate, a PEG-dilauryloxypropyl ($C_{12}$) conjugate, a PEG-dimyristyloxypropyl ($C_{14}$) conjugate, a PEG-dipalmityloxypropyl ($C_{16}$) conjugate, a PEG-distearyloxypropyl (Cis) conjugate, or mixtures thereof. In certain embodiments, wherein the PEG-DAA conjugate is a PEG-dimyristyloxypropyl ($C_{14}$) conjugate. In other embodiments, the lipid-PEG conjugate may be PEG bound to phospholipid such as phosphatidylethanolamine (PEG-PE), PEG conjugated to ceramide (PEG-CER, ceramide-PEG conjugate, ceramide-PEG, cholesterol or PEG conjugated to derivative thereof, PEG-c-DOMG, PEG-DMG, PEG-DLPE, PEG-DMPE, PEG-DPPC, PEG-DSPE(DSPE-PEG), and a mixture thereof, and for example, may be C16-PEG2000 ceramide (N-palmitoyl-sphingosine-1-{succinyl[methoxy(polyethylene glycol)2000]}), DMG-PEG 2000, 14:0 PEG2000 PE.

In certain embodiments, the conjugated lipid that inhibits aggregation of particles comprises from about 0.5 mol % to about 3 mol % of the total lipid present in the particle.

In one example, the average molecular weight of the lipid-PEG conjugate may be 100 daltons to 10,000 daltons, 200 daltons to 8,000 daltons, 500 daltons to 5,000 daltons, 1,000 daltons to 3,000 daltons, 1,000 daltons to 2,600 daltons, 1,500 daltons to 2,600 daltons, 1,500 daltons to 2,500 daltons, 2,000 daltons to 2,600 daltons, 2,000 daltons to 2,500 daltons, or 2,000 daltons.

For the lipid in the lipid-PEG conjugate, any lipid capable of binding to polyethyleneglycol may be used without limitation, and the phospholipid and/or cholesterol which are other elements of the LNP may be also used. Specifically, the lipid in the lipid-PEG conjugate may be ceramide, dimyristoylglycerol (DMG), succinoyl-diacylglycerol (s-DAG), distearoylphosphatidylcholine (DSPC), distearoylphosphatidylethanolamine (DSPE), or cholesterol, but not limited thereto.

In the lipid-PEG conjugate, the PEG may be directly conjugated to the lipid or linked to the lipid via a linker moiety. Any linker moiety suitable for binding PEG to the lipid may be used, and for example, includes an ester-free linker moiety and an ester-containing linker moiety. The ester-free linker moiety includes not only amido (—C(O)NH—), amino (—NR—), carbonyl (—C(O)—), carbamate (—NHC(O)O—), urea (—NHC(O)NH—), disulfide (—S—S—), ether (—O—), succinyl (—(O)CCH2CH2C(O)—), succinamidyl (—NHC(O)CH2CH2C(O)NH—), ether, disulfide but also combinations thereof (for example, a linker containing both a carbamate linker moiety and an amido linker moiety), but not limited thereto. The ester-containing linker moiety includes for example, carbonate (—OC(O)O—), succinoyl, phosphate ester (—O—(O)POH—O—), sulfonate ester, and combinations thereof, but not limited thereto.

In certain embodiments, the nucleic acid-lipid particle has a total lipid:gRNA mass ratio of from about 5:1 to about 15:1. In some embodiments, the weight ratio of the ionizable lipid and nucleic acid comprised in the LNP may be 1 to 20:1, 1 to 15:1, 1 to 10:1, 5 to 20:1, 5 to 15:1, 5 to 10:1, 7.5 to 20:1, 7.5 to 15:1, or 7.5 to 10:1.

In some embodiments, the LNP may comprise the ionizable lipid of 20 to 50 parts by weight, phospholipid of 10 to 30 parts by weight, cholesterol of 20 to 60 parts by weight (or 20 to 60 parts by weight), and lipid-PEG conjugate of 0.1 to 10 parts by weight (or 0.25 to 10 parts by weight, 0.5 to 5 parts by weight). The LNP may comprise the ionizable lipid of 20 to 50% by weight, phospholipid of 10 to 30% by weight, cholesterol of 20 to 60% by weight (or 30 to 60% by weight), and lipid-PEG conjugate of 0.1 to 10% by weight (or 0.25 to 10% by weight, 0.5 to 5% by weight) based on the total nanoparticle weight. In other example, the LNP may comprise the ionizable lipid of 25 to 50% by weight, phospholipid of 10 to 20% by weight, cholesterol of 35 to 55% by weight, and lipid-PEG conjugate of 0.1 to 10% by weight (or 0.25 to 10% by weight, 0.5 to 5% by weight), based on the total nanoparticle weight.

In some embodiments, the approach to formulating the LNP of the disclosure (described more fully in the examples) is to dissolve lipids in an organic solvent such as ethanol, which is then mixed through a micromixer with the nucleic acid dissolved in an acidic buffer (usually pH 4). At this pH the ionizable cationic lipid is positively charged and interacts with the negatively-charged nucleic acid polymers. The resulting nanostructures containing the nucleic acids are then converted to neutral LNP when dialyzed against a neutral buffer during the ethanol removal step. The LNP formed by this have a distinct electron-dense nanostructured core where the ionizable cationic lipids are organized into inverted micelles around the encapsulated mRNA molecules, as opposed to the traditional bilayer liposomal structures.

In some embodiments, the LNP may have an average diameter of 20 nm to 200 nm, 20 nm to 180 nm, 20 nm to 170 nm, 20 nm to 150 nm, 20 nm to 120 nm, 20 nm to 100 nm, 20 nm to 90 nm, 30 nm to 200 nm, 30 to 180 nm, 30 nm to 170 nm, 30 nm to 150 nm, 30 nm to 120 nm, 30 nm to 100 nm, 30 nm to 90 nm, 40 nm to 200 nm, 40 to 180 nm, 40 nm to 170 nm, 40 nm to 150 nm, 40 nm to 120 nm, 40 nm to 100 nm, 40 nm to 90 nm, 40 nm to 80 nm, 40 nm to 70 nm, 50 nm to 200 nm, 50 to 180 nm, 50 nm to 170 nm, 50 nm to 150 nm, 50 nm to 120 nm, 50 nm to 100 nm, 50 nm to 90 nm, 60 nm to 200 nm, 60 to 180 nm, 60 nm to 170 nm, 60 nm to 150 nm, 60 nm to 120 nm, 60 nm to 100 nm, 60 nm to 90 nm, 70 nm to 200 nm, 70 to 180 nm, 70 nm to 170 nm, 70 nm to 150 nm, 70 nm to 120 nm, 70 nm to 100 nm, 70 nm to 90 nm, 80 nm to 200 nm, 80 to 180 nm, 80 nm to 170 nm, 80 nm to 150 nm, 80 nm to 120 nm, 80 nm to 100 nm, 80 nm to 90 nm, 90 nm to 200 nm, 90 to 180 nm, 90 nm to 170 nm, 90 nm to 150 nm, 90 nm to 120 nm, or 90 nm to 100 nm. The LNP may be sized for easy introduction into organs or tissues, including but not limited to liver, lung, heart, spleen, as well as to tumors. When the size of the LNP is smaller than the above range, it is difficult to maintain stability as the surface area of the LNP is excessively increased, and thus delivery to the target tissue and/or therapeutic effect may be reduced. The LNP may specifically target liver tissue. The LNP may imitate metabolic behaviors of natural lipoproteins very similarly, and may be usefully applied for the lipid metabolism process by the liver and therapeutic mechanism through this. During the drug or biologic delivery to hepatocytes or and/or LSEC (liver sinusoidal endothelial cells), the diameter of the fenestrae leading from the sinusoidal lumen to the hepatocytes and LSEC is about 140 nm in mammals and about 100 nm in humans, so LNPs having a diameter in the above ranges may have superior delivery efficiency to hepatocytes and LSEC compared to LNP having the diameter outside the above range.

According to some embodiments, the LNP comprised in the composition for nucleic acid delivery into target cells may comprise the ionizable lipid:phospholipid:cholesterol: lipid-PEG conjugate in the range described above or at a molar ratio of 20 to 50:10 to 30:30 to 60:0.5 to 5, at a molar ratio of 25 to 45:10 to 25:40 to 50:0.5 to 3, at a molar ratio of 25 to 45:10 to 20:40 to 55:0.5 to 3, or at a molar ratio of 25 to 45:10 to 20:40 to 55:1.0 to 1.5. The LNP comprising components at a molar ratio in the above range may have excellent delivery efficiency specific to cells of target organs.

The LNP according to some embodiments exhibits a positive charge under the acidic pH condition by showing a pKa of 5 to 8, 5.5 to 7.5, 6 to 7, or 6.5 to 7, and may encapsulate a nucleic acid with high efficiency by easily forming a complex with a nucleic acid through electrostatic interaction with a therapeutic agent such as a nucleic acid showing a negative charge, and it may be usefully used as a composition for intracellular or in vivo delivery of a drug or biologic (for example, nucleic acid or protein). Herein, "encapsulation" refers to encapsulating a delivery substance for surrounding and embedding it in vivo efficiently, and the encapsulation efficiency (encapsulation efficiency) mean the content of the drug or biologic encapsulated in the LNP for the total drug or biologic content used for preparation.

The encapsulation efficiency of the nucleic acids of the composition in the LNP may be 70% or more, 75% or more, 80% or more, 85% or more, 90% or more, 91% or more, 92% or more, 94% or more, or 95% or more. In other embodiments, the encapsulation efficiency of the nucleic acids of the composition in the LNP is over 80% to 99% or less, over 80% to 97% or less, over 80% to 95% or less, 85% or more to 95% or less, 87% or more to 95% or less, 90% or more to 95% or less, 91% or more to 95% or less, 91% or more to 94% or less, over 91% to 95% or less, 92% or more to 99% or less, 92% or more to 97% or less, or 92% or more to 95% or less. As used herein, "encapsulation efficiency" means the percentage of LNP particles containing the nucleic acids to be incorporated within the LNP. In some embodiments, the mRNA encoding the dXR and a gRNA with a targeting sequence to the target nucleic acid of the disclosure are fully encapsulated in the nucleic acid-lipid particle.

The target organs to which a nucleic acid is delivered by the LNP include, but are not limited to the liver, lung, heart, spleen, as well as to tumors. The LNP according to one embodiment is liver tissue-specific and has excellent biocompatibility and can deliver the nucleic acids of a dXR: gRNA system composition with high efficiency, and thus it can be usefully used in related technical fields such as lipid nanoparticle-mediated gene therapy. In a particular embodiment, the target cell to which the nucleic acids of the dXR:gRNA system are delivered by the LNP according to one example may be a hepatocyte and/or LSEC in vivo. In other embodiments, the disclosure provides LNP formulated for delivery of the nucleic acids of the embodiments to cells ex vivo.

Accordingly, in certain embodiments, the disclosure encompasses gRNA molecules that target the expression of one or more target nucleic acids, nucleic acid-lipid particles comprising an mRNA encoding a dXR fusion protein of the disclosure and one or more of the gRNAs that target the expression of one or more target nucleic acids, nucleic acid-lipid particles comprising one or more (e.g., a cocktail) of the gRNAs, and methods of delivering and/or administering the nucleic acid-lipid particles. The gRNA molecules may be delivered concurrently with or sequentially with a mRNA molecule that encodes the dXR fusion protein, thereby delivering components to utilize the system to treat disease in a human in need of such treatment, for example, a human in need of treatment or prevention of a disorder. In certain embodiments the mRNA that encodes the dXR fusion protein and gRNA may be present in the same nucleic acid-lipid particle, or they may be present in different nucleic acid-lipid particles.

The disclosure also provides a pharmaceutical composition comprising one or more (e.g., a cocktail) of the gRNA targeting different sequences, together with one or more of the dXR described herein, and a pharmaceutically acceptable carrier. With respect to formulations comprising an dXR:gRNA cocktail, the different types of gRNA species present in the cocktail (e.g., gRNA with different targeting sequences) may be co-encapsulated in the same particle, or each type of gRNA species present in the cocktail may be encapsulated in a separate particle. The LNP cocktail may be formulated in the particles described herein using a mixture of two, three or more individual gRNA (each having a unique targeting sequence) at identical, similar, or different concentrations or molar ratios.

In one embodiment, a cocktail of mRNA encoding the fusion protein and two or more gRNA with different targeting sequences to the target nucleic acid is formulated using identical, similar, or different concentrations or molar ratios of each gRNA species, and the different types of gRNA are co-encapsulated in the same particle. In another embodiment, each type of gRNA species present in the cocktail is encapsulated in different particles at identical, similar, or different gRNA concentrations or molar ratios, and the particles thus formed (each containing a different gRNA payload) are administered separately (e.g., at different times in accordance with a therapeutic regimen), or are combined and administered together as a single unit dose (e.g., with a pharmaceutically acceptable carrier). The particles described herein are serum-stable, are resistant to nuclease degradation, and are substantially non-toxic to mammals such as humans.

In certain embodiments, the nucleic acid-lipid particle has an electron dense core.

In some embodiments, the disclosure provides nucleic acid-lipid particles comprising: (a) one or more (e.g., a cocktail) of mRNA encoding the dXR and a gRNA with a targeting sequence to the target nucleic acid described herein; (b) one or more ionizable cationic lipids or salts thereof comprising from about 50 mol % to about 85 mol % of the total lipid present in the particle; (c) one or more non-cationic lipids comprising from about 13 mol % to about 49.5 mol % of the total lipid present in the particle; and (d) one or more conjugated lipids that inhibit aggregation of particles comprising from about 0.5 mol % to about 2 mol % of the total lipid present in the particle.

In one embodiment, the nucleic acid-lipid particle comprises: (a) one or more (e.g., a cocktail) mRNA encoding the dXR and a gRNA with a targeting sequence to the target nucleic acid described herein; (b) a ionizable cationic lipid or a salt thereof comprising from about 52 mol % to about 62 mol % of the total lipid present in the particle; (c) a mixture of a phospholipid and cholesterol or a derivative thereof comprising from about 36 mol % to about 47 mol % of the total lipid present in the particle; and (d) a PEG-lipid conjugate comprising from about 1 mol % to about 2 mol % of the total lipid present in the particle. In one particular embodiment, the formulation is a four-component system comprising about 1.4 mol % PEG-lipid conjugate (e.g., PEG2000-C-DMA), about 57.1 mol % ionizable cationic lipid (e.g., DLin-K-C2-DMA) or a salt thereof, about 7.1 mol % DPPC (or DSPC), and about 34.3 mol % cholesterol (or derivative thereof).

In another embodiment, the nucleic acid-lipid particle comprises: (a) one or more (e.g., a cocktail) mRNA encoding the dXR and a gRNA with a targeting sequence to the target nucleic acid described herein; (b) a ionizable cationic lipid or a salt thereof comprising from about 46.5 mol % to about 66.5 mol % of the total lipid present in the particle; (c) cholesterol or a derivative thereof comprising from about 31.5 mol % to about 42.5 mol % of the total lipid present in the particle; and (d) a PEG-lipid conjugate comprising from about 1 mol % to about 2 mol % of the total lipid present in the particle. In one particular embodiment, the formulation is a three-component system which is phospholipid-free and comprises about 1.5 mol % PEG-lipid conjugate (e.g., PEG2000-C-DMA), about 61.5 mol % ionizable cationic lipid (e.g., DLin-K-C2-DMA) or a salt thereof, and about 36.9 mol % cholesterol (or derivative thereof).

Additional formulations are described in PCT Publication No. WO 09/127060 and published US patent application publication numbers US 2011/0071208 A1 and US 2011/0076335 A1, the disclosures of which are herein incorporated by reference in their entirety.

In other embodiments, the present disclosure provides nucleic acid-lipid particles comprising: (a) one or more (e.g., a cocktail) gRNA molecules described herein; (b) one or more ionizable lipids or salts thereof comprising from about 2 mol % to about 50 mol % of the total lipid present in the particle; (c) one or more non-cationic lipids comprising from about 5 mol % to about 90 mol % of the total lipid present in the particle; and (d) one or more conjugated lipids that inhibit aggregation of particles comprising from about 0.5 mol % to about 20 mol % of the total lipid present in the particle.

In one aspect of this embodiment, the nucleic acid-lipid particle comprises: (a) one or more (e.g., a cocktail) mRNA encoding the dXR and a gRNA with a targeting sequence to the target nucleic acid described herein; (b) a ionizable cationic lipid or a salt thereof comprising from about 30 mol % to about 50 mol % of the total lipid present in the particle; (c) a mixture of a phospholipid and cholesterol or a derivative thereof comprising from about 47 mol % to about 69 mol % of the total lipid present in the particle; and (d) a PEG-lipid conjugate comprising from about 1 mol % to about 3 mol % of the total lipid present in the particle. In one particular embodiment, the formulation is a four-component system which comprises about 2 mol % PEG-lipid conjugate (e.g., PEG2000-C-DMA), about 40 mol % ionizable cationic lipid (e.g., DLin-K-C2-DMA) or a salt thereof, about 10 mol % DPPC (or DSPC), and about 48 mol % cholesterol (or derivative thereof).

In further embodiments, the present disclosure provides nucleic acid-lipid particles comprising: (a) one or more (e.g., a cocktail) mRNA encoding the dXR and a gRNA with a targeting sequence to the target nucleic acid described herein; (b) one or more ionizable cationic lipids or salts thereof comprising from about 50 mol % to about 65 mol % of the total lipid present in the particle; (c) one or more non-cationic lipids comprising from about 25 mol % to about 45 mol % of the total lipid present in the particle; and (d) one or more conjugated lipids that inhibit aggregation of particles comprising from about 5 mol % to about 10 mol % of the total lipid present in the particle.

In another embodiment, the nucleic acid-lipid particle comprises: (a) one or more (e.g., a cocktail) mRNA encoding the dXR and a gRNA with a targeting sequence to the target nucleic acid described herein; (b) a ionizable cationic lipid or a salt thereof comprising from about 50 mol % to about 60 mol % of the total lipid present in the particle; (c) a mixture of a phospholipid and cholesterol or a derivative thereof comprising from about 35 mol % to about 45 mol % of the total lipid present in the particle; and (d) a PEG-lipid conjugate comprising from about 5 mol % to about 10 mol % of the total lipid present in the particle.

In certain embodiments, the non-cationic lipid mixture in the formulation comprises: (i) a phospholipid of from about 5 mol % to about 10 mol % of the total lipid present in the particle; and (ii) cholesterol or a derivative thereof of from about 25 mol % to about 35 mol % of the total lipid present in the particle. In one particular embodiment, the formulation is a four-component system which comprises about 7 mol % PEG-lipid conjugate (e.g., PEG750-C-DMA), about 54 mol % ionizable cationic lipid (e.g., DLin-K-C2-DMA) or a salt thereof, about 7 mol % DPPC (or DSPC), and about 32 mol % cholesterol (or derivative thereof).

In another embodiment, the nucleic acid-lipid particle comprises: (a) one or more (e.g., a cocktail) mRNA encoding the dXR and a gRNA with a targeting sequence to the target nucleic acid described herein; (b) a ionizable cationic lipid or a salt thereof comprising from about 55 mol % to about 65 mol % of the total lipid present in the particle; (c) cholesterol or a derivative thereof comprising from about 30 mol % to about 40 mol % of the total lipid present in the particle; and (d) a PEG-lipid conjugate comprising from about 5 mol % to about 10 mol % of the total lipid present in the particle. In one particular embodiment, the formulation is a three-component system which is phospholipid-free and comprises about 7 mol % PEG-lipid conjugate (e.g., PEG750-C-DMA), about 58 mol % ionizable cationic lipid (e.g., DLin-K-C2-DMA) or a salt thereof, and about 35 mol % cholesterol (or derivative thereof).

In certain embodiments of the disclosure, the nucleic acid-lipid particle comprises: (a) one or more (e.g., a cocktail) mRNA encoding the dXR and a gRNA with a targeting sequence to the target nucleic acid described herein; (b) a ionizable cationic lipid or a salt thereof comprising from about 48 mol % to about 62 mol % of the total lipid present in the particle; (c) a mixture of a phospholipid and cholesterol or a derivative thereof, wherein the phospholipid comprises about 7 mol % to about 17 mol % of the total lipid present in the particle, and wherein the cholesterol or derivative thereof comprises about 25 mol % to about 40 mol % of the total lipid present in the particle; and (d) a PEG-lipid conjugate comprising from about 0.5 mol % to about 3.0 mol % of the total lipid present in the particle.

VIII. Applications

The fusion proteins, gRNA, nucleic acids encoding the fusion proteins and variants thereof provided herein, as well as vectors encoding such components, particle systems for the delivery of the gene repressor systems, or LNP comprising nucleic acids are useful for various applications, including therapeutics, diagnostics, and research.

Provided herein are methods of repression of transcription of a target gene encoded by a target nucleic acid in a cell, comprising contacting the target nucleic acid with a dXR and a gRNA with a targeting sequence that is complementary to the target nucleic acid. In some embodiments of the method, the repressor system is provided to the cells as a dXR:gRNA RNP complex, embodiments of which have been described supra, wherein the contacting results in repression or silencing of transcription. In other embodiments of the method, the repressor system is provided to the cells as a nucleic acid or a vector comprising the nucleic acids encoding the dXR and gRNA, or as a lipid nanoparticle (LNP) comprising mRNA encoding the dXR and gRNA components, wherein the contacting results in repression or silencing of transcription of the target nucleic acid upon expression of the dXR and gRNA and binding of the resulting RNP complex to the target nucleic acid. In some embodiments, the vector is an AAV encoding the dXR and gRNA components. In other embodiments of the method, the vector is a virus-like particle, an XDP comprising multiple dXR:gRNA RNPs, wherein the contacting of the target nucleic acid results in repression or silencing of transcription of the gene proximal to the binding location of the RNP of the target nucleic acid.

In some embodiments of the method of repressing expression of a target nucleic acid in a cell, the repressor system is provided to the cells encapsidated in a population of lipid nanoparticles (LNP), described more fully, above. An LNP represents a particle made from lipids, wherein the nucleic acids of the system are fully encapsulated within the lipid. In certain instances, LNP are extremely useful for systemic applications, as they can exhibit extended circulation lifetimes following intravenous (i.v.) injection, they can accumulate at distal sites within the subject, and when used to encapsidate the dXR:gRNA systems of the embodiments, they can mediate repression or silencing of target gene expression at these distal sites. Preferably, these LNP compositions would encapsulate the nucleic acids of the system with high-efficiency, have high drug:lipid ratios, protect the encapsulated nucleic acid from degradation and clearance in serum, be suitable for systemic delivery, and provide intracellular delivery of the encapsulated nucleic acid. In some embodiments of the method, the repressor system is provided to the cells as a first and a second lipid nanoparticle (LNP) wherein the first LNP encapsidates mRNA encoding the dXR fusion protein of any of the embodiments described herein and the second LNP encapsidates the gRNA of any of the embodiments described herein, wherein the contacting of the cell and uptake of the LNP results in expression of the dXR fusion protein and complexing of the dXR and gRNA as an RNP, wherein upon binding of the resulting RNP complex to the target nucleic acid, repression or silencing of transcription of the target nucleic acid occurs. In other embodiments, the repressor system is provided to the cells as a population of LNPs wherein the LNP encapsidates both the mRNA encoding the dXR fusion protein of any of the embodiments described herein and a gRNA of any of the embodiments described herein, wherein the contacting of the cells and the uptake of the LNP results in expression of the dXR fusion protein and complexing of the RNP repression, wherein upon binding of the resulting RNP complex to the target nucleic acid, repression or silencing of transcription of the target nucleic occurs.

In some embodiments of the method, upon binding of the dXR:gRNA RNP to the target nucleic acid, transcription of the gene in the population of cells is repressed by at least about 10%, at least about 20%, at least about 30%, at least about 40%, at least about 50%, at least about 60%, at least about 70%, at least about 75%, at least about 80%, at least about 85%, at least about 90%, at least about 95%, or at least 99% greater compared to the repression effected by an RNP comprising a comparable guide RNA and a catalytically dead CasX variant without a repressor domain, when assessed in an in vitro assay. In other embodiments, transcription of the gene in the population of cells is repressed by at least about 10% to about 90%, or at least 20% to about 80%, or at least about 30% to about 60% compared to the repression effected by an RNP comprising a comparable guide RNA and a catalytically dead CasX variant without a repressor domain, when assessed in an in vitro assay. In some embodiments of the method, the repression of transcription in the populations of cells is sustained for at least about 8 hours, at least about 1 day, at least about 1 week, at least about 2 weeks, at least about 3 weeks, at least about 1 month, at least about 2 months, or at least about 6 months or longer. Exemplary assays to measure repression are described herein, including the Examples, below.

In some cases, off-target methylation or off-target transcription repression by the dXR:gRNA RNP is less than about 10%, less than about 9%, less than about 8%, less than about 7%, less than about 6%, less than about 5%, less than about 4%, less than about 3%, less than about 2%, or less than about 1% in the cells genome-wide.

In some embodiments of the method of repressing a target nucleic acid in a cell, the gRNA scaffold utilized in the dXR:gRNA systems of the disclosure is selected from the group of sequences consisting of SEQ ID NOS: 2238-2331, 57544-57589, and 59352, set forth in Table 2, or a sequence having at least about 80%, at least about 90%, at least about 95%, at least about 95%, at least about 96%, at least about 97%, at least about 98%, at least about 99% sequence identity thereto, and the gRNA further comprises a targeting sequence that is complementary to the target nucleic acid to be repressed. In some embodiments of the method, the gRNA scaffold utilized in the dXR:gRNA systems of the disclosure comprises one or more chemical modifications. In some embodiments of the method, the dCasX variant is a sequence of SEQ ID NOS: 17-36 and 59353-59358 as set forth in Table 4, or a sequence having at least about 80%, at least about 90%, at least about 95%, at least about 95%, at least about 96%, at least about 97%, at least about 98%, at least about 99% sequence identity thereto, and is linked to a first repressor domain, a first and a second repressor domain, a first, second and third repressor domain, or a first, second, third, and fourth repressor domains. In some embodiments of the method, the first domain linked to the dCasX as a fusion protein (or encoded to be expressed as a fusion protein) is a KRAB domain of any of the embodiments described herein. In some embodiments of the method, the first domain linked to the dCasX as a fusion protein is a KRAB domain sequence and the second repressor domain is a DNMT3A catalytic domain sequence. In some embodiments of the method, the first domain linked to the dCasX as a fusion protein is a KRAB domain sequence, the second repressor domain is a DNMT3A catalytic domain sequence, and the third repressor is a DNMT3L interaction domain sequence. In some embodiments of the method, the first domain linked to the dCasX as a fusion protein is a KRAB domain sequence, the second repressor domain is a DNMT3A catalytic domain sequence, the third repressor is a DNMT3L interaction domain sequence, and the fourth domain in a DNMT3A ADD domain. In some embodiments of the foregoing, KRAB domain is selected from the group consisting of SEQ ID NOS: 889-2100 and 2332-33239, or a sequence having at least about 80%, at least about 90%, at least about 95%, at least about 95%, at least about 96%, at least about 97%, at least about 98%, at least about 99% sequence identity thereto. In some embodiments of the method of repressing a target nucleic acid in a cell, the KRAB domain comprises one or more motifs selected from the group consisting of a) $PX_1X_2X_3X_4X_5X_6EX_7$, wherein $X_1$ is A, D, E, or N, $X_2$ is L or V, $X_3$ is I or V, $X_4$ is S, T, or F, $X_5$ is H, K, L, Q, R or W, $X_6$ is L or M, and $X_7$ is G, K, Q, or R; b) $X_1X_2X_3X_4GX_5X_6X_7X_8X_9$, wherein $X_1$ is L or V, $X_2$ is A, G, L, T or V, $X_3$ is A, F, or S, $X_4$ is L or V, $X_5$ is C, F, H, I, L or Y, $X_6$ is A, C, P, Q, or S, $X_7$ is A, F, G, I, S, or V, $X_8$ is A, P, S, or T, and $X_9$ is K or R; c) $QX_1X_2LYRX_3VMX_4$ (SEQ ID NO: 59345), wherein $X_1$ is K or R, $X_2$ is A, D, E, G, N, S, or T, $X_3$ is D, E, or S, and $X_4$ is L or R; d) $X_1X_2X_3FX_4DVX_5X_6X_7FX_8X_9X_{10}X_{11}$ (SEQ ID NO: 59346), wherein $X_1$ is A, L, P, or S, $X_2$ is L or V, $X_3$ is S or T, $X_4$ is A, E, G, K, or R, $X_5$ is A or T, $X_6$ is I or V, $X_7$ is D, E, N, or Y, $X_8$ is S or T, $X_9$ is E, P, Q, R, or W, $X_{10}$ is E or N, and $X_{11}$ is E or Q; e) $X_1X_2X_3PX_4X_5X_6X_7X_8X_9X_{10}$, wherein $X_1$ is E, G, or R, $X_2$ is E or K, $X_3$ is A, D, or E, $X_4$ is C or W, $X_5$ is I, K, L, M, T, or V, $X_6$ is I, L, P, or V, $X_7$ is D, E, K, or V, $X_8$ is E, G, K, P, or R, $X_9$ is A, D, R, G, K, Q, or V, and $X_{10}$ is D, E, G, I, L, R, S, or V; f) $LYX_1X_2VMX_3EX_4X_5X_6X_7X_8X_9X_{10}$ (SEQ ID NO: 59348), wherein $X_1$ is K or R, $X_2$ is D or E, $X_3$ is L, Q, or R, $X_4$ is N or T, $X_5$ is F or Y, $X_6$ is A, E, G, Q, R, or S, $X_7$ is H, L, or N, $X_8$ is L or V, $X_9$ is A, G, I, L, T, or V, and $X_{10}$ is A, F, or S; g) $FX_1DVX_2X_3X_4FX_5X_6X_7EWX_8$ (SEQ ID NO: 59349), wherein $X_1$ is A, E, G, K, or R, $X_2$ is A, S, or T, $X_3$ is I or V, $X_4$ is D, E, N, or Y, $X_5$ is S or T, $X_6$ is E, L, P, Q, R, or W, $X_7$ is D or E, and $X_8$ is A, E, G, Q, or R; h) $X_1PX_2X_3X_4X_5$ $X_6LEX_7X_8X_9X_{10}X_{11}X_{12}$, wherein $X_1$ is K or R, $X_2$ is A, D, E, or N, $X_3$ is I, L, M, or V, $X_4$ is I or V, $X_5$ is F, S, or T, $X_6$ is H, K, L, Q, R, or W, $X_7$ is K, Q, or R, $X_8$ is E, G, or R, $X_9$ is D, E, or K, $X_{10}$ is A, D, or E, $X_{11}$ is L or P, and $X_{12}$ is C or W; or i) $X_1LX_2X_3X_4QX_5X_6$, wherein $X_1$ is C, H, L, Q, or W, $X_2$ is D, G, N, R, or S, $X_3$ is L, P, S, or T, $X_4$ is A, S, or T, $X_5$ is K or R, and $X_6$ is A, D, E, K, N, S, or T, and the KRAB domain comprises a sequence selected from the group consisting of SEQ ID NOS: 57746-59342, or a sequence having at least about 70%, at least about 80%, at least about 85%, at least about 90% at least about 91%, at least about 92%, at least about 93% at least about 94% at least about 95%, at least about 96%, at least about 97%, at least about 98%, or at least about 99% identity thereto. In some embodiments of the method, the DNMT3A catalytic domain comprises a sequence selected from the group consisting of SEQ ID NOS: 33625-57543 and 59450, or a sequence having at least about 70%, at least about 80%, at least about 85%, at least about 90% at least about 91%, at least about 92%, at least about 93% at least about 94% at least about 95%, at least about 96%, at least about 97%, at least about 98%, or at least about 99% identity thereto. In some embodiments of the method, the DNMT3L interaction domain comprises a sequence of SEQ ID NO: 59625, or a sequence having at least about 70%, at least about 80%, at least about 85%, at least about 90% at least about 91%, at least about 92%, at least about 93% at least about 94% at least about 95%, at least about 96%, at least about 97%, at least about 98%, or at least about 99% identity thereto. In some embodiments of the method, the DNMT3A ADD domain comprises a sequence of SEQ ID NO: 59452, or a sequence having at least about 70%, at least about 80%, at least about 85%, at least about 90% at least about 91%, at least about 92%, at least about 93% at least about 94% at least about 95%, at least about 96%, at least about 97%, at least about 98%, or at least about 99% identity thereto.

In some embodiments of the method of repressing a target nucleic acid in a cell, the method further comprises inclusion of a second gRNA, or a nucleic acid encoding the second gNA, wherein the second gNA has a targeting sequence complementary to a different portion of the target nucleic acid sequence and is capable of forming a ribonuclear protein complex (RNP) with the dXR fusion protein.

In some embodiments of the method of repressing a target nucleic acid in a cell, the repression occurs in vitro, outside of a cell, in a cell-free system. In some embodiments, the repression occurs in vitro, inside of a cell, for example in a cell culture system. In some embodiments, the repression occurs in vivo inside of a cell, for example in a cell in an organism. In some embodiments, the cell is a eukaryotic cell. Exemplary eukaryotic cells may include a mammalian cell, a rodent cell, a mouse cell, a rat cell, a pig cell, a dog cell, a primate cell, and a non-human primate cell. In some embodiments, the cell is a human cell. In some embodiments, the cell is an embryonic stem cell, an induced pluripotent stem cell, a germ cell, a fibroblast, an oligodendrocyte, a glial cell, a hematopoietic stem cell, a neuron progenitor cell, a neuron, an astrocyte, a muscle cell, a bone cell, a hepatocyte, a pancreatic cell, a retinal cell, a cancer cell, a T-cell, a B-cell, an NK cell, a fetal cardiomyocyte, a myofibroblast, a mesenchymal stem cell, an autotransplanted expanded cardiomyocyte, an adipocyte, a totipotent cell, a pluripotent cell, a blood stem cell, a myoblast, a bone marrow cell, a mesenchymal cell, a parenchymal cell, an epithelial cell, an endothelial cell, a mesothelial cell, fibroblasts, osteoblasts, chondrocytes, a hematopoietic stem cell, a bone-marrow derived progenitor cell, a myocardial cell, a skeletal cell, a fetal cell, an undifferentiated cell, a multipotent progenitor cell, a unipotent progenitor cell, a monocyte, a cardiac myoblast, a skeletal myoblast, a macrophage, a capillary endothelial cell, a xenogeneic cell, an allogenic cell, or a post-natal stem cell. The cell can be in a subject. In some embodiments, repression occurs in the subject having a mutation in an allele of a gene wherein the mutation causes a disease or disorder in the subject. In some embodiments, repression reduces or silence transcription of an allele of a gene causing a disease or disorder in the subject, wherein the subject is selected from the group consisting of mouse, rat, pig, non-human primate, and human. In some embodiments, repression occurs in vitro inside of the cell prior to introducing the cell into a subject. In some embodiments, the cell is autologous or allogeneic with respect to the subject.

Methods of introducing a nucleic acid (e.g., nucleic acids encoding a dXR:gRNA system, or variants thereof as described herein) into a cell in vitro are known in the art, and any convenient method can be used to introduce a nucleic acid into a cell. Suitable methods include viral infection, transfection, lipofection, electroporation, calcium phosphate precipitation, polyethyleneimine (PEI)-mediated transfection, DEAE-dextran mediated transfection, liposome-mediated transfection, particle gun technology, nucleofection, electroporation, LNP transfection, direct addition by cell penetrating dXR proteins that are fused to or recruit donor DNA, cell squeezing, calcium phosphate precipitation, direct microinjection, nanoparticle-mediated nucleic acid delivery, and the like. Nucleic acids may be provided to the cells using well-developed transfection techniques, and the commercially available TransMessenger® reagents from Qiagen, Stemfect™ RNA Transfection Kit from Stemgent, and TransIT®-mRNA Transfection Kit from Mirus Bio LLC, Lonza nucleofection, Maxagen electroporation and the like. In some embodiments, vectors may be provided directly to a target host cell such that the vectors are taken up by the cells. Introducing recombinant expression vectors into cells can occur in any suitable culture media and under any suitable culture conditions that promote the survival of the cells.

A dXR protein or an mRNA encoding the dXR of the disclosure may be prepared by in vitro synthesis, using conventional methods as known in the art. Various commercial synthetic apparatuses are available, for example, automated synthesizers by Applied Biosystems, Inc., Beckman, etc. By using synthesizers, naturally occurring amino acids or nucleotides (as applicable) may be substituted with unnatural amino acids or nucleotides. The particular sequence and the manner of preparation will be determined by convenience, economics, purity required, and the like.

The dXR fusion protein may also be prepared by recombinantly producing a polynucleotide sequence coding for the dXR of any of the embodiments described herein and incorporating the encoding gene into an expression vector appropriate for a host cell. For production of the encoded dXR of any of the embodiments described herein, the methods include transforming an appropriate host cell with an expression vector comprising the encoding polynucleotide, and culturing the host cell under conditions causing or permitting the resulting dXR of any of the embodiments described herein to be expressed or transcribed in the transformed host cell, thereby producing the dXR, which are recovered by methods described herein or by standard purification methods known in the art or as described in the Examples. Standard recombinant techniques in molecular biology are used to make the polynucleotides and expression vectors of the present disclosure.

A dXR protein of the disclosure may also be isolated and purified in accordance with conventional methods of recombinant synthesis. A lysate may be prepared of the expression host and the lysate purified using high performance liquid chromatography (HPLC), exclusion chromatography, gel electrophoresis, affinity chromatography, or other purification technique. For the most part, the compositions which are used will comprise 50% or more by weight of the desired product, more usually 75% or more by weight, preferably 95% or more by weight, and for therapeutic purposes, usually 99.5% or more by weight, in relation to contaminants related to the method of preparation of the product and its purification. Usually, the percentages will be based upon total protein. Thus, in some cases, a dXR polypeptide, or a dXR fusion polypeptide, of the present disclosure is at least 80% pure, at least 85% pure, at least 90% pure, at least 95% pure, at least 98% pure, or at least 99% pure (e.g., free of contaminants, non-dXR proteins or other macromolecules, etc.).

In some embodiments, to induce repression of transcription of a target nucleic acid (e.g., genomic DNA) in an in vitro cell, the dXR and gRNA of the present disclosure, whether they be introduced as nucleic acids (including encapsidated within an LNP or within an AAV) or an RNP, are provided to the cells for about 30 minutes to about 24 hours, e.g., 1 hour, 1.5 hours, 2 hours, 2.5 hours, 3 hours, 3.5 hours 4 hours, 5 hours, 6 hours, 7 hours, 8 hours, 12 hours, 16 hours, 18 hours, 20 hours, or any other period from about 30 minutes to about 24 hours, which may be repeated with a frequency of about every day to about every 7 days, e.g., every 1.5 days, every 2 days, every 3 days, or any other frequency from about every day to about every 7 days. In some embodiments, to induce repression of transcription of a target nucleic acid in a subject, the dXR and gRNA of the present disclosure may be provided to the subject cells one or more times; e.g., one time, twice, three times, or more than three times, and the cells allowed to incubate with the agent(s) for some amount of time following each contacting event; e.g., 16-24 hours, after which time the media is replaced with fresh media and the cells are cultured further.

In some embodiments, the present disclosure provides a method of treating a subject with a disorder caused by a genetic mutation, comprising administering a therapeutically-effective dose of: (i) an AAV vector encoding the dXR:gRNA systems of any of the embodiments described herein, (ii) an XDP comprising RNP of the dXR:gRNA systems of any of the embodiments described herein, (iii) LNP comprising gRNA and mRNA encoding the dXR (which may be a single LNP, or are formulated as a first and second LNP encapsidating the mRNA encoding the dXR fusion protein and gRNA, respectively), or (iv) combinations of (i)-(iii), wherein upon binding of the RNP of the gene repressor system to the target nucleic acid of a gene in cells of the subject represses transcription of the gene proximal to the binding location of the RNP. In some embodiments, the gRNA target nucleic acid sequence complementary to the targeting sequence is within 1 kb of a transcription start site (TSS) in the gene, wherein upon binding of the RNP transcription is repressed. In some embodiments, the gRNA target nucleic acid sequence complementary to the targeting sequence is within 500 bps upstream to 500 bps downstream of a TSS of the gene, wherein upon binding of the RNP transcription is repressed.

In some embodiments, the gRNA target nucleic acid sequence complementary to the targeting sequence is within 300 bps upstream to 300 bps downstream of a TSS of the gene, wherein upon binding of the RNP transcription is repressed. In some embodiments, the gRNA target nucleic acid sequence complementary to the targeting sequence is within 1 kb of an enhancer of the gene, wherein upon binding of the RNP transcription is repressed. In some embodiments, the gRNA target nucleic acid sequence complementary to the targeting sequence is within the 3' untranslated region of the gene, wherein upon binding of the RNP transcription is repressed. In some embodiments, the gRNA target nucleic acid sequence complementary to the targeting sequence is within an exon of the gene, wherein upon binding of the RNP transcription is repressed. In some embodiments, the gRNA target nucleic acid sequence complementary to the targeting sequence is within exon 1 of the gene, wherein upon binding of the RNP transcription is repressed.

In some embodiments of the methods of treating a subject with a therapeutically-effective dose of the dXR:gRNA systems, transcription of the targeted gene in the cells of the subject is repressed by at least about 10%, at least about 20%, at least about 30%, at least about 40%, at least about 50%, at least about 60%, at least about 70%, at least about 75%, at least about 80%, at least about 85%, at least about 90%, at least about 95%, or at least 99%. In some embodiments of the methods of treating a subject with the dXR:gRNA systems with a therapeutically-effective dose of the foregoing dXR systems, the repression of transcription of the gene in the targeted cells of the subject is sustained for at least about 8 hours, at least about 1 day, at least about 7 days, at least about 2 weeks, at least about 3 weeks, at least about 1 month, at least about 2 months, or at least about 6 months or longer.

In some embodiments, the present disclosure provides a method of treating a subject with a disorder caused by a genetic mutation, comprising administering a therapeutically-effective amount of an AAV vector of any of the embodiments described herein, wherein upon the contacting of the targeted cell, the dXR:gRNA is expressed and complexes as an RNP, and upon binding of the RNP to the target nucleic acid in cells of the subject, transcription of the gene proximal to the binding location of the RNP is repressed wherein the treatment results in improvement in at least one clinically-relevant endpoint associated with the disorder. In some embodiments of the method, the AAV vector is administered at a dose of at least about $1\times10^{5}$ viral genomes (vg)/kg, at least about $1\times10^{6}$ vg/kg, at least about $1\times10^{7}$ vg/kg, at least about $1\times10^{8}$ vg/kg, at least about $1\times10^{9}$ vg/kg, at least about $1\times10^{10}$ vg/kg, at least about $1\times10^{11}$ vg/kg, at least about $1\times10^{12}$ vg/kg, at least about $1\times10^{13}$ vg/kg, at least about $1\times10^{14}$ vg/kg, at least about $1\times10^{15}$ vg/kg, at least about $1\times10^{6}$ vg/kg. In other embodiments, the AAV vector is administered to the subject at a dose of at least about $1\times10^{5}$ vg/kg to about $1\times10^{16}$ vg/kg, at least about $1\times10^{6}$ vg/kg to about $1\times10^{15}$ vg/kg, or at least about $1\times10^{7}$ vg/kg to about $1\times10^{14}$ vg/kg. In one embodiment of the foregoing, transcription of the gene in the targeted cells is repressed by at least about 10%, at least about 20%, at least about 30%, at least about 40%, at least about 50%, at least about 60%, at least about 70%, at least about 75%, at least about 80%, at least about 85%, at least about 90%, at least about 95%, or at least 99%. In another embodiment of the foregoing, transcription of the gene in the cells is repressed by at least about 10% to about 99%, or at least 20% to about 90%, at least about 30% to about 80%, or at least about 40% to about 60%.

In some embodiments, the present disclosure provides a method of treating a subject with a disorder caused by a genetic mutation, comprising administering a therapeutically-effective amount of an XDP of any of the embodiments described herein, wherein upon the contacting of the targeted cell and the binding of the RNP of the XDP to the target nucleic acid in cells of the subject, transcription of the gene proximal to the binding location of the RNP is repressed wherein the treatment results in improvement in at least one clinically-relevant endpoint associated with the disorder. In some embodiments of the method, the XDP is administered at a dose of at least about $1\times10^{5}$ particles/kg, at least about $1\times10^{6}$ particles/kg, at least about $1\times10^{7}$ particles/kg, at least about $1\times10^{8}$ particles/kg, at least about $1\times10^{9}$ particles/kg, at least about $1\times10^{10}$ particles/kg, at least about $1\times10^{11}$ particles/kg, at least about $1\times10^{12}$ particles/kg, at least about $1\times10^{13}$ particles/kg, at least about $1\times10^{14}$ particles/kg, at least about $1\times10^{15}$ particles/kg, at least about $1\times10^{6}$ particles/kg. In other embodiments, the XDP is administered to the subject at a dose of at least about $1\times10^{5}$ particles/kg to about $1\times10^{16}$ particles/kg, or at least about $1\times10^{6}$ particles/kg to about $1\times10^{15}$ particles/kg, or at least about $1\times10^{7}$ particles/kg to about $1\times10^{14}$ particles/kg. In one embodiment of the foregoing, transcription of the gene in the targeted cells is repressed by at least about 10%, at least about 20%, at least about 30%, at least about 40%, at least about 50%, at least about 60%, at least about 70%, at least about 75%, at least about 80%, at least about 85%, at least about 90%, at least about 95%, or at least 99%. In another embodiment of the foregoing, transcription of the gene in the cells is repressed by at least about 10% to about 99%, or at least 20% to about 90%, at least about 30% to about 80%, or at least about 40% to about 60%.

In some embodiments, the present disclosure provides a method of treating a subject with a disorder caused by a genetic mutation, comprising administering a therapeutically-effective amount of an LNP comprising mRNA encoding the dXR fusion protein and a gRNA (which may be a single LNP, or are formulated as a first and second LNP encapsidating the mRNA encoding the dXR fusion protein and gRNA, respectively), of any of the embodiments described herein, wherein upon the contacting of the targeted cell the dXR fusion protein is expressed and complexed with the gRNA to form an RNP, and upon the binding of the RNP to the target nucleic acid in cells of the subject, transcription of the gene proximal to the binding location of the RNP is repressed wherein the treatment results in improvement in at least one clinically-relevant endpoint associated with the disorder. In some embodiments of the method, the LNP are administered at a dose of at least about $1\times10^{5}$ particles/kg, at least about $1\times10^{6}$ particles/kg, at least about $1\times10^{7}$ particles/kg, at least about $1\times10^{8}$ particles/kg, at least about $1\times10^{9}$ particles/kg, at least about $1\times10^{10}$ particles/kg, at least about $1\times10^{11}$ particles/kg, at least about $1\times10^{12}$ particles/kg, at least about $1\times10^{13}$ particles/kg, at least about $1\times10^{14}$ particles/kg, at least about $1\times10^{15}$ particles/kg, at least about $1\times10^{6}$ particles/kg. In other embodiments, the LNP are administered to the subject at a dose of at least about $1\times10^{5}$ particles/kg to about $1\times10^{16}$ particles/kg, or at least about $1\times10^{6}$ particles/kg to about $1\times10^{15}$ particles/kg, or at least about $1\times10^{7}$ particles/kg to about $1\times10^{14}$ particles/kg. In one embodiment of the foregoing, transcription of the gene in the targeted cells is repressed by at least about 10%, at least about 20%, at least about 30%, at least about 40%, at least about 50%, at least about 60%, at least about 70%, at least about 75%, at least about 80%, at least about 85%, at least about 90%, at least about 95%, or at least 99%. In another embodiment of the foregoing, transcription of the gene in the cells is repressed by at least about 10% to about 99%, or at least 20% to about 90%, at least about 30% to about 80%, or at least about 40% to about 60%.

In the embodiments of the method of treatment, the AAV vector, the XDP, or the LNP is administered to the subject by a route of administration selected from subcutaneous, intradermal, intraneural, intranodal, intramedullary, intramuscular, intralumbar, intrathecal, subarachnoid, intraventricular, intracapsular, intravenous, intralymphatical, or intraperitoneal routes, wherein the administering method is injection, transfusion, or implantation, or combinations thereof. In some embodiments, the subject is selected from the group consisting of mouse, rat, pig, non-human primate, and human.

A number of therapeutic strategies have been used to design the compositions for use in the methods of treatment of a subject with a disease. In some embodiments, the invention provides a method of treatment of a subject having a disease, the method comprising administering to the subject a dXR:gRNA composition, an AAV vector, an XDP, of an LNP of any of the embodiments disclosed herein according to a treatment regimen comprising one or more consecutive doses using a therapeutically effective dose. In some embodiments of the treatment regimen, the therapeutically effective dose of the composition or vector is administered as a single dose. In other embodiments of the treatment regimen, the therapeutically effective dose is administered to the subject as two or more doses over a period of at least two weeks, or at least one month, or at least two months, or at least three months, or at least four months, or at least five months, or at least six months. In some embodiments of the treatment regimen, the effective doses are administered by a route selected from the group consisting of subcutaneous, intradermal, intraneural, intranodal, intramedullary, intramuscular, intralumbar, intrathecal, subarachnoid, intraventricular, intracapsular, intravenous, intralymphatical, intravitreal, subretinal, or intraperitoneal routes, wherein the administering method is injection, transfusion, or implantation. In some embodiments of the treatment regimen, the subject is selected from the group consisting of mouse, rat, pig, non-human primate, and human.

In some embodiments, the administering of the therapeutically effective amount of a dXR:gRNA modality, including a vector or an LNP comprising a polynucleotide encoding a dXR protein and a guide ribonucleic acid composition disclosed herein, to repress expression of a gene product to a subject with a disease leads to the prevention or amelioration of the underlying disease such that an improvement is observed in at least one clinically-relevant endpoint associated with the disease, notwithstanding that the subject may still be afflicted with the underlying disease. In some embodiments, the administration of the therapeutically effective amount of the dXR:gRNA modality leads to an improvement in at least two clinically-relevant parameters associated with the disease.

In embodiments in which two or more different targeting complexes are provided to the cell (e.g., two dXR:gRNA comprising two or more different targeting sequences that are complementary to different sequences within the same or different target nucleic acid), the complexes may be provided simultaneously or they may be provided consecutively; e.g. the first dXR:gRNA targeted complex being provided first, followed by the second targeted complex.

To improve the delivery of a DNA vector into a target cell, the DNA can be protected from damage and its entry into the cell facilitated, for example, by using lipoplexes and polyplexes. Thus, in some cases, a nucleic acid of the present disclosure (e.g., a recombinant expression vector of the present disclosure) can be covered with lipids in an organized structure like a micelle, a liposome, or a lipid nanoparticle, embodiments of which have been described more fully, above. There are four types of lipids, anionic (negatively-charged), neutral, cationic (positively-charged), or ionizable cationic employed in LNP. Cationic lipids (or ionizable lipids at the appropriate pH) of LNP, due to their positive charge, naturally complex with the negatively charged DNA. Also, as a result of their charge, they interact with the cell membrane. Endocytosis of the LNP then occurs, and the DNA is released into the cytoplasm. The cationic lipids also protect against degradation of the DNA by the cell.

In another aspect, the present disclosure provides compositions of gene repressor systems of any of the embodiments described herein for use as a medicament in the treatment of a disease in a subject. In some embodiments, the subject the subject is selected from the group consisting of mouse, rat, pig, non-human primate, and human.

IX. Kits and Articles of Manufacture

In another aspect, provided herein are kits comprising a fusion protein and one or a plurality of gRNA of any of the embodiments of the disclosure formulated in a pharmaceutically acceptable excipient and contained in a suitable container (for example a tube, vial or plate). In some embodiments, the kit comprises a gRNA variant of the disclosure. Exemplary gRNA variants that can be included comprise a sequence of any one of SEQ ID NOS: 2238-2331, 57544-57589, and 59352, or a sequence of Table 2, together with a targeting sequence appropriate for the gene to be repressed linked to the 3' end of the scaffold. In some embodiments, the kit comprises a dCasX variant protein of the disclosure (e.g., a sequence of SEQ ID NOS: 17-36 and 59353-59358 as set forth in Table 4) linked to one or more repressor domains of the embodiments described herein; e.g, DNMT3A catalytic domain, DNMT3L interaction domain, and DNMT3A ADD domain.

In some embodiments, the kit comprises a vector encoding a dXR:gRNA of any of the embodiments described herein, formulated in a pharmaceutically acceptable excipient and contained in a suitable container.

In certain embodiments, provided herein are kits comprising an LNP comprising an mRNA encoding a dXR as described herein, formulated in a pharmaceutically acceptable excipient and contained in a suitable container.

In some embodiments, the kit further comprises a buffer, a nuclease inhibitor, a protease inhibitor, a liposome, a therapeutic agent, a label, instructions for use, a label visualization reagent, or any combination of the foregoing.

The present description sets forth numerous exemplary configurations, methods, parameters, and the like. It should be recognized, however, that such description is not intended as a limitation on the scope of the present disclosure, but is instead provided as a description of exemplary embodiments. Embodiments of the present subject matter described above may be beneficial alone or in combination, with one or more other aspects or embodiments. Without limiting the foregoing description, certain non-limiting embodiments of the disclosure are provided below. As will be apparent to those of skill in the art upon reading this disclosure, each of the individually numbered embodiments may be used or combined with any of the preceding or following individually numbered embodiments. This is intended to provide support for all such combinations of embodiments and is not limited to combinations of embodiments explicitly provided below:

The following Examples are merely illustrative and are not meant to limit any aspects of the present disclosure in any way.

ENUMERATED EMBODIMENTS

The disclosure can be understood with respect to the following illustrated, enumerated embodiments:

SET 1.

1. A gene repressor system comprising:

(a) a catalytically-dead Class 2, Type V CRISPR protein;

(b) one or more transcription repressor domains; and (c) a guide ribonucleic acid (gRNA)

wherein:

i) the one or more transcription repressor domains are linked to the catalytically-dead Class 2, Type V CRISPR protein as a fusion protein;

ii) the gRNA comprises a targeting sequence complementary to a target nucleic acid sequence of a gene; and iii) the fusion protein is capable of forming a ribonuclear protein complex (RNP) with the gRNA.

2. The gene repressor system of embodiment 1, wherein the gene encodes mRNA, rRNA, tRNA, structural RNA, or protein.

3. The gene repressor system of embodiment 1, wherein the one or more transcription repressor domains are selected from the group consisting of Krüppel-associated box (KRAB), methyl-CpG (mCpG) binding domain 2 (MeCP2), DNMT3A, DNMT3L, FOG, EZH2, SID4X, SID, NcoR, NuE, methyl-CpG (mCpG) binding domain 2 (meCP2), Switch independent 3 transcription regulator family member A (SIN3A), histone deacetylase HDT1 (HDT1), n-terminal truncation of methyl-CpG-binding domain containing protein 2 (MBD2B), nuclear inhibitor of protein phosphatase-1 (NIPP1), and heterochromatin protein 1 (HP1A).

4. The gene repressor system of embodiment 3, wherein the KRAB transcriptional repressor domain is selected from the group consisting of ZNF343, ZNF337, ZNF334, ZNF215, ZNF519, ZNF485, ZNF214, ZNF33B, ZNF287, ZNF705A, ZNF37A, KRBOX4, ZKSCAN3, ZKSCAN4, ZNF57, ZNF557, ZNF705B, ZNF662, ZNF77, ZNF500, ZNF558, ZNF620, ZNF713, ZNF823, ZNF440, ZNF441, ZNF136, SNRPB, ZNF735, ZKSCAN2, ZNF619, ZNF627, ZNF333, ABCA11P, PLD5P1, ZNF25, ZNF727, ZNF595, ZNF14, ZNF33A, ZNF101, ZNF253, ZNF56, ZNF720, ZNF85, ZNF66, ZNF722P, ZNF486, ZNF682, ZNF626, ZNF100, ZNF93, ZKSCAN1, ZNF257, ZNF729, ZNF208, ZNF90, ZNF430, ZNF676, ZNF91, ZNF429, ZNF675, ZNF681, ZNF99, ZNF431, ZNF98, ZNF708, ZNF732, SSX2, ZNF721, ZNF726, ZNF730, ZNF506, ZNF728, ZNF141, ZNF723, ZNF302, ZNF484, LINC00960, SSX2B, ZNF718, ZNF74, ZNF157, ZNF790, ZNF565, ZNF705G, VN1R107P, SLC27A5, ZNF737, SSX4, ZNF850, ZNF717, ZNF155, ZNF283, ZNF404, ZNF114, ZNF716, ZNF230, ZNF45, ZNF222, ZNF286A, ZNF624, ZNF223, ZNF284, ZNF790-AS1, ZNF382, ZNF749, ZNF615, ZFP90, ZNF225, ZNF234, ZNF568, ZNF614, ZNF584, ZNF432, ZNF461, ZNF182, ZNF630, ZNF630-AS1, ZNF132, ZNF420, ZNF324B, ZNF616, ZNF471, ZNF227, ZNF324, ZNF860, ZFP28, ZNF470, ZNF586, ZNF235, ZNF274, ZNF446, ZFP1, ZIM3, ZNF212, ZNF766, ZNF264, ZNF480, ZNF667, ZNF805, ZNF610, ZNF783, ZNF621, ZNF8-DT, ZNF880, ZNF213-AS1, ZNF213, ZNF263, ZSCAN32, ZIM2, ZNF597, ZNF786, KRBA1, ZNF460, ZNF8, ZNF875, ZNF543, ZNF133, ZNF229, ZNF528, SSX1, ZNF81, ZNF578, ZNF862, ZNF777, ZNF425, ZNF548, ZNF746, ZNF282, ZNF398, ZNF599, ZNF251, ZNF195, ZNF181, RBAK-RBAKDN, ZFP37, RN7SL526P, ZNF879, ZNF26, ZSCAN21, ZNF3, ZNF354C, ZNF10, ZNF75D, ZNF426, ZNF561, ZNF562, ZNF846, ZNF782, ZNF552, ZNF587B, ZNF814, ZNF587, ZNF92, ZNF417, ZNF256, ZNF473, ZFP14, ZFP82, ZNF529, ZNF605, ZFP57, ZNF724, ZNF43, ZNF354A, ZNF547, SSX4B, ZNF585A, ZNF585B, ZNF792, ZNF789, ZNF394, ZNF655, ZFP92, ZNF41, ZNF674, ZNF546, ZNF780B, ZNF699, ZNF177, ZNF560, ZNF583, ZNF707, ZNF808, ZKSCAN5, ZNF137P, ZNF611, ZNF600, ZNF28, ZNF773, ZNF549, ZNF550, ZNF416, ZIK1, ZNF211, ZNF527, ZNF569, ZNF793, ZNF571-AS1, ZNF540, ZNF571, ZNF607, ZNF75A, ZNF205, ZNF175, ZNF268, ZNF354B, ZNF135, ZNF221, ZNF285, ZNF419, ZNF30, ZNF304, ZNF254, ZNF701, ZNF418, ZNF71, ZNF570, ZNF705E, KRBOX1, ZNF510, ZNF778, PRDM9, ZNF248, ZNF845, ZNF525, ZNF765, ZNF813, ZNF747, ZNF764, ZNF785, ZNF689, ZNF311, ZNF169, ZNF483, ZNF493, ZNF189, ZNF658, ZNF564, ZNF490, ZNF791, ZNF678, ZNF454, ZNF34, ZNF7, ZNF250, ZNF705D, ZNF641, ZNF2, ZNF554, ZNF555, ZNF556, ZNF596, ZNF517, ZNF331, ZNF18, ZNF829, ZNF772, ZNF17, ZNF112, ZNF514, ZNF688, PRDM7, ZNF695, ZNF670-ZNF695, ZNF138, ZNF670, ZNF19, ZNF316, ZNF12, ZNF202, RBAK, ZNF83, ZNF468, ZNF479, ZNF679, ZNF736, ZNF680, ZNF273, ZNF107, ZNF267, ZKSCAN8, ZNF84, ZNF573, ZNF23, ZNF559, ZNF44, ZNF563, ZNF442, ZNF799, ZNF443, ZNF709, ZNF566, ZNF69, ZNF700, ZNF763, ZNF433-AS1, ZNF433, ZNF878, ZNF844, ZNF788P, ZNF20, ZNF625-ZNF20, ZNF625, ZNF606, ZNF530, ZNF577, ZNF649, ZNF613, ZNF350, ZNF317, ZNF300, ZNF180, ZNF415, VN1R1, ZNF266, ZNF738, ZNF445, ZNF852, ZKSCAN7, ZNF660, MPRIPP1, ZNF197, ZNF567, ZNF582, ZNF439, ZFP30, ZNF559-ZNF177, ZNF226, ZNF841, ZNF544, ZNF233, ZNF534, ZNF836, ZNF320, KRBA2, ZNF761, ZNF383, ZNF224, ZNF551, ZNF154, ZNF671, ZNF776, ZNF780A, ZNF888, ZNF816-ZNF321P, ZNF321P, ZNF816, ZNF347, ZNF665, ZNF677, ZNF160, ZNF184, ZNF140, ZNF589, ZNF891, ZFP69B, ZNF436, POGK, ZNF669, ZFP69, ZNF684, ZNF124, and ZNF496.

5. The gene repressor system of embodiment 1, wherein the one or more transcription repressor domains are selected from the group of sequences consisting of SEQ ID NOS: 889-2100 and 2332-33239, or a sequence having at least about 85%, at least about 90%, at least about 91%, at least about 92%, at least about 93% at least about 94% at least about 95%, at least about 96%, at least about 97%, at least about 98%, or at least about 99% identity thereto.

6. The gene repressor system of embodiment 1, wherein the one or more transcription repressor domains are selected from the group of sequences consisting of SEQ ID NOS: 889-2100 and 2332-33239.

7. The gene repressor complex of any one of the preceding embodiments, wherein the fusion protein comprises two transcriptional repressor domains, wherein the first transcriptional repressor domain is different from the second transcriptional repressor domain.

8. The gene repressor complex of embodiment 7, wherein the first transcriptional repressor domain is KRAB and the second transcriptional repressor domain is selected from the group consisting of methyl-CpG (mCpG) binding domain 2 (MeCP2), DNMT3A, DNMT3L, FOG, EZH2, SID4X, SID, NcoR, NuE, methyl-CpG (mCpG) binding domain 2 (meCP2), Switch independent 3 transcription regulator family member A (SIN3A), histone deacetylase HDT1 (HDT1), n-terminal truncation of methyl-CpG-binding domain containing protein 2 (MBD2B), nuclear inhibitor of protein phosphatase-1 (NIPP1), heterochromatin protein 1 (HP1A), mixed lineage leukemia protein-1 (MLL1), MLL2, MLL3, MLL4, MLL5, SET Domain Containing 1A (SETD1A), SETD1B, SETD2, Suppressor Of Variegation 3-9 Homolog 1 (SUV39H1), SUV39H2, euchromatic histone lysine methyltransferase 1 (EHMT1), histone-lysine N-methyltransferase EZH1 (EZH1), nuclear receptor binding SET domain protein 1 (NSD1), NSD2, NSD3, ASH1 like histone lysine methyltransferase (ASH1L), tripartite motif containing 28 (TRIM28), Methyltransferase Like 3 (METTL3), METTL4, family with sequence similarity 208 member A (FAM208A), M-Phase Phosphoprotein 8 (MPHOSPH8), and Periphilin 1 (PPHLN1).

9. The gene repressor complex of embodiment 7 or embodiment 8, wherein the fusion protein comprises a third transcriptional repressor domain, wherein the third transcriptional repressor domain is different from the first and the second transcriptional repressor domains.

10. The gene repressor complex of embodiment 9, wherein the first transcriptional repressor domain is KRAB and the second and third transcriptional repressor domains are selected from the group consisting of methyl-CpG (mCpG) binding domain 2 (MeCP2), DNMT3A, DNMT3L, FOG, EZH2, SID4X, SID, NcoR, NuE, methyl-CpG (mCpG) binding domain 2 (meCP2), Switch independent 3 transcription regulator family member A (SIN3A), histone deacetylase HDT1 (HDT1), n-terminal truncation of methyl-CpG-binding domain containing protein 2 (MBD2B), nuclear inhibitor of protein phosphatase-1 (NIPP1), heterochromatin protein 1 (HP1A), mixed lineage leukemia protein-1 (MLL1), MLL2, MLL3, MLL4, MLL5, SET Domain Containing 1A (SETD1A), SETD1B, SETD2, Suppressor Of Variegation 3-9 Homolog 1 (SUV39H1), SUV39H2, euchromatic histone lysine methyltransferase 1 (EHMT1), histone-lysine N-methyltransferase EZH1 (EZH1), nuclear receptor binding SET domain protein 1 (NSD1), NSD2, NSD3, ASH1 like histone lysine methyltransferase (ASH1L), tripartite motif containing 28 (TRIM28), Methyltransferase Like 3 (METTL3), METTL4, family with sequence similarity 208 member A (FAM208A), M-Phase Phosphoprotein 8 (MPHOSPH8), and Periphilin 1 (PPHLN1).

11. The gene repressor complex of any one of embodiments 7-10, wherein the transcriptional repressor domains are linked by linker peptide sequences.

12. The gene repressor complex of any one of the preceding embodiments, wherein the one or more transcriptional repressor domains are linked at or near the C-terminus of the catalytically-dead Class 2, Type V CRISPR protein by linker peptide sequences.

13. The gene repressor complex of embodiments 1-11, wherein the one or more transcriptional repressor domains are linked at or near the N-terminus of the catalytically-dead Class 2, Type V CRISPR protein by linker peptide sequences.

14. The gene repressor complex of any one of embodiments 11-13, wherein the linker peptide is selected from the group consisting of RS, (G)n (SEQ ID NO: 33240), (GS)n (SEQ ID NO: 33241), (GGS)n (SEQ ID NO: 33242), (GSGGS)n (SEQ ID NO: 33243), (GGSGGS)n (SEQ ID NO: 33244), (GGGS)n (SEQ ID NO: 33245), GGSG (SEQ ID NO: 33246), GGSGG (SEQ ID NO: 33247), GSGSG (SEQ ID NO: 33248), GSGGG (SEQ ID NO: 33249), GGGSG (SEQ ID NO: 33250), GSSSG (SEQ ID NO: 33251), (GP)n (SEQ ID NO: 33252), GPGP (SEQ ID NO: 33253), GGSGGGS (SEQ ID NO: 33254), GGP, PPP, PPAPPA (SEQ ID NO: 33255), PPPGPPP (SEQ ID NO: 33256), PPPG (SEQ ID NO: 33257), PPP(GGGS)n (SEQ ID NO: 33258), (GGGS)nPPP (SEQ ID NO: 33259), AEAAAKEAAAKEAAAKA (SEQ ID NO:33260), AEAAAKEAAAKA (SEQ ID NO: 33261), SGSETPGTSESATPES (SEQ ID NO: 33262), and TPPKTKRKVEFE (SEQ ID NO: 33263), wherein n is an integer of 1 to 5.

15. The gene repressor system of any one of the preceding embodiments, wherein the catalytically-dead Class 2, Type V CRISPR protein comprises a catalytically-dead CasX variant protein (dCasX) comprising a sequence selected from the group consisting of SEQ ID NOS: 17-36 as set forth in Table 4, or a sequence having at least about 85%, at least about 90%, at least about 95%, at least about 96%, at least about 97%, at least about 98%, or at least about 99% sequence identity thereto.

16. The gene repressor system of any one of embodiments 1-14, wherein the catalytically-dead Class 2, Type V CRISPR protein comprises a catalytically-dead CasX variant protein (dCasX) comprising a sequence selected from the group consisting of the sequences SEQ ID NOS: 17-36 as set forth in Table 4.

17. The gene repressor system of embodiment 15 or embodiment 16, comprising a sequence selected from the group consisting of the sequences as set forth in SEQ ID NOS: 889-2100 and 2332-33239, or a sequence having at least about 85%, at least about 90%, at least about 95%, at least about 96%, at least about 97%, at least about 98%, or at least about 99% sequence identity thereto.

18. The gene repressor system of embodiment 15 or embodiment 16, comprising a sequence selected from the group consisting of the sequences as set forth in SEQ ID NOS: 889-2100 and 2332-33239.

19. The gene repressor system of any one of embodiments 15-18, wherein the fusion protein further comprises one or more nuclear localization signals (NLS).

20. The gene repressor system of embodiment 19, wherein the one or more NLS are selected from the group of sequences consisting of PKKKRKV (SEQ ID NO: 33289), KRPAATKKAGQAKKKK (SEQ ID NO: 33290), PAAKRVKLD (SEQ ID NO: 33291), RQRRNELKRSP (SEQ ID NO: 33292), NQSSNFGPMKGGNFGGRSSGPYGGGGQYFAKPRNQGGY (SEQ ID NO: 33293), RMRIZFKNKGKDTAELRRRRVEVSVELRKAKKDEQILKRRNV (SEQ ID NO: 33294), VSRKRPRP (SEQ ID NO: 33295), PPKKARED (SEQ ID NO: 33296), PQPKKKPL (SEQ ID NO: 166), SALIKKKKKMAP (SEQ ID NO: 33298), DRLRR (SEQ ID NO: 33299), PKQKKRK (SEQ ID NO: 33300), RKLKKKIKKL (SEQ ID NO: 33301), REKKKFLKRR (SEQ ID NO: 33302), KRKGDEVDGVDEVAKKKSKK (SEQ ID NO: 33303), RKCLQAGMNLEARKTKK (SEQ ID NO: 33304), PRPRKIPR (SEQ ID NO: 33305), PPRKKRTVV (SEQ ID NO: 33306), NLSKKKKRKREK (SEQ ID NO: 33307), RRPSRPFRKP (SEQ ID NO: 33308), KRPRSPSS (SEQ ID NO: 33309), KRGINDRNFWRGENERKTR (SEQ ID NO: 33310), PRPPKMARYDN (SEQ ID NO: 33311), KRSFSKAF (SEQ ID NO: 33312), KLKIKRPVK (SEQ ID NO: 33313), PKKKRKVPPPPAAKRVKLD (SEQ ID NO: 33314), PKTRRRPRRSQRKRPPT (SEQ ID NO: 33315), SRRRKANPTKLSENAKKLAKEVEN (SEQ ID NO:

33316), KTRRRPRRSQRKRPPT (SEQ ID NO: 33317), RRKKRRPRRKKRR (SEQ ID NO: 33318), PKKKSRKPKKKSRK (SEQ ID NO: 33319), HKKKHP-DASVNFSEFSK (SEQ ID NO: 33320), QRPGPY-DRPQRPGPYDRP (SEQ ID NO: 33321), LSPSLSPLL-SPSLSPL (SEQ ID NO: 33322), RGKGGKGLGKGGAKRHRK (SEQ ID NO: 33323), PKRGRGRPKRGRGR (SEQ ID NO: 33324), PKKKRKVPPPPAAKRVKLD (SEQ ID NO: 33325), PKKKRKVPPPPKKKRKV (SEQ ID NO: 33326), PAKRARRGYKC (SEQ ID NO: 33327), KLGPRKAT-GRW (SEQ ID NO: 33328), PRRKREE (SEQ ID NO: 33329), PYRGRKE (SEQ ID NO: 33330), PLRKRPRR (SEQ ID NO: 33331), PLRKRPRRGSPLRKRPRR (SEQ ID NO: 33332), PAAKRVKLDGGKRTADGSEF-ESPKKKRKV (SEQ ID NO: 33333), PAAKRVKLDGGKRTADGSEF-ESPKKKRKVGIHGVPAA (SEQ ID NO: 33334), PAAKRVKLDGGKRTADGSEFESPKKKRK-VAEAAAKEAAAKEAAAKA (SEQ ID NO: 33335), PAAKRVKLDGGKRTADGSEFESPKKKRKVPG (SEQ ID NO: 33336), KRKGSPERGERKRHW (SEQ ID NO: 33337), KRTADSQHSTPPKTKRKVEFEPKKKRKV (SEQ ID NO: 33338).

21. The gene repressor system of embodiment 19 or embodiment 20, wherein the one or more NLS are linked at or near the C-terminus of the dCasX or the repressor domain.

22. The gene repressor system of embodiment 19 or embodiment 20, wherein the one or more NLS are linked at or near the N-terminus of the dCasX or the repressor domain.

23. The gene repressor system of embodiment 19 or embodiment 20, wherein the one or more NLS are linked at or near both the N-terminus and the C-terminus of the dCasX or the repressor domain.

24. The gene repressor system of embodiment 19, wherein the one or more NLS are selected from the group of sequences as set forth in Table 5 and are linked at or near the N-terminus of the dCasX or the repressor domain.

25. The gene repressor system of embodiment 19, wherein the one or more NLS are selected from the group of SEQ ID NOS: 72-112 as set forth in Table 6 and are linked at or near the C-terminus of the dCasX or the repressor domain.

26. The gene repressor system of embodiment 19, wherein one or more NLS are selected from the group of SEQ ID NOS: 37-71 as set forth in Table 5 and are linked at or near the N-terminus of the dCasX or the repressor domain and one or more NLS are selected from the group of sequences as set forth in Table 6 and are linked at or near the C-terminus of the dCasX or the repressor domain.

27. The gene repressor system of any one of embodiments 19-26, wherein the one or more NLS are linked to the dCasX variant protein, the repressor domain, or to adjacent NLS with one or more linker peptides wherein the linker peptides are selected from the group consisting of RS, (G)n (SEQ ID NO: 33240), (GS)n (SEQ ID NO: 33241), (GGS)n (SEQ ID NO: 33242), (GSGGS)n (SEQ ID NO: 33243), (GGSGGS)n (SEQ ID NO: 33244), (GGGS)n (SEQ ID NO: 33245), GGSG (SEQ ID NO: 33246), GGSGG (SEQ ID NO: 33247), GSGSG (SEQ ID NO: 33248), GSGGG (SEQ ID NO: 33249), GGGSG (SEQ ID NO: 33250), GSSSG (SEQ ID NO: 33251), (GP)n (SEQ ID NO: 33252), GPGP (SEQ ID NO: 33253), GGSGGGS (SEQ ID NO: 33254), GGP, PPP, PPAPPA (SEQ ID NO: 33255), PPPGPPP (SEQ ID NO: 33256), PPPG (SEQ ID NO: 33257), PPP(GGGS)n (SEQ ID NO: 33258), (GGGS)nPPP (SEQ ID NO: 33259), AEAAAKEAAAKEAAAKA (SEQ ID NO: 33260), AEAAAKEAAAKA (SEQ ID NO: 33261), SGSETPGTS-ESATPES (SEQ ID NO: 33262), and TPPKTKRKVEFE (SEQ ID NO: 33263), wherein n is an integer of 1 to 5.

28. The gene repressor system of any one of the preceding embodiments, wherein the gRNA has a scaffold comprising a sequence selected from the group consisting of SEQ ID NOS: 2101-2331 as set forth in Table 2, or a sequence having at least about 85%, at least about 90%, at least about 95%, at least about 96%, at least about 97%, at least about 98%, or at least about 99% sequence identity thereto.

29. The gene repressor system of any one of embodiments 1-28, wherein the gRNA has a scaffold comprising a sequence selected from the group consisting of SEQ ID NOS: 2101-2331, as set forth in Table 2.

30. The gene repressor system of any one of the preceding embodiments, wherein the gRNA comprises a targeting sequence having 15, 16, 17, 18, 19, 20, or 21 nucleotides.

31. The gene repressor system of embodiment 30, wherein the target nucleic acid sequence complementary to the targeting sequence is within 1 kb of a transcription start site (TSS) in the gene.

32. The gene repressor system of embodiment 30, wherein the target nucleic acid sequence complementary to the targeting sequence is within 500 bps upstream to 500 bps downstream of a TSS of the gene.

33. The gene repressor system of embodiment 30, wherein the target nucleic acid sequence complementary to the targeting sequence is within 1 kb 3' or 5' to an untranslated region of the gene.

34. The gene repressor system of embodiment 30, wherein the target nucleic acid sequence complementary to the targeting sequence is within the open reading frame of the gene.

35. The gene repressor system of embodiment 30, wherein the target nucleic acid sequence complementary to the targeting sequence is within an exon of the gene.

36. The gene repressor system of embodiment 35, wherein the target nucleic acid sequence complementary to the targeting sequence is within exon 1 of the gene.

37. The gene repressor system of any one of the preceding embodiments, wherein the RNP is capable of binding the target nucleic acid but is not capable of cleaving the target nucleic acid.

38. A nucleic acid encoding the fusion protein of the gene repressor system of any one of the preceding embodiments.

39. A nucleic acid encoding the gRNA of any one of the preceding embodiments.

40. The nucleic acid of embodiment 38 or embodiment 39, wherein the nucleic acid sequence is codon optimized for expression in a eukaryotic cell.

41. A vector comprising the nucleic acids of embodiments 38-40.

42. The vector of embodiment 41, wherein the vector is selected from the group consisting of a retroviral vector, a lentiviral vector, an adenoviral vector, an adeno-associated viral (AAV) vector, a herpes simplex virus (HSV) vector, a virus-like particle (VLP) vector, a delivery particle system (XDP) vector, a plasmid, a minicircle, a nanoplasmid, and an RNA vector.

43. The vector of embodiment 42, wherein the vector is an AAV vector.

44. The vector of embodiment 43, wherein the AAV vector is selected from AAV1, AAV2, AAV3, AAV4, AAV5, AAV6, AAV7, AAV8, AAV9, AAV10, AAV11, AAV12, AAV 44.9, AAV-Rh74, or AAVRh10.

45. The vector of embodiment 43 or embodiment 44, wherein the nucleic acid encoding the fusion protein and the gRNA are incorporated as a transgene between a 5' and a 3' inverted terminal repeat (ITR) sequence within the AAV.

46. The vector of embodiment 42, wherein the vector is a XDP vector comprising a nucleic acid encoding one or more components of a retroviral gag polyprotein or a gag-pol polyprotein.

47. The vector of embodiment 46, wherein the nucleic acid encodes one or more components are selected from the group consisting of a gag-transframe region-pol protease polyprotein (gag-TFR-PR), a matrix protein (MA), a nucleocapsid protein (NC), a capsid protein (CA), a p1 peptide, a p6 peptide, a P2A peptide, a P2B peptide, a P10 peptide, a p12 peptide, a PP21/24 peptide, a P12/P3/P8 peptide, a P20 peptide, an MS2 coat protein, a protease, and a protease cleavage site.

48. The vector of embodiment 46 or embodiment 47, wherein the nucleic acid further encodes the fusion protein of embodiment 38.

49. The vector of embodiment 46 or embodiment 47, wherein the vector comprises a first nucleic acid encoding the fusion protein and a second nucleic acid encoding the one or more components of the gag polyprotein.

50. The vector of embodiment 48 or embodiment 49, further comprising a nucleic acid encoding a pseudotyping viral envelope glycoprotein or antibody fragment that provides for binding and fusion of the XDP to a target cell.

51. The vector of any one of embodiments 47-50, wherein the encoded gRNA further comprises an MS2 hairpin sequence.

52. The vector of any one of embodiments 47-51, further comprising a nucleic acid encoding a Gag-transframe region-Pol protease polyprotein (Gag-TFR-PR) and intervening protease cleavage sites between each component of the Gag-TFR-PR.

Figure 4:
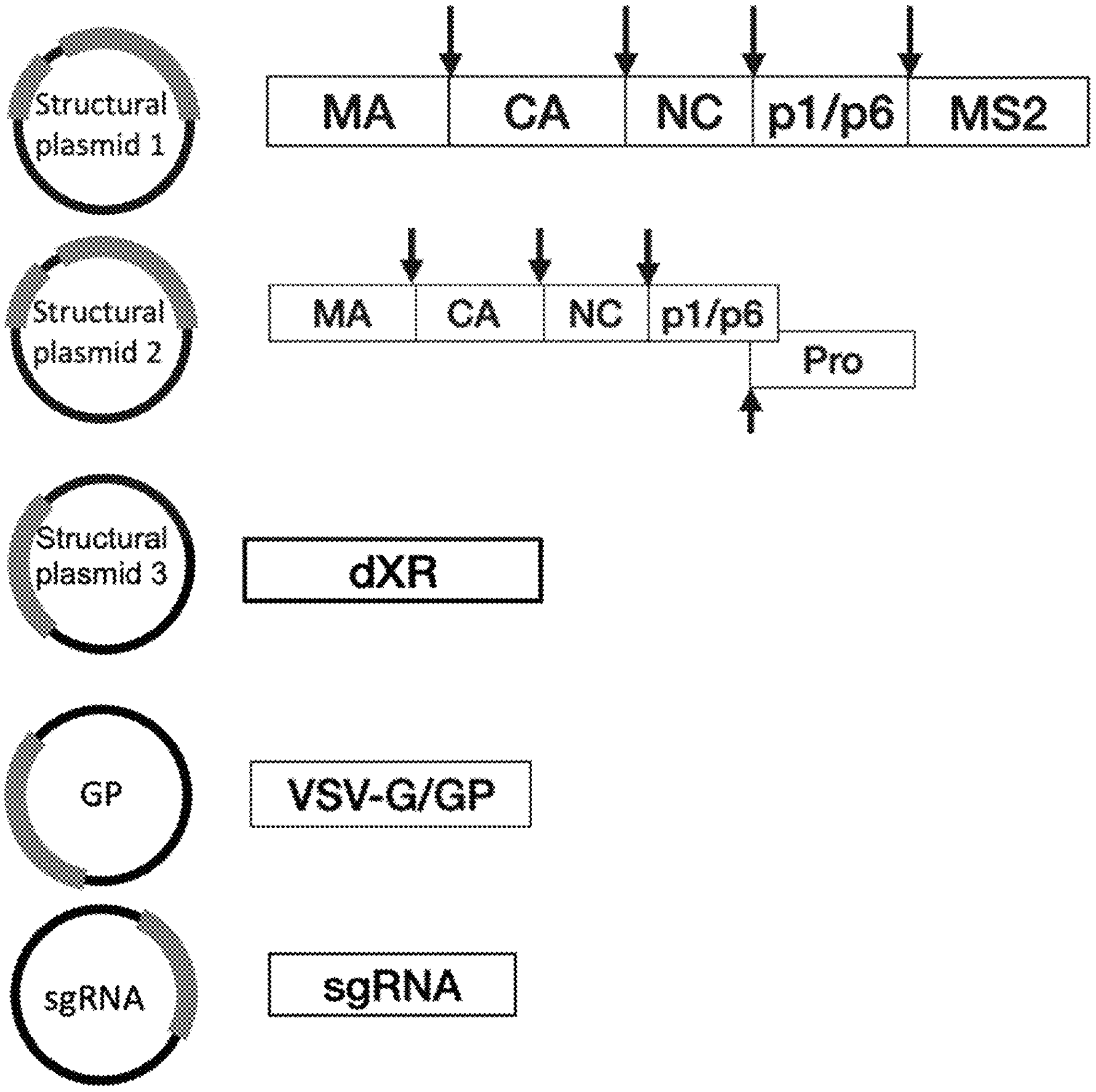
FIG. 4 shows the schematics that depict the plasmids utilized in the creation of an XDP construct in which the dXR is encoded on a separate plasmid and the plasmid encoding Gag components also encodes an MS2 coat protein, with protease cleavage sequence sites indicated by arrows.
Figure 5:
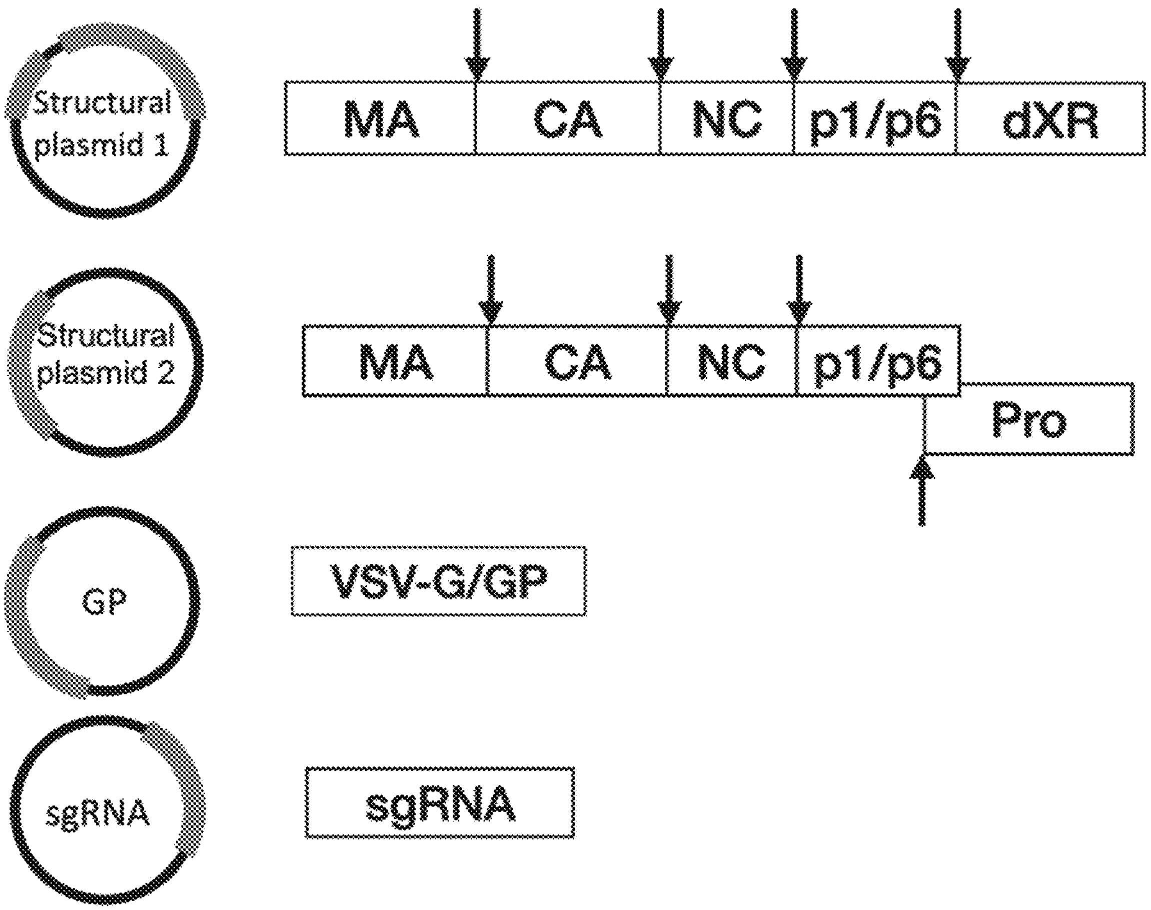
FIG. 5 shows the schematics that depict the plasmids utilized in the creation of an XDP construct in which the dXR is encoded on the plasmid encoding Gag components, with protease cleavage sequence sites indicated by arrows.

53. The vector of embodiment 52, wherein the nucleic acids are configured as depicted in FIG. 4 or FIG. 5.

54. A host cell comprising the vector of any one of embodiments 41-53.

55. The host cell of embodiment 54, wherein the host cell is selected from the group consisting of BHK, HEK293, HEK293T, NS0, SP2/0, YO myeloma cells, P3X63 mouse myeloma cells, PER, PER.C6, NIH3T3, COS, HeLa, CHO, and yeast cells.

56. An XDP comprising:

(a) one or more components of selected from the group consisting of a matrix protein (MA), a nucleocapsid protein (NC), a capsid protein (CA), a p1 peptide, a p6 peptide, a P2A peptide, a P2B peptide, a P10 peptide, a p12 peptide, a PP21/24 peptide, a P12/P3/P8 peptide, a P20 peptide, an MS2 coat protein, a protease, and a protease cleavage site;

(b) an RNP comprising the gene repressor system of any one of embodiments 1-37 wherein the RNP is encapsidated within the XDP upon self-assembly of the XDP;

(c) a pseudotyping viral envelope glycoprotein or antibody fragment incorporated on the XDP capsid surface that provides for binding and fusion of the XDP to a target cell.

57. A method of repressing transcription of a target nucleic acid sequence in a population of cells, the method comprising introducing into cells:

(a) RNP comprising the gene repressor system of any one of embodiments 1-37;

(b) the nucleic acid of any one of embodiments 38-40;

(c) the vector as in any one of embodiments 41-52;

(e) the XDP of embodiment 56; or (f) combinations thereof, wherein upon binding of the RNP to the target nucleic acid, transcription of the gene proximal to the binding location of the RNP is repressed in the cells.

58. The method of embodiment 57, wherein transcription of the gene in the population of cells is repressed by at least about 10%, at least about 20%, at least about 30%, at least about 40%, at least about 50%, at least about 60%, at least about 70%, at least about 75%, at least about 80%, at least about 85%, at least about 90%, at least about 95%, or at least 99% greater compared to the repression effected by an RNP comprising a comparable guide RNA and a catalytically dead CasX variant without a repressor domain, when assessed in an in vitro assay.

59. The method of embodiment 57 or embodiment 58, wherein off-target binding or off-target transcription repression is less than about 5%, less than about 4%, less than about 3%, less than about 2%, or less than about 1% in the cells.

60. The method of any one of embodiments 57-59, wherein the repression of transcription in the cells is sustained for at least about 8 hours, at least about 1 day, at least about 1 week, or at least about 1 month.

61. The method of any one of embodiments 57-60, further comprising a second gRNA or a nucleic acid encoding the second gNA, wherein the second gNA has a targeting sequence complementary to a different portion of the target nucleic acid sequence and is capable of forming a ribonuclear protein complex (RNP) with the catalytically-dead Class 2, Type V CRISPR protein.

62. A method of treating a subject with a disorder caused by a genetic mutation, comprising administering a therapeutically-effective amount of:

(a) the AAV vector of embodiment 43 or embodiment 44; or (b) the XDP of embodiment 56, wherein upon binding of the RNP to the target nucleic acid in cells of the subject contacted by the AAV vector or XDP, transcription of the gene proximal to the binding location of the RNP is repressed.

63. The method of embodiment 62, wherein transcription of the gene in the targeted cells is repressed by at least about 10%, at least about 20%, at least about 30%, at least about 40%, at least about 50%, at least about 60%, at least about 70%, at least about 75%, at least about 80%, at least about 85%, at least about 90%, at least about 95%, or at least 99%.

64. The method of embodiment 62 or embodiment 63, wherein the treating results in improvement in at least one clinically-relevant endpoint associated with the disease or disorder.

65. The method of any one of embodiments 62-64, wherein the AAV vector or XDP is administered to the subject by a route of administration selected from subcutaneous, intradermal, intraneural, intranodal, intramedullary, intramuscular, intralumbar, intrathecal, subarachnoid, intraventricular, intracapsular, intravenous, intralymphatical, or intraperitoneal routes, wherein the administering method is injection, transfusion, or implantation, or combinations thereof.

66. The method of embodiment 65, wherein the XDP is administered at a dose of at least about $1\times10^5$ particles/kg, or at least about $1\times10^6$ particles/kg, or at least about $1\times10^7$ particles/kg, or at least about $1\times10^8$ particles/kg, or at least about $1\times10^9$ particles/kg, or at least about $1\times10^{10}$ particles/kg, or at least about $1\times10^{11}$ particles/kg, or at least about $1\times10^{12}$ particles/kg, or at least about $1\times10^{13}$ particles/kg, or at least about $1\times10^{14}$ particles/kg, or at least about $1\times10^{15}$ particles/kg, or at least about $1\times10^{16}$ particles/kg.

67. The method of embodiment 65, wherein the XDP is administered to the subject at a dose of at least about $1\times10^5$ particles/kg to about $1\times10^{16}$ particles/kg, or at least about $1\times10^6$ particles/kg to about $1\times10^{15}$ particles/kg, or at least about $1\times10^7$ particles/kg to about $1\times10^{14}$ particles/kg.

68. The method of embodiment 65, wherein the AAV vector is administered to the subject at a dose of at least about $1\times10^8$ vector genomes (vg), at least about $1\times10^5$ vector genomes/kg (vg/kg), at least about $1\times10^6$ vg/kg, at least about $1\times10^7$ vg/kg, at least about $1\times10^8$ vg/kg, at least about $1\times10^9$ vg/kg, at least about $1\times10^{10}$ vg/kg, at least about $1\times10^{11}$ vg/kg, at least about $1\times10^{12}$ vg/kg, at least about $1\times10^{13}$ vg/kg, at least about $1\times10^{14}$ vg/kg, at least about $1\times10^{15}$ vg/kg, or at least about $1\times10^{16}$ vg/kg.

69. The method of embodiment 65, wherein the AAV vector is administered to the subject at a dose of at least about $1\times10^5$ vg/kg to about $1\times10^{16}$ vg/kg, at least about $1\times10^6$ vg/kg to about $1\times10^{15}$ vg/kg, or at least about $1\times10^7$ vg/kg to about $1\times10^{14}$ vg/kg.

70. The method of any one of embodiments 62-69, wherein the XDP or AAV vector is administered to the subject according to a treatment regimen comprising one or more consecutive doses of the XDP or AAV.

71. The method of embodiment 70, wherein the therapeutically effective dose is administered to the subject as two or more doses over a period of at least two weeks, or at least one month, or at least two months, or at least three months, or at least four months, or at least five months, or at least six months, or once a year.

72. The method of any one of embodiments 62-71, wherein the subject is selected from the group consisting of mouse, rat, pig, and non-human primate.

73. The method of any one of embodiments 62-71, wherein the subject is human.

74. A pharmaceutical composition comprising the gene repressor system of any one of embodiments 1-37 and a pharmaceutically acceptable excipient.

75. The gene repressor system of any one of embodiments 1-37 for use as a medicament in the treatment of a subject a disorder caused by a genetic mutation.

76. The gene repressor system of any one of embodiments 1-37, wherein the targeting sequence of the gRNA is complementary to a non-target strand sequence located 1 nucleotide 3' of a protospacer adjacent motif (PAM) sequence.

77. The composition of embodiment 76, wherein the PAM sequence comprises a TC motif.

78. The composition of embodiment 77, wherein the PAM sequence comprises ATC, GTC, CTC or TTC.

SET 2.

1. A gene repressor system comprising:

(a) a catalytically-dead Class 2, Type V CRISPR protein;

(b) one or more transcription repressor domains; and (c) a guide ribonucleic acid (gRNA) wherein:

i) the one or more transcription repressor domains are linked to the catalytically-dead Class 2, Type V CRISPR protein as a fusion protein;

ii) the gRNA comprises a targeting sequence complementary to a target nucleic acid sequence of a gene targeted for repression, silencing, or downregulation; iii) the fusion protein is capable of forming a ribonuclear protein complex (RNP) with the gRNA; and iv) the RNP is capable of binding to the target nucleic acid.

2. The gene repressor system of embodiment 1, wherein the gene encodes mRNA, rRNA, tRNA, or structural RNA.

3. The gene repressor system of embodiment 1, wherein the one or more transcription repressor domains are selected from the group consisting of a Krüppel-associated box (KRAB), DNA methyltransferase 3 alpha (DNMT3A), DNMT3A-like protein (DNMT3L), DNA methyltransferase 3 beta (DNMT3B), DNA methyltransferase 1 (DNMT1), Friend of GATA-1 (FOG), Mad mSIN3 interaction domain (SID), enhanced SID (SID4X), nuclear receptor corepressor (NcoR), nuclear effector protein (NuE), KOX1 repression domain, the ERF repressor domain (ERD), the SRDX repression domain, histone lysine methyltransferases such as PR/SET domain containing protein (Pr-SET)7/8, lysine methyltransferase 5B (SUV4-20H1), PR/SET domain 2 (RIZ1), histone lysine demethylases such as lysine demethylase 4A (JMJD2A/JHDM3A), lysine demethylase 4B (JMJD2B), lysine demethylase 4C (JMJD2C/GASC1), lysine demethylase 4D (JMJD2D), lysine demethylase 5A (JARID1A/RBP2), lysine demethylase 5B (JARID1B/PLU-1), lysine demethylase 5C (JARID 1C/SMCX), lysine demethylase 5D (JARID1D/SMCY), sirtuin 1 (SIRT1), SIRT2, DNA methylases such as HhaI DNA m5c-methyltransferase (M.HhaI), methyltransferase 1 (MET1), histone H3 lysine 9 methyltransferase G9a (G9a), S-adenosyl-L-methionine-dependent methyltransferases superfamily protein (DRM3), DNA cytosine methyltransferase MET2a (ZMET2), methyl-CpG (mCpG) binding domain 2 (meCP2), Switch independent 3 transcription regulator family member A (SIN3A), histone deacetylase HDT1 (HDT1), n-terminal truncation of methyl-CpG-binding domain containing protein 2 (MBD2B), nuclear inhibitor of protein phosphatase-1 (NIPP1), GLP, chromomethylase 1 (CMT1), chromomethylase 2 (CMT2), heterochromatin protein 1 (HP1A), mixed lineage leukemia protein-5 (MLL5), histone-lysine N-methyltransferase SETDB1 (SETB1), Suppressor Of Variegation 3-9 Homolog 1 (SUV39H1), SUV39H2, euchromatic histone lysine methyltransferase 1 (EHMT1), histone-lysine N-methyltransferase EZH1 (EZH1), EZH2, nuclear receptor binding SET domain protein 1 (NSD1), NSD2, NSD3, ASH1 like histone lysine methyltransferase (ASH1L), tripartite motif containing 28 (TRIM28), Methyltransferase Like 3 (METTL3), METTL4, family with sequence similarity 208 member A (FAM208A), M-Phase Phosphoprotein 8 (MPHOSPH8), SET domain containing 2 (SETD2), histone deacetylase 1 (HDAC1), HDAC2, HDAC3, HDAC8, HDAC4, HDAC5, HDAC7, HDAC9, and Periphilin 1 (PPHLN1) domain.

4. The gene repressor system of embodiment 3, wherein the transcription repressor domain is a KRAB domain.

5. The gene repressor system of embodiment 4, wherein the KRAB transcriptional repressor domain is selected from the group consisting of ZNF343, ZNF337, ZNF334, ZNF215, ZNF519, ZNF485, ZNF214, ZNF33B, ZNF287, ZNF705A, ZNF37A, KRBOX4, ZKSCAN3, ZKSCAN4, ZNF57, ZNF557, ZNF705B, ZNF662, ZNF77, ZNF500, ZNF558, ZNF620, ZNF713, ZNF823, ZNF440, ZNF441, ZNF136, SNRPB, ZNF735, ZKSCAN2, ZNF619, ZNF627, ZNF333, ABCA11P, PLD5P1, ZNF25, ZNF727, ZNF595, ZNF14, ZNF33A, ZNF101, ZNF253, ZNF56, ZNF720, ZNF85, ZNF66, ZNF722P, ZNF486, ZNF682, ZNF626, ZNF100, ZNF93, ZKSCAN1, ZNF257, ZNF729, ZNF208, ZNF90, ZNF430, ZNF676, ZNF91, ZNF429, ZNF675, ZNF681, ZNF99, ZNF431, ZNF98, ZNF708, ZNF732, SSX2, ZNF721, ZNF726, ZNF730, ZNF506, ZNF728, ZNF141, ZNF723, ZNF302, ZNF484, LINC00960, SSX2B, ZNF718, ZNF74, ZNF157, ZNF790, ZNF565, ZNF705G, VN1R107P, SLC27A5, ZNF737, SSX4, ZNF850, ZNF717, ZNF155, ZNF283, ZNF404, ZNF114, ZNF716, ZNF230, ZNF45, ZNF222, ZNF286A, ZNF624, ZNF223, ZNF284, ZNF790-AS1, ZNF382, ZNF749, ZNF615, ZFP90, ZNF225, ZNF234, ZNF568, ZNF614, ZNF584, ZNF432, ZNF461, ZNF182, ZNF630, ZNF630-AS1, ZNF132, ZNF420, ZNF324B, ZNF616, ZNF471, ZNF227, ZNF324, ZNF860, ZFP28, ZNF470, ZNF586, ZNF235, ZNF274, ZNF446, ZFP1, ZIM3, ZNF212, ZNF766, ZNF264, ZNF480, ZNF667, ZNF805, ZNF610, ZNF783, ZNF621, ZNF8-DT, ZNF880, ZNF213-AS1, ZNF213, ZNF263, ZSCAN32, ZIM2, ZNF597, ZNF786, KRBA1, ZNF460, ZNF8, ZNF875, ZNF543, ZNF133, ZNF229, ZNF528, SSX1, ZNF81, ZNF578, ZNF862, ZNF777, ZNF425, ZNF548, ZNF746, ZNF282, ZNF398, ZNF599, ZNF251, ZNF195, ZNF181, RBAK-RBAKDN, ZFP37, RN7SL526P, ZNF879, ZNF26, ZSCAN21, ZNF3, ZNF354C, ZNF10, ZNF75D, ZNF426, ZNF561, ZNF562, ZNF846, ZNF782, ZNF552, ZNF587B, ZNF814, ZNF587, ZNF92, ZNF417, ZNF256, ZNF473, ZFP14, ZFP82, ZNF529, ZNF605, ZFP57, ZNF724, ZNF43, ZNF354A, ZNF547, SSX4B, ZNF585A, ZNF585B, ZNF792, ZNF789, ZNF394, ZNF655, ZFP92, ZNF41, ZNF674, ZNF546, ZNF780B, ZNF699, ZNF177, ZNF560, ZNF583, ZNF707, ZNF808, ZKSCAN5, ZNF137P, ZNF611, ZNF600, ZNF28, ZNF773, ZNF549, ZNF550, ZNF416, ZIK1, ZNF211, ZNF527, ZNF569, ZNF793, ZNF571-AS1, ZNF540, ZNF571, ZNF607, ZNF75A, ZNF205, ZNF175, ZNF268, ZNF354B, ZNF135, ZNF221, ZNF285, ZNF419, ZNF30, ZNF304, ZNF254, ZNF701, ZNF418, ZNF71, ZNF570, ZNF705E, KRBOX1, ZNF510, ZNF778, PRDM9, ZNF248, ZNF845, ZNF525, ZNF765, ZNF813, ZNF747, ZNF764, ZNF785, ZNF689, ZNF311, ZNF169, ZNF483, ZNF493, ZNF189, ZNF658, ZNF564, ZNF490, ZNF791, ZNF678, ZNF454, ZNF34, ZNF7, ZNF250, ZNF705D, ZNF641, ZNF2, ZNF554, ZNF555, ZNF556, ZNF596, ZNF517, ZNF331, ZNF18, ZNF829, ZNF772, ZNF17, ZNF112, ZNF514, ZNF688, PRDM7, ZNF695, ZNF670-ZNF695, ZNF138, ZNF670, ZNF19, ZNF316, ZNF12, ZNF202, RBAK, ZNF83, ZNF468, ZNF479, ZNF679, ZNF736, ZNF680, ZNF273, ZNF107, ZNF267, ZKSCAN8, ZNF84, ZNF573, ZNF23, ZNF559, ZNF44, ZNF563, ZNF442, ZNF799, ZNF443, ZNF709, ZNF566, ZNF69, ZNF700, ZNF763, ZNF433-AS1, ZNF433, ZNF878, ZNF844, ZNF788P, ZNF20, ZNF625-ZNF20, ZNF625, ZNF606, ZNF530, ZNF577, ZNF649, ZNF613, ZNF350, ZNF317, ZNF300, ZNF180, ZNF415, VN1R1, ZNF266, ZNF738, ZNF445, ZNF852, ZKSCAN7, ZNF660, MPRIPP1, ZNF197, ZNF567, ZNF582, ZNF439, ZFP30, ZNF559-ZNF177, ZNF226, ZNF841, ZNF544, ZNF233, ZNF534, ZNF836, ZNF320, KRBA2, ZNF761, ZNF383, ZNF224, ZNF551, ZNF154, ZNF671, ZNF776, ZNF780A, ZNF888, ZNF816-ZNF321P, ZNF321P, ZNF816, ZNF347, ZNF665, ZNF677, ZNF160, ZNF184, ZNF140, ZNF589, ZNF891, ZFP69B, ZNF436, POGK, ZNF669, ZFP69, ZNF684, ZNF124, ZNF496, and sequence variants thereof.

6. The gene repressor system of embodiment 4 or embodiment 5, wherein the KRAB domain is selected from the group of sequences consisting of SEQ ID NOS: 889-2100 and 2332-33239, or a sequence having at least about 85%, at least about 90%, at least about 91%, at least about 92%, at least about 93% at least about 94% at least about 95%, at least about 96%, at least about 97%, at least about 98%, or at least about 99% identity thereto.

7. The gene repressor system of embodiment 4 or embodiment 5, wherein the KRAB domain is selected from the group of sequences consisting of SEQ ID NOS: 889-2100 and 2332-33239.

8. The gene repressor complex of any one of embodiments 1-7, wherein the one or more transcriptional repressor domains are linked at or near the C-terminus of the catalytically-dead Class 2, Type V CRISPR protein by linker peptide sequences.

9. The gene repressor complex of embodiments 1-7, wherein the one or more transcriptional repressor domains are linked at or near the N-terminus of the catalytically-dead Class 2, Type V CRISPR protein by linker peptide sequences.

10. The gene repressor complex of any one of embodiments 1-9, wherein the fusion protein comprises two transcriptional repressor domains, wherein the first transcriptional repressor domain is different from the second transcriptional repressor domain.

11. The gene repressor complex of embodiment 10, wherein the first transcriptional repressor domain is KRAB and the second transcriptional repressor domain is selected from the group consisting of DNMT3A, DNMT3L, DNMT3B, DNMT1, FOG, SID, SID4X, NcoR, NuE, KOX1, ERD, Pr-SET 7/8, SUV4-20H1, RIZ1, JMJD2A/JHDM3A, JMJD2B, JMJD2C/GASC1, JMJD2D, JARID1A/RBP2, JARID1B/PLU-1, JARID 1C/SMCX, JARID1D/SMCY, SIRT1, SIRT2, M.HhaI, MET1, G9a, DRM3, ZMET2, meCP2, SIN3A, HDT1, MBD2B, NIPP1, GLP, CMT1, CMT2, HP1A, MLL5, SETB1, SUV39H1, SUV39H2, EHMT1, EZH1, EZH2, NSD1, NSD2, NSD3, ASH1L, TRIM28, METTL3, METTL4, FAM208A, MPHOSPH8, SETD2, HDAC1, HDAC2, HDAC3, HDAC8, HDAC4, HDAC5, HDAC7, HDAC9, and PPHLN1.

12. The gene repressor complex of embodiment 11, wherein the second transcriptional repressor domain is a DNMT3A domain, or a sequence variant thereof.

13. The gene repressor complex of embodiment 12, wherein the DNMT3A domain is selected from the group consisting of SEQ ID NOS: 33625-57543.

14. The gene repressor complex of any one of embodiments 10-13, wherein the fusion protein comprises a third transcriptional repressor domain, wherein the third transcriptional repressor domain is different from the first and the second transcriptional repressor domains.

15. The gene repressor complex of embodiment 14, wherein the third transcriptional repressor domain is selected from the group consisting of DNMT3L, DNMT3B, DNMT1, FOG, SID, SID4X, NcoR, NuE, KOX1, ERD, Pr-SET 7/8, SUV4-20H1, RIZ1, JMJD2A/JHDM3A, JMJD2B, JMJD2C/GASC1, JMJD2D, JARID1A/RBP2, JARID1B/PLU-1, JARID 1C/SMCX, JARID1D/SMCY, SIRT1, SIRT2, M.HhaI, MET1, G9a, DRM3, ZMET2, meCP2, SIN3A, HDT1, MBD2B, NIPP1, GLP, CMT1, CMT2, HP1A, MLL5, SETB1, SUV39H1, SUV39H2, EHMT1, EZH1, EZH2, NSD1, NSD2, NSD3, ASH1L, TRIM28, METTL3, METTL4, FAM208A, MPHOSPH8, SETD2, HDAC1, HDAC2, HDAC3, HDAC8, HDAC4, HDAC5, HDAC7, HDAC9, and PPHLN1.

16. The gene repressor complex of embodiment 14 or embodiment 15, wherein the third transcriptional repressor domain is DMNT3L, or a sequence variant thereof.

17. The gene repressor complex of any one of embodiments 1-16, wherein the second and/or third transcriptional repressor domains are linked to the catalytically-dead Class 2, Type V CRISPR protein or to a transcriptional repressor domain by a linker peptide sequence.

18. The gene repressor complex of any one of embodiments 8-17, wherein the linker peptide is selected from the group consisting of RS, (G)n (SEQ ID NO: 33240), (GS)n (SEQ ID NO: 33241), (GGS)n (SEQ ID NO: 33242), (GSGGS)n (SEQ ID NO: 33243), (GGSGGS)n (SEQ ID NO: 33244), (GGGS)n (SEQ ID NO: 33245), GGSG (SEQ ID NO: 33246), GGSGG (SEQ ID NO: 33247), GSGSG (SEQ ID NO: 33248), GSGGG (SEQ ID NO: 33249), GGGSG (SEQ ID NO: 33250), GSSSG (SEQ ID NO: 33251), (GP)n (SEQ ID NO: 33252), GPGP (SEQ ID NO: 33253), GGSGGGS (SEQ ID NO: 33254), GSGSGGG (SEQ ID NO: 57628), GGP, PPP, PPAPPA (SEQ ID NO: 33255), PPPGPPP (SEQ ID NO: 33256), PPPG (SEQ ID NO: 33257), PPP(GGGS)n (SEQ ID NO: 33258), (GGGS)nPPP (SEQ ID NO: 33259), AEAAAKEAAAKEAAAKA (SEQ ID NO:33260), AEAAAKEAAAKA (SEQ ID NO: 33261), SGSETPGTSESATPES (SEQ ID NO: 33262), and TPPKTKRKVEFE (SEQ ID NO: 33263), wherein n is an integer of 1 to 5.

19. The gene repressor system of any one of embodiments 1-18, wherein the catalytically-dead Class 2, Type V CRISPR protein comprises a catalytically-dead CasX variant protein (dCasX) comprising a sequence selected from the group consisting of SEQ ID NOS: 17-36 as set forth in Table 4, or a sequence having at least about 85%, at least about 90%, at least about 95%, at least about 96%, at least about 97%, at least about 98%, or at least about 99% sequence identity thereto.

20. The gene repressor system of any one of embodiments 1-18, wherein the catalytically-dead Class 2, Type V CRISPR protein comprises a catalytically-dead CasX variant protein (dCasX) comprising a sequence selected from the group consisting of the sequences SEQ ID NOS: 17-36 as set forth in Table 4.

21. The gene repressor system of any one of embodiments 1-20, wherein the fusion protein further comprises one or more nuclear localization signals (NLS).

22. The gene repressor system of embodiment 21, wherein the one or more NLS are selected from the group of sequences consisting of PKKKRKV (SEQ ID NO: 33289), KRPAATKKAGQAKKKK (SEQ ID NO: 33290), PAAKRVKLD (SEQ ID NO: 33291), RQRRNELKRSP (SEQ ID NO: 33292), NQSSNFGPMKGGNFGGRSSGPYGGGGQYFAKPRNQGGY (SEQ ID NO: 33293), RMRIZFKNKGKDTAELRRRRVEVSVELRKAKKDEQILKRRNV (SEQ ID NO: 33294), VSRKRPRP (SEQ ID NO: 33295), PPKKARED (SEQ ID NO: 33296), PQPKKKPL (SEQ ID NO: 166), SALIKKKKKMAP (SEQ ID NO: 33298), DRLRR (SEQ ID NO: 33299), PKQKKRK (SEQ ID NO: 33300), RKLKKKIKKL (SEQ ID NO: 33301), REKKKFLKRR (SEQ ID NO: 33302), KRKGDEVDGVDEVAKKKSKK (SEQ ID NO: 33303), RKCLQAGMNLEARKTKK (SEQ ID NO: 33304), PRPRKIPR (SEQ ID NO: 33305), PPRKKRTVV (SEQ ID NO: 33306), NLSKKKKRKREK (SEQ ID NO: 33307), RRPSRPFRKP (SEQ ID NO: 33308), KRPRSPSS (SEQ ID NO: 33309), KRGINDRNFWRGENERKTR (SEQ ID NO: 33310), PRPPKMARYDN (SEQ ID NO: 33311), KRSFSKAF (SEQ ID NO: 33312), KLKIKRPVK (SEQ ID NO: 33313), PKKKRKVPPPPAAKRVKLD (SEQ ID NO: 33314), PKTRRRPRRSQRKRPPT (SEQ ID NO: 33315), SRRRKANPTKLSENAKKLAKEVEN (SEQ ID NO: 33316), KTRRRPRRSQRKRPPT (SEQ ID NO: 33317), RRKKRRPRRKKRR (SEQ ID NO: 33318), PKKKSRKPKKKSRK (SEQ ID NO: 33319), HKKKHPDASVNFSEFSK (SEQ ID NO: 33320), QRPGPYDRPQRPGPYDRP (SEQ ID NO: 33321), LSPSLSPLLSPSLSPL (SEQ ID NO: 33322), RGKGGKGLGKGGAKRHRK (SEQ ID NO: 33323), PKRGRGRPKRGRGR (SEQ ID NO: 33324), PKKKRKVPPPPAAKRVKLD (SEQ ID NO: 33325), PKKKRKVPPPPKKKRKV (SEQ ID NO: 33326), PAKRARRGYKC (SEQ ID NO: 33327), KLGPRKATGRW (SEQ ID NO: 33328), PRRKREE (SEQ ID NO: 33329), PYRGRKE (SEQ ID NO: 33330), PLRKRPRR (SEQ ID NO: 33331), PLRKRPRRGSPLRKRPRR (SEQ ID NO: 33332), PAAKRVKLDGGKRTADGSEFESPKKKRKV (SEQ ID NO: 33333), PAAKRVKLDGGKRTADGSEFESPKKKRKVGIHGVPAA (SEQ ID NO: 33334), PAAKRVKLDGGKRTADGSEFESPKKKRKVAEAAAKEAAAKEAAAKA (SEQ ID NO: 33335), PAAKRVKLDGGKRTADGSEFESPKKKRKVPG (SEQ ID NO: 33336), KRKGSPERGERKRHW (SEQ ID NO: 33337), KRTADSQHSTPPKTKRKVEFEPKKKRKV (SEQ ID NO: 33338), and SEQ ID NOS: 37-112.

23. The gene repressor system of embodiment 21 or embodiment 22, wherein the one or more NLS are linked at or near the C-terminus of the dCasX or the repressor domain.

24. The gene repressor system of embodiment 21 or embodiment 22, wherein the one or more NLS are linked at or near the N-terminus of the dCasX or the repressor domain.

25. The gene repressor system of embodiment 21 or embodiment 22, wherein the one or more NLS are linked at or near both the N-terminus and the C-terminus of the dCasX or the repressor domain.

26. The gene repressor system of embodiment 21, wherein the one or more NLS are selected from the group of SEQ ID NOS: 37-71 as set forth in Table 5 and are linked at or near the N-terminus of the dCasX or the repressor domain.

27. The gene repressor system of embodiment 21, wherein the one or more NLS are selected from the group of SEQ ID NOS: 72-112 as set forth in Table 6 and are linked at or near the C-terminus of the dCasX or the repressor domain.

28. The gene repressor system of embodiment 21, wherein one or more NLS comprise an NLS selected from the group consisting of SEQ ID NOS: 37-71 as set forth in Table 5 and are linked at or near the N-terminus of the dCasX or the repressor domain, and an NLS selected from the group consisting of SEQ ID NOS: 72-112 as set forth in Table 6 and are linked at or near the C-terminus of the dCasX or the repressor domain.

29. The gene repressor system of any one of embodiments 21-28, wherein the one or more NLS are linked to the dCasX variant protein, the repressor domain, or to adjacent NLS with one or more linker peptides wherein the linker peptides are selected from the group consisting of RS, (G)n (SEQ ID NO: 33240), (GS)n (SEQ ID NO: 33241), (GGS)n (SEQ ID NO: 33242), (GSGGS)n (SEQ ID NO: 33243), (GGSGGS)n (SEQ ID NO: 33244), (GGGS)n (SEQ ID NO: 33245), GGSG (SEQ ID NO: 33246), GGSGG (SEQ ID NO: 33247), GSGSG (SEQ ID NO: 33248), GSGGG (SEQ ID NO: 33249), GGGSG (SEQ ID NO: 33250), GSSSG (SEQ ID NO: 33251), (GP)n (SEQ ID NO: 33252), GPGP (SEQ ID NO: 33253), GGSGGGS (SEQ ID NO: 33254), GGP, PPP, PPAPPA (SEQ ID NO: 33255), PPPGPPP (SEQ ID NO: 33256), PPPG (SEQ ID NO: 33257), PPP(GGGS)n (SEQ ID NO: 33258), (GGGS)nPPP (SEQ ID NO: 33259), AEAAAKEAAAKEAAAKA (SEQ ID NO: 33260), AEAAAKEAAAKA (SEQ ID NO: 33261), SGSETPGTS-ESATPES (SEQ ID NO: 33262), and TPPKTKRKVEFE (SEQ ID NO: 33263), wherein n is an integer of 1 to 5.

30. The gene repressor complex of any one of embodiments 21-29, wherein the fusion protein is configured according to a configuration as portrayed in FIG. 7.

31. The gene repressor system of any one of embodiments 1-30, wherein the gRNA has a scaffold comprising a sequence selected from the group consisting of SEQ ID NOS: 2238-2331 and 57544-57589 as set forth in Table 2, or a sequence having at least about 85%, at least about 90%, at least about 95%, at least about 96%, at least about 97%, at least about 98%, or at least about 99% sequence identity thereto.

32. The gene repressor system of any one of embodiments 1-31, wherein the gRNA has a scaffold comprising a sequence selected from the group consisting of SEQ ID NOS: 2238-2331 and 57544-57589, as set forth in Table 2.

33. The gene repressor system of any one of embodiments 1-32, wherein the gRNA comprises a targeting sequence having 15, 16, 17, 18, 19, 20, or 21 nucleotides.

34. The gene repressor system of embodiment 33, wherein the target nucleic acid sequence complementary to the targeting sequence is within 1 kb of a transcription start site (TSS) in the gene.

35. The gene repressor system of embodiment 33, wherein the target nucleic acid sequence complementary to the targeting sequence is within 500 bps upstream to 500 bps downstream of a TSS of the gene.

36. The gene repressor system of embodiment 33, wherein the target nucleic acid sequence complementary to the targeting sequence is within 300 bps upstream to 300 bps downstream of a TSS of the gene.

37. The gene repressor system of embodiment 33, wherein the target nucleic acid sequence complementary to the targeting sequence is within 1 kb of an enhancer of the gene.

38. The gene repressor system of embodiment 33, wherein the target nucleic acid sequence complementary to the targeting sequence is within the 3' untranslated region of the gene.

39. The gene repressor system of embodiment 33, wherein the target nucleic acid sequence complementary to the targeting sequence is within an exon of the gene.

40. The gene repressor system of embodiment 39, wherein the target nucleic acid sequence complementary to the targeting sequence is within exon 1 of the gene.

41. The gene repressor system of any one of embodiments 1-40, wherein the RNP is capable of binding to the target nucleic acid but is not capable of cleaving the target nucleic acid.

42. A nucleic acid encoding the fusion protein of the gene repressor system of any one of embodiments 1-41.

43. A nucleic acid encoding the gRNA of the gene repressor system of any one of embodiments 1-41.

44. The nucleic acid of embodiment 42, wherein the nucleic acid sequence is codon optimized for expression in a eukaryotic cell.

45. A lipid nanoparticle comprising the nucleic acid of embodiment 42.

46. A lipid nanoparticle comprising the nucleic acid of embodiment 43.

47. A lipid nanoparticle comprising a first nucleic acid encoding the fusion protein and a second nucleic acid comprising the gRNA of the repressor system of any one of embodiments 1-41.

48. A lipid nanoparticle composition comprising a first population of lipid nanoparticles and a second population of lipid nanoparticles, and nucleic acids encoding the gene repressor system of any one of embodiments 1-41, wherein the first population comprises lipid nanoparticles that encapsidate a first nucleic acid encoding the fusion protein and the second population of lipid nanoparticles comprises nanoparticles that encapsidate a second nucleic acid encoding the gRNA or that comprises the gRNA.

49. A vector comprising the nucleic acid of any one of embodiments 42-44.

50. The vector of embodiment 49, wherein the vector is selected from the group consisting of a retroviral vector, a lentiviral vector, an adenoviral vector, an adeno-associated viral (AAV) vector, a herpes simplex virus (HSV) vector, a virus-like particle (VLP) vector, a plasmid, a minicircle, a nanoplasmid, and an RNA vector.

51. The vector of embodiment 50, wherein the vector is an AAV vector.

52. The vector of embodiment 51, wherein the AAV vector is selected from AAV1, AAV2, AAV3, AAV4, AAV5, AAV6, AAV7, AAV8, AAV9, AAV10, AAV11, AAV12, AAV 44.9, AAV-Rh74, or AAVRh10.

53. The vector of embodiment 51 or embodiment 52, wherein the nucleic acid encoding the fusion protein and the gRNA are incorporated as a transgene between a 5' and a 3' inverted terminal repeat (ITR) sequence within the AAV.

54. A delivery particle system (XDP) comprising:

(a) one or more components of selected from the group consisting of a matrix protein (MA), a nucleocapsid protein (NC), a capsid protein (CA), a p1 peptide, a p6 peptide, a p2A peptide, a p2B peptide, a p10 peptide, a p12 peptide, a pp21/24 peptide, a p12/p3/p8 peptide, a p20 peptide, an MS2 coat protein, PP7 coat protein, Q coat protein, U1A signal recognition particle, phage R-loop, Rev protein, and Psi packaging element;

(b) an RNP comprising the gene repressor system of any one of embodiments 1-41 wherein the RNP is encapsidated within the XDP;

(c) a tropism factor incorporated on the XDP surface that provides for binding and fusion of the XDP to a target cell.

55. The XDP of embodiment 54, wherein the tropism factor is selected from the group consisting of a pseudotyping viral envelope glycoprotein, an antibody fragment, or a cell receptor fragment.

56. A method of repressing transcription of a target nucleic acid sequence of a gene in a population of cells, the method comprising introducing into the cells:

(a) an RNP comprising the gene repressor system of any one of embodiments 1-41;

(b) the nucleic acid of any one of embodiments 42-44;

(c) the vector of any one of embodiments 49-53;

(d) the XDP of embodiment 54 or 55;

(e) the lipid nanoparticle of any one of embodiments 45-47; or (f) the lipid nanoparticle composition of embodiment 48, wherein upon binding of the RNP of the gene repressor system to the target nucleic acid, transcription of the gene proximal to the binding location of the RNP is repressed in the cells.

57. The method of embodiment 56, wherein the binding location of the RNP is selected from the group consisting of:

(a) a sequence within 300 to 1,000 base pairs 5' to a transcription start site (TSS) in the gene;

(b) a sequence within 300 to 1,000 base pairs 3' to a TSS in the gene;

(c) a sequence within 300 to 1,000 base pairs to an enhancer of the gene;

(d) a sequence within the open reading frame of the gene;

(e) a sequence within an exon of the gene; or (f) a sequence in the 3' untranslated region (UTR) of the gene.

58. The method of embodiment 56 or embodiment 57, wherein transcription of the gene is repressed 5' to the binding location of the RNP.

59. The method of embodiment 56 or embodiment 57, wherein transcription of the gene is repressed 3' to the binding location of the RNP.

60. The method of any one of embodiments 56-59, wherein transcription of the gene in the population of cells is repressed by at least about 10%, at least about 20%, at least about 30%, at least about 40%, at least about 50%, at least about 60%, at least about 70%, at least about 75%, at least about 80%, at least about 85%, at least about 90%, at least about 95%, or at least 99% greater compared to untreated cells, when assessed in an in vitro assay.

61. The method of any one of embodiments 56-60, wherein off-target methylation or off-target transcription repression is less than about 10%, less than about 9%, less than about 8%, less than about 7%, less than about 6%, less than about 5%, less than about 4%, less than about 3%, less than about 2%, or less than about 1% in the cells, when assessed in an in vitro assay.

62. The method of any one of embodiments 56-61, wherein the repression of transcription in the cells is sustained for at least about 8 hours, at least about 1 day, at least about 7 days, at least about 1 month, or at least about 2 months.

63. The method of any one of embodiments 56-62, further comprising a second gRNA or a nucleic acid encoding the second gNA, wherein the second gNA has a targeting sequence complementary to a different portion of the target nucleic acid sequence and is capable of forming a ribonuclear protein complex (RNP) with the fusion protein comprising the catalytically-dead Class 2, Type V CRISPR protein and the one or more transcription repressor domains.

64. The method of any one of embodiments 56-63, wherein the method mediates a heritable epigenetic change in the gene of the cells.

65. A method of treating a subject with a disorder caused by a genetic mutation, comprising administering a therapeutically-effective dose of:

(a) the AAV vector of any one of embodiments 51-53;

(b) the XDP of embodiment 54 or embodiment 55;

(c) the lipid nanoparticle of any one of embodiments 45-47; or (d) the lipid nanoparticle composition of embodiment 48;

wherein upon binding of the RNP of the gene repressor system to the target nucleic acid of a gene in cells of the subject transcription of the gene proximal to the binding location of the RNP is repressed.

66. The method of embodiment 65, wherein transcription of the gene is repressed 5' to the binding location of the RNP.

67. The method of embodiment 65, wherein transcription of the gene is repressed 3' to the binding location of the RNP.

68. The method of any one of embodiments 65, wherein transcription of the gene in the cells is repressed by at least about 10%, at least about 20%, at least about 30%, at least about 40%, at least about 50%, at least about 60%, at least about 70%, at least about 75%, at least about 80%, at least about 85%, at least about 90%, at least about 95%, or at least 99%.

69. The method of any one of embodiments 65, wherein the repression of transcription of the gene in the cells is sustained for at least about 8 hours, at least about 1 day, at least about 7 days, at least about 1 month, or at least about 2 months.

70. The method of any one of embodiments 65-69, wherein the method mediates a heritable epigenetic change in the gene of the cells of the subject.

71. The method of any one of embodiments 65-70, wherein the AAV vector, XDP, or the lipid nanoparticles are administered to the subject by a route of administration selected from subcutaneous, intradermal, intraneural, intranodal, intramedullary, intramuscular, intralumbar, intrathecal, subarachnoid, intraventricular, intracapsular, intravenous, intralymphatical, or intraperitoneal routes, wherein the administering method is injection, transfusion, or implantation, or combinations thereof.

72. The method of embodiment 71, wherein the XDP or the lipid nanoparticles are administered at a dose of at least about $1\times10^5$ particles/kg, or at least about $1\times10^6$ particles/kg, or at least about $1\times10^7$ particles/kg, or at least about $1\times10^8$ particles/kg, or at least about $1\times10^9$ particles/kg, or at least about $1\times10^{10}$ particles/kg, or at least about $1\times10^{11}$ particles/kg, or at least about $1\times10^{12}$ particles/kg, or at least about $1\times10^{13}$ particles/kg, or at least about $1\times10^{14}$ particles/kg, or at least about $1\times10^{15}$ particles/kg, or at least about $1\times10^{16}$ particles/kg.

73. The method of embodiment 71, wherein the XDP or the lipid nanoparticles are administered to the subject at a dose of at least about $1\times10^5$ particles/kg to about $1\times10^{16}$ particles/kg, or at least about $1\times10^6$ particles/kg to about $1\times10^{15}$ particles/kg, or at least about $1\times10^7$ particles/kg to about $1\times10^{14}$ particles/kg.

74. The method of embodiment 71, wherein the AAV vector is administered to the subject at a dose of at least about $1\times10^8$ vector genomes (vg), at least about $1\times10^5$ vector genomes/kg (vg/kg), at least about $1\times10^6$ vg/kg, at least about $1\times10^7$ vg/kg, at least about $1\times10^8$ vg/kg, at least about $1\times10^9$ vg/kg, at least about $1\times10^{10}$ vg/kg, at least about $1\times10^{11}$ vg/kg, at least about $1\times10^{12}$ vg/kg, at least about $1\times10^{13}$ vg/kg, at least about $1\times10^{14}$ vg/kg, at least about $1\times10^{15}$ vg/kg, or at least about $1\times10^{16}$ vg/kg.

75. The method of embodiment 71, wherein the AAV vector is administered to the subject at a dose of at least about $1\times10^5$ vg/kg to about $1\times10^{16}$ vg/kg, at least about $1\times10^6$ vg/kg to about $1\times10^{15}$ vg/kg, or at least about $1\times10^7$ vg/kg to about $1\times10^{14}$ vg/kg.

76. The method of embodiment 71, wherein the first and second lipid nanoparticles are each administered at a dose of at least about $1\times10^5$ particles/kg, or at least about $1\times10^6$ particles/kg, or at least about $1\times10^7$ particles/kg, or at least about $1\times10^8$ particles/kg, or at least about $1\times10^9$ particles/kg, or at least about $1\times10^{10}$ particles/kg, or at least about $1\times10^{11}$ particles/kg, or at least about $1\times10^{12}$ particles/kg, or at least about $1\times10^{13}$ particles/kg, or at least about $1\times10^{14}$ particles/kg, or at least about $1\times10^{15}$ particles/kg, or at least about $1\times10^{16}$ particles/kg.

77. The method of embodiment 71, wherein the first and the second lipid nanoparticles are each administered to the subject at a dose of at least about $1\times10^5$ particles/kg to about $1\times10^{16}$ particles/kg, or at least about $1\times10^6$ particles/kg to about $1\times10^{15}$ particles/kg, or at least about $1\times10^7$ particles/kg to about $1\times10^{14}$ particles/kg.

78. The method of any one of embodiments 65-77, wherein the XDP, the AAV vector, or the first and second lipid nanoparticles are administered to the subject according to a treatment regimen comprising one or more consecutive doses.

79. The method of any one of embodiments 65-78, wherein the therapeutically effective dose is administered to the subject as two or more doses over a period of at least two weeks, or at least one month, or at least two months, or at least three months, or at least four months, or at least five months, or at least six months, or once a year.

80. The method of any one of embodiments 65-79, wherein the treating results in improvement in at least one clinically-relevant endpoint associated with the disorder in the subject.

81. The method of any one of embodiments 65-79, wherein the subject is selected from the group consisting of mouse, rat, pig, and non-human primate.

82. The method of any one of embodiments 65-79, wherein the subject is human.

83. A pharmaceutical composition comprising the gene repressor system of any one of embodiments 1-41 and a pharmaceutically acceptable excipient.

84. The gene repressor system of any one of embodiments 1-41 for use as a medicament in the treatment of a subject a disorder caused by a genetic mutation.

85. The gene repressor system of any one of embodiments 1-41, wherein the targeting sequence of the gRNA is complementary to a non-target strand sequence located 1 nucleotide 3' of a protospacer adjacent motif (PAM) sequence.

86. The composition of embodiment 85, wherein the PAM sequence comprises a TC motif.

87. The composition of embodiment 85 or embodiment 86, wherein the PAM sequence comprises ATC, GTC, CTC or TTC.

88. The composition of embodiment 85, wherein the PAM sequence comprises a TC motif.

89. The composition of embodiment 85 or embodiment 86, wherein the PAM sequence comprises ATC, GTC, CTC or TTC.

EXAMPLES

Example 1: Demonstration of a Catalytically-Dead CasX Repressor (dXR) System on Repression of B2M at RNA and Protein Levels Experiments were performed to determine if various catalytically-dead CasX repressor (dXR) constructs can act as transcriptional repressors in mammalian cells.

Materials and Methods:

dXR variant plasmids encoding constructs having the configuration of U6-gRNA+Ef1α-NLS-GGS-dCasX491-GGS-KRAB variant-NLS (dCasX491 refers to catalytically-dead CasX 491), were transiently transfected into HEK293T cells in an arrayed 96-well format. These constructs also contained a 2× FLAG sequence, as well as sequences encoding either a gRNA scaffold 174 (SEQ ID NO: 2238) having a spacer (spacer 7.37) targeting the endogenous B2M (beta-2-microglobulin) gene or a non-targeting control (spacer 0.0), which were all cloned upstream of a P2A-puromycin element on the plasmid. Four different effector domains were tested in addition to the "naked" dCasX491 (KRAB variant domains listed in Table 9; spacer sequences listed in Table 10; sequences of additional elements listed in Table 11). The sequences encoding the full dXR molecule are listed in Table 12. The corresponding protein sequences of the dXR molecule are listed in Table 13, and the generic configuration of the dXR molecule is illustrated in FIG. 38. Positive and negative controls based on a catalytically-dead Cas9 nuclease (with or without a ZNF10 repressor) with a B2M-targeting gRNA (spacer 7.14) or a non-targeting gRNA control (spacer 0.0) were included, along with a catalytically-active CasX 491 and gRNA with the same 7.37 and 0.0 spacers. Two days after transfection, total RNA was harvested, and reverse transcribed to generate a cDNA library. Changes in gene expression were calculated by performing qPCR on the targeted gene and a housekeeping gene as reference. Relative gene expression represents the amount of target-specific RNA relative to a reference gene normalized to the non-targeting guide condition for two biological replicates. In addition to the wells used for RNA measurements, a separate set of wells was harvested seven days post-transfection and analyzed for B2M protein expression. Expression of B2M protein was determined by using an antibody that detects the B2M-dependent HLA protein complex on the cell surface. Cells that expressed B2M (B2M+) were measured using flow cytometry, and the relevant data are shown in Table 14.

TABLE 9

Sequences of KRAB domains tested fused to CasX.

| Domain Name | KRAB domain sequence | Construct name | SEQ ID NO |
|---|---|---|---|
| ZIM3 | MNNSQGRVTFEDVTVNFTQGEWQRLNPEQRNLYRDVMLE-NYSNLVSVG QGETTKPDVILRLEQGKEPWLEEEEVLGSGRAEKNG-DIGGQIWKPKDV KESL | dXR1 | 337 |
| ZNF10 | MDAKSLTAWSRTLVTFKDVFVDFTREEWKLLDTAQQIVYRNVMLE-NYK NLVSLGYQLTKPDVILRLEKGEEP | dXR2 | 338 |
| ZNF10- | MDAKSLTAWSRTLVTFKDVFVDFTREEWKLLDTAQQIVYRNVMLE-NYK | dXR3 | 339 |

TABLE 9-continued

| Sequences of KRAB domains tested fused to CasX. | | | |
|---|---|---|---|
| Domain Name | KRAB domain sequence | Construct name | SEQ ID NO |
| MeCP2 | NLVSLGYQLTKPDVILR-LEKGEEPWLVSGGGSGGSGSSPKKKRKVEAS VQVKRVLEKSPGKLLVKMPFQASPGGKGEGGGATTSAQVM-VIKRPGRK RKAEADPQAIPKKRGRKPGSVVAAAAAEAKKKAVKES-SIRSVQETVLP IKKRKTRETVSIEVKEVVKPLLVSTLGEKSGKGLKTCKSPGRK-SKESS PKGRSSSASSPPKKEHHHHHHHAESPKAPMPLLPPPPP-PEPQSSEDPI SPPEPQDLSSSICKEEKMPRAGSLESDGCPKEPAKTQP | | |
| ZNF334 | KMKKFQIPVSFQDLTVNFTQEEWQQLDPAQRLLYRDVMLE-NYSNLVSV GYHVSKPDVIFKLEQGEEPWIVEEFSNQNYPD | dXR4 | 340 |

TABLE 10

| Sequences of spacers tested. | | | | |
|---|---|---|---|---|
| Spacer ID | DNA sequence | SEQ ID NO | RNA sequence | SEQ ID NO |
| 7.37 | GGCCGAGATGTC TCGCTCCG | 341 | GGCCGAGAUGUC UCGCUCCG | 59628 |
| 7.148 | CGCGAGCACAGC TAAGGCCA | 342 | CGCGAGCACAGC UAAGGCCA | 59629 |
| 0.0 | CGAGACGTAATT ACGTCTCG | 343 | CGAGACGUAAUU ACGUCUCG | 59630 |

TABLE 11

Sequences of additional key dXR elements to generate the dXR construct having the configuration illustrated in FIG. 38. Note that buffer sequences are not listed.

| Key component | SEQ ID NO (DNA) | SEQ ID NO (Protein) |
|---|---|---|
| dCasX491 | 57618 | 57619 |
| Linker 3A | 57624 | 57626 |
| Linker 3B | 57625 | |
| NLS A | 57629 | 57631 |
| NLS B | 57630 | |

TABLE 12

DNA sequences of dXR constructs.

| dXR ID | KRAB domain | SEQ ID NO (DNA sequence of dXR encoding construct) |
|---|---|---|
| dXR1 | ZIM3 | 59434 |
| dXR2 | ZNF10 | 59435 |
| dXR3 | ZNF10-MeCP2 | 59436 |
| dXR4 | ZNF334 | 59437 |

TABLE 13

Protein sequences of the dXR molecules.

| dXR ID | KRAB domain | SEQ ID NO (Amino Acid Sequence of dXR Molecule) |
|---|---|---|
| dXR1 | ZIM3 | 59438 |
| dXR2 | ZNF10 | 59439 |
| dXR3 | ZNF10-MeCP2 | 59440 |
| dXR4 | ZNF334 | 59441 |

Results

All conditions with a guide RNA targeting the gene resulted in repression, although the strength of repression varied by the choice of domain (FIG. 1). Catalytically-dead CasX molecules with effector domains depleted most of the targeted RNA in 48 hours (~81% of the RNA is depleted on average) comparable to dCas9-KRAB (~82% of RNA depleted). On the protein level, dCasX confers slight repression on its own (~10% of cells negative at the protein level), but addition of any KRAB domain considerably contributed to further repression (a range of 80-89% of cells were negative for the B2M protein (Table 14). Furthermore, most CasX constructs compared favorably in depleting protein compared to the dCas9 controls (22% of cells negative for dCas9 and 81% of cells negative for dCas9-KRAB) (Table 14).

TABLE 14

Repression of B2M protein levels by CasX and Cas9 molecules and repressor constructs. Data represent biological triplicates.

| Molecule | Spacer | % cells expressing B2M protein* | std deviation |
|---|---|---|---|
| dCas9 | 0.0 | 97.34 | 0.16 |
| dCas9-KRAB | 0.0 | 98.54 | 0.19 |
| CasX | 0.0 | 98.62 | 0.66 |
| dCasX | 0.0 | 95.90 | 0.50 |
| dXR1 | 0.0 | 98.09 | 0.18 |
| dXR2 | 0.0 | 98.01 | 0.11 |
| dXR3 | 0.0 | 97.51 | 0.28 |
| dXR4 | 0.0 | 98.23 | 0.11 |
| dCas9 | 7.14 | 77.87 | 0.15 |
| dCas9-KRAB | 7.14 | 18.83 | 0.45 |
| CasX | 7.37 | 21.60 | 0.56 |
| dCasX | 7.37 | 85.70 | 0.00 |

TABLE 14-continued

Repression of B2M protein levels by CasX and Cas9 molecules and repressor constructs. Data represent biological triplicates.

| Molecule | Spacer | % cells expressing B2M protein* | std deviation |
|---|---|---|---|
| dXR1 | 7.37 | 13.50 | 0.66 |
| dXR2 | 7.37 | 16.90 | 0.96 |
| dXR3 | 7.37 | 10.20 | 0.46 |
| dXR4 | 7.37 | 19.80 | 1.64 |

*Data represent % of cells counted that were positive

In Table 14, dCasX refers to catalytically-dead CasX 491, dXR1-4 refer to dCasX491 fused to the KRAB domains indicated in Table 9, in the following orientation: U6-gRNA+Ef1α-NLS-GGS-dCasX-GGS-KRAB variant-NLS, and CasX refers to catalytically active CasX 491. dCas9-KRAB refers to dCas9 fused to a ZNF10-KRAB domain.

The results demonstrate that dXR can transcriptionally repress an endogenous locus (B2M) resulting in loss of target protein. Furthermore, the addition and choice of transcriptional effector domains affects the overall potency of the molecule.

Example 2: Demonstration of dXR Effectiveness on HBEGF for High-Throughput Screening Experiments were performed to determine the feasibility of using dXR constructs for high-throughput screening of molecules in mammalian cells.

Materials and Methods:

HEK293T cells were seeded in a 6-well plate at 300,000 cells/well and lipofected with 1 μg of plasmid encoding either a CasX molecule (491), a catalytically-dead CasX 491 with the ZNF10-KRAB repressor domain (dXR) and a guide scaffold 174 (SEQ ID NO: 2238) with a spacer targeting the HBEGF gene or a non-targeting spacer. Five combinations of CasX-based molecules and gRNAs with the indicated spacers (Table 15) were transfected into five separate wells. HBEGF is the receptor that mediates entry of diphtheria toxin that, when added to the cells, inhibits translation and leads to cell death. Targeting of the HBEGF gene with a CasX or dXR molecule and targeting gRNA should prevent toxin entry and allow survival of the cells, whereas cells treated with CasX and dXR molecules and a non-targeting gRNA should not survive. One day post-transfection, cells in each transfected well were split into 12 different wells in a 96-well plate and selected with puromycin. Over three days, cells were treated with six different concentrations of diphtheria toxin (0, 0.2, 2, 20, 200, and 2000 ng/mL), and biological duplicates were performed. After another two days, cells were split into fresh media, and total cell counts were measured on an ImageXpress Pico Automated Cell Imaging System.

TABLE 15

Sequences of spacers tested.

| Spacer ID | DNA sequence | SEQ ID NO | RNA sequence | SEQ ID NO | Molecule |
|---|---|---|---|---|---|
| 34.19 | ACTGGGAGGCTCAGCCCATG | 344 | ACUGGGAGGCUCAGCCCAUG | 59631 | CasX |
| 34.21 | TGTTCTGTCTTGAACTAGCT | 345 | UGUUCUGUCUUGAACUAGCU | 59632 | CasX |
| 34.28 | TGAGTGTCTTGTCTTGCTCA | 346 | UGAGUGUCUUGUCUUGCUCA | 59633 | dXR |
| 0.0 | CGAGACGTAATTACGTCTCG | 343 | CGAGACGUAAUUACGUCUCG | 59630 | CasX & dXR |

Results

Figure 2:
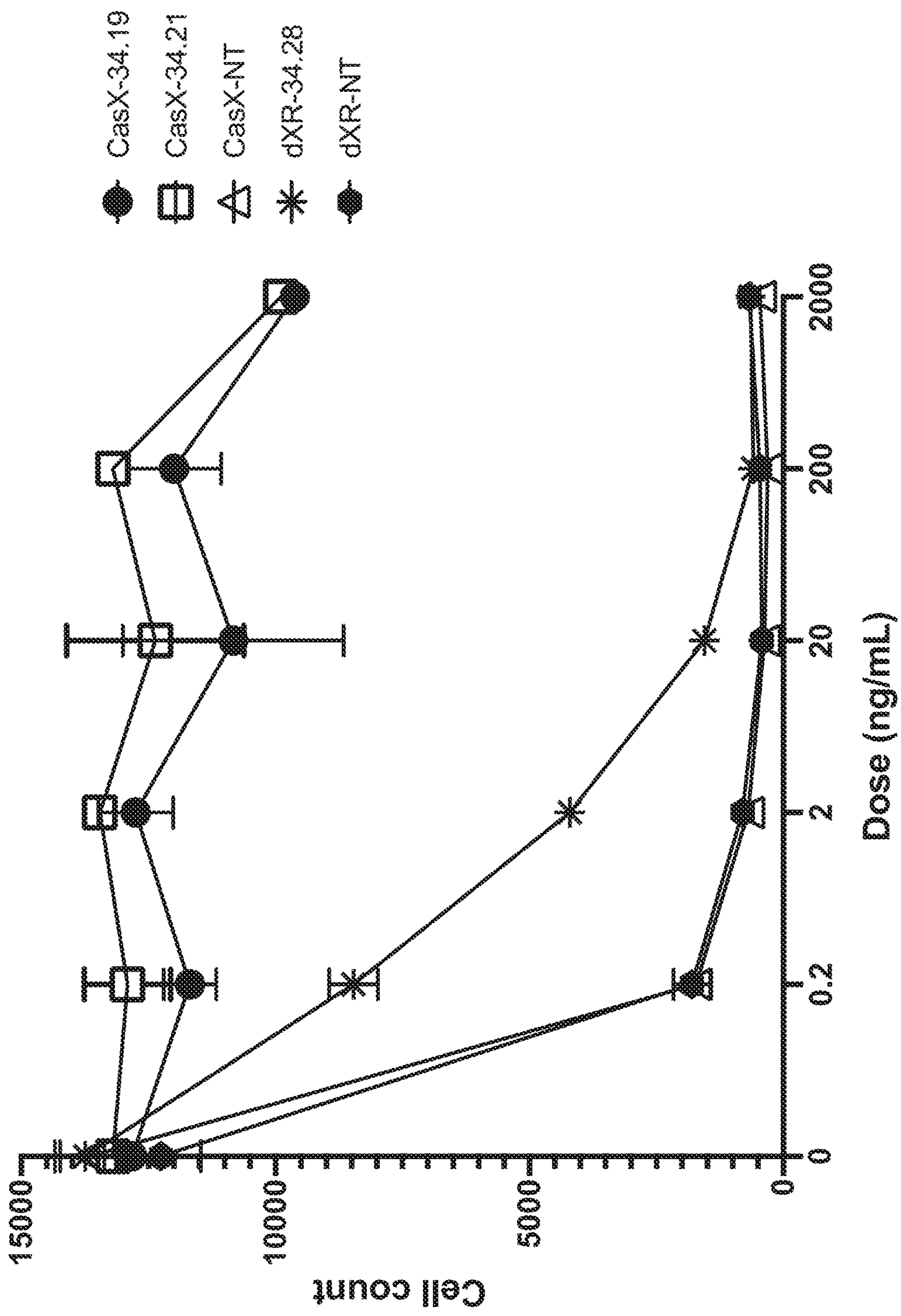
FIG. 2 shows the dose response results of the diphtheria toxin titration for cells transduced with either catalytically active CasX editors with gRNAs targeting the gene encoding the Heparin Binding EGF-like Growth Factor (HBEGF), i.e., CasX-34.19 and CasX-34.21; a catalytically-dead CasX (dCasX) protein linked to a repressor domain as a fusion protein targeted to HBEGF (dXR fusion proteins, i.e., dXR1-34.28); or a non-targeting dXR molecule (CasX-NT or dXR-NT), as described in Example 2. Data represent the mean and standard deviation of two biological replicates.

The results of the diphtheria toxin assay are illustrated in the plot in FIG. 2. dXR-mediated repression of the HBEGF gene resulted in survival of cells, but only at low doses of toxin (0.2-20 ng/mL). However, those same doses led to complete cell death in the control cells treated with non-targeting constructs. High doses (>20 ng/mL) of toxin led to cell death in both the dXR and control samples, suggesting that the basal level of transcription permitted by dXR allows sufficient toxin to enter and trigger cell death. The results show that CasX-edited cells remained protected as editing of the locus leads to complete loss of functional protein. The non-targeting controls died at all doses, demonstrating the efficacy of the toxin when HBEGF is not repressed or edited.

The results show that dXR protects at low doses of toxin, demonstrating that this molecule can be screened in a range of 0.2-20 ng/mL diphtheria toxin, with highest fold-enrichment between dXR and control observed at 0.2 ng/mL. Note that while CasX protects at all doses, repression by dXR still induces low basal expression of the target that leads to toxicity of the cells at high doses of the toxin.

Example 3: Demonstration of the Ability of Catalytically Dead CasX-Based Repressor (dXR) to Repress C9orf72

Experiments were performed to determine if dCasX-based repressors can induce transcriptional silencing of a reporter constructed with the 5'UTR of the C9orf72 gene. This system will allow studying the efficacy of dXR-gRNA combinations in cell types in which C9orf72 is not endogenously expressed and, furthermore, allow high-throughput screening of additional dXR molecules using a gRNA with spacers known to be active in editing systems.

Materials and Methods:

A clonal reporter cell line was constructed by nucleofecting K562 (a human myelogenous leukemia cell line) cells with a plasmid reporter containing the CMV promoter, the C9orf72 complete 5'UTR (Exon1a-Exon1b-Exon2 with all potential ATG start codons mutated and two artificial PAMs added at the 5' and 3' ends), and a coding sequence of TurboGFP-PEST-p2A-HSV_TK. The CMV promoter allows constitutive expression of the reporter, the C9orf72 5'UTR provides a sequence to target with dCasX constructs, and the GFP and TK (Herpes Simplex Virus-1 Thymidine Kinase) proteins provide markers for selection and counter-selection. Specifically, TK metabolizes the typically inert pro-drug ganciclovir into a toxic thymidine analog that leads to cell death. The nucleofected cells were selected in hygromycin for 1 month, sorted to single cells and characterized for ganciclovir sensitivity. A single clone (GFP-TK-c10)

was selected that displayed complete cell death within 5 days at a ganciclovir concentration of 5 μg/mL.

GFP-TK-c10 cells were transduced (250,000 cells; 6-well format) with lentiviruses encoding dXR molecule containing the ZNF10-KRAB domain and gRNA with scaffold 174 (SEQ ID NO: 2238) and spacers targeting the 5'UTR sequence of the C9orf72 locus present in the GFP-TK reporter (Table 16). Transductions were carried out in an arrayed fashion in which one lentivirus was applied to one well of cells. 48 hours after transduction, cells were treated with 5 μg/mL ganciclovir for 5 days and then stained with trypan blue and counted on an automated cell counter.

TABLE 16

Spacers tested in arrayed transductions.

| Spacer ID | DNA sequence | SEQ ID NO | RNA sequence | SEQ ID NO |
|---|---|---|---|---|
| 29.2000 | CGTAACCTACGG TGTCCCGC | 347 | CGUAACCUACGG UGUCCCGC | 59670 |
| 29.168 | TAGCGGGACACC GTAGGTTA | 348 | UAGCGGGACACC GUAGGUUA | 59671 |
| 29.163 | CTTTTGGGGGCG GGGTCTAG | 349 | CUUUUGGGGGCG GGGUCUAG | 59672 |
| 0.0 | CGAGACGTAATT ACGTCTCG | 343 | CGAGACGUAAUU ACGUCUCG | 59630 |

Separately, cells were transduced (250,000 cells; 6-well format) with multiple virus combinations at defined ratios (Table 17). 48 hours post-transduction, half of the cells in each well were harvested and frozen as cell pellets, and the other half were selected in the same manner (5 days; 5 μg/mL ganciclovir). After ganciclovir selection the remaining cells were harvested and gDNA was extracted from both pre- and post-ganciclovir treatment samples. Primers flanking the region containing the spacer sequence in the lentivirus constructs were used to generate amplicons for next generation sequencing analysis in which the ratios of the spacers in each well were compared pre- and post-selection. These ratios were used to calculate spacer fitness scores for each competition by taking the log 2 of the fold change in the spacer frequency from pre-selection to post-selection. Fitness was determined by the following equation:

$$\text{Fitness} = \log_2(\text{spacer frequency post-selection}/\text{spacer frequency pre-selection})$$

TABLE 17

Matrix of competition experiments (each virus present at equal ratio).

| Experiment | 29.2000 (1) | 29.168 (2) | 29.163 (3) | 0.0 (NT) |
|---|---|---|---|---|
| 1 | + | − | − | + |
| 2 | − | + | − | + |
| 3 | − | − | + | + |
| 4 | + | + | − | + |
| 5 | + | − | + | + |
| 6 | − | + | + | + |
| 7 | + | + | + | + |

Results

Figure 3:
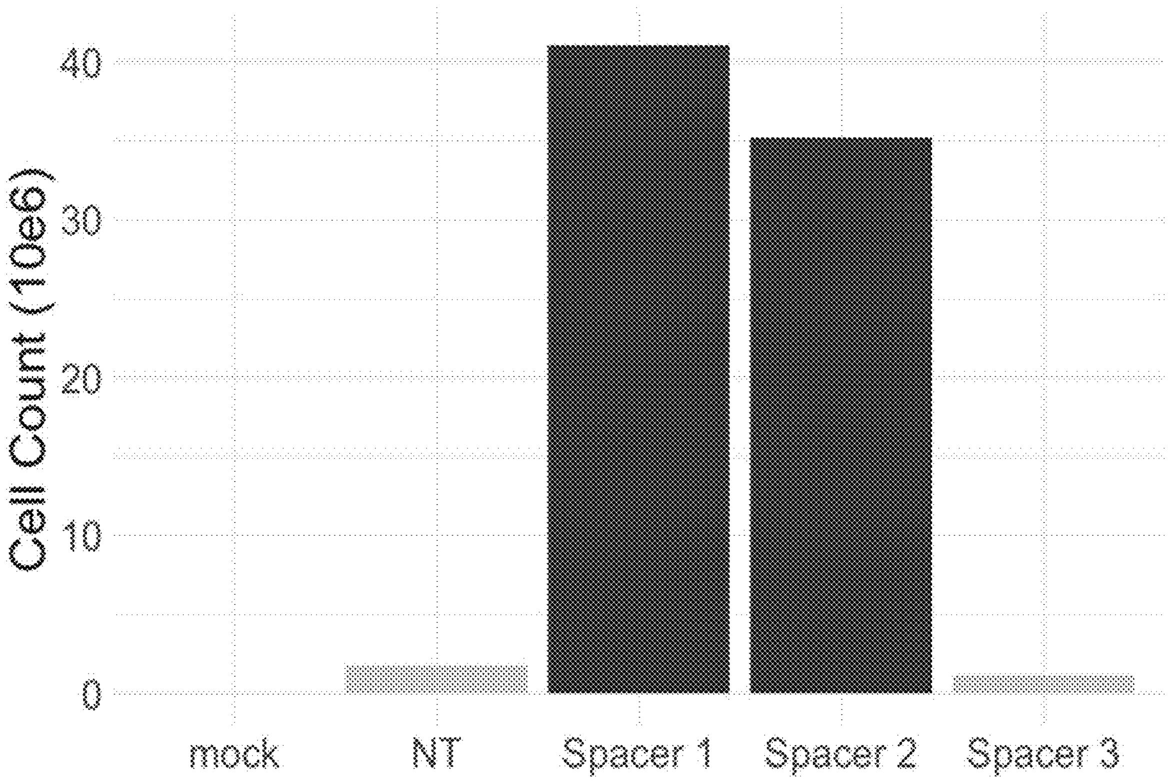
FIG. 3 shows cell counts from arrayed testing of dXR and three spacers targeting the 5'UTR sequence of the C9orf72 locus in a TK-GFP cell line after ganciclovir treatment, as described in Example 3. Data represent single point cell counts after treatment with ganciclovir. NT: non-targeting spacer.

Treatment with dXR containing the ZNF10-KRAB domain and guide 174 with Spacers 1 (29.2000) and 2 (29.168) permitted cell survival (FIG. 3), while mock, NT (0.0) and Spacer 3 (29.163) conditions all resulted in cell death. The results of constructs utilizing Spacers 1 and 2 demonstrate that the combination of a dXR molecule and a C9orf72-targeting spacer can induce potent transcriptional repression, establishing this system as a platform by which to measure dXR and spacer potency at a therapeutically-relevant locus.

Furthermore, measurements of spacer fitness in Table 18 demonstrate the quantitative and reproducible nature of this assay as constructs utilizing Spacers 1 and 2 both permitted cell survival, with Spacer 2 measurably more potent than Spacer 1 in all competitions. Furthermore, constructs with Spacer 3 were ineffective in almost all competitions, demonstrating the utility of this system in screening for effective spacers.

The results demonstrate that dXR molecules can transcriptionally repress therapeutically-relevant sequences and distinguish between functional and non-functional spacers.

TABLE 18

Spacer fitness calculated from lentivirus competition experiments.

| Experiment | Spacer | Fitness* |
|---|---|---|
| 1 | 1 | 0.65 |
| 1 | NT | −3.38 |
| 2 | 2 | 0.88 |
| 2 | NT | −3.10 |
| 3 | 3 | 0.12 |
| 3 | NT | −0.38 |
| 4 | 1 | −0.09 |
| 4 | 2 | 0.83 |
| 5 | 1 | 0.90 |
| 5 | 2 | 0.98 |
| 5 | 3 | −4.40 |
| 5 | NT | −3.44 |

*Data represent the log2 fold change in frequency of spacer counts as measured by next generation sequencing; a positive score indicates a spacer is more fit than the other spacers present in the competition.

Example 4: Development of a Selection to Identify Improved Repressors for Inclusion in dXR Compositions To develop better dXR molecules, a library of transcriptional effector domains from many species was tested in a selection assay. As KRAB domains are one of the largest and most rapidly-evolved domains in vertebrates, domains from species not previously evaluated were anticipated to provide improved strength and permanence of repression.

Materials and Methods:

Identification of Candidate KRAB Domains:

KRAB domains were identified by downloading all sequences annotated with Prosite accession ps50805 (the accession number for KRAB domains). All domains were extended by 100 amino acids (with the annotation centered in the middle) to include potential unannotated functional sequence. In addition, HMMER, a tool to identify domains, was run on a set of high-quality primate annotations from recently completed alignments of long-read primate genome assemblies described (Warren, W C, et al. Sequence diversity analyses of an improved rhesus macaque genome enhance its biomedical utility. Science 370, Issue 6523, eabc6617in (2020); Fiddes, I T, et al. Comparative Annotation Toolkit (CAT)-simultaneous clade and personal genome annotation. Genome Res. 28(7):1029 (2018); Mao, Y, et al. A high-quality bonobo genome refines the analysis of hominid evolution. Nature 594:77 (2021)), to identify KRAB domains in these assemblies most of which were not present in UniProt. The search resulted in 32,120 unique sequences from 159 different organisms that will be tested for their potency in repression. The complete list of sequences is listed as SEQ ID NOS: 355-2100 and 2332-33239. Additionally, 580 random amino acid sequence 80 residues in length were included in the library as negative controls, and 304 human KRAB domains were included based on work by Tycko, J. et al. (*Cell.* 2020 Dec. 23; 183(7):2020-2035).

Screening Methods:

The KRAB domains described above were synthesized as DNA oligos, amplified, and cloned into a dCasX491 C-terminal GS linker lentiviral construct along with guide scaffold 174 (SEQ ID NO: 2238) with either Spacer 34.28 or Spacer 29.168, both of which repress their respective targets (i.e., HBEGF and GFP-TK) and confer survival in the assays described in the above Examples. For each KRAB domain, the C-terminal GS linker was synonymously substituted to produce unique DNA barcodes that could be differentiated by NGS allowing internal technical replicates to be assessed in each pooled experiment. These plasmids were used to generate the lentiviral constructs of the library. The lentiviral library with 29,168 plasmids were used to transduce GFP-TK cells, which were treated with 1 μg/mL puromycin to remove untransduced cells, then 5 μg/mL ganciclovir for 5 days. After selection, gDNA was extracted, and gDNA containing the KRAB domain in the surviving cells was amplified and sequenced.

An analogous assay was performed with the lentiviral library with spacer 34.28 targeting HBEGF. HEK293T cells were transduced, treated with 1 μg/mL puromycin to remove untransduced cells, and selection was carried out at 2 ng/mL diphtheria toxin for 48 hours. gDNA was extracted, amplified, and sequenced as described above. gDNA samples were also extracted, amplified, and sequenced from the cells before selection with ganciclovir or diphtheria toxin, as a control. Two independent replicates were performed for both the diphtheria toxin and GFP-TK selections.

Assessment of B2M Repression:

Representative KRAB domains were cloned into a dCasX491 C-terminal GS linker lentiviral construct along with guide scaffold 316 (SEQ ID NO: 59352) with spacer 7.15 (GGAAUGCCCGCCAGCGCGAC; SEQ ID NO: 59634), targeting the B2M locus. Separately, representative KRAB domains were cloned into a dCasX491 C-terminal GS linker lentiviral construct along with guide scaffold 174 (SEQ ID NO: 2238) with spacer 7.37 (SEQ ID NO: 57644), targeting the B2M locus. The lentiviral plasmid constructs encoding dXRs with various KRAB domains were generated using standard molecular cloning techniques. These constructs included sequences encoding dCasX491, and a KRAB domain from ZNF10, ZIM3, or one of the KRAB domains tested in the library. Cloned and sequence-validated constructs were midi-prepped and subjected to quality assessment prior to transfection in HEK293T cells.

HEK293T cells were seeded at a density of 30,000 cells in each well of a 96-well plate. The next day, each well was transiently transfected using lipofectamine with 100 ng of dXR plasmids, each containing a dXR construct with a different KRAB domain and a gRNA having a targeting spacer to the B2M locus. Experimental controls included dXR constructs with KRAB domains from ZNF10 or ZIM3, KRAB domains that were in the library but not in the top 95 or 1597 KRAB domains, or dCas9-ZNF10, each with a corresponding B2M-targeting gRNA. Each construct was tested in triplicate. 24 hours post-transfection, cells were selected with 1p g/mL puromycin for two days. Seven or ten days after transfection, cells were harvested for editing repression analysis by analyzing B2M protein expression via HLA immunostaining followed by flow cytometry. B2M expression was determined by using an antibody that would detect the B2M-dependent HLA protein expressed on the cell surface. HLA+ cells were measured using the Attune™ NxT flow cytometer.

Data Analysis:

To understand the diversity of protein sequences in the tested KRAB library, an evolutionary scale modeling (ESM) transformer (ESM-1b) was applied to the initial library of 32,120 KRAB domain amino acid sequences to generate a high dimensional representation of the sequences (Rives, A. et al. *Proc Natl Acad Sci USA.* 2021 Apr. 13; 118(15)). Next, Uniform Manifold Approximation and Projection (UMAP) was applied to reduce the data set to a two-dimensional representation of the sequence diversity (McInnes, L., Healy, J., ArXiv e-prints 1802.03426, 2018). Using this technique, 75 clusters of KRAB domain sequences were identified.

Protein sequence motifs were generated using the STREME algorithm (Bailey, T., *Bioinformatics.* 2021 Mar. 24; 37(18):2834-2840) to identify motifs enriched in strong repressors.

Results

Selections were performed to identify the KRAB domains out of a library of 32,120 unique sequences that were the most potent transcriptional repressors. The diphtheria toxin selections produced higher quality NGS libraries and were therefore selected for further analysis. The fold change in the abundance of each KRAB domain in the library before and after selection was calculated for each barcode-KRAB pair such that together the two independent replicates of the experiment represent 12 measurements of each KRAB domain's fitness.

Figure 16:
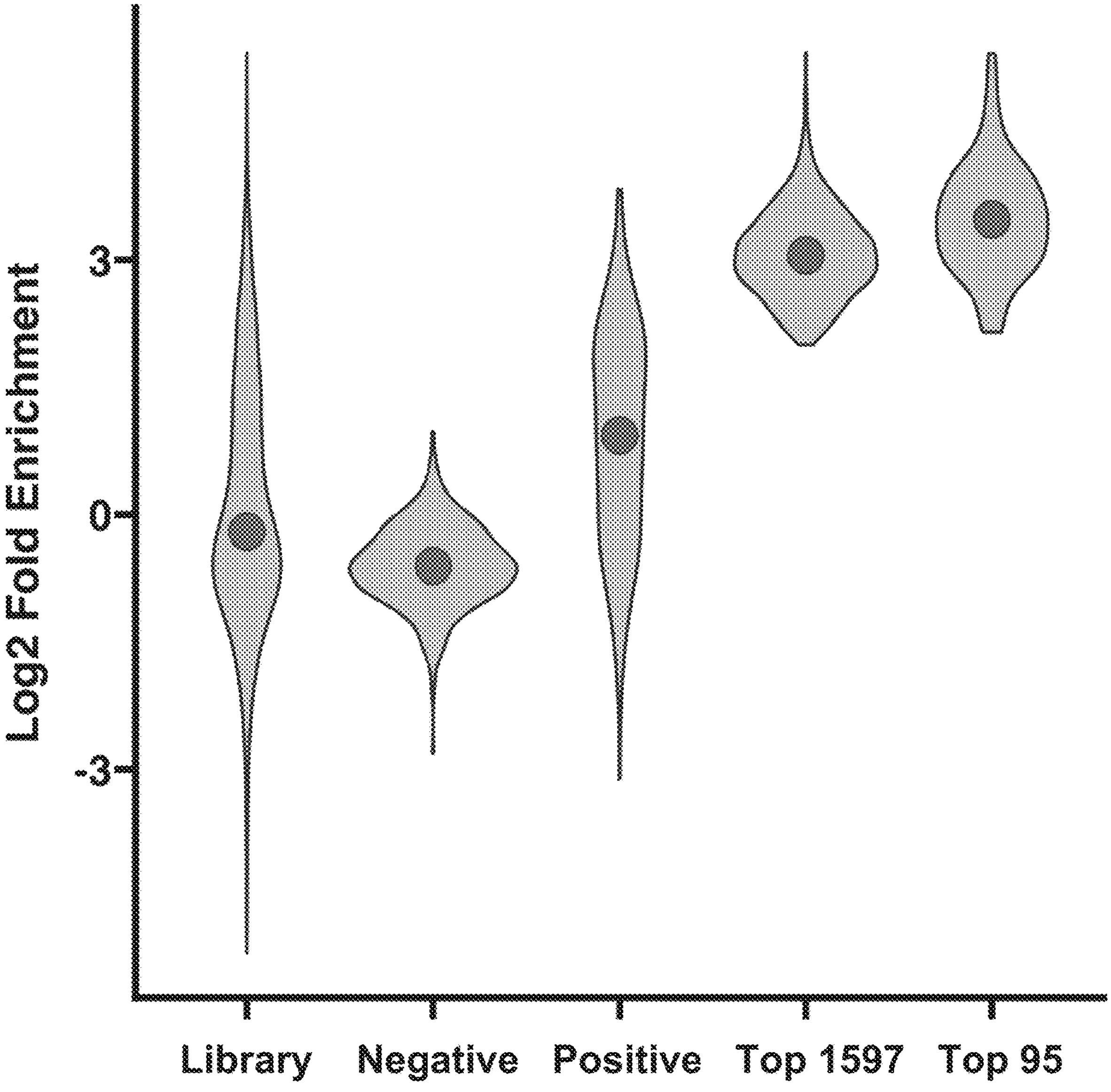
FIG. 16 provides violin plots showing the log 2 (fold change) of sequences before and after selection for their ability to support dXR repression of the HBEGF locus, as described in Example 4. The plots show the results for the entire KRAB domain library, a negative control set of sequences, a positive control set of known KRAB repressors, the top 1597 KRAB domains tested with log 2(fold change)>2 and p-values<0.01, and the top 95 KRAB domains tested.

FIG. 16 shows the range of $\log_2$(fold change) values for the entire library, the randomized sequences that served as negative controls, a positive control set of KRAB domains that were shown to have a $\log_2$(fold change) greater than 1 on day 5 of the HT-recruit experiment performed by Tycko et al. (Cell. 2020 Dec. 23; 183(7):2020-2035). As shown in FIG. 16, the diphtheria toxin selection successfully enriched for KRAB domains that were more potent repressors. The negative control sequences were de-enriched from the library following selection.

To identify the KRAB domains that were reproducibly enriched in the post-selection library, a p-value threshold of less than 0.01 and a log 2(fold change) threshold of greater than 2 was set. 1597 KRAB domains met these criteria. P-values were calculated via the MAGeCK algorithm which uses a permutation test and false discovery rate adjustment for multiple testing (Wei, L. et al. *Genome Biol.* 2014; 15(12):554). The $\log_2$(fold change) values of these top 1597 KRAB domains are shown in FIG. 16, and the amino acid sequences, p-values, and log 2(fold change) values are provided in Table 19, below. In contrast, Zim3 had a log 2(fold change) of 1.7787, standard Znf10 had a $\log_2$(fold change) of 1.3637, and an alternate Znf10 corresponding to the Znf10 KRAB domain used in Tycko, J. et al. (Cell. 2020 Dec. 23; 183(7):2020-2035) had a $\log_2$(fold change) of 1.6182. Therefore, the 1597 top KRAB domains were substantially superior repressors to Znf10 and Zim3. Many of these top KRAB repressors contained amino acids with residues that are predicted to stabilize interactions with the Trim28 protein when compared to Zim3 and Znf10 (Stoll, G. A. et al., bioRxiv 2022.03.17.484746)

To further narrow down the list of KRAB domains while maintaining a breadth of amino acid sequence diversity, a set of 95 lead domains was chosen from within the 1597 by selecting the best domains from each cluster, as well as the top 25 best repressors of the 1597. These top 95 KRAB domains were further narrowed to a top 10 based on by choosing the top domains by log 2(fold change), p-value, and performance in independent repression assays, as described below. The top 10 KRAB domains identified were DOMAIN_737, DOMAIN_10331, DOMAIN_10948, DOMAIN_11029, DOMAIN_17358, DOMAIN_17759, DOMAIN_18258, DOMAIN_19804, DOMAIN_20505, and DOMAIN_26749.

TABLE 19

List of 1,597 KRAB domain candidates identified from the high throughput screen assessing dXR repression of the HBEGF gene and subsequent application of the following criteria: p-value < 0.01 and $\log_2$(fold change) > 2.

| Domain ID | Species | SEQ ID NO | Log2 (fold change) | P-value |
|---|---|---|---|---|
| Top 10 KRAB domains | | | | |
| DOMAIN_737 | Bonobo | 57746 | 4.544 | 1.53E−07 |
| DOMAIN_10331 | *Colobus angolensis palliatus* | 57747 | 3.6796 | 1.53E−07 |
| DOMAIN_10948 | *Colobus angolensis palliatus* | 57748 | 3.2959 | 2.30E−06 |
| DOMAIN_11029 | *Mandrillus leucophaeus* | 57749 | 3.5748 | 1.53E−07 |
| DOMAIN_17358 | *Bos indicus × Bos taurus* | 57750 | 4.9878 | 1.53E−07 |
| DOMAIN_17759 | *Felis catus* | 57751 | 3.3159 | 1.38E−06 |
| DOMAIN_18258 | *Physeter macrocephalus* | 57752 | 3.75 | 3.42E−04 |
| DOMAIN_19804 | *Callorhinus ursinus* | 57753 | 3.8217 | 1.53E−07 |
| DOMAIN_20505 | *Chlorocebus sabaeus* | 57754 | 3.4989 | 2.91E−06 |
| DOMAIN_26749 | *Ophiophagus hannah* | 57755 | 5.4323 | 1.53E−07 |
| Remaining KRAB domains in the top 95 KRAB domains | | | | |
| DOMAIN_221 | Bonobo | 57756 | 3.5533 | 3.06E−06 |
| DOMAIN_881 | Bonobo | 57757 | 4.3546 | 4.59E−07 |
| DOMAIN_2380 | Orangutan | 57758 | 3.2024 | 1.74E−04 |
| DOMAIN_2942 | Gibbon | 57759 | 3.3658 | 1.38E−06 |
| DOMAIN_4687 | Marmoset | 57760 | 5.2288 | 3.22E−06 |
| DOMAIN_4806 | Marmoset | 57761 | 3.3896 | 1.58E−04 |
| DOMAIN_4968 | Marmoset | 57762 | 3.0315 | 0.0022262 |
| DOMAIN_5066 | Marmoset | 57763 | 2.9062 | 0.0067409 |
| DOMAIN_5290 | Owl Monkey | 57764 | 3.0993 | 5.16E−05 |
| DOMAIN_5463 | Owl Monkey | 57765 | 3.2102 | 0.0022788 |
| DOMAIN_6248 | *Saimiri boliviensis boliviensis* | 57766 | 2.4415 | 0.0056883 |
| DOMAIN_6445 | *Alligator sinensis* | 57767 | 3.1151 | 4.51E−04 |
| DOMAIN_6802 | *Pantherophis guttatus* | 57768 | 3.0403 | 5.18E−04 |
| DOMAIN_6807 | *Xenopus laevis* | 57769 | 3.1615 | 5.16E−05 |
| DOMAIN_7255 | *Microcaecilia unicolor* | 57770 | 4.5265 | 1.38E−06 |
| DOMAIN_7694 | *Columba livia* | 57771 | 3.7111 | 1.13E−04 |
| DOMAIN_8503 | *Mus caroli* | 57772 | 2.8193 | 0.003503 |
| DOMAIN_8790 | *Marmota monax* | 57773 | 2.7436 | 2.06E−04 |
| DOMAIN_8853 | *Mesocricetus auratus* | 57774 | 4.6199 | 1.53E−07 |
| DOMAIN_9114 | *Peromyscus maniculatus bairdii* | 57775 | 2.2058 | 0.0048423 |
| DOMAIN_9331 | *Peromyscus maniculatus bairdii* | 57776 | 4.1063 | 4.59E−07 |
| DOMAIN_9538 | *Mus musculus* | 57777 | 3.5443 | 1.20E−04 |
| DOMAIN_9960 | *Octodon degus* | 57778 | 3.4751 | 1.07E−06 |
| DOMAIN_10123 | *Rattus norvegicus* | 57779 | 3.6356 | 8.11E−06 |
| DOMAIN_10277 | *Dipodomys ordii* | 57780 | 2.8257 | 4.16E−04 |
| DOMAIN_10577 | *Colobus angolensis palliatus* | 57781 | 4.1248 | 1.53E−07 |
| DOMAIN_11348 | *Chlorocebus sabaeus* | 57782 | 3.3651 | 2.95E−05 |
| DOMAIN_11386 | *Capra hircus* | 57783 | 3.7637 | 4.75E−06 |
| DOMAIN_11486 | *Bos mutus* | 57784 | 4.8326 | 1.53E−07 |
| DOMAIN_11683 | *Nomascus leucogenys* | 57785 | 2.9249 | 0.0015672 |
| DOMAIN_12292 | *Sus scrofa* | 57786 | 4.3194 | 1.53E−07 |
| DOMAIN_12452 | *Neophocaena asiaeorientalis asiaeorientalis* | 57787 | 3.8774 | 5.05E−06 |
| DOMAIN_12631 | *Macaca fascicularis* | 57788 | 3.6926 | 1.53E−07 |
| DOMAIN_13331 | *Macaca fascicularis* | 57789 | 3.5154 | 2.15E−04 |
| DOMAIN_13468 | *Phascolarctos cinereus* | 57790 | 4.1548 | 1.38E−06 |
| DOMAIN_13539 | Gorilla | 57791 | 3.4924 | 1.79E−05 |
| DOMAIN_14659 | *Acinonyx jubatus* | 57792 | 4.0495 | 1.06E−05 |
| DOMAIN_14755 | *Cebus imitator* | 57793 | 3.1667 | 1.88E−04 |
| DOMAIN_15126 | *Callithrix jacchus* | 57794 | 2.9781 | 4.08E−04 |

TABLE 19-continued

List of 1,597 KRAB domain candidates identified from the high throughput screen assessing dXR repression of the HBEGF gene and subsequent application of the following criteria: p-value < 0.01 and $\log_2$(fold change) > 2.

| Domain ID | Species | SEQ ID NO | Log2 (fold change) | P-value |
|---|---|---|---|---|
| DOMAIN_15507 | *Cebus imitator* | 57795 | 3.8531 | 1.53E−07 |
| DOMAIN_16444 | *Acinonyx jubatus* | 57796 | 3.2246 | 2.30E−06 |
| DOMAIN_16688 | *Lipotes vexillifer* | 57797 | 3.5601 | 4.26E−05 |
| DOMAIN_16806 | *Sapajus apella* | 57798 | 3.9386 | 1.53E−07 |
| DOMAIN_17317 | *Otolemur garnettii* | 57799 | 3.4551 | 1.81E−04 |
| DOMAIN_17432 | *Otolemur garnettii* | 57800 | 3.11 | 1.36E−05 |
| DOMAIN_17905 | Chimp | 57801 | 2.5038 | 5.60E−04 |
| DOMAIN_18137 | *Monodelphis domestica* | 57802 | 3.292 | 3.51E−05 |
| DOMAIN_18216 | *Physeter macrocephalus* | 57803 | 3.0602 | 9.40E−04 |
| DOMAIN_18563 | OwlMonkey | 57804 | 3.0406 | 0.0034849 |
| DOMAIN_19229 | *Enhydra lutris kenyoni* | 57805 | 4.0294 | 5.01E−05 |
| DOMAIN_19460 | *Monodelphis domestica* | 57806 | 3.995 | 1.97E−05 |
| DOMAIN_19476 | OwlMonkey | 57807 | 4.1343 | 1.53E−07 |
| DOMAIN_19821 | *Rhinopithecus roxellana* | 57808 | 3.583 | 1.53E−07 |
| DOMAIN_19892 | *Ursus maritimus* | 57809 | 3.1396 | 5.21E−04 |
| DOMAIN_19896 | *Ovis aries* | 57810 | 2.2228 | 1.58E−04 |
| DOMAIN_19949 | *Callorhinus ursinus* | 57811 | 3.2903 | 2.62E−04 |
| DOMAIN_21247 | *Neovison vison* | 57812 | 2.741 | 0.0043129 |
| DOMAIN_21317 | *Pteropus vampyrus* | 57813 | 4.0893 | 1.18E−05 |
| DOMAIN_21336 | *Equus caballus* | 57814 | 2.738 | 0.005135 |
| DOMAIN_21603 | *Lipotes vexillifer* | 57815 | 2.8535 | 4.35E−04 |
| DOMAIN_21755 | *Equus caballus* | 57816 | 3.1889 | 0.0028238 |
| DOMAIN_22153 | *Zalophus californianus* | 57817 | 3.6967 | 3.52E−06 |
| DOMAIN_22270 | Bonobo | 57818 | 2.3813 | 0.0030391 |
| DOMAIN_23394 | *Vicugna pacos* | 57819 | 4.0769 | 3.06E−07 |
| DOMAIN_23723 | *Carlito syrichta* | 57820 | 3.5301 | 8.71E−05 |
| DOMAIN_24125 | *Saimiri boliviensis boliviensis* | 57821 | 3.9692 | 1.53E−07 |
| DOMAIN_24458 | *Lynx pardinus* | 57822 | 3.4012 | 9.66E−05 |
| DOMAIN_24663 | *Myotis brandtii* | 57823 | 2.9806 | 1.49E−04 |
| DOMAIN_25289 | *Ursus maritimus* | 57824 | 3.4113 | 7.70E−05 |
| DOMAIN_25379 | *Sapajus apella* | 57825 | 3.5892 | 1.53E−07 |
| DOMAIN_25405 | *Desmodus rotundus* | 57826 | 3.8846 | 3.20E−05 |
| DOMAIN_26070 | *Geotrypetes seraphini* | 57827 | 3.7958 | 1.53E−07 |
| DOMAIN_26322 | *Geotrypetes seraphini* | 57828 | 2.9265 | 7.13E−04 |
| DOMAIN_26732 | *Meleagris gallopavo* | 57829 | 2.7548 | 0.0057183 |
| DOMAIN_27060 | *Gopherus agassizii* | 57830 | 2.7943 | 0.0029172 |
| DOMAIN_27385 | *Octodon degus* | 57831 | 4.1339 | 2.77E−05 |
| DOMAIN_27506 | *Bos mutus* | 57832 | 3.8121 | 4.29E−06 |
| DOMAIN_27604 | *Ailuropoda melanoleuca* | 57833 | 2.8198 | 6.05E−05 |
| DOMAIN_27811 | *Callithrix jacchus* | 57834 | 2.9728 | 8.34E−05 |
| DOMAIN_28640 | *Colinus virginianus* | 57835 | 3.624 | 4.13E−06 |
| DOMAIN_28803 | *Monodelphis domestica* | 57836 | 3.0697 | 2.07E−05 |
| DOMAIN_29304 | *Peromyscus maniculatus bairdii* | 57837 | 4.0496 | 1.53E−07 |
| DOMAIN_30173 | *Phyllostomus discolor* | 57838 | 2.2538 | 5.41E−04 |
| DOMAIN_30661 | *Physeter macrocephalus* | 57839 | 2.15 | 4.76E−05 |
| DOMAIN_31643 | *Micrurus lemniscatus lemniscatus* | 57840 | 3.8782 | 3.57E−04 |
| Remaining KRAB domains in the top 1597 KRAB domains | | | | |
| DOMAIN_10870 | *Vicugna pacos* | 57841 | 2.5964 | 0.004315 |
| DOMAIN_10918 | *Odobenus rosmarus divergens* | 57842 | 3.2079 | 9.21E−04 |
| DOMAIN_92 | Bonobo | 57843 | 2.1475 | 0.0021413 |
| DOMAIN_98 | Bonobo | 57844 | 2.7848 | 0.0055875 |
| DOMAIN_134 | Bonobo | 57845 | 2.9322 | 0.004676 |
| DOMAIN_143 | Bonobo | 57846 | 3.63 | 3.17E−05 |
| DOMAIN_145 | Bonobo | 57847 | 3.1497 | 4.09E−05 |
| DOMAIN_214 | Bonobo | 57848 | 2.1073 | 0.00941 |
| DOMAIN_225 | Bonobo | 57849 | 2.259 | 0.0013991 |
| DOMAIN_226 | Bonobo | 57850 | 3.0188 | 2.76E−04 |
| DOMAIN_235 | Bonobo | 57851 | 2.9615 | 0.0016622 |
| DOMAIN_302 | Bonobo | 57852 | 2.5092 | 0.0033327 |
| DOMAIN_313 | Bonobo | 57853 | 2.4558 | 0.0049862 |
| DOMAIN_344 | Bonobo | 57854 | 2.4948 | 0.0087725 |
| DOMAIN_362 | Bonobo | 57855 | 3.6736 | 2.38E−04 |
| DOMAIN_382 | Bonobo | 57856 | 3.1625 | 0.0019781 |
| DOMAIN_389 | Bonobo | 57857 | 3.011 | 3.42E−04 |
| DOMAIN_407 | Bonobo | 57858 | 3.8312 | 1.59E−04 |
| DOMAIN_418 | Bonobo | 57859 | 3.2429 | 1.37E−04 |
| DOMAIN_419 | Bonobo | 57860 | 3.5913 | 5.13E−05 |
| DOMAIN_421 | Bonobo | 57861 | 3.2969 | 1.06E−05 |

TABLE 19-continued

List of 1,597 KRAB domain candidates identified from the high throughput screen assessing dXR repression of the HBEGF gene and subsequent application of the following criteria: p-value < 0.01 and $\log_2$(fold change) > 2.

| Domain ID | Species | SEQ ID NO | Log2 (fold change) | P-value |
|---|---|---|---|---|
| DOMAIN_451 | Bonobo | 57862 | 3.0774 | 0.0018269 |
| DOMAIN_504 | Bonobo | 57863 | 3.2187 | 4.17E−04 |
| DOMAIN_516 | Bonobo | 57864 | 2.0448 | 0.0018554 |
| DOMAIN_621 | Bonobo | 57865 | 2.1025 | 0.0034678 |
| DOMAIN_623 | Bonobo | 57866 | 3.3299 | 6.50E−04 |
| DOMAIN_624 | Bonobo | 57867 | 2.8281 | 0.0031625 |
| DOMAIN_629 | Bonobo | 57868 | 3.6318 | 1.09E−05 |
| DOMAIN_668 | Bonobo | 57869 | 2.9256 | 6.60E−04 |
| DOMAIN_718 | Bonobo | 57870 | 3.9 | 8.73E−06 |
| DOMAIN_731 | Bonobo | 57871 | 2.1318 | 0.0058273 |
| DOMAIN_749 | Bonobo | 57872 | 3.1162 | 0.0060655 |
| DOMAIN_759 | Bonobo | 57873 | 3.3019 | 0.0046077 |
| DOMAIN_761 | Bonobo | 57874 | 3.181 | 9.64E−04 |
| DOMAIN_784 | Bonobo | 57875 | 2.4886 | 0.0083818 |
| DOMAIN_801 | Bonobo | 57876 | 2.4863 | 0.0040602 |
| DOMAIN_802 | Bonobo | 57877 | 2.6563 | 5.66E−04 |
| DOMAIN_811 | Bonobo | 57878 | 2.4706 | 0.0035997 |
| DOMAIN_812 | Bonobo | 57879 | 2.8201 | 0.0013526 |
| DOMAIN_888 | Bonobo | 57880 | 2.8951 | 0.0033756 |
| DOMAIN_893 | Bonobo | 57881 | 2.7511 | 5.41E−04 |
| DOMAIN_938 | Bonobo | 57882 | 2.2926 | 0.0040367 |
| DOMAIN_966 | Chimp | 57883 | 3.3535 | 5.49E−04 |
| DOMAIN_972 | Chimp | 57884 | 3.7627 | 5.59E−05 |
| DOMAIN_980 | Chimp | 57885 | 2.9297 | 0.0011707 |
| DOMAIN_987 | Chimp | 57886 | 2.6881 | 5.48E−04 |
| DOMAIN_999 | Chimp | 57887 | 2.7361 | 0.0038248 |
| DOMAIN_1006 | Chimp | 57888 | 3.2119 | 1.28E−04 |
| DOMAIN_1079 | Chimp | 57889 | 3.7915 | 3.90E−05 |
| DOMAIN_1137 | Chimp | 57890 | 3.1719 | 4.58E−04 |
| DOMAIN_1153 | Chimp | 57891 | 3.7928 | 5.16E−04 |
| DOMAIN_1184 | Chimp | 57892 | 3.2772 | 5.47E−04 |
| DOMAIN_1237 | Chimp | 57893 | 2.1795 | 0.0059151 |
| DOMAIN_1242 | Chimp | 57894 | 2.7144 | 0.0037672 |
| DOMAIN_1247 | Chimp | 57895 | 2.9622 | 4.18E−04 |
| DOMAIN_1378 | Gorilla | 57896 | 3.2279 | 0.0022191 |
| DOMAIN_1381 | Gorilla | 57897 | 4.1424 | 3.35E−05 |
| DOMAIN_1382 | Gorilla | 57898 | 3.0579 | 1.91E−04 |
| DOMAIN_1457 | Gorilla | 57899 | 2.6896 | 0.0026956 |
| DOMAIN_1523 | Gorilla | 57900 | 2.8607 | 0.0042127 |
| DOMAIN_1539 | Gorilla | 57901 | 2.9337 | 0.0028055 |
| DOMAIN_1561 | Gorilla | 57902 | 2.8783 | 0.0011557 |
| DOMAIN_1565 | Gorilla | 57903 | 2.771 | 3.04E−04 |
| DOMAIN_1578 | Gorilla | 57904 | 3.4875 | 5.97E−04 |
| DOMAIN_1621 | Gorilla | 57905 | 3.3004 | 1.20E−04 |
| DOMAIN_1790 | Gorilla | 57906 | 3.0669 | 0.0038707 |
| DOMAIN_1816 | Gorilla | 57907 | 3.108 | 0.0011178 |
| DOMAIN_1818 | Gorilla | 57908 | 3.2866 | 6.15E−04 |
| DOMAIN_1822 | Gorilla | 57909 | 2.4697 | 1.04E−04 |
| DOMAIN_1870 | Gorilla | 57910 | 2.215 | 0.0044522 |
| DOMAIN_1875 | Gorilla | 57911 | 2.5576 | 0.0043383 |
| DOMAIN_1893 | Gorilla | 57912 | 2.3898 | 0.0043422 |
| DOMAIN_1946 | Orangutan | 57913 | 3.1449 | 9.41E−04 |
| DOMAIN_1952 | Orangutan | 57914 | 3.0762 | 5.53E−04 |
| DOMAIN_1964 | Orangutan | 57915 | 2.3009 | 0.0099771 |
| DOMAIN_1978 | Orangutan | 57916 | 3.2215 | 0.0029968 |
| DOMAIN_2014 | Orangutan | 57917 | 2.7323 | 3.95E−04 |
| DOMAIN_2034 | Orangutan | 57918 | 3.7415 | 1.38E−06 |
| DOMAIN_2119 | Orangutan | 57919 | 2.2117 | 0.0054271 |
| DOMAIN_2208 | Orangutan | 57920 | 2.3044 | 0.009903 |
| DOMAIN_2223 | Orangutan | 57921 | 2.6106 | 0.0087315 |
| DOMAIN_2229 | Orangutan | 57922 | 2.9337 | 0.0032308 |
| DOMAIN_2245 | Orangutan | 57923 | 3.2712 | 0.0012727 |
| DOMAIN_2255 | Orangutan | 57924 | 3.1952 | 0.002815 |
| DOMAIN_2295 | Orangutan | 57925 | 3.2816 | 6.61E−04 |
| DOMAIN_2299 | Orangutan | 57926 | 2.5125 | 0.0042678 |
| DOMAIN_2376 | Orangutan | 57927 | 2.1539 | 9.52E−04 |
| DOMAIN_2391 | Orangutan | 57928 | 2.4608 | 0.0045936 |
| DOMAIN_2398 | Orangutan | 57929 | 3.3125 | 3.44E−04 |
| DOMAIN_2470 | Orangutan | 57930 | 2.3815 | 0.0031273 |
| DOMAIN_2499 | Orangutan | 57931 | 3.114 | 0.0050479 |
| DOMAIN_2563 | Orangutan | 57932 | 2.8105 | 0.003781 |
| DOMAIN_2576 | Orangutan | 57933 | 3.1733 | 2.56E−04 |
| DOMAIN_2590 | Orangutan | 57934 | 2.8348 | 0.0091663 |

TABLE 19-continued

List of 1,597 KRAB domain candidates identified from the high throughput screen assessing dXR repression of the HBEGF gene and subsequent application of the following criteria: p-value < 0.01 and $log_2$(fold change) > 2.

| Domain ID | Species | SEQ ID NO | Log2 (fold change) | P-value |
|---|---|---|---|---|
| DOMAIN_2629 | Orangutan | 57935 | 3.092 | 0.0015715 |
| DOMAIN_2652 | Orangutan | 57936 | 4.3981 | 4.59E−07 |
| DOMAIN_2744 | Gibbon | 57937 | 2.863 | 0.003897 |
| DOMAIN_2754 | Gibbon | 57938 | 3.7601 | 1.17E−04 |
| DOMAIN_2786 | Gibbon | 57939 | 2.5449 | 0.0037666 |
| DOMAIN_2806 | Gibbon | 57940 | 3.1649 | 0.0083733 |
| DOMAIN_2808 | Gibbon | 57941 | 2.6227 | 0.0079231 |
| DOMAIN_2813 | Gibbon | 57942 | 2.9522 | 4.12E−04 |
| DOMAIN_2851 | Gibbon | 57943 | 3.3945 | 3.80E−04 |
| DOMAIN_2867 | Gibbon | 57944 | 3.0591 | 4.79E−04 |
| DOMAIN_2888 | Gibbon | 57945 | 2.4267 | 0.0043214 |
| DOMAIN_2891 | Gibbon | 57946 | 2.7489 | 0.0082897 |
| DOMAIN_2896 | Gibbon | 57947 | 2.7253 | 0.0094587 |
| DOMAIN_2904 | Gibbon | 57948 | 2.8035 | 0.0019408 |
| DOMAIN_2908 | Gibbon | 57949 | 2.6452 | 0.0062379 |
| DOMAIN_2943 | Gibbon | 57950 | 2.9574 | 9.75E−04 |
| DOMAIN_2962 | Gibbon | 57951 | 2.1784 | 6.34E−04 |
| DOMAIN_2992 | Gibbon | 57952 | 2.6341 | 0.0045667 |
| DOMAIN_2994 | Gibbon | 57953 | 3.1921 | 0.0022412 |
| DOMAIN_2997 | Gibbon | 57954 | 2.9911 | 0.0016588 |
| DOMAIN_3000 | Gibbon | 57955 | 2.9522 | 5.36E−04 |
| DOMAIN_3062 | Gibbon | 57956 | 2.6076 | 0.0035414 |
| DOMAIN_3087 | Gibbon | 57957 | 2.7999 | 5.44E−04 |
| DOMAIN_3092 | Gibbon | 57958 | 3.1954 | 2.80E−05 |
| DOMAIN_3094 | Gibbon | 57959 | 3.7195 | 2.83E−05 |
| DOMAIN_3096 | Gibbon | 57960 | 3.3962 | 2.16E−04 |
| DOMAIN_3123 | Gibbon | 57961 | 3.1293 | 1.88E−05 |
| DOMAIN_3137 | Gibbon | 57962 | 2.8303 | 0.0038836 |
| DOMAIN_3300 | Gibbon | 57963 | 3.0127 | 2.76E−04 |
| DOMAIN_3328 | Gibbon | 57964 | 2.3718 | 0.0015893 |
| DOMAIN_3332 | Gibbon | 57965 | 2.8786 | 0.0036582 |
| DOMAIN_3335 | Gibbon | 57966 | 4.0001 | 4.75E−06 |
| DOMAIN_3336 | Gibbon | 57967 | 3.5946 | 4.75E−06 |
| DOMAIN_3337 | Gibbon | 57968 | 2.9398 | 0.0053162 |
| DOMAIN_3344 | Gibbon | 57969 | 3.2218 | 4.60E−04 |
| DOMAIN_3373 | Gibbon | 57970 | 3.0768 | 0.0030033 |
| DOMAIN_3434 | Gibbon | 57971 | 2.4767 | 0.0035835 |
| DOMAIN_3463 | Gibbon | 57972 | 3.5462 | 5.96E−04 |
| DOMAIN_3557 | Rhesus | 57973 | 2.4416 | 0.0024889 |
| DOMAIN_3575 | Rhesus | 57974 | 3.7842 | 1.53E−07 |
| DOMAIN_3585 | Rhesus | 57975 | 2.4981 | 0.0036466 |
| DOMAIN_3586 | Rhesus | 57976 | 2.365 | 0.0033728 |
| DOMAIN_3602 | Rhesus | 57977 | 2.0444 | 0.0061662 |
| DOMAIN_3661 | Rhesus | 57978 | 2.4083 | 0.0088114 |
| DOMAIN_3691 | Rhesus | 57979 | 2.8393 | 0.0018244 |
| DOMAIN_3759 | Rhesus | 57980 | 2.5324 | 0.004454 |
| DOMAIN_3760 | Rhesus | 57981 | 2.7025 | 0.0017399 |
| DOMAIN_3781 | Rhesus | 57982 | 2.9317 | 0.0024892 |
| DOMAIN_3782 | Rhesus | 57983 | 2.3058 | 0.0048669 |
| DOMAIN_3803 | Rhesus | 57984 | 3.0165 | 0.0083941 |
| DOMAIN_3832 | Rhesus | 57985 | 2.7334 | 0.0026058 |
| DOMAIN_4030 | Rhesus | 57986 | 2.5274 | 0.0038526 |
| DOMAIN_4036 | Rhesus | 57987 | 2.7725 | 0.001577 |
| DOMAIN_4046 | Rhesus | 57988 | 2.7847 | 0.0088564 |
| DOMAIN_4120 | Rhesus | 57989 | 3.3237 | 4.55E−05 |
| DOMAIN_4121 | Rhesus | 57990 | 3.3195 | 1.53E−07 |
| DOMAIN_4126 | Rhesus | 57991 | 3.529 | 1.65E−04 |
| DOMAIN_4129 | Rhesus | 57992 | 3.7382 | 9.33E−04 |
| DOMAIN_4184 | Rhesus | 57993 | 3.2397 | 9.40E−04 |
| DOMAIN_4185 | Rhesus | 57994 | 2.9116 | 0.0032623 |
| DOMAIN_4199 | Rhesus | 57995 | 2.6844 | 0.0058444 |
| DOMAIN_4239 | Rhesus | 57996 | 4.4187 | 9.19E−07 |
| DOMAIN_4394 | Marmoset | 57997 | 3.8103 | 4.09E−05 |
| DOMAIN_4425 | Marmoset | 57998 | 2.9741 | 0.0087646 |
| DOMAIN_4461 | Marmoset | 57999 | 3.0094 | 0.0076595 |
| DOMAIN_4463 | Marmoset | 58000 | 2.9717 | 0.008252 |
| DOMAIN_4515 | Marmoset | 58001 | 4.2166 | 1.21E−05 |
| DOMAIN_4516 | Marmoset | 58002 | 2.7603 | 0.0027577 |
| DOMAIN_4534 | Marmoset | 58003 | 2.6242 | 0.0034292 |
| DOMAIN_4574 | Marmoset | 58004 | 2.7135 | 9.16E−04 |
| DOMAIN_4580 | Marmoset | 58005 | 2.9618 | 3.22E−06 |
| DOMAIN_4589 | Marmoset | 58006 | 2.507 | 0.0070104 |
| DOMAIN_4665 | Marmoset | 58007 | 3.2985 | 0.0011116 |

TABLE 19-continued

List of 1,597 KRAB domain candidates identified from the high throughput screen assessing dXR repression of the HBEGF gene and subsequent application of the following criteria: p-value < 0.01 and $log_2$(fold change) > 2.

| Domain ID | Species | SEQ ID NO | Log2 (fold change) | P-value |
|---|---|---|---|---|
| DOMAIN_4705 | Marmoset | 58008 | 3.5232 | 5.02E−04 |
| DOMAIN_4722 | Marmoset | 58009 | 4.8639 | 1.53E−07 |
| DOMAIN_4748 | Marmoset | 58010 | 3.0477 | 5.73E−04 |
| DOMAIN_4749 | Marmoset | 58011 | 3.5545 | 2.83E−05 |
| DOMAIN_4751 | Marmoset | 58012 | 3.238 | 4.91E−05 |
| DOMAIN_4774 | Marmoset | 58013 | 2.8894 | 0.0029528 |
| DOMAIN_4823 | Marmoset | 58014 | 2.7527 | 0.0083334 |
| DOMAIN_4913 | Marmoset | 58015 | 2.8878 | 0.0028098 |
| DOMAIN_4921 | Marmoset | 58016 | 3.5291 | 4.44E−06 |
| DOMAIN_4922 | Marmoset | 58017 | 4.0258 | 1.82E−05 |
| DOMAIN_4978 | Marmoset | 58018 | 2.7787 | 0.0025526 |
| DOMAIN_5005 | Marmoset | 58019 | 2.8406 | 0.00183 |
| DOMAIN_5006 | Marmoset | 58020 | 3.8614 | 1.38E−06 |
| DOMAIN_5029 | Marmoset | 58021 | 2.2642 | 0.0022609 |
| DOMAIN_5031 | Marmoset | 58022 | 2.8605 | 0.0025559 |
| DOMAIN_5060 | Marmoset | 58023 | 2.6043 | 8.74E−04 |
| DOMAIN_5096 | Marmoset | 58024 | 2.456 | 0.008963 |
| DOMAIN_5099 | Marmoset | 58025 | 3.1407 | 0.0021138 |
| DOMAIN_5102 | Marmoset | 58026 | 2.7241 | 0.0024099 |
| DOMAIN_5103 | Marmoset | 58027 | 2.1016 | 0.0093552 |
| DOMAIN_5125 | Marmoset | 58028 | 2.911 | 0.0015369 |
| DOMAIN_5188 | OwlMonkey | 58029 | 2.1842 | 0.0046295 |
| DOMAIN_5201 | OwlMonkey | 58030 | 3.3658 | 1.53E−07 |
| DOMAIN_5217 | OwlMonkey | 58031 | 2.4689 | 0.0031316 |
| DOMAIN_5235 | OwlMonkey | 58032 | 3.437 | 4.62E−04 |
| DOMAIN_5246 | OwlMonkey | 58033 | 2.7473 | 0.0042075 |
| DOMAIN_5248 | OwlMonkey | 58034 | 4.1052 | 1.53E−07 |
| DOMAIN_5267 | OwlMonkey | 58035 | 3.1247 | 0.0016383 |
| DOMAIN_5273 | OwlMonkey | 58036 | 2.4023 | 0.0069063 |
| DOMAIN_5299 | OwlMonkey | 58037 | 2.7399 | 0.0093892 |
| DOMAIN_5337 | OwlMonkey | 58038 | 3.7616 | 4.52E−05 |
| DOMAIN_5370 | OwlMonkey | 58039 | 3.0452 | 0.0088803 |
| DOMAIN_5440 | OwlMonkey | 58040 | 2.7871 | 0.0048658 |
| DOMAIN_5485 | OwlMonkey | 58041 | 2.7826 | 0.0080202 |
| DOMAIN_5489 | OwlMonkey | 58042 | 2.6774 | 0.0021808 |
| DOMAIN_5518 | OwlMonkey | 58043 | 2.8542 | 0.0030235 |
| DOMAIN_5527 | OwlMonkey | 58044 | 3.1092 | 0.0016793 |
| DOMAIN_5603 | OwlMonkey | 58045 | 3.2806 | 0.0015418 |
| DOMAIN_5716 | OwlMonkey | 58046 | 3.0606 | 5.36E−04 |
| DOMAIN_5742 | *Homo sapiens* | 58047 | 2.8617 | 0.0029913 |
| DOMAIN_5765 | *Rattus norvegicus* | 58048 | 4.2973 | 1.53E−07 |
| DOMAIN_5774 | *Homo sapiens* | 58049 | 2.9608 | 3.75E−05 |
| DOMAIN_5782 | *Homo sapiens* | 58050 | 2.9086 | 4.56E−04 |
| DOMAIN_5791 | *Homo sapiens* | 58051 | 2.6823 | 0.0051494 |
| DOMAIN_5792 | *Homo sapiens* | 58052 | 3.0218 | 8.56E−04 |
| DOMAIN_5806 | *Homo sapiens* | 58053 | 2.866 | 0.0037801 |
| DOMAIN_5822 | *Homo sapiens* | 58054 | 2.9335 | 0.0074467 |
| DOMAIN_5843 | *Homo sapiens* | 58055 | 3.1821 | 2.83E−05 |
| DOMAIN_5866 | *Homo sapiens* | 58056 | 2.6362 | 0.0080677 |
| DOMAIN_5883 | *Homo sapiens* | 58057 | 3.0097 | 5.52E−04 |
| DOMAIN_5896 | *Bos taurus* | 58058 | 2.9429 | 0.0023166 |
| DOMAIN_5901 | *Homo sapiens* | 58059 | 3.2935 | 0.0012981 |
| DOMAIN_5914 | *Homo sapiens* | 58060 | 2.5527 | 0.0029099 |
| DOMAIN_5921 | *Homo sapiens* | 58061 | 2.4715 | 0.00101 |
| DOMAIN_5943 | *Mus musculus* | 58062 | 2.501 | 0.0027917 |
| DOMAIN_5946 | *Homo sapiens* | 58063 | 3.2998 | 1.38E−06 |
| DOMAIN_5968 | *Bos taurus* | 58064 | 3.2856 | 3.86E−04 |
| DOMAIN_5984 | *Homo sapiens* | 58065 | 2.9852 | 2.37E−04 |
| DOMAIN_5989 | *Mus musculus* | 58066 | 3.6632 | 9.30E−04 |
| DOMAIN_5994 | Orangutan | 58067 | 2.9214 | 5.04E−04 |
| DOMAIN_6038 | *Homo sapiens* | 58068 | 3.3315 | 2.59E−04 |
| DOMAIN_6053 | Orangutan | 58069 | 3.2566 | 1.21E−04 |
| DOMAIN_6063 | *Homo sapiens* | 58070 | 3.5653 | 0.0019059 |
| DOMAIN_6078 | *Homo sapiens* | 58071 | 2.6246 | 0.0075453 |
| DOMAIN_6134 | *Homo sapiens* | 58072 | 2.7081 | 0.0034203 |
| DOMAIN_6169 | *Homo sapiens* | 58073 | 3.3909 | 1.68E−06 |
| DOMAIN_6172 | *Homo sapiens* | 58074 | 3.883 | 1.07E−06 |
| DOMAIN_6249 | *Saimiri boliviensis boliviensis* | 58075 | 3.5469 | 4.44E−06 |

TABLE 19-continued

List of 1,597 KRAB domain candidates identified from the high throughput screen assessing dXR repression of the HBEGF gene and subsequent application of the following criteria: p-value < 0.01 and $log_2$(fold change) > 2.

| Domain ID | Species | SEQ ID NO | Log2 (fold change) | P-value |
|---|---|---|---|---|
| DOMAIN_6293 | *Rattus norvegicus* | 58076 | 2.6707 | 0.0034812 |
| DOMAIN_6354 | *Terrapene carolina triunguis* | 58077 | 2.4812 | 0.0095055 |
| DOMAIN_6356 | *Terrapene carolina triunguis* | 58078 | 2.9197 | 0.0031965 |
| DOMAIN_6382 | *Gopherus agassizii* | 58079 | 3.2875 | 1.66E−04 |
| DOMAIN_6398 | *Gopherus agassizii* | 58080 | 2.8238 | 0.0059966 |
| DOMAIN_6410 | *Podarcis muralis* | 58081 | 2.7633 | 0.0034243 |
| DOMAIN_6433 | *Podarcis muralis* | 58082 | 3.0313 | 1.16E−04 |
| DOMAIN_6458 | *Gopherus agassizii* | 58083 | 2.8973 | 0.0048435 |
| DOMAIN_6472 | *Alligator sinensis* | 58084 | 2.9259 | 0.0052565 |
| DOMAIN_6482 | *Paroedura picta* | 58085 | 3.3106 | 0.0019705 |
| DOMAIN_6501 | *Paroedura picta* | 58086 | 3.4172 | 0.0010204 |
| DOMAIN_6539 | *Paroedura picta* | 58087 | 3.2371 | 0.0025654 |
| DOMAIN_6555 | *Paroedura picta* | 58088 | 3.534 | 4.92E−04 |
| DOMAIN_6577 | *Terrapene carolina triunguis* | 58089 | 3.3168 | 3.95E−04 |
| DOMAIN_6595 | *Terrapene carolina triunguis* | 58090 | 2.2407 | 0.0027133 |
| DOMAIN_6599 | *Terrapene carolina triunguis* | 58091 | 3.3653 | 4.49E−05 |
| DOMAIN_6697 | *Podarcis muralis* | 58092 | 2.6712 | 7.35E−04 |
| DOMAIN_6737 | *Microcaecilia unicolor* | 58093 | 2.4861 | 0.0065704 |
| DOMAIN_6738 | *Microcaecilia unicolor* | 58094 | 2.9275 | 7.79E−04 |
| DOMAIN_6741 | *Microcaecilia unicolor* | 58095 | 3.5726 | 2.50E−04 |
| DOMAIN_6866 | *Alligator mississippiensis* | 58096 | 3.5825 | 1.02E−04 |
| DOMAIN_6936 | *Callipepla squamata* | 58097 | 3.5294 | 9.07E−04 |
| DOMAIN_6938 | *Alligator mississippiensis* | 58098 | 2.6093 | 0.0020584 |
| DOMAIN_6952 | *Alligator mississippiensis* | 58099 | 2.3403 | 0.0084774 |
| DOMAIN_6970 | *Phasianus colchicus* | 58100 | 3.343 | 3.02E−04 |
| DOMAIN_7000 | *Phasianus colchicus* | 58101 | 2.8279 | 0.0039843 |
| DOMAIN_7098 | *Microcaecilia unicolor* | 58102 | 2.7074 | 0.0030553 |
| DOMAIN_7109 | *Microcaecilia unicolor* | 58103 | 2.9932 | 0.0077318 |
| DOMAIN_7123 | *Microcaecilia unicolor* | 58104 | 2.9074 | 0.0043723 |
| DOMAIN_7166 | *Microcaecilia unicolor* | 58105 | 3.1419 | 5.72E−04 |
| DOMAIN_7183 | *Microcaecilia unicolor* | 58106 | 2.4918 | 1.27E−04 |
| DOMAIN_7184 | *Microcaecilia unicolor* | 58107 | 2.2019 | 0.0099168 |
| DOMAIN_7328 | *Terrapene carolina triunguis* | 58108 | 3.1808 | 5.04E−05 |
| DOMAIN_7353 | *Microcaecilia unicolor* | 58109 | 2.6649 | 0.0042219 |
| DOMAIN_7365 | *Microcaecilia unicolor* | 58110 | 2.597 | 0.0042403 |
| DOMAIN_7480 | *Gopherus agassizii* | 58111 | 3.1707 | 5.44E−04 |
| DOMAIN_7510 | *Gopherus agassizii* | 58112 | 3.0452 | 6.73E−04 |
| DOMAIN_7534 | *Gopherus agassizii* | 58113 | 3.4086 | 2.50E−04 |
| DOMAIN_7553 | *Gopherus agassizii* | 58114 | 2.9036 | 0.0088341 |
| DOMAIN_7605 | *Alligator sinensis* | 58115 | 2.8444 | 0.0018789 |
| DOMAIN_7607 | *Alligator sinensis* | 58116 | 2.7102 | 0.0018612 |
| DOMAIN_7641 | *Gallus gallus* | 58117 | 3.6727 | 4.51E−04 |
| DOMAIN_7653 | *Gallus gallus* | 58118 | 3.3772 | 0.0028364 |
| DOMAIN_7678 | *Chelonia mydas* | 58119 | 2.7348 | 0.0039197 |
| DOMAIN_7711 | *Columba livia* | 58120 | 3.7965 | 1.67E−05 |
| DOMAIN_7716 | *Pogona vitticeps* | 58121 | 3.1171 | 0.0011931 |
| DOMAIN_7745 | *Meleagris gallopavo* | 58122 | 3.4946 | 0.0016126 |
| DOMAIN_7750 | *Columba livia* | 58123 | 2.8111 | 0.0012249 |
| DOMAIN_7774 | *Pogona vitticeps* | 58124 | 3.427 | 8.09E−04 |
| DOMAIN_7796 | *Chelonia mydas* | 58125 | 2.9513 | 1.04E−04 |
| DOMAIN_7813 | *Columba livia* | 58126 | 3.4645 | 7.95E−04 |
| DOMAIN_7824 | *Columba livia* | 58127 | 2.9383 | 5.45E−04 |
| DOMAIN_7850 | *Terrapene carolina triunguis* | 58128 | 3.124 | 5.15E−04 |
| DOMAIN_7895 | *Patagioenas fasciata monilis* | 58129 | 3.2254 | 0.0013863 |
| DOMAIN_7925 | *Gallus gallus* | 58130 | 3.3919 | 0.0025195 |
| DOMAIN_8012 | *Callipepla squamata* | 58131 | 3.2046 | 0.0023734 |
| DOMAIN_8013 | *Callipepla squamata* | 58132 | 3.9783 | 2.13E−05 |
| DOMAIN_8014 | *Callipepla squamata* | 58133 | 3.7425 | 6.23E−05 |
| DOMAIN_8036 | *Alligator mississippiensis* | 58134 | 2.3504 | 0.0094483 |
| DOMAIN_8041 | *Dipodomys ordii* | 58135 | 3.6568 | 3.47E−04 |
| DOMAIN_8054 | *Cavia porcellus* | 58136 | 3.5889 | 4.15E−05 |
| DOMAIN_8148 | *Cricetulus griseus* | 58137 | 3.6904 | 4.82E−05 |
| DOMAIN_8151 | *Cricetulus griseus* | 58138 | 3.1527 | 0.0034782 |
| DOMAIN_8154 | *Cricetulus griseus* | 58139 | 2.8774 | 0.0027807 |
| DOMAIN_8167 | *Mus musculus* | 58140 | 3.9362 | 1.04E−04 |

TABLE 19-continued

List of 1,597 KRAB domain candidates identified from the high throughput screen assessing dXR repression of the HBEGF gene and subsequent application of the following criteria: p-value < 0.01 and $\log_2$(fold change) > 2.

| Domain ID | Species | SEQ ID NO | Log2 (fold change) | P-value |
|---|---|---|---|---|
| DOMAIN_8179 | *Mesocricetus auratus* | 58141 | 3.0623 | 0.0026242 |
| DOMAIN_8182 | *Mus caroli* | 58142 | 2.2411 | 0.0018051 |
| DOMAIN_8216 | *Cricetulus griseus* | 58143 | 3.1747 | 9.05E−05 |
| DOMAIN_8226 | *Rattus norvegicus* | 58144 | 2.4602 | 0.0090772 |
| DOMAIN_8235 | *Mus caroli* | 58145 | 2.8965 | 0.0012522 |
| DOMAIN_8282 | *Peromyscus maniculatus bairdii* | 58146 | 3.9882 | 1.07E−06 |
| DOMAIN_8289 | *Peromyscus maniculatus bairdii* | 58147 | 3.3026 | 2.94E−04 |
| DOMAIN_8301 | *Mesocricetus auratus* | 58148 | 3.1084 | 0.0017647 |
| DOMAIN_8303 | *Ictidomys tridecemlineatus* | 58149 | 3.6843 | 1.34E−04 |
| DOMAIN_8305 | *Ictidomys tridecemlineatus* | 58150 | 2.5554 | 0.0084633 |
| DOMAIN_8308 | *Marmota monax* | 58151 | 2.6564 | 3.69E−04 |
| DOMAIN_8317 | *Mus caroli* | 58152 | 3.3091 | 2.40E−05 |
| DOMAIN_8340 | *Peromyscus maniculatus bairdii* | 58153 | 2.2764 | 0.0086378 |
| DOMAIN_8353 | *Peromyscus maniculatus bairdii* | 58154 | 2.7989 | 4.14E−04 |
| DOMAIN_8370 | *Cavia porcellus* | 58155 | 3.5737 | 2.58E−04 |
| DOMAIN_8412 | *Mus musculus* | 58156 | 2.4486 | 0.0077639 |
| DOMAIN_8418 | *Cricetulus griseus* | 58157 | 2.4014 | 0.001307 |
| DOMAIN_8424 | *Peromyscus maniculatus bairdii* | 58158 | 2.7945 | 0.0019818 |
| DOMAIN_8425 | *Peromyscus maniculatus bairdii* | 58159 | 2.8391 | 0.004804 |
| DOMAIN_8460 | *Peromyscus maniculatus bairdii* | 58160 | 3.1352 | 6.66E−05 |
| DOMAIN_8467 | *Mesocricetus auratus* | 58161 | 3.8156 | 7.15E−05 |
| DOMAIN_8489 | *Mus caroli* | 58162 | 2.8336 | 0.0042299 |
| DOMAIN_8492 | *Mus musculus* | 58163 | 3.3107 | 0.0032374 |
| DOMAIN_8502 | *Cricetulus griseus* | 58164 | 2.1429 | 4.22E−04 |
| DOMAIN_8545 | *Rattus norvegicus* | 58165 | 3.1044 | 0.0011282 |
| DOMAIN_8546 | *Mus musculus* | 58166 | 2.9439 | 0.0033958 |
| DOMAIN_8547 | *Mus caroli* | 58167 | 3.3997 | 0.0022286 |
| DOMAIN_8549 | *Mus caroli* | 58168 | 2.8508 | 0.0052033 |
| DOMAIN_8555 | *Cricetulus griseus* | 58169 | 3.2852 | 5.62E−05 |
| DOMAIN_8618 | *Mesocricetus auratus* | 58170 | 2.6363 | 0.008293 |
| DOMAIN_8688 | *Mus musculus* | 58171 | 2.4409 | 2.00E−04 |
| DOMAIN_8689 | *Mus musculus* | 58172 | 2.8548 | 6.62E−04 |
| DOMAIN_8712 | *Mesocricetus auratus* | 58173 | 2.7776 | 0.0028768 |
| DOMAIN_8742 | *Peromyscus maniculatus bairdii* | 58174 | 2.3354 | 0.002149 |
| DOMAIN_8746 | *Mesocricetus auratus* | 58175 | 3.317 | 1.64E−04 |
| DOMAIN_8789 | *Marmota monax* | 58176 | 3.1756 | 0.0021937 |
| DOMAIN_8793 | *Mus caroli* | 58177 | 2.6774 | 9.60E−05 |
| DOMAIN_8816 | *Peromyscus maniculatus bairdii* | 58178 | 2.4156 | 2.32E−04 |
| DOMAIN_8830 | *Cavia porcellus* | 58179 | 3.0644 | 0.0025588 |
| DOMAIN_8839 | *Peromyscus maniculatus bairdii* | 58180 | 3.0637 | 0.0036542 |
| DOMAIN_8844 | *Peromyscus maniculatus bairdii* | 58181 | 4.1629 | 7.81E−06 |
| DOMAIN_8850 | *Peromyscus maniculatus bairdii* | 58182 | 2.695 | 0.0040575 |
| DOMAIN_8862 | *Marmota monax* | 58183 | 2.3521 | 0.0061537 |
| DOMAIN_8881 | *Cricetulus griseus* | 58184 | 3.743 | 1.49E−05 |
| DOMAIN_8886 | *Cricetulus griseus* | 58185 | 3.5727 | 1.94E−05 |
| DOMAIN_8899 | *Mesocricetus auratus* | 58186 | 3.2182 | 9.45E−05 |
| DOMAIN_8931 | *Cricetulus griseus* | 58187 | 2.9497 | 8.73E−04 |
| DOMAIN_8936 | *Cricetulus griseus* | 58188 | 4.3486 | 1.07E−06 |
| DOMAIN_8953 | *Mus caroli* | 58189 | 2.5941 | 0.0032969 |
| DOMAIN_8982 | *Mesocricetus auratus* | 58190 | 3.1585 | 3.54E−05 |
| DOMAIN_8989 | *Marmota monax* | 58191 | 2.2309 | 0.0094553 |
| DOMAIN_9012 | *Mus musculus* | 58192 | 2.3905 | 0.0070058 |
| DOMAIN_9042 | *Mus caroli* | 58193 | 2.5894 | 0.0033885 |
| DOMAIN_9060 | *Cricetulus griseus* | 58194 | 2.5974 | 0.0027286 |
| DOMAIN_9119 | *Mesocricetus auratus* | 58195 | 2.2985 | 0.0052412 |
| DOMAIN_9141 | *Mus caroli* | 58196 | 3.035 | 2.62E−05 |
| DOMAIN_9159 | *Dipodomys ordii* | 58197 | 3.0141 | 0.0023052 |
| DOMAIN_9174 | *Peromyscus maniculatus bairdii* | 58198 | 2.5194 | 0.0035749 |
| DOMAIN_9175 | *Peromyscus maniculatus bairdii* | 58199 | 2.4231 | 0.0042293 |

TABLE 19-continued

List of 1,597 KRAB domain candidates identified from the high throughput screen assessing dXR repression of the HBEGF gene and subsequent application of the following criteria: p-value < 0.01 and $\log_2$(fold change) > 2.

| Domain ID | Species | SEQ ID NO | Log2 (fold change) | P-value |
|---|---|---|---|---|
| DOMAIN_9189 | *Heterocephalus glaber* | 58200 | 3.3801 | 1.76E−04 |
| DOMAIN_9192 | *Mus caroli* | 58201 | 2.7981 | 0.008526 |
| DOMAIN_9217 | *Mesocricetus auratus* | 58202 | 3.8919 | 5.43E−05 |
| DOMAIN_9235 | *Mus musculus* | 58203 | 2.7307 | 0.0035899 |
| DOMAIN_9250 | *Marmota monax* | 58204 | 3.466 | 0.0012007 |
| DOMAIN_9265 | *Mus musculus* | 58205 | 2.1221 | 0.0021172 |
| DOMAIN_9290 | *Peromyscus maniculatus bairdii* | 58206 | 4.256 | 1.07E−06 |
| DOMAIN_9303 | *Marmota monax* | 58207 | 2.5344 | 0.0051732 |
| DOMAIN_9313 | *Mus musculus* | 58208 | 2.7692 | 0.0061916 |
| DOMAIN_9324 | *Peromyscus maniculatus bairdii* | 58209 | 3.1782 | 0.0020198 |
| DOMAIN_9329 | *Peromyscus maniculatus bairdii* | 58210 | 4.263 | 7.81E−06 |
| DOMAIN_9332 | *Peromyscus maniculatus bairdii* | 58211 | 3.9002 | 1.38E−06 |
| DOMAIN_9356 | *Ictidomys tridecemlineatus* | 58212 | 2.9297 | 0.0037302 |
| DOMAIN_9389 | *Marmota monax* | 58213 | 3.1785 | 2.65E−05 |
| DOMAIN_9424 | *Dipodomys ordii* | 58214 | 3.771 | 1.53E−07 |
| DOMAIN_9435 | *Fukomys damarensis* | 58215 | 3.1672 | 3.01E−04 |
| DOMAIN_9446 | *Marmota monax* | 58216 | 2.8722 | 3.80E−04 |
| DOMAIN_9489 | *Dipodomys ordii* | 58217 | 3.0215 | 0.0074336 |
| DOMAIN_9503 | *Ictidomys tridecemlineatus* | 58218 | 2.9864 | 0.0021536 |
| DOMAIN_9526 | *Mesocricetus auratus* | 58219 | 2.9435 | 0.0042492 |
| DOMAIN_9530 | *Mesocricetus auratus* | 58220 | 2.7003 | 0.0026178 |
| DOMAIN_9541 | *Dipodomys ordii* | 58221 | 2.8442 | 0.0028404 |
| DOMAIN_9542 | *Octodon degus* | 58222 | 2.6734 | 0.0036809 |
| DOMAIN_9544 | *Octodon degus* | 58223 | 2.9143 | 0.0054966 |
| DOMAIN_9559 | *Mus caroli* | 58224 | 3.327 | 0.001653 |
| DOMAIN_9563 | *Mus musculus* | 58225 | 3.7261 | 3.81E−05 |
| DOMAIN_9576 | *Octodon degus* | 58226 | 2.1952 | 0.0094564 |
| DOMAIN_9617 | *Mesocricetus auratus* | 58227 | 2.4034 | 0.0040152 |
| DOMAIN_9643 | *Dipodomys ordii* | 58228 | 3.4306 | 0.0023603 |
| DOMAIN_9697 | *Octodon degus* | 58229 | 2.7566 | 0.0063579 |
| DOMAIN_9704 | *Dipodomys ordii* | 58230 | 3.1674 | 0.0013462 |
| DOMAIN_9706 | *Octodon degus* | 58231 | 2.821 | 0.0041809 |
| DOMAIN_9713 | *Cricetulus griseus* | 58232 | 3.0323 | 0.002243 |
| DOMAIN_9716 | *Mus caroli* | 58233 | 2.9009 | 0.0040762 |
| DOMAIN_9723 | *Mus caroli* | 58234 | 2.1903 | 0.0058971 |
| DOMAIN_9725 | *Mus caroli* | 58235 | 2.9654 | 0.0028095 |
| DOMAIN_9776 | *Marmota monax* | 58236 | 2.6258 | 0.0084697 |
| DOMAIN_9787 | *Mus caroli* | 58237 | 3.2962 | 8.37E−05 |
| DOMAIN_9789 | *Mus musculus* | 58238 | 2.5801 | 0.0012534 |
| DOMAIN_9822 | *Ictidomys tridecemlineatus* | 58239 | 2.9382 | 0.0065879 |
| DOMAIN_9824 | *Heterocephalus glaber* | 58240 | 3.1306 | 8.34E−05 |
| DOMAIN_9827 | *Mus caroli* | 58241 | 2.1904 | 0.0077554 |
| DOMAIN_9843 | *Mus musculus* | 58242 | 2.3385 | 0.0035982 |
| DOMAIN_9846 | *Cricetulus griseus* | 58243 | 2.7865 | 0.0025033 |
| DOMAIN_9857 | *Mesocricetus auratus* | 58244 | 3.3666 | 8.92E−04 |
| DOMAIN_9858 | *Mesocricetus auratus* | 58245 | 3.0047 | 1.33E−04 |
| DOMAIN_9878 | *Marmota monax* | 58246 | 3.7349 | 2.61E−04 |
| DOMAIN_9891 | *Mus caroli* | 58247 | 2.8116 | 3.13E−04 |
| DOMAIN_9915 | *Mus caroli* | 58248 | 3.4011 | 3.45E−04 |
| DOMAIN_9962 | *Rattus norvegicus* | 58249 | 2.7249 | 0.004063 |
| DOMAIN_9993 | *Rattus norvegicus* | 58250 | 2.7601 | 0.0035973 |
| DOMAIN_10018 | *Octodon degus* | 58251 | 3.3372 | 4.27E−04 |
| DOMAIN_10041 | *Mus caroli* | 58252 | 2.8662 | 0.0062437 |
| DOMAIN_10044 | *Mus musculus* | 58253 | 2.826 | 0.0043095 |
| DOMAIN_10050 | *Octodon degus* | 58254 | 3.3147 | 0.0020066 |
| DOMAIN_10057 | *Mus musculus* | 58255 | 2.2961 | 0.0026799 |
| DOMAIN_10091 | *Fukomys damarensis* | 58256 | 2.1679 | 4.36E−04 |
| DOMAIN_10127 | *Peromyscus maniculatus bairdii* | 58257 | 3.6912 | 3.83E−06 |
| DOMAIN_10160 | *Ictidomys tridecemlineatus* | 58258 | 2.9333 | 4.23E−04 |
| DOMAIN_10184 | *Mus caroli* | 58259 | 4.2854 | 1.53E−07 |
| DOMAIN_10241 | *Octodon degus* | 58260 | 3.5766 | 8.19E−05 |
| DOMAIN_10257 | *Octodon degus* | 58261 | 3.1757 | 5.20E−04 |
| DOMAIN_10294 | *Mus musculus* | 58262 | 2.689 | 0.0067073 |
| DOMAIN_10334 | *Mustela putorius furo* | 58263 | 3.3529 | 5.07E−05 |

TABLE 19-continued

List of 1,597 KRAB domain candidates identified from the high throughput screen assessing dXR repression of the HBEGF gene and subsequent application of the following criteria: p-value < 0.01 and $\log_2$(fold change) > 2.

| Domain ID | Species | SEQ ID NO | Log2 (fold change) | P-value |
|---|---|---|---|---|
| DOMAIN_10351 | *Delphinapterus leucas* | 58264 | 3.3309 | 3.78E−04 |
| DOMAIN_10359 | *Delphinapterus leucas* | 58265 | 2.9199 | 0.0036842 |
| DOMAIN_10381 | *Vicugna pacos* | 58266 | 2.215 | 0.0057838 |
| DOMAIN_10386 | *Odobenus rosmarus divergens* | 58267 | 2.8337 | 0.0028753 |
| DOMAIN_10403 | *Vicugna pacos* | 58268 | 3.3993 | 0.0016441 |
| DOMAIN_10420 | *Odobenus rosmarus divergens* | 58269 | 3.7185 | 1.01E−04 |
| DOMAIN_10425 | *Delphinapterus leucas* | 58270 | 2.8616 | 0.0041775 |
| DOMAIN_10427 | *Carlito syrichta* | 58271 | 2.3719 | 0.0078328 |
| DOMAIN_10491 | *Vicugna pacos* | 58272 | 3.7199 | 0.0012761 |
| DOMAIN_10495 | *Delphinapterus leucas* | 58273 | 3.4705 | 5.27E−04 |
| DOMAIN_10526 | *Delphinapterus leucas* | 58274 | 2.4499 | 0.0033355 |
| DOMAIN_10573 | *Cervus elaphus hippelaphus* | 58275 | 2.4077 | 5.02E−04 |
| DOMAIN_10612 | *Vicugna pacos* | 58276 | 2.4997 | 0.0035134 |
| DOMAIN_10613 | *Odobenus rosmarus divergens* | 58277 | 2.9148 | 5.62E−05 |
| DOMAIN_10623 | *Carlito syrichta* | 58278 | 3.2233 | 0.0018333 |
| DOMAIN_10646 | *Delphinapterus leucas* | 58279 | 2.9354 | 0.0036496 |
| DOMAIN_10647 | *Delphinapterus leucas* | 58280 | 2.9514 | 7.60E−04 |
| DOMAIN_10675 | *Ornithorhynchus anatinus* | 58281 | 3.2777 | 5.13E−05 |
| DOMAIN_10684 | *Odobenus rosmarus divergens* | 58282 | 4.531 | 1.64E−05 |
| DOMAIN_10704 | *Colobus angolensis palliatus* | 58283 | 3.1582 | 0.004292 |
| DOMAIN_10705 | *Colobus angolensis palliatus* | 58284 | 3.6392 | 4.09E−05 |
| DOMAIN_10733 | *Odobenus rosmarus divergens* | 58285 | 3.315 | 0.0028523 |
| DOMAIN_10762 | *Erinaceus europaeus* | 58286 | 3.9254 | 4.55E−05 |
| DOMAIN_10763 | *Mustela putorius furo* | 58287 | 2.5924 | 0.0073193 |
| DOMAIN_10765 | *Mustela putorius furo* | 58288 | 2.5661 | 0.0076445 |
| DOMAIN_10807 | *Erinaceus europaeus* | 58289 | 3.5237 | 1.54E−04 |
| DOMAIN_10882 | *Vicugna pacos* | 58290 | 3.6289 | 2.93E−04 |
| DOMAIN_10902 | *Vicugna pacos* | 58291 | 3.1052 | 0.0096752 |
| DOMAIN_10917 | *Odobenus rosmarus divergens* | 58292 | 3.7871 | 1.53E−07 |
| DOMAIN_10943 | *Cervus elaphus hippelaphus* | 58293 | 2.5554 | 0.0037715 |
| DOMAIN_10974 | *Chelonia mydas* | 58294 | 2.6444 | 0.0091318 |
| DOMAIN_11006 | *Loxodonta africana* | 58295 | 2.6669 | 6.71E−04 |
| DOMAIN_11024 | *Suricata suricatta* | 58296 | 3.2397 | 2.77E−04 |
| DOMAIN_11031 | *Mandrillus leucophaeus* | 58297 | 2.5516 | 0.005857 |
| DOMAIN_11034 | *Mandrillus leucophaeus* | 58298 | 2.2541 | 0.0042161 |
| DOMAIN_11040 | *Sus scrofa* | 58299 | 3.5161 | 3.39E−04 |
| DOMAIN_11049 | *Neophocaena asiaeorientalis asiaeorientalis* | 58300 | 2.7072 | 0.0015299 |
| DOMAIN_11053 | *Nomascus leucogenys* | 58301 | 3.677 | 4.44E−06 |
| DOMAIN_11069 | *Capra hircus* | 58302 | 3.2745 | 0.0036948 |
| DOMAIN_11071 | *Chrysochloris asiatica* | 58303 | 3.1268 | 0.0012421 |
| DOMAIN_11097 | *Mandrillus leucophaeus* | 58304 | 3.239 | 0.0011508 |
| DOMAIN_11110 | *Sus scrofa* | 58305 | 3.6632 | 4.76E−04 |
| DOMAIN_11129 | *Nomascus leucogenys* | 58306 | 2.3864 | 1.88E−04 |
| DOMAIN_11130 | *Nomascus leucogenys* | 58307 | 2.3487 | 6.64E−04 |
| DOMAIN_11132 | *Bos indicus* | 58308 | 3.5671 | 3.08E−05 |
| DOMAIN_11157 | *Suricata suricatta* | 58309 | 3.6671 | 8.22E−05 |
| DOMAIN_11158 | *Chrysochloris asiatica* | 58310 | 2.6889 | 0.0035388 |
| DOMAIN_11162 | *Mandrillus leucophaeus* | 58311 | 3.2804 | 2.65E−04 |
| DOMAIN_11178 | *Sus scrofa* | 58312 | 2.4845 | 0.0043413 |
| DOMAIN_11192 | *Neophocaena asiaeorientalis asiaeorientalis* | 58313 | 2.8798 | 2.10E−04 |
| DOMAIN_11202 | *Nomascus leucogenys* | 58314 | 3.5851 | 4.18E−05 |
| DOMAIN_11204 | *Nomascus leucogenys* | 58315 | 3.5793 | 5.22E−05 |
| DOMAIN_11225 | *Capra hircus* | 58316 | 3.606 | 0.0011566 |
| DOMAIN_11227 | *Capra hircus* | 58317 | 2.7556 | 0.0032733 |
| DOMAIN_11264 | *Sus scrofa* | 58318 | 3.5019 | 5.64E−04 |
| DOMAIN_11265 | *Sus scrofa* | 58319 | 4.2521 | 1.53E−07 |
| DOMAIN_11282 | *Suricata suricatta* | 58320 | 3.536 | 1.53E−07 |
| DOMAIN_11289 | *Suricata suricatta* | 58321 | 2.69 | 2.48E−04 |
| DOMAIN_11291 | *Suricata suricatta* | 58322 | 4.0373 | 4.59E−07 |
| DOMAIN_11307 | *Mandrillus leucophaeus* | 58323 | 3.6383 | 1.07E−06 |
| DOMAIN_11312 | *Sus scrofa* | 58324 | 3.8532 | 9.26E−05 |

TABLE 19-continued

List of 1,597 KRAB domain candidates identified from the high throughput screen assessing dXR repression of the HBEGF gene and subsequent application of the following criteria: p-value < 0.01 and $\log_2$(fold change) > 2.

| Domain ID | Species | SEQ ID NO | Log2 (fold change) | P-value |
|---|---|---|---|---|
| DOMAIN_11314 | *Sus scrofa* | 58325 | 2.9575 | 0.0015357 |
| DOMAIN_11321 | *Nomascus leucogenys* | 58326 | 2.9718 | 0.0086853 |
| DOMAIN_11331 | *Capra hircus* | 58327 | 3.0611 | 4.37E−04 |
| DOMAIN_11332 | *Capra hircus* | 58328 | 3.0468 | 2.19E−04 |
| DOMAIN_11356 | *Sus scrofa* | 58329 | 2.6549 | 0.0027629 |
| DOMAIN_11359 | *Sus scrofa* | 58330 | 3.1036 | 0.0092232 |
| DOMAIN_11381 | *Nomascus leucogenys* | 58331 | 3.1705 | 4.83E−04 |
| DOMAIN_11393 | *Suricata suricatta* | 58332 | 3.4256 | 1.65E−04 |
| DOMAIN_11401 | *Suricata suricatta* | 58333 | 2.6345 | 0.0077459 |
| DOMAIN_11403 | *Suricata suricatta* | 58334 | 3.4222 | 2.27E−04 |
| DOMAIN_11413 | *Sus scrofa* | 58335 | 2.1814 | 0.0084919 |
| DOMAIN_11433 | *Neophocaena asiaeorientalis asiaeorientalis* | 58336 | 3.3986 | 1.91E−05 |
| DOMAIN_11446 | *Nomascus leucogenys* | 58337 | 2.6971 | 3.26E−04 |
| DOMAIN_11461 | *Equus caballus* | 58338 | 2.508 | 0.0090515 |
| DOMAIN_11466 | *Suricata suricatta* | 58339 | 3.4716 | 0.0027896 |
| DOMAIN_11470 | *Mandrillus leucophaeus* | 58340 | 3.1038 | 0.0012895 |
| DOMAIN_11502 | *Trichechus manatus latirostris* | 58341 | 3.601 | 4.21E−05 |
| DOMAIN_11505 | *Trichechus manatus latirostris* | 58342 | 3.0969 | 9.19E−07 |
| DOMAIN_11534 | *Sus scrofa* | 58343 | 3.8118 | 1.91E−05 |
| DOMAIN_11554 | *Nomascus leucogenys* | 58344 | 3.0498 | 4.11E−04 |
| DOMAIN_11567 | *Zalophus californianus* | 58345 | 3.4239 | 0.0010611 |
| DOMAIN_11581 | *Equus caballus* | 58346 | 3.1882 | 4.10E−04 |
| DOMAIN_11612 | *Loxodonta africana* | 58347 | 3.3006 | 0.0040119 |
| DOMAIN_11621 | *Chrysochloris asiatica* | 58348 | 3.2074 | 5.42E−04 |
| DOMAIN_11643 | *Nomascus leucogenys* | 58349 | 2.3544 | 0.0020207 |
| DOMAIN_11662 | *Capra hircus* | 58350 | 3.7889 | 2.36E−04 |
| DOMAIN_11672 | *Suricata suricatta* | 58351 | 3.318 | 0.0022931 |
| DOMAIN_11701 | *Capra hircus* | 58352 | 2.5282 | 0.0084694 |
| DOMAIN_11726 | *Sus scrofa* | 58353 | 3.4183 | 1.09E−05 |
| DOMAIN_11749 | *Chlorocebus sabaeus* | 58354 | 3.2721 | 0.0023817 |
| DOMAIN_11753 | *Mandrillus leucophaeus* | 58355 | 2.6119 | 0.0062269 |
| DOMAIN_11760 | *Neophocaena asiaeorientalis asiaeorientalis* | 58356 | 2.8102 | 0.0039794 |
| DOMAIN_11796 | *Sus scrofa* | 58357 | 2.2811 | 0.0010219 |
| DOMAIN_11813 | *Canis lupus familiaris* | 58358 | 3.5195 | 7.62E−04 |
| DOMAIN_11825 | *Mandrillus leucophaeus* | 58359 | 3.9893 | 1.53E−07 |
| DOMAIN_11851 | *Nomascus leucogenys* | 58360 | 3.0241 | 1.32E−04 |
| DOMAIN_11858 | *Canis lupus familiaris* | 58361 | 3.6419 | 1.53E−07 |
| DOMAIN_11862 | *Canis lupus familiaris* | 58362 | 2.8817 | 0.0032412 |
| DOMAIN_11865 | *Muntiacus muntjak* | 58363 | 3.0474 | 0.0026931 |
| DOMAIN_11868 | *Mandrillus leucophaeus* | 58364 | 3.5158 | 4.44E−06 |
| DOMAIN_11908 | *Canis lupus familiaris* | 58365 | 2.894 | 0.0035529 |
| DOMAIN_11923 | *Sus scrofa* | 58366 | 3.2271 | 0.0018734 |
| DOMAIN_11925 | *Mandrillus leucophaeus* | 58367 | 3.5582 | 3.04E−04 |
| DOMAIN_11928 | *Neophocaena asiaeorientalis asiaeorientalis* | 58368 | 3.751 | 7.59E−04 |
| DOMAIN_11933 | *Neophocaena asiaeorientalis asiaeorientalis* | 58369 | 4.1135 | 1.52E−05 |
| DOMAIN_11944 | *Bos indicus* | 58370 | 3.2762 | 0.0022727 |
| DOMAIN_11950 | *Canis lupus familiaris* | 58371 | 4.3869 | 2.91E−06 |
| DOMAIN_11988 | *Muntiacus muntjak* | 58372 | 3.5916 | 3.83E−06 |
| DOMAIN_11996 | *Canis lupus familiaris* | 58373 | 3.0831 | 0.0015161 |
| DOMAIN_11999 | *Canis lupus familiaris* | 58374 | 3.7891 | 5.04E−05 |
| DOMAIN_12001 | *Mandrillus leucophaeus* | 58375 | 2.4384 | 0.0057376 |
| DOMAIN_12021 | *Canis lupus familiaris* | 58376 | 2.4637 | 0.0018489 |
| DOMAIN_12051 | *Muntiacus muntjak* | 58377 | 2.7925 | 0.0039375 |
| DOMAIN_12057 | *Muntiacus muntjak* | 58378 | 2.0631 | 0.0086017 |
| DOMAIN_12079 | *Muntiacus muntjak* | 58379 | 2.4029 | 0.0095567 |
| DOMAIN_12092 | *Bos mutus* | 58380 | 3.1752 | 1.82E−05 |
| DOMAIN_12114 | *Neophocaena asiaeorientalis asiaeorientalis* | 58381 | 3.3227 | 6.62E−04 |
| DOMAIN_12133 | *Canis lupus familiaris* | 58382 | 3.0204 | 0.0034751 |
| DOMAIN_12139 | *Canis lupus familiaris* | 58383 | 2.8097 | 0.0066678 |

TABLE 19-continued

List of 1,597 KRAB domain candidates identified from the high throughput screen assessing dXR repression of the HBEGF gene and subsequent application of the following criteria: p-value < 0.01 and $\log_2$(fold change) > 2.

| Domain ID | Species | SEQ ID NO | Log2 (fold change) | P-value |
|---|---|---|---|---|
| DOMAIN_12147 | *Neophocaena asiaeorientalis asiaeorientalis* | 58384 | 2.6974 | 9.14E-04 |
| DOMAIN_12158 | *Nomascus leucogenys* | 58385 | 3.0332 | 0.006631 |
| DOMAIN_12187 | *Canis lupus familiaris* | 58386 | 3.6477 | 5.13E-05 |
| DOMAIN_12191 | *Muntiacus muntjak* | 58387 | 3.6138 | 8.18E-04 |
| DOMAIN_12195 | *Canis lupus familiaris* | 58388 | 2.9023 | 1.11E-04 |
| DOMAIN_12206 | *Bos mutus* | 58389 | 2.9101 | 5.13E-04 |
| DOMAIN_12210 | *Bos indicus* | 58390 | 3.6136 | 0.0018284 |
| DOMAIN_12214 | *Muntiacus muntjak* | 58391 | 2.613 | 9.76E-04 |
| DOMAIN_12231 | *Nomascus leucogenys* | 58392 | 2.6703 | 0.00421 |
| DOMAIN_12261 | *Neophocaena asiaeorientalis asiaeorientalis* | 58393 | 2.7989 | 0.0029785 |
| DOMAIN_12285 | Gorilla | 58394 | 2.2573 | 0.0091023 |
| DOMAIN_12313 | *Bos indicus* | 58395 | 2.6903 | 0.0012684 |
| DOMAIN_12320 | *Muntiacus muntjak* | 58396 | 2.5075 | 0.0023021 |
| DOMAIN_12365 | *Nomascus leucogenys* | 58397 | 3.5626 | 7.78E-04 |
| DOMAIN_12395 | *Ailuropoda melanoleuca* | 58398 | 3.1504 | 3.56E-04 |
| DOMAIN_12459 | *Bos indicus* | 58399 | 4.0425 | 3.06E-06 |
| DOMAIN_12463 | *Ailuropoda melanoleuca* | 58400 | 3.2567 | 0.009339 |
| DOMAIN_12467 | Gorilla | 58401 | 2.9575 | 4.85E-04 |
| DOMAIN_12498 | *Muntiacus muntjak* | 58402 | 2.8947 | 0.0075569 |
| DOMAIN_12499 | *Muntiacus muntjak* | 58403 | 2.2932 | 0.0064341 |
| DOMAIN_12508 | Gorilla | 58404 | 3.0173 | 0.0024497 |
| DOMAIN_12511 | Gorilla | 58405 | 3.0694 | 0.0023557 |
| DOMAIN_12517 | *Lynx canadensis* | 58406 | 2.6983 | 0.0017522 |
| DOMAIN_12544 | Gorilla | 58407 | 3.306 | 4.83E-04 |
| DOMAIN_12550 | *Ailuropoda melanoleuca* | 58408 | 3.0229 | 2.37E-04 |
| DOMAIN_12576 | Gorilla | 58409 | 3.04 | 0.0044151 |
| DOMAIN_12590 | *Bos indicus* | 58410 | 2.5531 | 0.0020023 |
| DOMAIN_12591 | *Bos indicus* | 58411 | 3.4169 | 0.0011553 |
| DOMAIN_12598 | *Muntiacus muntjak* | 58412 | 3.3709 | 4.18E-05 |
| DOMAIN_12599 | *Muntiacus muntjak* | 58413 | 2.2098 | 0.007064 |
| DOMAIN_12630 | *Macaca fascicularis* | 58414 | 3.6424 | 4.03E-05 |
| DOMAIN_12646 | *Myotis lucifugus* | 58415 | 3.487 | 0.0014708 |
| DOMAIN_12686 | *Phascolarctos cinereus* | 58416 | 2.76 | 0.0032103 |
| DOMAIN_12698 | *Phascolarctos cinereus* | 58417 | 2.8029 | 0.0066675 |
| DOMAIN_12704 | *Myotis lucifugus* | 58418 | 2.9127 | 0.0034078 |
| DOMAIN_12712 | *Puma concolor* | 58419 | 2.1195 | 0.008023 |
| DOMAIN_12728 | *Lynx canadensis* | 58420 | 3.1999 | 9.49E-04 |
| DOMAIN_12734 | *Phyllostomus discolor* | 58421 | 3.5207 | 1.38E-06 |
| DOMAIN_12755 | *Oryctolagus cuniculus* | 58422 | 2.8082 | 0.0061475 |
| DOMAIN_12764 | *Desmodus rotundus* | 58423 | 3.9505 | 1.53E-07 |
| DOMAIN_12769 | *Macaca fascicularis* | 58424 | 2.0555 | 0.0080928 |
| DOMAIN_12777 | *Phascolarctos cinereus* | 58425 | 2.1778 | 0.0057731 |
| DOMAIN_12780 | *Phascolarctos cinereus* | 58426 | 3.2671 | 1.01E-04 |
| DOMAIN_12801 | *Sapajus apella* | 58427 | 2.0238 | 0.006988 |
| DOMAIN_12811 | *Macaca fascicularis* | 58428 | 2.4278 | 0.0068959 |
| DOMAIN_12815 | *Macaca fascicularis* | 58429 | 2.7296 | 0.0029445 |
| DOMAIN_12818 | *Macaca fascicularis* | 58430 | 3.6211 | 9.69E-05 |
| DOMAIN_12829 | *Phascolarctos cinereus* | 58431 | 3.3994 | 3.20E-04 |
| DOMAIN_12831 | *Phascolarctos cinereus* | 58432 | 2.9845 | 0.0029084 |
| DOMAIN_12839 | *Oryctolagus cuniculus* | 58433 | 3.4039 | 3.03E-04 |
| DOMAIN_12849 | *Muntiacus muntjak* | 58434 | 4.1042 | 1.53E-07 |
| DOMAIN_12896 | *Macaca fascicularis* | 58435 | 2.0413 | 0.0010397 |
| DOMAIN_12901 | *Macaca fascicularis* | 58436 | 3.5686 | 4.75E-06 |
| DOMAIN_12902 | *Macaca fascicularis* | 58437 | 3.3489 | 0.0016432 |
| DOMAIN_12912 | *Puma concolor* | 58438 | 2.7422 | 4.78E-04 |
| DOMAIN_12941 | *Phyllostomus discolor* | 58439 | 2.4012 | 0.0062382 |
| DOMAIN_12985 | *Phascolarctos cinereus* | 58440 | 3.7331 | 3.05E-05 |
| DOMAIN_13004 | *Macaca fascicularis* | 58441 | 3.2216 | 1.37E-04 |
| DOMAIN_13022 | *Phascolarctos cinereus* | 58442 | 3.0468 | 0.003082 |
| DOMAIN_13029 | *Myotis lucifugus* | 58443 | 3.1708 | 3.58E-04 |
| DOMAIN_13062 | *Ursus maritimus* | 58444 | 2.9752 | 2.10E-04 |
| DOMAIN_13068 | *Ailuropoda melanoleuca* | 58445 | 3.6132 | 2.43E-05 |
| DOMAIN_13089 | *Sapajus apella* | 58446 | 2.8761 | 0.0065934 |
| DOMAIN_13111 | *Ailuropoda melanoleuca* | 58447 | 2.6151 | 0.0090675 |
| DOMAIN_13121 | *Macaca fascicularis* | 58448 | 3.353 | 3.98E-04 |
| DOMAIN_13125 | *Macaca fascicularis* | 58449 | 3.2101 | 3.31E-04 |
| DOMAIN_13171 | *Phascolarctos cinereus* | 58450 | 3.0052 | 0.0061932 |
| DOMAIN_13193 | *Sapajus apella* | 58451 | 3.8948 | 1.53E-07 |
| DOMAIN_13227 | *Oryctolagus cuniculus* | 58452 | 2.3234 | 0.0034855 |

TABLE 19-continued

List of 1,597 KRAB domain candidates identified from the high throughput screen assessing dXR repression of the HBEGF gene and subsequent application of the following criteria: p-value < 0.01 and $log_2$(fold change) > 2.

| Domain ID | Species | SEQ ID NO | Log2 (fold change) | P-value |
|---|---|---|---|---|
| DOMAIN_13269 | *Desmodus rotundus* | 58453 | 2.7236 | 0.0010081 |
| DOMAIN_13277 | *Macaca fascicularis* | 58454 | 2.9151 | 4.66E−04 |
| DOMAIN_13282 | *Phascolarctos cinereus* | 58455 | 3.5504 | 8.75E−04 |
| DOMAIN_13284 | *Phascolarctos cinereus* | 58456 | 3.0903 | 0.0057642 |
| DOMAIN_13293 | *Myotis lucifugus* | 58457 | 2.5884 | 6.56E−04 |
| DOMAIN_13325 | *Macaca fascicularis* | 58458 | 2.4051 | 0.0085787 |
| DOMAIN_13332 | *Phascolarctos cinereus* | 58459 | 2.685 | 0.0052498 |
| DOMAIN_13333 | *Phascolarctos cinereus* | 58460 | 2.9787 | 0.0079948 |
| DOMAIN_13339 | *Puma concolor* | 58461 | 3.2731 | 5.64E−04 |
| DOMAIN_13346 | *Oryctolagus cuniculus* | 58462 | 2.9551 | 0.0031649 |
| DOMAIN_13363 | *Phyllostomus discolor* | 58463 | 2.2178 | 0.0041619 |
| DOMAIN_13364 | *Macaca fascicularis* | 58464 | 3.5606 | 2.40E−05 |
| DOMAIN_13379 | *Phascolarctos cinereus* | 58465 | 3.2967 | 0.0018734 |
| DOMAIN_13380 | *Myotis lucifugus* | 58466 | 3.6615 | 1.09E−05 |
| DOMAIN_13387 | *Sapajus apella* | 58467 | 2.8731 | 0.001777 |
| DOMAIN_13417 | *Ailuropoda melanoleuca* | 58468 | 3.7056 | 1.17E−04 |
| DOMAIN_13439 | *Sapajus apella* | 58469 | 2.5091 | 0.0050786 |
| DOMAIN_13470 | *Phascolarctos cinereus* | 58470 | 3.7598 | 2.40E−05 |
| DOMAIN_13486 | *Puma concolor* | 58471 | 3.4895 | 7.93E−04 |
| DOMAIN_13501 | *Macaca fascicularis* | 58472 | 2.8162 | 0.0083892 |
| DOMAIN_13509 | *Phascolarctos cinereus* | 58473 | 2.8053 | 0.00351 |
| DOMAIN_13516 | *Phascolarctos cinereus* | 58474 | 2.4421 | 0.0034809 |
| DOMAIN_13536 | Gorilla | 58475 | 3.3269 | 0.0064418 |
| DOMAIN_13537 | *Ailuropoda melanoleuca* | 58476 | 3.3265 | 8.83E−05 |
| DOMAIN_13562 | *Phascolarctos cinereus* | 58477 | 3.7608 | 4.71E−04 |
| DOMAIN_13565 | *Phascolarctos cinereus* | 58478 | 2.994 | 0.0032926 |
| DOMAIN_13574 | *Puma concolor* | 58479 | 3.1114 | 6.89E−04 |
| DOMAIN_13591 | *Lynx canadensis* | 58480 | 3.215 | 5.12E−04 |
| DOMAIN_13601 | *Macaca fascicularis* | 58481 | 2.4865 | 0.0065955 |
| DOMAIN_13609 | *Phascolarctos cinereus* | 58482 | 3.1787 | 0.002393 |
| DOMAIN_13610 | *Phascolarctos cinereus* | 58483 | 3.1925 | 0.0018707 |
| DOMAIN_13644 | *Phascolarctos cinereus* | 58484 | 3.2677 | 0.001927 |
| DOMAIN_13648 | *Oryctolagus cuniculus* | 58485 | 3.1393 | 0.0014022 |
| DOMAIN_13650 | *Ailuropoda melanoleuca* | 58486 | 3.8556 | 4.44E−06 |
| DOMAIN_13664 | *Macaca fascicularis* | 58487 | 2.7443 | 0.002582 |
| DOMAIN_13670 | *Phascolarctos cinereus* | 58488 | 3.154 | 4.21E−04 |
| DOMAIN_13690 | *Sapajus apella* | 58489 | 3.2587 | 0.0017001 |
| DOMAIN_13691 | *Sapajus apella* | 58490 | 2.6205 | 0.0033052 |
| DOMAIN_13703 | *Lynx canadensis* | 58491 | 3.7947 | 2.43E−05 |
| DOMAIN_13705 | *Phyllostomus discolor* | 58492 | 2.496 | 0.009207 |
| DOMAIN_13722 | *Phascolarctos cinereus* | 58493 | 2.4814 | 0.0058557 |
| DOMAIN_13723 | *Phascolarctos cinereus* | 58494 | 2.9677 | 0.0026349 |
| DOMAIN_13733 | *Sapajus apella* | 58495 | 3.3285 | 1.82E−04 |
| DOMAIN_13783 | *Macaca fascicularis* | 58496 | 2.5821 | 0.0093056 |
| DOMAIN_13805 | *Lynx canadensis* | 58497 | 3.1769 | 0.0088613 |
| DOMAIN_13823 | *Macaca fascicularis* | 58498 | 4.219 | 1.53E−07 |
| DOMAIN_13830 | *Phascolarctos cinereus* | 58499 | 2.6435 | 0.0033465 |
| DOMAIN_13832 | *Phascolarctos cinereus* | 58500 | 2.9705 | 0.0077505 |
| DOMAIN_13843 | *Phascolarctos cinereus* | 58501 | 3.6119 | 1.81E−04 |
| DOMAIN_13851 | *Canis lupus familiaris* | 58502 | 2.6472 | 0.0033845 |
| DOMAIN_13859 | *Macaca fascicularis* | 58503 | 2.2006 | 0.0086366 |
| DOMAIN_13878 | *Ailuropoda melanoleuca* | 58504 | 4.3232 | 4.75E−06 |
| DOMAIN_13880 | *Lynx canadensis* | 58505 | 3.0991 | 0.0013743 |
| DOMAIN_13907 | *Phascolarctos cinereus* | 58506 | 2.4263 | 0.0084749 |
| DOMAIN_13910 | *Bos mutus* | 58507 | 2.9556 | 0.0048664 |
| DOMAIN_13915 | *Muntiacus muntjak* | 58508 | 2.8554 | 0.0080147 |
| DOMAIN_13958 | *Phascolarctos cinereus* | 58509 | 3.2926 | 9.78E−05 |
| DOMAIN_13970 | *Lynx canadensis* | 58510 | 2.89 | 0.0058701 |
| DOMAIN_13979 | *Macaca fascicularis* | 58511 | 2.6188 | 0.0016793 |
| DOMAIN_13981 | *Phascolarctos cinereus* | 58512 | 2.8041 | 0.0024451 |
| DOMAIN_13984 | *Phascolarctos cinereus* | 58513 | 2.8513 | 0.0029797 |
| DOMAIN_13987 | *Myotis lucifugus* | 58514 | 3.0633 | 4.59E−04 |
| DOMAIN_13997 | *Puma concolor* | 58515 | 2.984 | 2.51E−04 |
| DOMAIN_14009 | *Ailuropoda melanoleuca* | 58516 | 2.9207 | 5.05E−05 |
| DOMAIN_14013 | *Ailuropoda melanoleuca* | 58517 | 2.4619 | 0.0082352 |
| DOMAIN_14031 | *Phyllostomus discolor* | 58518 | 3.0963 | 0.0045422 |
| DOMAIN_14040 | *Phascolarctos cinereus* | 58519 | 3.0933 | 0.0065673 |
| DOMAIN_14041 | *Phascolarctos cinereus* | 58520 | 2.9069 | 0.0077333 |
| DOMAIN_14049 | *Phascolarctos cinereus* | 58521 | 2.7761 | 0.0052936 |
| DOMAIN_14069 | *Lynx canadensis* | 58522 | 2.9182 | 0.0020008 |
| DOMAIN_14082 | *Phyllostomus discolor* | 58523 | 3.2495 | 2.19E−04 |
| DOMAIN_14083 | *Phyllostomus discolor* | 58524 | 2.7465 | 0.0042213 |
| DOMAIN_14108 | *Canis lupus familiaris* | 58525 | 3.0621 | 0.004127 |

TABLE 19-continued

List of 1,597 KRAB domain candidates identified from the high throughput screen assessing dXR repression of the HBEGF gene and subsequent application of the following criteria: p-value < 0.01 and $\log_2$(fold change) > 2.

| Domain ID | Species | SEQ ID NO | Log2 (fold change) | P-value |
|---|---|---|---|---|
| DOMAIN_14129 | *Lynx canadensis* | 58526 | 2.8195 | 0.0026925 |
| DOMAIN_14135 | *Bos mutus* | 58527 | 2.426 | 0.0033513 |
| DOMAIN_14147 | *Canis lupus familiaris* | 58528 | 3.3683 | 2.59E−04 |
| DOMAIN_14153 | *Muntiacus muntjak* | 58529 | 2.883 | 0.0011637 |
| DOMAIN_14197 | *Muntiacus muntjak* | 58530 | 2.9589 | 0.0041555 |
| DOMAIN_14219 | *Ailuropoda melanoleuca* | 58531 | 2.6653 | 0.0035657 |
| DOMAIN_14226 | *Lynx canadensis* | 58532 | 3.1176 | 0.0020645 |
| DOMAIN_14228 | *Lynx canadensis* | 58533 | 3.3445 | 7.54E−04 |
| DOMAIN_14256 | *Lynx canadensis* | 58534 | 2.4946 | 0.0066852 |
| DOMAIN_14287 | *Bos indicus* | 58535 | 3.6232 | 1.66E−04 |
| DOMAIN_14295 | *Muntiacus muntjak* | 58536 | 3.4018 | 7.22E−04 |
| DOMAIN_14322 | *Desmodus rotundus* | 58537 | 3.3716 | 1.94E−04 |
| DOMAIN_14337 | *Muntiacus muntjak* | 58538 | 3.2753 | 2.86E−05 |
| DOMAIN_14338 | *Ailuropoda melanoleuca* | 58539 | 3.1071 | 0.0022421 |
| DOMAIN_14358 | *Lynx canadensis* | 58540 | 2.7094 | 8.85E−04 |
| DOMAIN_14365 | *Desmodus rotundus* | 58541 | 3.0706 | 1.39E−04 |
| DOMAIN_14373 | *Macaca fascicularis* | 58542 | 2.5861 | 0.0069375 |
| DOMAIN_14382 | *Phascolarctos cinereus* | 58543 | 4.0523 | 7.52E−05 |
| DOMAIN_14444 | *Phyllostomus discolor* | 58544 | 2.4641 | 0.0037357 |
| DOMAIN_14487 | *Ailuropoda melanoleuca* | 58545 | 2.7981 | 0.0050538 |
| DOMAIN_14526 | *Ailuropoda melanoleuca* | 58546 | 3.2232 | 0.003818 |
| DOMAIN_14532 | *Lynx canadensis* | 58547 | 3.2071 | 2.43E−04 |
| DOMAIN_14534 | *Lynx canadensis* | 58548 | 2.8122 | 0.0039834 |
| DOMAIN_14546 | *Muntiacus muntjak* | 58549 | 3.5039 | 5.01E−05 |
| DOMAIN_14551 | *Ailuropoda melanoleuca* | 58550 | 3.6894 | 2.30E−06 |
| DOMAIN_14557 | *Lynx canadensis* | 58551 | 2.9876 | 2.85E−04 |
| DOMAIN_14574 | Gorilla | 58552 | 3.3356 | 7.83E−04 |
| DOMAIN_14576 | *Ailuropoda melanoleuca* | 58553 | 3.2158 | 0.0028459 |
| DOMAIN_14602 | Gorilla | 58554 | 3.2145 | 0.0037718 |
| DOMAIN_14627 | *Acinonyx jubatus* | 58555 | 2.9501 | 0.0033732 |
| DOMAIN_14639 | Rhesus | 58556 | 2.7046 | 0.0033915 |
| DOMAIN_14714 | *Odocoileus virginianus texanus* | 58557 | 3.2752 | 2.48E−04 |
| DOMAIN_14746 | *Odocoileus virginianus texanus* | 58558 | 2.605 | 0.0084645 |
| DOMAIN_14773 | *Sapajus apella* | 58559 | 3.5997 | 1.45E−05 |
| DOMAIN_14794 | *Acinonyx jubatus* | 58560 | 3.4295 | 4.09E−04 |
| DOMAIN_14795 | *Rhinopithecus roxellana* | 58561 | 2.8119 | 0.0024062 |
| DOMAIN_14800 | *Rhinopithecus roxellana* | 58562 | 2.274 | 0.0012494 |
| DOMAIN_14815 | *Cebus imitator* | 58563 | 3.3826 | 0.0075808 |
| DOMAIN_14820 | *Callithrix jacchus* | 58564 | 2.8836 | 0.0021743 |
| DOMAIN_14829 | *Rhinopithecus roxellana* | 58565 | 2.7188 | 4.08E−04 |
| DOMAIN_14845 | *Cebus imitator* | 58566 | 2.7224 | 0.0041993 |
| DOMAIN_14849 | *Cebus imitator* | 58567 | 2.3659 | 0.0093133 |
| DOMAIN_14862 | *Callithrix jacchus* | 58568 | 2.8116 | 0.0079314 |
| DOMAIN_14864 | Rhesus | 58569 | 3.3492 | 2.46E−04 |
| DOMAIN_14885 | *Cebus imitator* | 58570 | 3.5373 | 4.09E−05 |
| DOMAIN_14901 | *Bos taurus* | 58571 | 2.9774 | 0.0085175 |
| DOMAIN_14905 | *Rhinopithecus roxellana* | 58572 | 3.372 | 0.0034794 |
| DOMAIN_14928 | *Callithrix jacchus* | 58573 | 3.1547 | 2.58E−04 |
| DOMAIN_14939 | *Callorhinus ursinus* | 58574 | 2.3884 | 0.0071338 |
| DOMAIN_14946 | *Acinonyx jubatus* | 58575 | 3.2842 | 7.46E−04 |
| DOMAIN_14948 | *Acinonyx jubatus* | 58576 | 3.3727 | 1.73E−04 |
| DOMAIN_14974 | *Sapajus apella* | 58577 | 2.9963 | 0.0091608 |
| DOMAIN_14977 | *Sapajus apella* | 58578 | 3.0085 | 5.11E−04 |
| DOMAIN_14978 | *Acinonyx jubatus* | 58579 | 3.0358 | 0.0017363 |
| DOMAIN_14983 | *Rhinopithecus roxellana* | 58580 | 3.704 | 1.53E−07 |
| DOMAIN_14994 | *Bison bison bison* | 58581 | 2.4997 | 0.0054874 |
| DOMAIN_14995 | *Cebus imitator* | 58582 | 3.5057 | 4.13E−06 |
| DOMAIN_15042 | *Ovis aries* | 58583 | 3.0774 | 0.0045881 |
| DOMAIN_15070 | *Callithrix jacchus* | 58584 | 4.0108 | 2.60E−04 |
| DOMAIN_15083 | *Ovis aries* | 58585 | 2.7541 | 7.89E−04 |
| DOMAIN_15086 | *Ovis aries* | 58586 | 3.5994 | 2.56E−04 |
| DOMAIN_15089 | *Vulpes vulpes* | 58587 | 2.3585 | 0.0076298 |
| DOMAIN_15102 | *Acinonyx jubatus* | 58588 | 3.0929 | 0.0033921 |
| DOMAIN_15103 | *Bison bison bison* | 58589 | 2.652 | 0.0021839 |
| DOMAIN_15119 | *Callithrix jacchus* | 58590 | 3.3838 | 2.60E−06 |
| DOMAIN_15137 | *Ovis aries* | 58591 | 2.7071 | 0.0022528 |
| DOMAIN_15138 | *Vulpes vulpes* | 58592 | 3.1771 | 6.85E−04 |
| DOMAIN_15159 | *Ovis aries* | 58593 | 3.2135 | 0.0012084 |
| DOMAIN_15171 | *Vulpes vulpes* | 58594 | 3.2837 | 2.40E−05 |
| DOMAIN_15174 | *Vulpes vulpes* | 58595 | 3.1387 | 0.0033116 |
| DOMAIN_15184 | *Acinonyx jubatus* | 58596 | 3.0092 | 0.0021588 |

TABLE 19-continued

List of 1,597 KRAB domain candidates identified from the high throughput screen assessing dXR repression of the HBEGF gene and subsequent application of the following criteria: p-value < 0.01 and $\log_2$(fold change) > 2.

| Domain ID | Species | SEQ ID NO | Log2 (fold change) | P-value |
|---|---|---|---|---|
| DOMAIN_15197 | *Acinonyx jubatus* | 58597 | 3.0957 | 0.0012736 |
| DOMAIN_15227 | *Rhinopithecus roxellana* | 58598 | 3.5532 | 4.75E−06 |
| DOMAIN_15233 | *Rhinopithecus roxellana* | 58599 | 2.788 | 0.0046622 |
| DOMAIN_15234 | *Acinonyx jubatus* | 58600 | 3.546 | 0.0019916 |
| DOMAIN_15241 | *Odocoileus virginianus texanus* | 58601 | 3.3955 | 3.85E−04 |
| DOMAIN_15251 | *Callithrix jacchus* | 58602 | 2.2209 | 9.47E−04 |
| DOMAIN_15254 | *Callithrix jacchus* | 58603 | 3.5159 | 2.32E−04 |
| DOMAIN_15267 | *Ovis aries* | 58604 | 2.8528 | 0.0020149 |
| DOMAIN_15269 | *Ovis aries* | 58605 | 2.0839 | 0.0057336 |
| DOMAIN_15278 | *Callithrix jacchus* | 58606 | 3.2523 | 0.0089241 |
| DOMAIN_15279 | *Callithrix jacchus* | 58607 | 3.8574 | 6.87E−05 |
| DOMAIN_15352 | *Cebus imitator* | 58608 | 3.0832 | 0.0079363 |
| DOMAIN_15354 | *Tursiops truncatus* | 58609 | 3.5099 | 5.16E−05 |
| DOMAIN_15356 | *Acinonyx jubatus* | 58610 | 3.5466 | 0.0019099 |
| DOMAIN_15360 | *Neophocaena asiaeorientalis asiaeorientalis* | 58611 | 3.2575 | 3.95E−04 |
| DOMAIN_15363 | Orangutan | 58612 | 4.3121 | 1.53E−07 |
| DOMAIN_15391 | *Leptonychotes weddellii* | 58613 | 3.9053 | 1.53E−07 |
| DOMAIN_15406 | Chimp | 58614 | 3.4616 | 1.53E−07 |
| DOMAIN_15419 | *Rhinopithecus roxellana* | 58615 | 2.6943 | 0.0012439 |
| DOMAIN_15426 | *Odocoileus virginianus texanus* | 58616 | 2.9673 | 0.0024959 |
| DOMAIN_15447 | *Rhinopithecus roxellana* | 58617 | 3.1112 | 0.0031907 |
| DOMAIN_15451 | *Bison bison bison* | 58618 | 3.2905 | 0.0024601 |
| DOMAIN_15527 | *Balaenoptera acutorostrata scammoni* | 58619 | 3.0354 | 0.0023685 |
| DOMAIN_15536 | *Cebus imitator* | 58620 | 2.4515 | 0.0048713 |
| DOMAIN_15540 | *Callithrix jacchus* | 58621 | 3.124 | 0.0020464 |
| DOMAIN_15575 | *Callithrix jacchus* | 58622 | 2.594 | 0.0095671 |
| DOMAIN_15577 | *Callithrix jacchus* | 58623 | 2.4456 | 0.0010642 |
| DOMAIN_15581 | *Callorhinus ursinus* | 58624 | 3.2465 | 0.0031873 |
| DOMAIN_15586 | *Callorhinus ursinus* | 58625 | 2.6157 | 0.002815 |
| DOMAIN_15603 | *Cebus imitator* | 58626 | 3.5111 | 0.0027084 |
| DOMAIN_15605 | *Cebus imitator* | 58627 | 3.8196 | 2.50E−04 |
| DOMAIN_15634 | *Delphinapterus leucas* | 58628 | 3.3574 | 0.0025587 |
| DOMAIN_15636 | Chimp | 58629 | 2.2086 | 0.0062339 |
| DOMAIN_15638 | *Sapajus apella* | 58630 | 3.4277 | 1.53E−07 |
| DOMAIN_15669 | *Callorhinus ursinus* | 58631 | 2.8865 | 0.0027889 |
| DOMAIN_15687 | *Cebus imitator* | 58632 | 2.5362 | 0.0063187 |
| DOMAIN_15688 | *Cebus imitator* | 58633 | 3.2098 | 6.98E−04 |
| DOMAIN_15693 | Rhesus | 58634 | 3.8571 | 9.95E−06 |
| DOMAIN_15699 | *Bos taurus* | 58635 | 3.5255 | 7.09E−04 |
| DOMAIN_15753 | *Ovis aries* | 58636 | 3.1699 | 0.0035272 |
| DOMAIN_15759 | *Ovis aries* | 58637 | 3.1884 | 0.0011061 |
| DOMAIN_15764 | *Otolemur garnettii* | 58638 | 3.107 | 3.97E−04 |
| DOMAIN_15800 | *Otolemur garnettii* | 58639 | 3.4462 | 1.80E−04 |
| DOMAIN_15814 | Rhesus | 58640 | 3.9503 | 3.26E−05 |
| DOMAIN_15823 | *Ovis aries* | 58641 | 2.8458 | 0.0034405 |
| DOMAIN_15834 | *Otolemur garnettii* | 58642 | 3.7629 | 1.30E−05 |
| DOMAIN_15839 | *Callithrix jacchus* | 58643 | 2.3399 | 0.0090833 |
| DOMAIN_15863 | *Vulpes vulpes* | 58644 | 2.7434 | 0.0042734 |
| DOMAIN_15931 | *Ovis aries* | 58645 | 3.0861 | 0.0028731 |
| DOMAIN_15940 | *Enhydra lutris kenyoni* | 58646 | 2.8684 | 0.007571 |
| DOMAIN_15956 | *Bos taurus* | 58647 | 3.2271 | 4.36E−04 |
| DOMAIN_15972 | *Enhydra lutris kenyoni* | 58648 | 2.3299 | 1.05E−04 |
| DOMAIN_16009 | *Zalophus californianus* | 58649 | 3.2738 | 0.0020718 |
| DOMAIN_16011 | *Delphinapterus leucas* | 58650 | 4.3363 | 1.53E−07 |
| DOMAIN_16017 | *Ovis aries* | 58651 | 2.6715 | 0.0041604 |
| DOMAIN_16023 | *Rhinopithecus bieti* | 58652 | 2.2831 | 0.0064672 |
| DOMAIN_16050 | *Ovis aries* | 58653 | 2.7105 | 0.0086883 |
| DOMAIN_16063 | Rhesus | 58654 | 2.1603 | 0.0054023 |
| DOMAIN_16084 | *Enhydra lutris kenyoni* | 58655 | 3.0131 | 0.0022672 |
| DOMAIN_16115 | *Bos taurus* | 58656 | 2.9023 | 0.0027605 |
| DOMAIN_16123 | *Ovis aries* | 58657 | 2.3799 | 0.0079176 |
| DOMAIN_16147 | Orangutan | 58658 | 2.5699 | 4.83E−04 |
| DOMAIN_16184 | *Ovis aries* | 58659 | 3.7743 | 4.44E−06 |
| DOMAIN_16188 | *Otolemur garnettii* | 58660 | 2.5145 | 0.0014414 |
| DOMAIN_16238 | *Orangutan* | 58661 | 3.8734 | 2.87E−04 |
| DOMAIN_16246 | Rhesus | 58662 | 2.3971 | 3.89E−04 |
| DOMAIN_16253 | *Ovis aries* | 58663 | 4.488 | 1.53E−07 |
| DOMAIN_16266 | *Otolemur garnettii* | 58664 | 3.075 | 0.0019834 |

TABLE 19-continued

List of 1,597 KRAB domain candidates identified from the high throughput screen assessing dXR repression of the HBEGF gene and subsequent application of the following criteria: p-value < 0.01 and $\log_2$(fold change) > 2.

| Domain ID | Species | SEQ ID NO | Log2 (fold change) | P-value |
|---|---|---|---|---|
| DOMAIN_16274 | *Otolemur garnettii* | 58665 | 2.7655 | 0.0014904 |
| DOMAIN_16312 | *Vicugna pacos* | 58666 | 2.4302 | 0.0024702 |
| DOMAIN_16323 | *Trichechus manatus latirostris* | 58667 | 4.0053 | 2.15E−04 |
| DOMAIN_16340 | *Ovis aries* | 58668 | 2.778 | 0.0034068 |
| DOMAIN_16372 | *Odocoileus virginianus texanus* | 58669 | 4.2664 | 1.53E−07 |
| DOMAIN_16378 | *Callithrix jacchus* | 58670 | 2.9868 | 0.0037718 |
| DOMAIN_16399 | *Rhinopithecus roxellana* | 58671 | 4.0639 | 1.53E−07 |
| DOMAIN_16408 | *Cebus imitator* | 58672 | 2.0194 | 0.009233 |
| DOMAIN_16461 | *Cebus imitator* | 58673 | 3.1155 | 0.0020676 |
| DOMAIN_16471 | *Acinonyx jubatus* | 58674 | 3.3465 | 0.0021006 |
| DOMAIN_16478 | *Rhinopithecus roxellana* | 58675 | 2.8285 | 0.0023275 |
| DOMAIN_16516 | Rhesus | 58676 | 3.8473 | 1.94E−05 |
| DOMAIN_16517 | *Callithrix jacchus* | 58677 | 3.3189 | 2.60E−06 |
| DOMAIN_16534 | *Acinonyx jubatus* | 58678 | 2.7531 | 0.0057425 |
| DOMAIN_16556 | *Rhinopithecus roxellana* | 58679 | 2.4217 | 0.0084734 |
| DOMAIN_16566 | *Odocoileus virginianus texanus* | 58680 | 3.3903 | 7.82E−04 |
| DOMAIN_16576 | Chimp | 58681 | 2.6949 | 0.0021998 |
| DOMAIN_16597 | *Cebus imitator* | 58682 | 2.9869 | 0.0023416 |
| DOMAIN_16611 | *Papio anubis* | 58683 | 3.4786 | 1.53E−07 |
| DOMAIN_16618 | *Ursus maritimus* | 58684 | 3.1184 | 0.0015351 |
| DOMAIN_16629 | *Cebus imitator* | 58685 | 3.7569 | 1.57E−04 |
| DOMAIN_16630 | *Cebus imitator* | 58686 | 3.2435 | 1.36E−04 |
| DOMAIN_16638 | *Macaca nemestrina* | 58687 | 3.3871 | 0.0011337 |
| DOMAIN_16648 | *Physeter macrocephalus* | 58688 | 3.629 | 1.88E−05 |
| DOMAIN_16651 | *Delphinapterus leucas* | 58689 | 2.0926 | 0.0074143 |
| DOMAIN_16659 | *Leptonychotes weddellii* | 58690 | 3.8913 | 2.37E−05 |
| DOMAIN_16664 | *Leptonychotes weddellii* | 58691 | 3.4502 | 1.76E−05 |
| DOMAIN_16673 | *Phascolarctos cinereus* | 58692 | 3.0938 | 0.0039727 |
| DOMAIN_16677 | Orangutan | 58693 | 3.1577 | 0.0023254 |
| DOMAIN_16694 | *Callorhinus ursinus* | 58694 | 2.0979 | 0.0094743 |
| DOMAIN_16695 | *Callorhinus ursinus* | 58695 | 3.965 | 3.06E−07 |
| DOMAIN_16696 | *Tursiops truncatus* | 58696 | 3.0806 | 0.002705 |
| DOMAIN_16703 | *Phascolarctos cinereus* | 58697 | 3.3969 | 2.19E−04 |
| DOMAIN_16731 | *Ursus arctos horribilis* | 58698 | 2.849 | 1.30E−05 |
| DOMAIN_16734 | *Leptonychotes weddellii* | 58699 | 3.4791 | 2.57E−04 |
| DOMAIN_16738 | Chimp | 58700 | 3.5957 | 8.11E−06 |
| DOMAIN_16744 | *Enhydra lutris kenyoni* | 58701 | 3.637 | 6.38E−05 |
| DOMAIN_16763 | *Monodelphis domestica* | 58702 | 2.9244 | 0.0053031 |
| DOMAIN_16771 | *Saimiri boliviensis boliviensis* | 58703 | 3.3025 | 0.0027295 |
| DOMAIN_16773 | *Balaenoptera acutorostrata scammoni* | 58704 | 4.5309 | 1.38E−06 |
| DOMAIN_16776 | *Callorhinus ursinus* | 58705 | 3.0877 | 0.0024757 |
| DOMAIN_16809 | *Delphinapterus leucas* | 58706 | 2.4357 | 0.0068567 |
| DOMAIN_16811 | *Balaenoptera acutorostrata scammoni* | 58707 | 3.5141 | 3.08E−04 |
| DOMAIN_16856 | *Ursus maritimus* | 58708 | 2.7613 | 0.0040844 |
| DOMAIN_16865 | *Papio anubis* | 58709 | 3.9619 | 1.53E−07 |
| DOMAIN_16876 | *Callorhinus ursinus* | 58710 | 3.2183 | 4.66E−04 |
| DOMAIN_16877 | *Rhinolophus ferrumequinum* | 58711 | 3.3745 | 3.78E−05 |
| DOMAIN_16936 | *Rhinopithecus roxellana* | 58712 | 2.9808 | 0.0044295 |
| DOMAIN_16953 | *Callorhinus ursinus* | 58713 | 3.3286 | 1.62E−04 |
| DOMAIN_16973 | *Delphinapterus leucas* | 58714 | 3.0187 | 0.0041062 |
| DOMAIN_16994 | *Odocoileus virginianus texanus* | 58715 | 3.0575 | 0.0025431 |
| DOMAIN_17001 | *Rhinolophus ferrumequinum* | 58716 | 3.045 | 0.003661 |
| DOMAIN_17023 | *Sapajus apella* | 58717 | 2.5472 | 0.0041588 |
| DOMAIN_17027 | *Balaenoptera acutorostrata scammoni* | 58718 | 3.131 | 0.0028042 |
| DOMAIN_17041 | *Rhinopithecus roxellana* | 58719 | 2.7589 | 0.0074146 |
| DOMAIN_17062 | *Rhinopithecus roxellana* | 58720 | 3.2594 | 7.33E−05 |
| DOMAIN_17105 | Rhesus | 58721 | 2.637 | 0.0054256 |
| DOMAIN_17108 | *Phyllostomus discolor* | 58722 | 2.4499 | 0.0018315 |
| DOMAIN_17134 | *Panthera pardus* | 58723 | 3.2502 | 0.0016926 |
| DOMAIN_17139 | *Ursus arctos horribilis* | 58724 | 4.0326 | 2.13E−05 |
| DOMAIN_17153 | *Ursus arctos horribilis* | 58725 | 2.1759 | 0.0043459 |
| DOMAIN_17167 | *Ursus maritimus* | 58726 | 4.1644 | 1.52E−05 |
| DOMAIN_17177 | *Physeter macrocephalus* | 58727 | 3.2446 | 0.002928 |

TABLE 19-continued

List of 1,597 KRAB domain candidates identified from the high throughput screen assessing dXR repression of the HBEGF gene and subsequent application of the following criteria: p-value < 0.01 and $\log_2$(fold change) > 2.

| Domain ID | Species | SEQ ID NO | Log2 (fold change) | P-value |
|---|---|---|---|---|
| DOMAIN_17180 | *Zalophus californianus* | 58728 | 2.945 | 0.0082198 |
| DOMAIN_17195 | *Ursus maritimus* | 58729 | 3.0566 | 0.0037464 |
| DOMAIN_17202 | *Ursus arctos horribilis* | 58730 | 2.6589 | 0.0072284 |
| DOMAIN_17206 | *Pteropus vampyrus* | 58731 | 3.7092 | 5.05E−06 |
| DOMAIN_17234 | *Delphinapterus leucas* | 58732 | 2.0152 | 0.0059669 |
| DOMAIN_17236 | *Rhinolophus ferrumequinum* | 58733 | 2.7166 | 0.0039056 |
| DOMAIN_17241 | *Muntiacus muntjak* | 58734 | 2.2217 | 0.003544 |
| DOMAIN_17264 | *Vicugna pacos* | 58735 | 3.0866 | 0.0021294 |
| DOMAIN_17278 | *Tursiops truncatus* | 58736 | 3.4898 | 4.12E−05 |
| DOMAIN_17279 | *Bison bison bison* | 58737 | 3.591 | 8.11E−06 |
| DOMAIN_17333 | *Camelus dromedarius* | 58738 | 2.8765 | 0.003642 |
| DOMAIN_17340 | *Leptonychotes weddellii* | 58739 | 3.1536 | 5.34E−05 |
| DOMAIN_17382 | *Leptonychotes weddellii* | 58740 | 3.075 | 0.0035284 |
| DOMAIN_17383 | *Leptonychotes weddellii* | 58741 | 2.953 | 0.0032519 |
| DOMAIN_17412 | *Ovis aries* | 58742 | 4.9319 | 1.53E−07 |
| DOMAIN_17421 | *Vulpes vulpes* | 58743 | 3.3129 | 2.83E−05 |
| DOMAIN_17474 | *Monodelphis domestica* | 58744 | 2.683 | 0.0036059 |
| DOMAIN_17483 | *Cercocebus atys* | 58745 | 3.5742 | 3.44E−05 |
| DOMAIN_17495 | *Neomonachus schauinslandi* | 58746 | 3.1828 | 5.59E−05 |
| DOMAIN_17497 | *Monodelphis domestica* | 58747 | 2.8088 | 5.07E−05 |
| DOMAIN_17509 | *Physeter macrocephalus* | 58748 | 3.438 | 8.07E−04 |
| DOMAIN_17516 | *Monodelphis domestica* | 58749 | 3.1523 | 4.18E−04 |
| DOMAIN_17525 | *Myotis davidii* | 58750 | 3.4986 | 7.28E−04 |
| DOMAIN_17534 | *Cercocebus atys* | 58751 | 2.9374 | 0.0033612 |
| DOMAIN_17547 | *Neomonachus schauinslandi* | 58752 | 3.2455 | 5.64E−04 |
| DOMAIN_17548 | *Neomonachus schauinslandi* | 58753 | 2.8002 | 5.08E−04 |
| DOMAIN_17574 | *Cercocebus atys* | 58754 | 3.4893 | 2.80E−05 |
| DOMAIN_17632 | *Monodelphis domestica* | 58755 | 3.3689 | 2.06E−04 |
| DOMAIN_17658 | *Monodelphis domestica* | 58756 | 3.8781 | 1.99E−06 |
| DOMAIN_17662 | *Monodelphis domestica* | 58757 | 2.7612 | 0.0040459 |
| DOMAIN_17666 | *Monodelphis domestica* | 58758 | 2.6895 | 0.002059 |
| DOMAIN_17671 | *Monodelphis domestica* | 58759 | 3.0937 | 0.008519 |
| DOMAIN_17689 | *Cercocebus atys* | 58760 | 3.6469 | 1.53E−07 |
| DOMAIN_17704 | *Neomonachus schauinslandi* | 58761 | 3.1047 | 0.0028404 |
| DOMAIN_17714 | *Monodelphis domestica* | 58762 | 2.2724 | 0.0043612 |
| DOMAIN_17717 | *Physeter macrocephalus* | 58763 | 2.9442 | 7.54E−04 |
| DOMAIN_17748 | *Leptonychotes weddellii* | 58764 | 3.0918 | 2.44E−04 |
| DOMAIN_17752 | *Leptonychotes weddellii* | 58765 | 3.2541 | 4.59E−04 |
| DOMAIN_17775 | *Camelus dromedarius* | 58766 | 2.6595 | 0.0033885 |
| DOMAIN_17798 | Orangutan | 58767 | 3.3458 | 5.16E−05 |
| DOMAIN_17801 | Orangutan | 58768 | 2.9733 | 0.0022819 |
| DOMAIN_17871 | *Leptonychotes weddellii* | 58769 | 3.1894 | 1.49E−05 |
| DOMAIN_17873 | *Leptonychotes weddellii* | 58770 | 3.4076 | 3.00E−04 |
| DOMAIN_17890 | *Cercocebus atys* | 58771 | 4.2356 | 2.80E−05 |
| DOMAIN_17898 | *Enhydra lutris kenyoni* | 58772 | 3.2117 | 0.0034476 |
| DOMAIN_17903 | Orangutan | 58773 | 2.4683 | 0.0030976 |
| DOMAIN_17925 | *Otolemur garnettii* | 58774 | 2.7982 | 0.0042639 |
| DOMAIN_18048 | OwlMonkey | 58775 | 2.5186 | 0.0087422 |
| DOMAIN_18083 | *Papio anubis* | 58776 | 2.9283 | 4.79E−04 |
| DOMAIN_18100 | *Neomonachus schauinslandi* | 58777 | 2.3606 | 0.0061598 |
| DOMAIN_18103 | *Monodelphis domestica* | 58778 | 2.7334 | 0.0056181 |
| DOMAIN_18136 | *Monodelphis domestica* | 58779 | 2.7288 | 6.75E−04 |
| DOMAIN_18155 | *Sarcophilus harrisii* | 58780 | 2.7528 | 0.0052222 |
| DOMAIN_18161 | *Cercocebus atys* | 58781 | 2.6663 | 0.0060803 |
| DOMAIN_18181 | *Physeter macrocephalus* | 58782 | 4.696 | 4.59E−07 |
| DOMAIN_18203 | *Monodelphis domestica* | 58783 | 3.7912 | 4.81E−04 |
| DOMAIN_18206 | *Monodelphis domestica* | 58784 | 2.3929 | 0.0046062 |
| DOMAIN_18214 | *Physeter macrocephalus* | 58785 | 2.6389 | 0.0094737 |
| DOMAIN_18227 | OwlMonkey | 58786 | 3.5267 | 5.66E−06 |
| DOMAIN_18241 | *Leptonychotes weddellii* | 58787 | 3.8187 | 9.60E−05 |
| DOMAIN_18243 | *Felis catus* | 58788 | 3.5331 | 6.96E−04 |
| DOMAIN_18244 | *Leptonychotes weddellii* | 58789 | 3.1726 | 0.0050817 |
| DOMAIN_18272 | *Neomonachus schauinslandi* | 58790 | 2.9141 | 0.0085916 |
| DOMAIN_18303 | *Monodelphis domestica* | 58791 | 2.9174 | 0.0018489 |
| DOMAIN_18312 | *Monodelphis domestica* | 58792 | 2.8473 | 8.20E−04 |
| DOMAIN_18323 | *Monodelphis domestica* | 58793 | 2.3956 | 0.0040336 |

TABLE 19-continued

List of 1,597 KRAB domain candidates identified from the high throughput screen assessing dXR repression of the HBEGF gene and subsequent application of the following criteria: p-value < 0.01 and $\log_2$(fold change) > 2.

| Domain ID | Species | SEQ ID NO | Log2 (fold change) | P-value |
|---|---|---|---|---|
| DOMAIN_18325 | *Monodelphis domestica* | 58794 | 2.7636 | 0.0038297 |
| DOMAIN_18332 | *Monodelphis domestica* | 58795 | 3.4328 | 4.68E−04 |
| DOMAIN_18345 | *Monodelphis domestica* | 58796 | 3.349 | 4.43E−04 |
| DOMAIN_18356 | *Monodelphis domestica* | 58797 | 3.1967 | 4.67E−04 |
| DOMAIN_18385 | *Neomonachus schauinslandi* | 58798 | 2.1472 | 0.0044932 |
| DOMAIN_18415 | *Neomonachus schauinslandi* | 58799 | 2.9768 | 4.55E−04 |
| DOMAIN_18424 | *Physeter macrocephalus* | 58800 | 3.7744 | 3.31E−04 |
| DOMAIN_18426 | *Physeter macrocephalus* | 58801 | 2.8011 | 0.0079672 |
| DOMAIN_18428 | *Physeter macrocephalus* | 58802 | 2.5903 | 0.0095383 |
| DOMAIN_18433 | OwlMonkey | 58803 | 3.4614 | 0.0022427 |
| DOMAIN_18441 | *Felis catus* | 58804 | 3.7534 | 1.77E−04 |
| DOMAIN_18458 | *Monodelphis domestica* | 58805 | 3.1061 | 0.0018603 |
| DOMAIN_18459 | *Monodelphis domestica* | 58806 | 3.1352 | 2.38E−04 |
| DOMAIN_18483 | *Monodelphis domestica* | 58807 | 2.8259 | 5.19E−04 |
| DOMAIN_18485 | *Monodelphis domestica* | 58808 | 2.8817 | 0.0011922 |
| DOMAIN_18498 | OwlMonkey | 58809 | 2.7354 | 0.0021141 |
| DOMAIN_18502 | *Myotis davidii* | 58810 | 3.4127 | 1.93E−04 |
| DOMAIN_18504 | *Cercocebus atys* | 58811 | 3.2213 | 5.38E−04 |
| DOMAIN_18536 | *Camelus dromedarius* | 58812 | 3.2028 | 0.0011217 |
| DOMAIN_18580 | *Cercocebus atys* | 58813 | 4.4477 | 3.22E−06 |
| DOMAIN_18589 | *Neomonachus schauinslandi* | 58814 | 3.039 | 0.0025063 |
| DOMAIN_18594 | *Monodelphis domestica* | 58815 | 3.2119 | 0.0036607 |
| DOMAIN_18618 | *Physeter macrocephalus* | 58816 | 2.6489 | 0.0072165 |
| DOMAIN_18646 | *Monodelphis domestica* | 58817 | 2.4678 | 0.007646 |
| DOMAIN_18670 | *Neomonachus schauinslandi* | 58818 | 3.1792 | 3.80E−04 |
| DOMAIN_18677 | *Monodelphis domestica* | 58819 | 2.2686 | 0.0068996 |
| DOMAIN_18693 | *Camelus dromedarius* | 58820 | 3.0179 | 0.0013759 |
| DOMAIN_18698 | *Felis catus* | 58821 | 3.3067 | 0.0093304 |
| DOMAIN_18711 | *Vulpes vulpes* | 58822 | 2.2749 | 0.0063986 |
| DOMAIN_18724 | Chimp | 58823 | 3.2062 | 5.16E−04 |
| DOMAIN_18726 | *Myotis davidii* | 58824 | 2.9362 | 0.0025771 |
| DOMAIN_18734 | *Monodelphis domestica* | 58825 | 2.8813 | 0.0092612 |
| DOMAIN_18752 | *Monodelphis domestica* | 58826 | 3.5544 | 4.85E−05 |
| DOMAIN_18753 | *Monodelphis domestica* | 58827 | 2.6101 | 3.54E−04 |
| DOMAIN_18760 | Chimp | 58828 | 3.1806 | 7.49E−05 |
| DOMAIN_18785 | *Leptonychotes weddellii* | 58829 | 2.9139 | 0.0019203 |
| DOMAIN_18817 | *Monodelphis domestica* | 58830 | 2.2496 | 0.0091589 |
| DOMAIN_18830 | *Monodelphis domestica* | 58831 | 3.2719 | 0.0032764 |
| DOMAIN_18835 | *Camelus dromedarius* | 58832 | 2.4878 | 8.56E−05 |
| DOMAIN_18873 | *Camelus dromedarius* | 58833 | 3.262 | 0.0049846 |
| DOMAIN_18891 | Orangutan | 58834 | 3.6429 | 1.38E−06 |
| DOMAIN_18923 | *Callithrix jacchus* | 58835 | 2.2053 | 0.0054504 |
| DOMAIN_18935 | *Ovis aries* | 58836 | 3.4507 | 3.14E−05 |
| DOMAIN_18947 | *Enhydra lutris kenyoni* | 58837 | 3.3167 | 7.58E−04 |
| DOMAIN_18971 | *Enhydra lutris kenyoni* | 58838 | 3.3941 | 5.05E−06 |
| DOMAIN_18977 | Orangutan | 58839 | 3.6262 | 9.03E−06 |
| DOMAIN_18979 | Orangutan | 58840 | 2.0034 | 0.0071822 |
| DOMAIN_19005 | *Enhydra lutris kenyoni* | 58841 | 3.4092 | 4.57E−04 |
| DOMAIN_19028 | *Orangutan* | 58842 | 2.3618 | 0.0022277 |
| DOMAIN_19056 | *Bos indicus* × *Bos taurus* | 58843 | 3.0542 | 0.001874 |
| DOMAIN_19072 | *Vulpes vulpes* | 58844 | 2.8133 | 0.0016331 |
| DOMAIN_19079 | *Otolemur garnettii* | 58845 | 4.0159 | 4.88E−05 |
| DOMAIN_19125 | *Otolemur garnettii* | 58846 | 2.9892 | 8.36E−04 |
| DOMAIN_19207 | *Enhydra lutris kenyoni* | 58847 | 2.655 | 0.0091617 |
| DOMAIN_19220 | *Camelus dromedarius* | 58848 | 3.1947 | 0.0088687 |
| DOMAIN_19221 | *Camelus dromedarius* | 58849 | 3.1733 | 4.21E−04 |
| DOMAIN_19299 | *Myotis davidii* | 58850 | 2.8882 | 0.0043533 |
| DOMAIN_19351 | Orangutan | 58851 | 3.1988 | 2.17E−04 |
| DOMAIN_19385 | *Monodelphis domestica* | 58852 | 2.9198 | 0.008105 |
| DOMAIN_19387 | *Monodelphis domestica* | 58853 | 3.4706 | 1.85E−04 |
| DOMAIN_19388 | *Physeter macrocephalus* | 58854 | 3.2831 | 7.71E−04 |
| DOMAIN_19404 | *Monodelphis domestica* | 58855 | 2.0125 | 0.0031965 |
| DOMAIN_19423 | *Monodelphis domestica* | 58856 | 3.49 | 0.002544 |
| DOMAIN_19424 | *Monodelphis domestica* | 58857 | 2.5838 | 0.0041846 |
| DOMAIN_19437 | OwlMonkey | 58858 | 2.826 | 0.001773 |
| DOMAIN_19445 | *Monodelphis domestica* | 58859 | 2.1105 | 0.0078325 |
| DOMAIN_19447 | *Monodelphis domestica* | 58860 | 3.4492 | 1.40E−04 |
| DOMAIN_19487 | *Monodelphis domestica* | 58861 | 3.4312 | 6.00E−04 |
| DOMAIN_19497 | *Monodelphis domestica* | 58862 | 3.466 | 2.80E−05 |

TABLE 19-continued

List of 1,597 KRAB domain candidates identified from the high throughput screen assessing dXR repression of the HBEGF gene and subsequent application of the following criteria: p-value < 0.01 and $\log_2$(fold change) > 2.

| Domain ID | Species | SEQ ID NO | Log2 (fold change) | P-value |
|---|---|---|---|---|
| DOMAIN_19517 | *Monodelphis domestica* | 58863 | 3.3361 | 1.04E-04 |
| DOMAIN_19533 | *Papio anubis* | 58864 | 2.5831 | 4.67E-04 |
| DOMAIN_19563 | *Papio anubis* | 58865 | 2.5522 | 0.0089134 |
| DOMAIN_19580 | *Monodelphis domestica* | 58866 | 3.5716 | 3.29E-05 |
| DOMAIN_19585 | *Monodelphis domestica* | 58867 | 3.0031 | 0.0032403 |
| DOMAIN_19596 | *Monodelphis domestica* | 58868 | 3.8583 | 8.18E-05 |
| DOMAIN_19597 | *Monodelphis domestica* | 58869 | 3.5081 | 4.46E-04 |
| DOMAIN_19600 | *Monodelphis domestica* | 58870 | 2.5854 | 0.0042185 |
| DOMAIN_19602 | *Physeter macrocephalus* | 58871 | 2.7219 | 0.0058524 |
| DOMAIN_19611 | *Lipotes vexillifer* | 58872 | 3.3901 | 4.24E-04 |
| DOMAIN_19629 | *Monodelphis domestica* | 58873 | 3.0535 | 0.0017954 |
| DOMAIN_19699 | *Otolemur garnettii* | 58874 | 2.8474 | 3.15E-04 |
| DOMAIN_19708 | *Bos indicus* × *Bos taurus* | 58875 | 3.6339 | 8.02E-04 |
| DOMAIN_19713 | Chimp | 58876 | 3.845 | 2.95E-05 |
| DOMAIN_19721 | *Otolemur garnettii* | 58877 | 2.6913 | 0.0089069 |
| DOMAIN_19776 | *Enhydra lutris kenyoni* | 58878 | 2.617 | 0.0093497 |
| DOMAIN_19777 | Orangutan | 58879 | 3.2427 | 0.0075444 |
| DOMAIN_19780 | Orangutan | 58880 | 3.0867 | 1.72E-04 |
| DOMAIN_19786 | Chimp | 58881 | 2.9155 | 5.94E-04 |
| DOMAIN_19788 | *Enhydra lutris kenyoni* | 58882 | 3.3393 | 4.71E-04 |
| DOMAIN_19800 | *Zalophus californianus* | 58883 | 2.368 | 0.009162 |
| DOMAIN_19805 | *Rhinolophus ferrumequinum* | 58884 | 2.6527 | 0.0030997 |
| DOMAIN_19818 | *Rhinopithecus roxellana* | 58885 | 2.3477 | 0.0022161 |
| DOMAIN_19883 | *Zalophus californianus* | 58886 | 3.5504 | 3.42E-04 |
| DOMAIN_19886 | *Panthera pardus* | 58887 | 2.8642 | 4.04E-05 |
| DOMAIN_19889 | *Vicugna pacos* | 58888 | 3.1963 | 4.15E-05 |
| DOMAIN_19891 | *Zalophus californianus* | 58889 | 3.2135 | 0.0010023 |
| DOMAIN_19921 | *Callorhinus ursinus* | 58890 | 2.0083 | 0.0055679 |
| DOMAIN_19944 | *Zalophus californianus* | 58891 | 3.8559 | 8.71E-05 |
| DOMAIN_19947 | Bonobo | 58892 | 2.2608 | 0.00818 |
| DOMAIN_19967 | *Tursiops truncatus* | 58893 | 2.9548 | 0.0027997 |
| DOMAIN_19968 | *Tursiops truncatus* | 58894 | 2.8089 | 0.004093 |
| DOMAIN_19990 | *Panthera pardus* | 58895 | 3.5329 | 0.0018768 |
| DOMAIN_19993 | *Tursiops truncatus* | 58896 | 3.4227 | 0.0047476 |
| DOMAIN_20012 | *Leptonychotes weddellii* | 58897 | 3.8253 | 3.41E-05 |
| DOMAIN_20023 | *Physeter macrocephalus* | 58898 | 3.6893 | 5.78E-04 |
| DOMAIN_20025 | *Carlito syrichta* | 58899 | 2.2451 | 0.002157 |
| DOMAIN_20030 | *Tursiops truncatus* | 58900 | 4.1273 | 3.22E-06 |
| DOMAIN_20089 | *Panthera pardus* | 58901 | 4.2275 | 8.99E-05 |
| DOMAIN_20095 | *Phascolarctos cinereus* | 58902 | 3.7141 | 1.55E-05 |
| DOMAIN_20115 | *Physeter macrocephalus* | 58903 | 3.1154 | 0.0030089 |
| DOMAIN_20134 | *Acinonyx jubatus* | 58904 | 3.2457 | 3.20E-04 |
| DOMAIN_20136 | *Sus scrofa* | 58905 | 3.3856 | 2.94E-04 |
| DOMAIN_20147 | *Odocoileus virginianus texanus* | 58906 | 3.7467 | 1.53E-07 |
| DOMAIN_20171 | *Trichechus manatus latirostris* | 58907 | 3.951 | 1.03E-05 |
| DOMAIN_20208 | *Pteropus vampyrus* | 58908 | 2.4805 | 0.0041634 |
| DOMAIN_20249 | *Vicugna pacos* | 58909 | 2.7041 | 0.0043741 |
| DOMAIN_20250 | *Phascolarctos cinereus* | 58910 | 3.5525 | 1.37E-04 |
| DOMAIN_20287 | *Cercocebus atys* | 58911 | 3.4486 | 5.29E-04 |
| DOMAIN_20318 | *Callithrix jacchus* | 58912 | 3.5311 | 3.52E-06 |
| DOMAIN_20332 | *Callithrix jacchus* | 58913 | 3.2855 | 0.0011689 |
| DOMAIN_20336 | *Panthera pardus* | 58914 | 2.3293 | 0.0076785 |
| DOMAIN_20345 | *Cebus imitator* | 58915 | 3.8132 | 1.53E-07 |
| DOMAIN_20352 | *Vicugna pacos* | 58916 | 2.9839 | 9.79E-04 |
| DOMAIN_20359 | *Pteropus vampyrus* | 58917 | 3.9594 | 4.06E-05 |
| DOMAIN_20371 | *Ursus arctos horribilis* | 58918 | 2.8418 | 0.0061393 |
| DOMAIN_20381 | *Saimiri boliviensis boliviensis* | 58919 | 2.0412 | 0.0013486 |
| DOMAIN_20398 | *Physeter macrocephalus* | 58920 | 3.1266 | 0.0039215 |
| DOMAIN_20436 | *Sus scrofa* | 58921 | 2.724 | 0.0058616 |
| DOMAIN_20455 | *Nomascus leucogenys* | 58922 | 3.112 | 2.94E-04 |
| DOMAIN_20462 | *Trichechus manatus latirostris* | 58923 | 5.4429 | 1.53E-07 |
| DOMAIN_20469 | *Equus caballus* | 58924 | 2.7506 | 0.0077201 |
| DOMAIN_20487 | *Mandrillus leucophaeus* | 58925 | 2.8325 | 0.0020982 |
| DOMAIN_20524 | *Nomascus leucogenys* | 58926 | 3.2893 | 0.0024993 |
| DOMAIN_20537 | *Chlorocebus sabaeus* | 58927 | 3.2762 | 0.0027249 |
| DOMAIN_20540 | *Mandrillus leucophaeus* | 58928 | 2.8477 | 0.0021931 |
| DOMAIN_20545 | *Sus scrofa* | 58929 | 2.711 | 0.0086718 |
| DOMAIN_20561 | *Chrysochloris asiatica* | 58930 | 3.8309 | 3.52E-05 |

TABLE 19-continued

List of 1,597 KRAB domain candidates identified from the high throughput screen assessing dXR repression of the HBEGF gene and subsequent application of the following criteria: p-value < 0.01 and $\log_2$(fold change) > 2.

| Domain ID | Species | SEQ ID NO | Log2 (fold change) | P-value |
|---|---|---|---|---|
| DOMAIN_20565 | *Suricata suricatta* | 58931 | 3.148 | 2.90E−04 |
| DOMAIN_20601 | *Sus scrofa* | 58932 | 2.9097 | 0.0037911 |
| DOMAIN_20652 | *Neophocaena asiaeorientalis asiaeorientalis* | 58933 | 2.7283 | 0.0038931 |
| DOMAIN_20667 | *Suricata suricatta* | 58934 | 3.7485 | 1.38E−06 |
| DOMAIN_20674 | *Mandrillus leucophaeus* | 58935 | 3.3115 | 1.53E−07 |
| DOMAIN_20716 | *Suricata suricatta* | 58936 | 3.6174 | 3.02E−05 |
| DOMAIN_20729 | *Mandrillus leucophaeus* | 58937 | 2.5535 | 0.0090894 |
| DOMAIN_20746 | *Chrysochloris asiatica* | 58938 | 3.4727 | 4.79E−04 |
| DOMAIN_20767 | *Sus scrofa* | 58939 | 3.1224 | 3.16E−04 |
| DOMAIN_20835 | *Suricata suricatta* | 58940 | 3.0025 | 0.0031432 |
| DOMAIN_20915 | *Mandrillus leucophaeus* | 58941 | 2.4373 | 0.0054586 |
| DOMAIN_20998 | Bonobo | 58942 | 2.6659 | 0.0044767 |
| DOMAIN_21010 | *Equus caballus* | 58943 | 2.2253 | 0.0040982 |
| DOMAIN_21023 | *Sarcophilus harrisii* | 58944 | 3.1196 | 0.0023342 |
| DOMAIN_21067 | *Zalophus californianus* | 58945 | 3.0246 | 0.0010917 |
| DOMAIN_21082 | *Loxodonta africana* | 58946 | 3.2032 | 0.0040056 |
| DOMAIN_21086 | *Pteropus vampyrus* | 58947 | 2.1339 | 0.0079029 |
| DOMAIN_21095 | *Trichechus manatus latirostris* | 58948 | 2.5003 | 0.0091721 |
| DOMAIN_21110 | *Neovison vison* | 58949 | 2.499 | 0.0065113 |
| DOMAIN_21123 | *Callorhinus ursinus* | 58950 | 3.237 | 4.13E−04 |
| DOMAIN_21133 | *Suricata suricatta* | 58951 | 3.1021 | 4.18E−04 |
| DOMAIN_21161 | *Sarcophilus harrisii* | 58952 | 3.2208 | 5.87E−04 |
| DOMAIN_21162 | *Sarcophilus harrisii* | 58953 | 2.885 | 6.85E−04 |
| DOMAIN_21175 | *Callorhinus ursinus* | 58954 | 3.3334 | 2.29E−04 |
| DOMAIN_21197 | *Tursiops truncatus* | 58955 | 2.214 | 0.0073288 |
| DOMAIN_21226 | *Sarcophilus harrisii* | 58956 | 2.6942 | 0.0033484 |
| DOMAIN_21260 | *Pteropus vampyrus* | 58957 | 3.1806 | 0.0039855 |
| DOMAIN_21276 | *Mandrillus leucophaeus* | 58958 | 3.0178 | 0.0029699 |
| DOMAIN_21277 | OwlMonkey | 58959 | 2.7115 | 0.0075352 |
| DOMAIN_21312 | *Lipotes vexillifer* | 58960 | 3.5287 | 4.75E−06 |
| DOMAIN_21333 | *Zalophus californianus* | 58961 | 3.5801 | 3.57E−05 |
| DOMAIN_21334 | *Equus caballus* | 58962 | 2.9508 | 8.67E−04 |
| DOMAIN_21335 | *Equus caballus* | 58963 | 2.518 | 0.0034809 |
| DOMAIN_21367 | *Equus caballus* | 58964 | 2.9921 | 0.0091001 |
| DOMAIN_21369 | *Equus caballus* | 58965 | 2.7947 | 0.0011824 |
| DOMAIN_21371 | *Physeter macrocephalus* | 58966 | 3.8804 | 4.44E−06 |
| DOMAIN_21421 | *Pteropus vampyrus* | 58967 | 2.7713 | 7.52E−05 |
| DOMAIN_21481 | Bonobo | 58968 | 2.7056 | 0.0012415 |
| DOMAIN_21494 | *Tursiops truncatus* | 58969 | 3.783 | 1.36E−04 |
| DOMAIN_21583 | *Sarcophilus harrisii* | 58970 | 3.1529 | 0.0026931 |
| DOMAIN_21588 | *Callorhinus ursinus* | 58971 | 3.4914 | 5.39E−04 |
| DOMAIN_21612 | OwlMonkey | 58972 | 3.2931 | 4.09E−05 |
| DOMAIN_21626 | *Monodelphis domestica* | 58973 | 3.5419 | 1.57E−04 |
| DOMAIN_21632 | *Monodelphis domestica* | 58974 | 2.6551 | 0.0071923 |
| DOMAIN_21658 | *Monodelphis domestica* | 58975 | 3.1325 | 2.50E−04 |
| DOMAIN_21786 | *Trichechus manatus latirostris* | 58976 | 3.2249 | 2.76E−04 |
| DOMAIN_21822 | *Equus caballus* | 58977 | 3.5647 | 3.22E−06 |
| DOMAIN_21823 | *Equus caballus* | 58978 | 3.2474 | 0.0072446 |
| DOMAIN_21844 | OwlMonkey | 58979 | 3.467 | 4.44E−06 |
| DOMAIN_21862 | *Chlorocebus sabaeus* | 58980 | 2.3797 | 0.0032299 |
| DOMAIN_21889 | *Equus caballus* | 58981 | 3.6563 | 4.18E−04 |
| DOMAIN_21896 | *Lipotes vexillifer* | 58982 | 2.8718 | 0.0093653 |
| DOMAIN_21900 | *Equus caballus* | 58983 | 2.7606 | 0.0041711 |
| DOMAIN_21909 | *Suricata suricatta* | 58984 | 3.2301 | 3.40E−04 |
| DOMAIN_21928 | *Callorhinus ursinus* | 58985 | 3.758 | 1.67E−05 |
| DOMAIN_21947 | *Trichechus manatus latirostris* | 58986 | 3.1204 | 0.003623 |
| DOMAIN_21951 | *Equus caballus* | 58987 | 2.8972 | 3.24E−04 |
| DOMAIN_21985 | *Suricata suricatta* | 58988 | 3.6273 | 1.99E−06 |
| DOMAIN_21988 | *Sarcophilus harrisii* | 58989 | 3.3393 | 0.0011817 |
| DOMAIN_21993 | *Lipotes vexillifer* | 58990 | 2.5494 | 0.0039206 |
| DOMAIN_22022 | *Tursiops truncatus* | 58991 | 3.9558 | 4.44E−06 |
| DOMAIN_22079 | *Trichechus manatus latirostris* | 58992 | 3.4511 | 6.43E−04 |
| DOMAIN_22117 | *Sarcophilus harrisii* | 58993 | 2.5969 | 0.0040801 |
| DOMAIN_22143 | *Pteropus vampyrus* | 58994 | 2.6595 | 9.36E−04 |
| DOMAIN_22151 | *Trichechus manatus latirostris* | 58995 | 3.1615 | 5.26E−04 |
| DOMAIN_22158 | *Lipotes vexillifer* | 58996 | 2.0562 | 0.0010562 |

TABLE 19-continued

List of 1,597 KRAB domain candidates identified from the high throughput screen assessing dXR repression of the HBEGF gene and subsequent application of the following criteria: p-value < 0.01 and $log_2$(fold change) > 2.

| Domain ID | Species | SEQ ID NO | Log2 (fold change) | P-value |
|---|---|---|---|---|
| DOMAIN_22166 | *Trichechus manatus latirostris* | 58997 | 4.2024 | 2.53E−05 |
| DOMAIN_22192 | *Trichechus manatus latirostris* | 58998 | 2.8134 | 0.0083622 |
| DOMAIN_22220 | Bonobo | 58999 | 2.8922 | 0.0013379 |
| DOMAIN_22268 | *Lipotes vexillifer* | 59000 | 2.6534 | 0.0053876 |
| DOMAIN_22278 | *Pteropus vampyrus* | 59001 | 3.3575 | 0.0037798 |
| DOMAIN_22280 | *Pteropus vampyrus* | 59002 | 3.1521 | 0.0017347 |
| DOMAIN_22285 | *Trichechus manatus latirostris* | 59003 | 3.0261 | 6.83E−04 |
| DOMAIN_22297 | *Sarcophilus harrisii* | 59004 | 2.4261 | 0.0066953 |
| DOMAIN_22311 | *Monodelphis domestica* | 59005 | 2.9903 | 0.0017115 |
| DOMAIN_22322 | *Tursiops truncatus* | 59006 | 3.4452 | 3.85E−04 |
| DOMAIN_22366 | OwlMonkey | 59007 | 4.848 | 3.06E−07 |
| DOMAIN_22375 | *Tursiops truncatus* | 59008 | 2.5484 | 0.0090894 |
| DOMAIN_22381 | *Tursiops truncatus* | 59009 | 3.8641 | 2.63E−04 |
| DOMAIN_22383 | *Pteropus vampyrus* | 59010 | 3.4752 | 2.48E−04 |
| DOMAIN_22407 | OwlMonkey | 59011 | 2.5308 | 0.0081831 |
| DOMAIN_22425 | OwlMonkey | 59012 | 3.0333 | 0.0032208 |
| DOMAIN_22430 | *Callorhinus ursinus* | 59013 | 2.982 | 0.0064761 |
| DOMAIN_22454 | *Monodelphis domestica* | 59014 | 2.6042 | 0.0022491 |
| DOMAIN_22458 | *Monodelphis domestica* | 59015 | 3.0003 | 0.0025373 |
| DOMAIN_22459 | *Monodelphis domestica* | 59016 | 2.9261 | 0.0013171 |
| DOMAIN_22462 | *Monodelphis domestica* | 59017 | 3.5597 | 2.34E−05 |
| DOMAIN_22471 | *Papio anubis* | 59018 | 3.6293 | 1.68E−06 |
| DOMAIN_22479 | OwlMonkey | 59019 | 3.9668 | 4.18E−05 |
| DOMAIN_22483 | OwlMonkey | 59020 | 2.1702 | 0.0013107 |
| DOMAIN_22495 | *Callorhinus ursinus* | 59021 | 2.2623 | 0.0043918 |
| DOMAIN_22512 | OwlMonkey | 59022 | 2.93 | 0.003255 |
| DOMAIN_22518 | *Lipotes vexillifer* | 59023 | 2.8869 | 0.0024472 |
| DOMAIN_22520 | *Callorhinus ursinus* | 59024 | 3.3586 | 2.83E−05 |
| DOMAIN_22527 | *Tursiops truncatus* | 59025 | 2.989 | 9.71E−04 |
| DOMAIN_22566 | *Papio anubis* | 59026 | 3.5278 | 6.63E−05 |
| DOMAIN_22586 | *Nomascus leucogenys* | 59027 | 2.1811 | 0.0021723 |
| DOMAIN_22615 | *Homo sapiens* | 59028 | 3.0957 | 4.43E−04 |
| DOMAIN_22654 | *Ursus arctos horribilis* | 59029 | 3.248 | 5.59E−05 |
| DOMAIN_22667 | *Saimiri boliviensis boliviensis* | 59030 | 3.4947 | 0.0037256 |
| DOMAIN_22669 | *Balaenoptera acutorostrata scammoni* | 59031 | 3.583 | 4.34E−04 |
| DOMAIN_22692 | *Propithecus coquereli* | 59032 | 3.2791 | 3.52E−04 |
| DOMAIN_22710 | *Propithecus coquereli* | 59033 | 3.4387 | 0.0032081 |
| DOMAIN_22740 | *Panthera pardus* | 59034 | 2.692 | 0.0027611 |
| DOMAIN_22742 | *Panthera pardus* | 59035 | 2.9133 | 0.0027938 |
| DOMAIN_22768 | *Ursus maritimus* | 59036 | 4.0609 | 7.81E−06 |
| DOMAIN_22771 | *Ursus americanus* | 59037 | 3.3498 | 2.83E−05 |
| DOMAIN_22776 | *Propithecus coquereli* | 59038 | 2.7757 | 2.88E−04 |
| DOMAIN_22778 | *Saimiri boliviensis boliviensis* | 59039 | 3.1251 | 4.93E−04 |
| DOMAIN_22782 | *Vombatus ursinus* | 59040 | 3.1663 | 4.24E−04 |
| DOMAIN_22917 | *Cervus elaphus hippelaphus* | 59041 | 3.8061 | 2.77E−05 |
| DOMAIN_22919 | *Colobus angolensis palliatus* | 59042 | 2.8609 | 0.003796 |
| DOMAIN_22928 | *Tupaia chinensis* | 59043 | 3.0141 | 0.0015348 |
| DOMAIN_22937 | *Ursus arctos horribilis* | 59044 | 3.0779 | 0.0032951 |
| DOMAIN_22939 | *Muntiacus reevesi* | 59045 | 3.6187 | 1.78E−04 |
| DOMAIN_22944 | *Muntiacus reevesi* | 59046 | 3.3908 | 5.28E−04 |
| DOMAIN_23007 | *Lynx pardinus* | 59047 | 3.7329 | 1.09E−04 |
| DOMAIN_23009 | *Saimiri boliviensis boliviensis* | 59048 | 3.1269 | 0.0062706 |
| DOMAIN_23011 | *Cervus elaphus hippelaphus* | 59049 | 3.6236 | 3.51E−05 |
| DOMAIN_23012 | *Cervus elaphus hippelaphus* | 59050 | 3.6131 | 2.50E−04 |
| DOMAIN_23013 | *Cervus elaphus hippelaphus* | 59051 | 3.4615 | 4.85E−04 |
| DOMAIN_23018 | *Colobus angolensis palliatus* | 59052 | 3.4177 | 2.30E−04 |
| DOMAIN_23039 | *Saimiri boliviensis boliviensis* | 59053 | 2.8829 | 5.70E−04 |
| DOMAIN_23040 | *Saimiri boliviensis boliviensis* | 59054 | 2.5742 | 0.0056531 |
| DOMAIN_23041 | *Vombatus ursinus* | 59055 | 3.6194 | 1.92E−04 |
| DOMAIN_23050 | *Balaenoptera acutorostrata scammoni* | 59056 | 2.9754 | 0.003318 |
| DOMAIN_23082 | *Mustela putorius furo* | 59057 | 3.9481 | 5.17E−05 |

TABLE 19-continued

List of 1,597 KRAB domain candidates identified from the high throughput screen assessing dXR repression of the HBEGF gene and subsequent application of the following criteria: p-value < 0.01 and $\log_2$(fold change) > 2.

| Domain ID | Species | SEQ ID NO | Log2 (fold change) | P-value |
|---|---|---|---|---|
| DOMAIN_23093 | *Propithecus coquereli* | 59058 | 3.2165 | 5.48E−04 |
| DOMAIN_23109 | *Mustela putorius furo* | 59059 | 2.9639 | 0.0019589 |
| DOMAIN_23113 | *Camelus ferus* | 59060 | 3.4612 | 3.52E−04 |
| DOMAIN_23136 | *Vicugna pacos* | 59061 | 3.285 | 2.16E−04 |
| DOMAIN_23181 | *Colobus angolensis palliatus* | 59062 | 2.7665 | 0.0021609 |
| DOMAIN_23196 | *Odobenus rosmarus divergens* | 59063 | 4.3363 | 3.22E−06 |
| DOMAIN_23200 | *Ursus americanus* | 59064 | 3.755 | 1.84E−06 |
| DOMAIN_23215 | *Vombatus ursinus* | 59065 | 3.0212 | 0.0035725 |
| DOMAIN_23217 | *Vombatus ursinus* | 59066 | 4.1674 | 2.76E−06 |
| DOMAIN_23239 | *Vicugna pacos* | 59067 | 3.0945 | 0.0090937 |
| DOMAIN_23250 | *Delphinapterus leucas* | 59068 | 2.71 | 3.14E−04 |
| DOMAIN_23260 | *Tupaia chinensis* | 59069 | 2.7567 | 0.0029622 |
| DOMAIN_23281 | *Colobus angolensis palliatus* | 59070 | 2.5048 | 0.0036625 |
| DOMAIN_23286 | *Mustela putorius furo* | 59071 | 3.3651 | 1.66E−04 |
| DOMAIN_23301 | *Gulo gulo* | 59072 | 2.6839 | 0.0035226 |
| DOMAIN_23323 | *Erinaceus europaeus* | 59073 | 3.2619 | 0.0031362 |
| DOMAIN_23331 | *Carlito syrichta* | 59074 | 2.8995 | 5.23E−04 |
| DOMAIN_23336 | *Carlito syrichta* | 59075 | 2.239 | 0.0065533 |
| DOMAIN_23341 | *Carlito syrichta* | 59076 | 2.656 | 0.0058992 |
| DOMAIN_23375 | *Vicugna pacos* | 59077 | 3.266 | 7.64E−04 |
| DOMAIN_23378 | *Odobenus rosmarus divergens* | 59078 | 3.0623 | 0.0016508 |
| DOMAIN_23419 | *Gulo gulo* | 59079 | 3.5213 | 7.41E−04 |
| DOMAIN_23453 | *Carlito syrichta* | 59080 | 2.2331 | 0.006161 |
| DOMAIN_23454 | *Carlito syrichta* | 59081 | 3.0632 | 7.96E−04 |
| DOMAIN_23458 | *Vicugna pacos* | 59082 | 2.4232 | 0.0045857 |
| DOMAIN_23480 | *Odobenus rosmarus divergens* | 59083 | 3.4432 | 3.38E−04 |
| DOMAIN_23494 | *Mustela putorius furo* | 59084 | 3.847 | 5.05E−06 |
| DOMAIN_23508 | *Mustela putorius furo* | 59085 | 2.3582 | 0.0047712 |
| DOMAIN_23513 | *Tupaia chinensis* | 59086 | 3.2927 | 5.31E−05 |
| DOMAIN_23514 | *Odobenus rosmarus divergens* | 59087 | 3.0166 | 4.77E−04 |
| DOMAIN_23561 | *Colobus angolensis palliatus* | 59088 | 3.2392 | 0.0021906 |
| DOMAIN_23574 | *Gulo gulo* | 59089 | 2.939 | 0.0083249 |
| DOMAIN_23575 | *Erinaceus europaeus* | 59090 | 3.4624 | 0.001589 |
| DOMAIN_23576 | *Erinaceus europaeus* | 59091 | 3.8014 | 2.89E−05 |
| DOMAIN_23590 | *Odobenus rosmarus divergens* | 59092 | 2.8653 | 0.0052881 |
| DOMAIN_23604 | *Vicugna pacos* | 59093 | 2.6984 | 0.0046123 |
| DOMAIN_23641 | *Carlito syrichta* | 59094 | 2.6942 | 0.0081075 |
| DOMAIN_23642 | *Delphinapterus leucas* | 59095 | 3.8829 | 2.28E−04 |
| DOMAIN_23654 | *Carlito syrichta* | 59096 | 2.337 | 0.0083622 |
| DOMAIN_23679 | *Tupaia chinensis* | 59097 | 3.7951 | 5.10E−05 |
| DOMAIN_23680 | *Vicugna pacos* | 59098 | 2.712 | 0.0034785 |
| DOMAIN_23709 | *Carlito syrichta* | 59099 | 4.545 | 1.53E−07 |
| DOMAIN_23711 | *Gulo gulo* | 59100 | 2.658 | 0.0016432 |
| DOMAIN_23721 | *Carlito syrichta* | 59101 | 2.972 | 0.0022972 |
| DOMAIN_23731 | *Colobus angolensis palliatus* | 59102 | 3.1609 | 2.35E−04 |
| DOMAIN_23745 | *Myotis brandtii* | 59103 | 3.4544 | 3.54E−04 |
| DOMAIN_23793 | *Odobenus rosmarus divergens* | 59104 | 2.7573 | 0.0081197 |
| DOMAIN_23804 | *Colobus angolensis palliatus* | 59105 | 2.3403 | 0.0086366 |
| DOMAIN_23827 | *Odobenus rosmarus divergens* | 59106 | 2.3013 | 0.009767 |
| DOMAIN_23854 | *Gulo gulo* | 59107 | 3.838 | 7.18E−05 |
| DOMAIN_23856 | *Erinaceus europaeus* | 59108 | 3.1072 | 0.0035694 |
| DOMAIN_23863 | *Mustela putorius furo* | 59109 | 2.8758 | 0.0085493 |
| DOMAIN_23885 | *Colobus angolensis palliatus* | 59110 | 3.033 | 0.0034316 |
| DOMAIN_23895 | *Mustela putorius furo* | 59111 | 2.6148 | 0.003318 |
| DOMAIN_23898 | *Mustela putorius furo* | 59112 | 2.7383 | 0.0035921 |
| DOMAIN_23916 | *Odobenus rosmarus divergens* | 59113 | 3.3232 | 1.63E−04 |
| DOMAIN_23931 | *Gulo gulo* | 59114 | 3.8077 | 1.49E−05 |
| DOMAIN_23940 | *Homo sapiens* | 59115 | 2.5087 | 0.0010424 |
| DOMAIN_23953 | *Muntiacus reevesi* | 59116 | 2.4156 | 0.0075055 |

TABLE 19-continued

List of 1,597 KRAB domain candidates identified from the high throughput screen assessing dXR repression of the HBEGF gene and subsequent application of the following criteria: p-value < 0.01 and $log_2$(fold change) > 2.

| Domain ID | Species | SEQ ID NO | Log2 (fold change) | P-value |
|---|---|---|---|---|
| DOMAIN_23979 | *Balaenoptera acutorostrata scammoni* | 59117 | 4.0461 | 5.77E−05 |
| DOMAIN_24020 | *Rhinolophus ferrumequinum* | 59118 | 3.1125 | 1.66E−04 |
| DOMAIN_24028 | *Ursus arctos horribilis* | 59119 | 3.8797 | 1.53E−07 |
| DOMAIN_24035 | *Propithecus coquereli* | 59120 | 3.2225 | 0.0017975 |
| DOMAIN_24042 | *Propithecus coquereli* | 59121 | 3.3038 | 4.75E−06 |
| DOMAIN_24083 | *Myotis brandtii* | 59122 | 3.9804 | 2.77E−05 |
| DOMAIN_24113 | *Propithecus coquereli* | 59123 | 3.3264 | 2.89E−04 |
| DOMAIN_24152 | *Vombatus ursinus* | 59124 | 3.3664 | 0.0022672 |
| DOMAIN_24204 | *Propithecus coquereli* | 59125 | 3.0779 | 4.60E−04 |
| DOMAIN_24212 | *Pteropus alecto* | 59126 | 2.498 | 0.0034998 |
| DOMAIN_24230 | *Muntiacus reevesi* | 59127 | 3.1832 | 1.53E−07 |
| DOMAIN_24256 | *Ursus arctos horribilis* | 59128 | 2.7933 | 0.0018808 |
| DOMAIN_24282 | *Muntiacus reevesi* | 59129 | 2.694 | 0.0052575 |
| DOMAIN_24306 | *Propithecus coquereli* | 59130 | 3.2084 | 0.0023952 |
| DOMAIN_24317 | *Myotis brandtii* | 59131 | 3.9767 | 3.17E−05 |
| DOMAIN_24379 | *Macaca nemestrina* | 59132 | 2.4643 | 0.0086804 |
| DOMAIN_24393 | *Propithecus coquereli* | 59133 | 3.8008 | 2.45E−06 |
| DOMAIN_24446 | *Propithecus coquereli* | 59134 | 3.6312 | 7.27E−05 |
| DOMAIN_24463 | *Balaenoptera acutorostrata scammoni* | 59135 | 2.5362 | 0.007147 |
| DOMAIN_24496 | *Ursus americanus* | 59136 | 3.6403 | 4.24E−04 |
| DOMAIN_24515 | *Balaenoptera acutorostrata scammoni* | 59137 | 3.7358 | 5.28E−05 |
| DOMAIN_24518 | *Balaenoptera acutorostrata scammoni* | 59138 | 3.4135 | 3.05E−05 |
| DOMAIN_24546 | *Ursus americanus* | 59139 | 3.4262 | 8.42E−06 |
| DOMAIN_24570 | *Saimiri boliviensis boliviensis* | 59140 | 3.6773 | 1.45E−05 |
| DOMAIN_24571 | *Balaenoptera acutorostrata scammoni* | 59141 | 2.6912 | 0.0038376 |
| DOMAIN_24600 | *Ursus americanus* | 59142 | 3.156 | 0.0012483 |
| DOMAIN_24614 | *Cervus elaphus hippelaphus* | 59143 | 2.6295 | 0.0046463 |
| DOMAIN_24615 | *Colobus angolensis palliatus* | 59144 | 2.4075 | 0.0069247 |
| DOMAIN_24653 | *Cervus elaphus hippelaphus* | 59145 | 2.9883 | 0.0083016 |
| DOMAIN_24677 | *Lynx pardinus* | 59146 | 2.3115 | 0.0094713 |
| DOMAIN_24719 | *Muntiacus reevesi* | 59147 | 2.7499 | 0.005142 |
| DOMAIN_24725 | *Ursus arctos horribilis* | 59148 | 3.4496 | 4.09E−05 |
| DOMAIN_24771 | *Myotis brandtii* | 59149 | 3.3701 | 0.0025351 |
| DOMAIN_24786 | *Vombatus ursinus* | 59150 | 2.9237 | 0.0078001 |
| DOMAIN_24788 | *Vombatus ursinus* | 59151 | 2.7694 | 0.0021557 |
| DOMAIN_24838 | *Pteropus alecto* | 59152 | 2.3323 | 0.0042954 |
| DOMAIN_24867 | *Nomascus leucogenys* | 59153 | 3.469 | 2.97E−04 |
| DOMAIN_24903 | *Ailuropoda melanoleuca* | 59154 | 3.0377 | 0.0030054 |
| DOMAIN_24939 | *Phascolarctos cinereus* | 59155 | 3.3066 | 6.08E−04 |
| DOMAIN_24947 | *Ursus maritimus* | 59156 | 2.9491 | 0.0055208 |
| DOMAIN_24975 | *Muntiacus muntjak* | 59157 | 3.2737 | 0.0069767 |
| DOMAIN_24993 | *Oryctolagus cuniculus* | 59158 | 3.3817 | 5.00E−04 |
| DOMAIN_25016 | *Oryctolagus cuniculus* | 59159 | 2.9822 | 0.0034776 |
| DOMAIN_25052 | *Pteropus alecto* | 59160 | 2.3634 | 0.0072024 |
| DOMAIN_25060 | *Ailuropoda melanoleuca* | 59161 | 3.6002 | 4.82E−04 |
| DOMAIN_25063 | *Phascolarctos cinereus* | 59162 | 2.9436 | 0.0042752 |
| DOMAIN_25070 | *Sapajus apella* | 59163 | 2.9649 | 0.0043634 |
| DOMAIN_25091 | *Phascolarctos cinereus* | 59164 | 2.9006 | 0.0039332 |
| DOMAIN_25094 | *Phascolarctos cinereus* | 59165 | 3.0413 | 0.0026876 |
| DOMAIN_25106 | *Canis lupus familiaris* | 59166 | 2.8622 | 0.0075508 |
| DOMAIN_25126 | *Puma concolor* | 59167 | 2.1478 | 0.005514 |
| DOMAIN_25128 | *Sapajus apella* | 59168 | 2.588 | 0.0029475 |
| DOMAIN_25131 | *Sapajus apella* | 59169 | 2.592 | 0.0051895 |
| DOMAIN_25146 | *Macaca nemestrina* | 59170 | 3.629 | 1.68E−06 |
| DOMAIN_25150 | *Muntiacus reevesi* | 59171 | 3.147 | 0.0018391 |
| DOMAIN_25157 | *Myotis brandtii* | 59172 | 3.0902 | 0.0012442 |
| DOMAIN_25194 | *Macaca nemestrina* | 59173 | 2.4613 | 0.003597 |
| DOMAIN_25204 | *Panthera pardus* | 59174 | 2.7595 | 0.0027917 |
| DOMAIN_25234 | *Saimiri boliviensis boliviensis* | 59175 | 2.743 | 0.0042296 |
| DOMAIN_25235 | *Oryctolagus cuniculus* | 59176 | 3.6965 | 1.76E−05 |
| DOMAIN_25334 | *Phascolarctos cinereus* | 59177 | 2.7501 | 0.0096299 |
| DOMAIN_25384 | *Rhinolophus ferrumequinum* | 59178 | 3.5139 | 8.10E−05 |
| DOMAIN_25389 | *Ursus maritimus* | 59179 | 3.0814 | 6.54E−04 |

TABLE 19-continued

List of 1,597 KRAB domain candidates identified from the high throughput screen assessing dXR repression of the HBEGF gene and subsequent application of the following criteria: p-value < 0.01 and $log_2$(fold change) > 2.

| Domain ID | Species | SEQ ID NO | Log2 (fold change) | P-value |
|---|---|---|---|---|
| DOMAIN_25400 | *Lynx canadensis* | 59180 | 2.2285 | 3.10E−04 |
| DOMAIN_25410 | *Puma concolor* | 59181 | 2.8699 | 0.0022843 |
| DOMAIN_25443 | *Muntiacus reevesi* | 59182 | 3.2531 | 0.0016615 |
| DOMAIN_25534 | *Ursus maritimus* | 59183 | 2.2698 | 0.0054246 |
| DOMAIN_25554 | *Panthera pardus* | 59184 | 3.0101 | 0.003898 |
| DOMAIN_25564 | *Muntiacus reevesi* | 59185 | 3.4378 | 6.04E−04 |
| DOMAIN_25565 | *Muntiacus reevesi* | 59186 | 2.6133 | 0.0011572 |
| DOMAIN_25623 | *Ursus maritimus* | 59187 | 3.4886 | 2.91E−06 |
| DOMAIN_25628 | *Rhinopithecus bieti* | 59188 | 2.8332 | 0.0022213 |
| DOMAIN_25649 | *Ursus arctos horribilis* | 59189 | 3.6884 | 5.62E−05 |
| DOMAIN_25654 | *Pteropus alecto* | 59190 | 2.2996 | 0.0031144 |
| DOMAIN_25671 | *Muntiacus reevesi* | 59191 | 3.5244 | 1.53E−07 |
| DOMAIN_25682 | *Rhinopithecus bieti* | 59192 | 2.5621 | 0.002108 |
| DOMAIN_25686 | *Panthera pardus* | 59193 | 2.8635 | 0.0031882 |
| DOMAIN_25726 | *Pteropus alecto* | 59194 | 2.8203 | 0.0039506 |
| DOMAIN_25741 | *Sapajus apella* | 59195 | 3.7244 | 1.32E−04 |
| DOMAIN_25780 | *Rhinopithecus bieti* | 59196 | 2.8383 | 0.0018385 |
| DOMAIN_25807 | *Puma concolor* | 59197 | 3.6511 | 0.0018679 |
| DOMAIN_25842 | *Rhinolophus ferrumequinum* | 59198 | 3.0942 | 2.44E−04 |
| DOMAIN_25844 | *Ursus maritimus* | 59199 | 2.5635 | 0.0037997 |
| DOMAIN_25857 | *Balaenoptera acutorostrata scammoni* | 59200 | 2.898 | 0.0026959 |
| DOMAIN_25865 | *Vombatus ursinus* | 59201 | 3.1027 | 0.0066133 |
| DOMAIN_25869 | *Vombatus ursinus* | 59202 | 2.3538 | 0.006932 |
| DOMAIN_25972 | *Geotrypetes seraphini* | 59203 | 3.2178 | 0.0036689 |
| DOMAIN_25973 | *Geotrypetes seraphini* | 59204 | 2.7804 | 0.001766 |
| DOMAIN_25996 | *Geotrypetes seraphini* | 59205 | 3.984 | 1.24E−05 |
| DOMAIN_26010 | *Geotrypetes seraphini* | 59206 | 2.1911 | 0.008383 |
| DOMAIN_26012 | *Geotrypetes seraphini* | 59207 | 2.3532 | 9.70E−04 |
| DOMAIN_26044 | *Geotrypetes seraphini* | 59208 | 2.8874 | 0.0068616 |
| DOMAIN_26103 | *Geotrypetes seraphini* | 59209 | 2.5308 | 0.0033422 |
| DOMAIN_26127 | *Geotrypetes seraphini* | 59210 | 2.5183 | 0.00586 |
| DOMAIN_26131 | *Geotrypetes seraphini* | 59211 | 2.4087 | 0.0068533 |
| DOMAIN_26134 | *Geotrypetes seraphini* | 59212 | 2.4433 | 0.0072939 |
| DOMAIN_26163 | *Geotrypetes seraphini* | 59213 | 2.4527 | 0.0041806 |
| DOMAIN_26177 | *Geotrypetes seraphini* | 59214 | 3.4467 | 1.27E−05 |
| DOMAIN_26180 | *Geotrypetes seraphini* | 59215 | 3.4522 | 1.35E−04 |
| DOMAIN_26194 | *Geotrypetes seraphini* | 59216 | 2.8857 | 0.0031518 |
| DOMAIN_26211 | *Pelodiscus sinensis* | 59217 | 2.6058 | 0.0064871 |
| DOMAIN_26233 | *Colinus virginianus* | 59218 | 3.6739 | 1.77E−04 |
| DOMAIN_26236 | *Pelodiscus sinensis* | 59219 | 2.7094 | 0.003991 |
| DOMAIN_26265 | *Geotrypetes seraphini* | 59220 | 2.5922 | 3.31E−04 |
| DOMAIN_26268 | *Geotrypetes seraphini* | 59221 | 2.1404 | 0.0020397 |
| DOMAIN_26292 | *Geotrypetes seraphini* | 59222 | 2.4722 | 0.0074388 |
| DOMAIN_26299 | *Geotrypetes seraphini* | 59223 | 2.3704 | 0.0058481 |
| DOMAIN_26305 | *Geotrypetes seraphini* | 59224 | 3.0107 | 0.0084216 |
| DOMAIN_26306 | *Geotrypetes seraphini* | 59225 | 2.6178 | 0.0051922 |
| DOMAIN_26335 | *Colinus virginianus* | 59226 | 4.0965 | 3.41E−04 |
| DOMAIN_26340 | *Pelodiscus sinensis* | 59227 | 3.1704 | 0.003352 |
| DOMAIN_26353 | *Pelodiscus sinensis* | 59228 | 3.5785 | 1.16E−04 |
| DOMAIN_26373 | *Pseudonaja textilis* | 59229 | 3.3204 | 5.13E−04 |
| DOMAIN_26407 | *Colinus virginianus* | 59230 | 2.9778 | 0.0049206 |
| DOMAIN_26414 | *Pelodiscus sinensis* | 59231 | 2.9544 | 0.0089308 |
| DOMAIN_26415 | *Pelodiscus sinensis* | 59232 | 2.5032 | 0.0035489 |
| DOMAIN_26416 | *Pelodiscus sinensis* | 59233 | 3.6321 | 4.36E−05 |
| DOMAIN_26417 | *Pelodiscus sinensis* | 59234 | 4.1057 | 4.46E−05 |
| DOMAIN_26423 | *Pelodiscus sinensis* | 59235 | 3.0169 | 0.0025697 |
| DOMAIN_26430 | *Pelodiscus sinensis* | 59236 | 2.6946 | 0.0051824 |
| DOMAIN_26439 | *Pelodiscus sinensis* | 59237 | 3.2468 | 0.0010568 |
| DOMAIN_26463 | *Pelodiscus sinensis* | 59238 | 2.8812 | 0.003427 |
| DOMAIN_26469 | *Pelodiscus sinensis* | 59239 | 3.021 | 5.08E−04 |
| DOMAIN_26496 | *Geotrypetes seraphini* | 59240 | 2.7991 | 0.0040994 |
| DOMAIN_26501 | *Geotrypetes seraphini* | 59241 | 2.6513 | 0.0041882 |
| DOMAIN_26518 | *Geotrypetes seraphini* | 59242 | 2.397 | 0.0087878 |
| DOMAIN_26577 | *Geotrypetes seraphini* | 59243 | 2.4722 | 0.0035247 |
| DOMAIN_26634 | *Gopherus agassizii* | 59244 | 2.8182 | 0.0079972 |
| DOMAIN_26636 | *Gopherus agassizii* | 59245 | 2.6934 | 0.0090052 |
| DOMAIN_26660 | *Phasianus colchicus* | 59246 | 3.201 | 4.90E−04 |
| DOMAIN_26679 | *Paroedura picta* | 59247 | 2.6033 | 0.001326 |
| DOMAIN_26780 | *Meleagris gallopavo* | 59248 | 3.1696 | 0.0031591 |
| DOMAIN_26783 | *Meleagris gallopavo* | 59249 | 3.2848 | 0.0020241 |
| DOMAIN_26795 | *Meleagris gallopavo* | 59250 | 3.3538 | 0.001228 |

TABLE 19-continued

List of 1,597 KRAB domain candidates identified from the high throughput screen assessing dXR repression of the HBEGF gene and subsequent application of the following criteria: p-value < 0.01 and $log_2$(fold change) > 2.

| Domain ID | Species | SEQ ID NO | Log2 (fold change) | P-value |
|---|---|---|---|---|
| DOMAIN_26800 | *Meleagris gallopavo* | 59251 | 3.8197 | 1.62E−04 |
| DOMAIN_26803 | *Aquila chrysaetos chrysaetos* | 59252 | 3.4265 | 0.001246 |
| DOMAIN_26852 | *Mus musculus* | 59253 | 2.8783 | 0.0025253 |
| DOMAIN_26853 | *Mus musculus* | 59254 | 3.6235 | 7.59E−04 |
| DOMAIN_26886 | *Homo sapiens* | 59255 | 3.3209 | 0.0016312 |
| DOMAIN_26925 | *Alligator sinensis* | 59256 | 3.2248 | 0.0036928 |
| DOMAIN_26999 | *Xenopus laevis* | 59257 | 3.4317 | 4.75E−06 |
| DOMAIN_27032 | *Alligator mississippiensis* | 59258 | 3.4805 | 0.0019423 |
| DOMAIN_27285 | *Peromyscus maniculatus bairdii* | 59259 | 3.092 | 5.16E−04 |
| DOMAIN_27498 | *Sus scrofa* | 59260 | 2.9278 | 0.0029754 |
| DOMAIN_27521 | *Suricata suricatta* | 59261 | 2.7447 | 0.0010703 |
| DOMAIN_27563 | *Muntiacus muntjak* | 59262 | 3.6292 | 6.63E−05 |
| DOMAIN_27566 | *Muntiacus muntjak* | 59263 | 2.7825 | 0.0020795 |
| DOMAIN_27579 | *Muntiacus muntjak* | 59264 | 3.8878 | 7.50E−06 |
| DOMAIN_27581 | *Canis lupus familiaris* | 59265 | 2.4582 | 0.0090172 |
| DOMAIN_27639 | *Macaca fascicularis* | 59266 | 2.452 | 0.0032574 |
| DOMAIN_27642 | *Puma concolor* | 59267 | 2.8615 | 0.0015287 |
| DOMAIN_27690 | *Myotis lucifugus* | 59268 | 3.1465 | 0.0012118 |
| DOMAIN_27705 | *Phascolarctos cinereus* | 59269 | 2.5921 | 0.0030483 |
| DOMAIN_27759 | *Bos taurus* | 59270 | 2.2124 | 0.0070756 |
| DOMAIN_27767 | *Callithrix jacchus* | 59271 | 2.2153 | 0.0023952 |
| DOMAIN_27777 | *Odocoileus virginianus texanus* | 59272 | 2.6766 | 0.0067364 |
| DOMAIN_27784 | *Ovis aries* | 59273 | 2.1631 | 0.0040915 |
| DOMAIN_27809 | *Cebus imitator* | 59274 | 2.8715 | 0.0025161 |
| DOMAIN_27827 | *Vulpes vulpes* | 59275 | 3.1318 | 2.13E−05 |
| DOMAIN_27833 | *Callithrix jacchus* | 59276 | 3.0164 | 4.27E−04 |
| DOMAIN_27866 | Orangutan | 59277 | 2.9226 | 0.0029981 |
| DOMAIN_27886 | *Bison bison bison* | 59278 | 2.735 | 0.0036356 |
| DOMAIN_27902 | *Vulpes vulpes* | 59279 | 2.9068 | 0.0039341 |
| DOMAIN_27988 | *Camelus dromedarius* | 59280 | 2.5381 | 0.0015476 |
| DOMAIN_28051 | *Neomonachus schauinslandi* | 59281 | 2.4353 | 0.0018581 |
| DOMAIN_28071 | *Enhydra lutris kenyoni* | 59282 | 3.2938 | 2.61E−04 |
| DOMAIN_28085 | *Enhydra lutris kenyoni* | 59283 | 2.2962 | 0.0029074 |
| DOMAIN_28103 | *Physeter macrocephalus* | 59284 | 2.4116 | 0.009594 |
| DOMAIN_28118 | OwlMonkey | 59285 | 3.1049 | 0.0027807 |
| DOMAIN_28158 | *Odocoileus virginianus texanus* | 59286 | 3.0762 | 0.0016156 |
| DOMAIN_28164 | *Callithrix jacchus* | 59287 | 2.7356 | 0.0064115 |
| DOMAIN_28299 | *Capra hircus* | 59288 | 3.5584 | 6.41E−05 |
| DOMAIN_28309 | *Pteropus vampyrus* | 59289 | 3.5338 | 3.28E−04 |
| DOMAIN_28335 | Bonobo | 59290 | 3.3013 | 2.50E−04 |
| DOMAIN_28341 | *Homo sapiens* | 59291 | 2.7008 | 5.14E−04 |
| DOMAIN_28417 | *Gulo gulo* | 59292 | 2.5366 | 5.02E−04 |
| DOMAIN_28421 | *Erinaceus europaeus* | 59293 | 3.0763 | 0.0038713 |
| DOMAIN_28507 | *Muntiacus reevesi* | 59294 | 3.2874 | 8.76E−04 |
| DOMAIN_28513 | *Propithecus coquereli* | 59295 | 2.3747 | 0.0050076 |
| DOMAIN_28533 | *Propithecus coquereli* | 59296 | 2.7575 | 0.0031303 |
| DOMAIN_28588 | *Rhinolophus ferrumequinum* | 59297 | 2.6131 | 0.0030648 |
| DOMAIN_28619 | *Rhinolophus ferrumequinum* | 59298 | 2.6504 | 0.0027237 |
| DOMAIN_28823 | *Microcaecilia unicolor* | 59299 | 2.331 | 0.0078575 |
| DOMAIN_28845 | *Camelus ferus* | 59300 | 3.0175 | 0.0017733 |
| DOMAIN_28929 | *Mus musculus* | 59301 | 3.1025 | 6.70E−04 |
| DOMAIN_29066 | *Xenopus tropicalis* | 59302 | 2.6393 | 3.67E−04 |
| DOMAIN_29164 | *Chelonia mydas* | 59303 | 2.1345 | 0.0029635 |
| DOMAIN_29260 | *Peromyscus maniculatus bairdii* | 59304 | 2.5127 | 0.0074146 |
| DOMAIN_29339 | *Mesocricetus auratus* | 59305 | 2.9581 | 0.0028165 |
| DOMAIN_29377 | *Mesocricetus auratus* | 59306 | 2.672 | 0.0070692 |
| DOMAIN_29426 | *Mus caroli* | 59307 | 2.0491 | 6.64E−04 |
| DOMAIN_29434 | *Mus caroli* | 59308 | 2.2707 | 0.005184 |
| DOMAIN_29467 | *Mus caroli* | 59309 | 3.4689 | 5.79E−05 |
| DOMAIN_29471 | *Cricetulus griseus* | 59310 | 3.1911 | 4.18E−05 |
| DOMAIN_29511 | *Peromyscus maniculatus bairdii* | 59311 | 3.4739 | 7.00E−05 |
| DOMAIN_29614 | *Peromyscus maniculatus bairdii* | 59312 | 3.4528 | 1.82E−04 |
| DOMAIN_29616 | *Mesocricetus auratus* | 59313 | 2.2807 | 0.0035376 |

TABLE 19-continued

List of 1,597 KRAB domain candidates identified from the high throughput screen assessing dXR repression of the HBEGF gene and subsequent application of the following criteria: p-value < 0.01 and $log_2$(fold change) > 2.

| Domain ID | Species | SEQ ID NO | Log2 (fold change) | P-value |
|---|---|---|---|---|
| DOMAIN_29765 | *Erinaceus europaeus* | 59314 | 3.3088 | 9.79E−04 |
| DOMAIN_29900 | *Nomascus leucogenys* | 59315 | 2.1583 | 0.0098463 |
| DOMAIN_30185 | *Rhinopithecus roxellana* | 59316 | 3.0766 | 5.83E−05 |
| DOMAIN_30211 | *Bison bison bison* | 59317 | 2.3322 | 0.0023122 |
| DOMAIN_30236 | *Callithrix jacchus* | 59318 | 2.7293 | 0.0021744 |
| DOMAIN_30329 | Rhesus | 59319 | 2.1216 | 0.0099018 |
| DOMAIN_30783 | Chimp | 59320 | 2.952 | 0.001698 |
| DOMAIN_31235 | *Vicugna pacos* | 59321 | 2.2828 | 0.0067045 |
| DOMAIN_31340 | *Homo sapiens* | 59322 | 2.8261 | 0.0021028 |
| DOMAIN_31383 | *Propithecus coquereli* | 59323 | 2.1919 | 0.0087058 |
| DOMAIN_31638 | *Balaenoptera acutorostrata scammoni* | 59324 | 2.0254 | 0.0036297 |
| DOMAIN_31798 | *Notechis scutatus* | 59325 | 4.8007 | 7.82E−04 |
| DOMAIN_31935 | *Rhinolophus ferrumequinum* | 59326 | 3.5544 | 0.0084786 |
| DOMAIN_32127 | Human | 59327 | 3.7547 | 2.62E−05 |
| DOMAIN_32145 | Human | 59328 | 3.1866 | 1.67E−05 |
| DOMAIN_32146 | Human | 59329 | 2.7628 | 0.0016129 |
| DOMAIN_32159 | Human | 59330 | 2.7874 | 0.0021753 |
| DOMAIN_32215 | Human | 59331 | 3.2653 | 0.001461 |
| DOMAIN_32223 | Human | 59332 | 2.8836 | 0.0068873 |
| DOMAIN_32255 | Human | 59333 | 3.8237 | 1.39E−05 |
| DOMAIN_32279 | Human | 59334 | 2.4917 | 0.0060199 |
| DOMAIN_32286 | Human | 59335 | 2.8921 | 0.0070992 |
| DOMAIN_32312 | Human | 59336 | 2.9151 | 0.0030308 |
| DOMAIN_32321 | Human | 59337 | 3.0441 | 0.0040854 |
| DOMAIN_32327 | Human | 59338 | 3.1024 | 0.0044212 |
| DOMAIN_32334 | Human | 59339 | 2.8117 | 0.0015241 |
| DOMAIN_32351 | Human | 59340 | 2.0727 | 0.0036362 |
| DOMAIN_32386 | Human | 59341 | 3.5521 | 3.87E−04 |
| DOMAIN_32390 | Human | 59342 | 3.757 | 4.30E−05 |

The KRAB domain with the highest $log_2$(fold change) was derived from the king cobra, *Ophiophagus hannah* (DOMAIN_26749; SEQ ID NO: 57755). Surprisingly, this sequence was highly divergent from human KRAB domains (with only 41% sequence identity) and was grouped in a sequence cluster of poor repressor domains.

Figure 17:
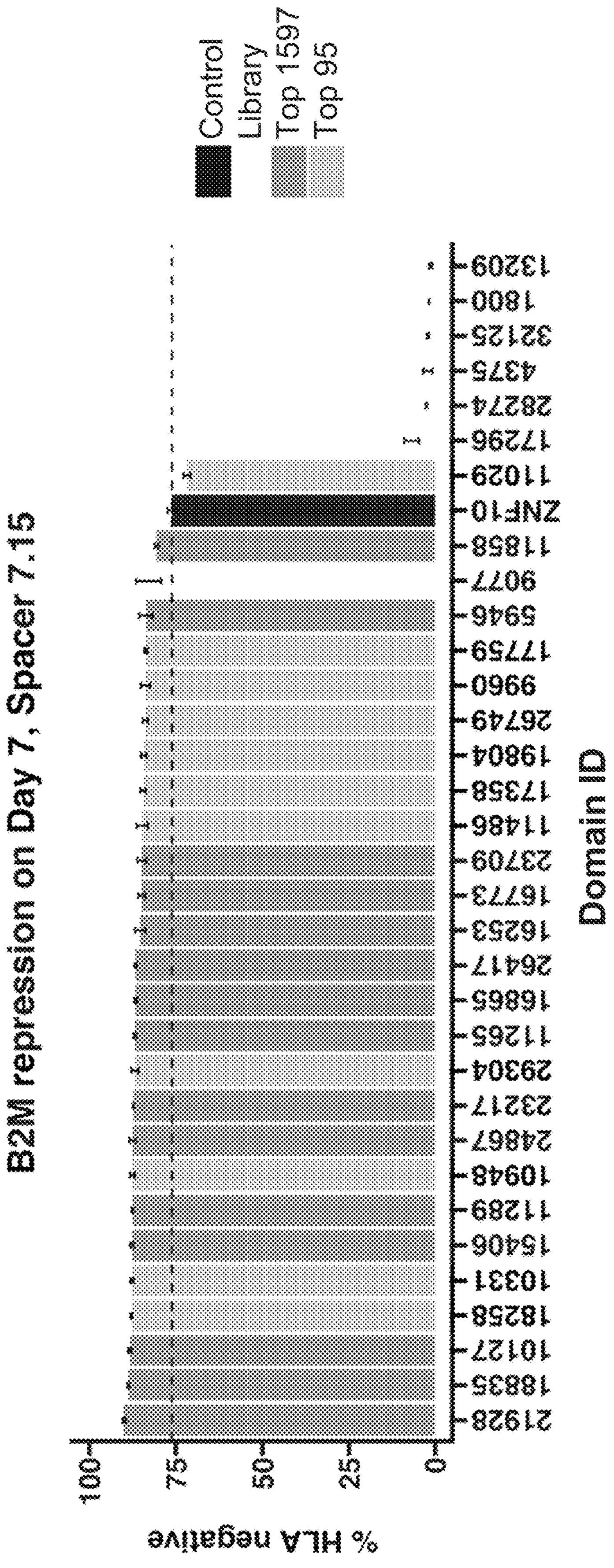
FIG. 17 shows B2M silencing activities (represented as percentage of HLA-negative cells) of dXR proteins with various KRAB domains, as described in Example 4. Data are presented as mean with standard deviation, N=3.
Figure 18:
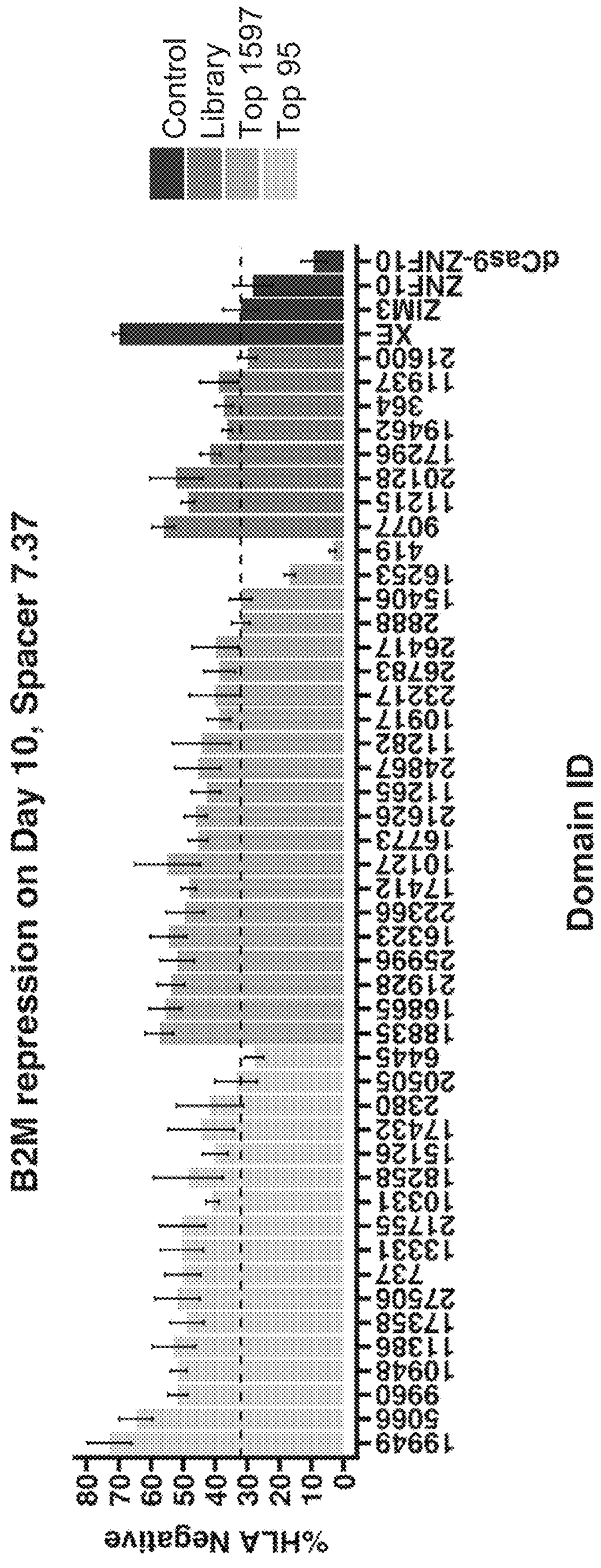
FIG. 18 shows B2M silencing activities (represented as percentage of HLA-negative cells) of dXR proteins with various KRAB domains, as described in Example 4. Data are presented as mean with standard deviation, N=3.
Figure 19A:
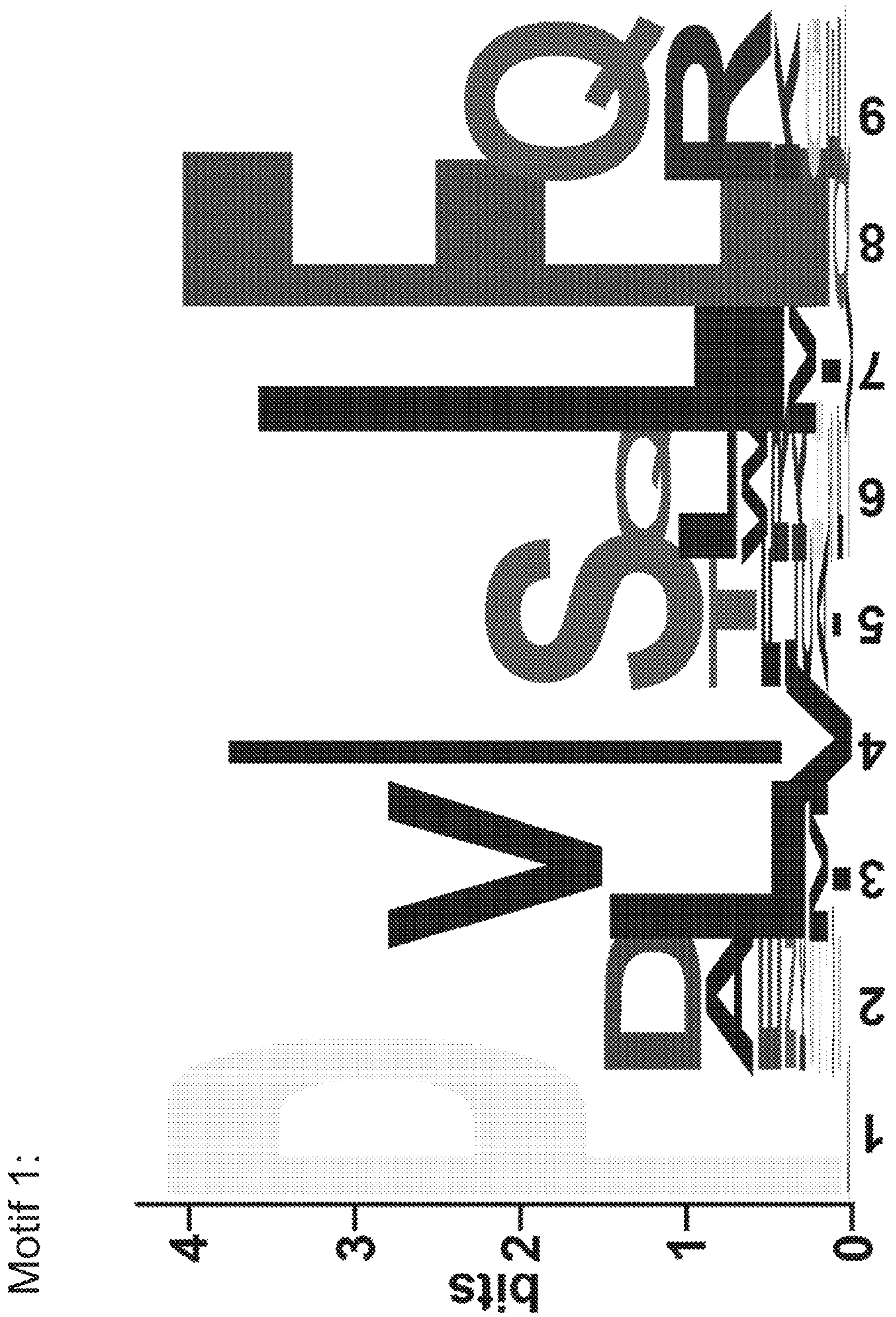
FIG. 19A provides the logo of KRAB domain motif 1, as described in Example 4.
Figure 19B:
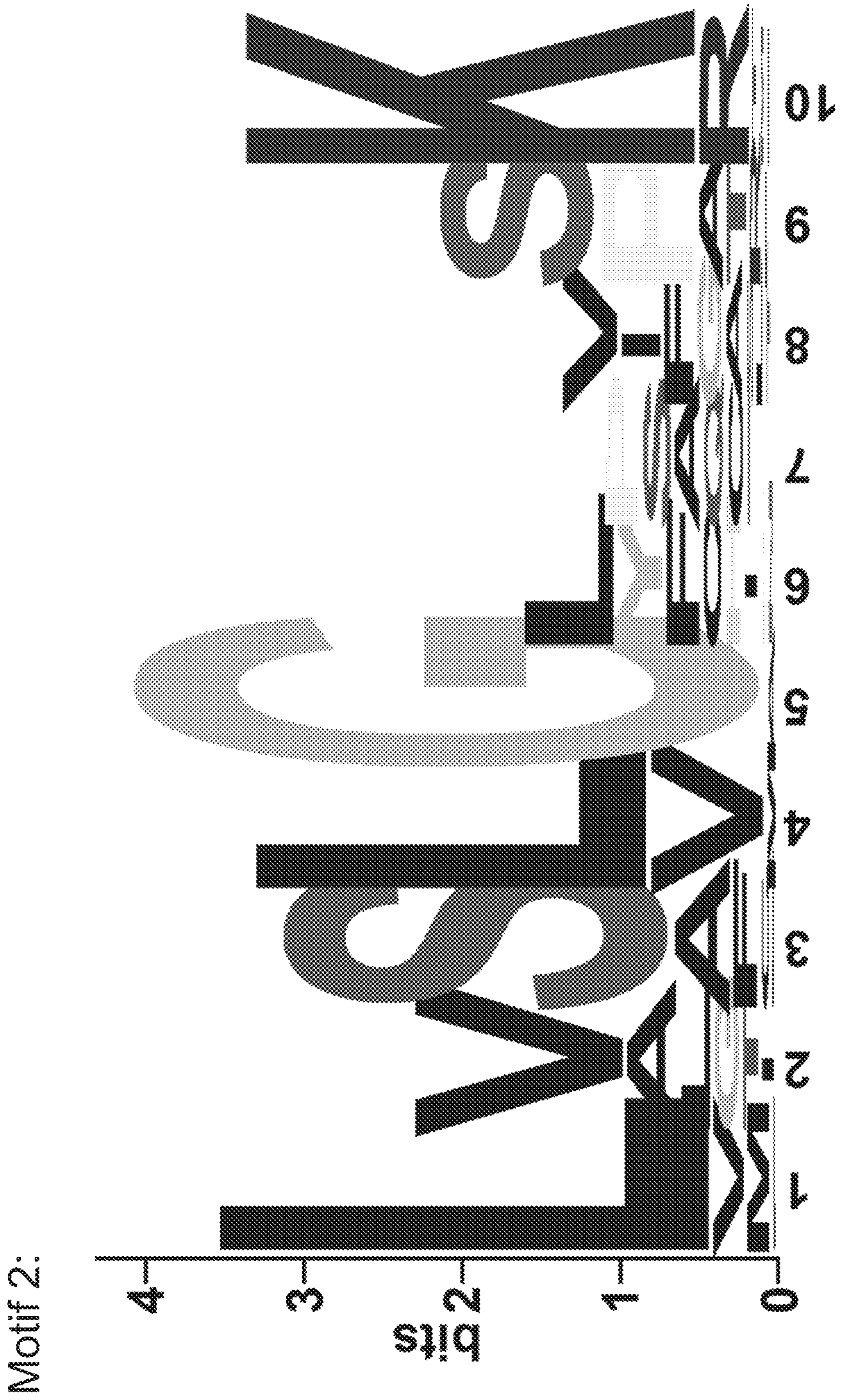
FIG. 19B provides the logo of KRAB domain motif 2, as described in Example 4.
Figure 19C:
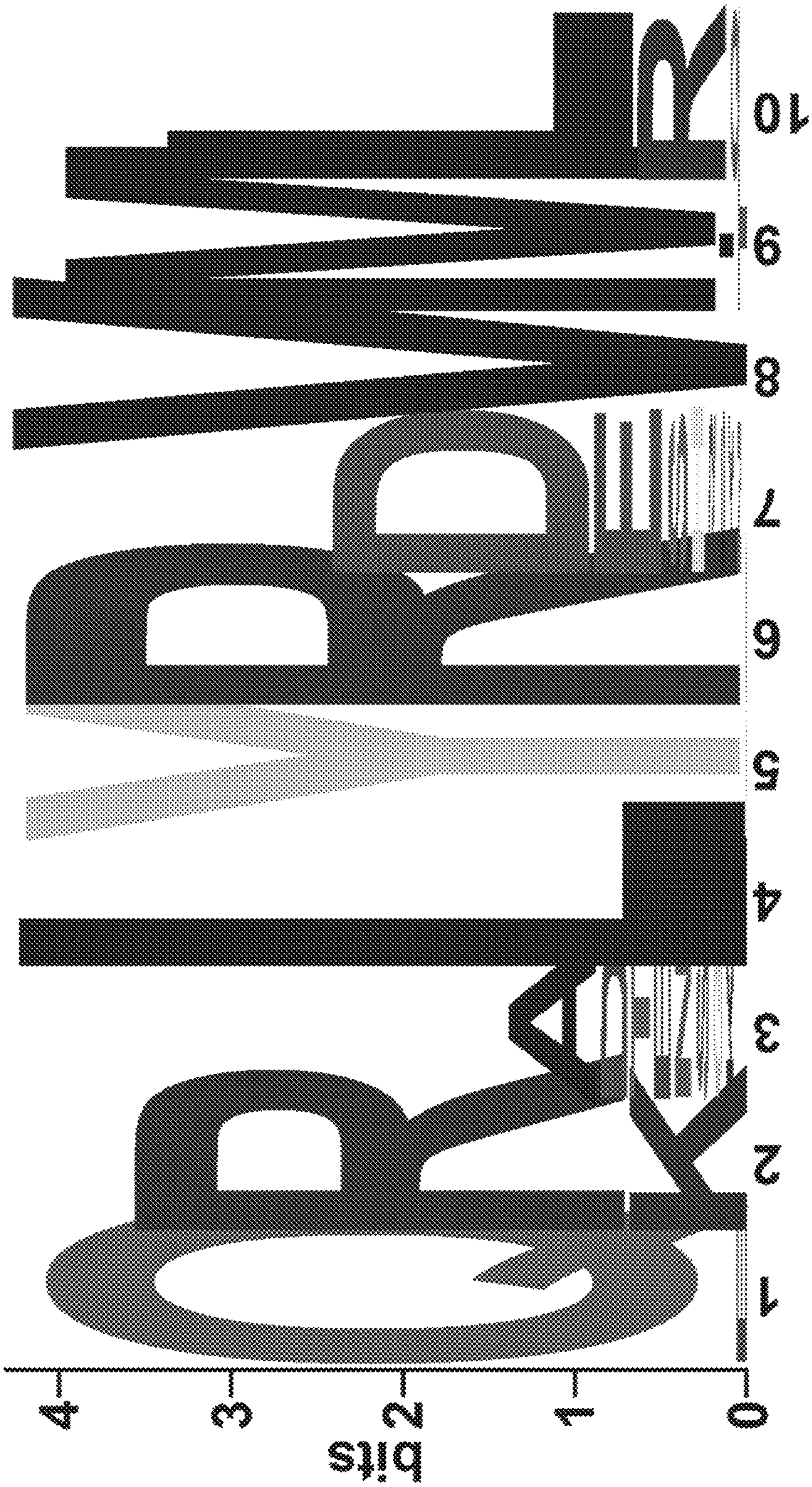
FIG. 19C provides the logo of KRAB domain motif 3 (SEQ ID NO: 59345), as described in Example 4.
Figure 19D:
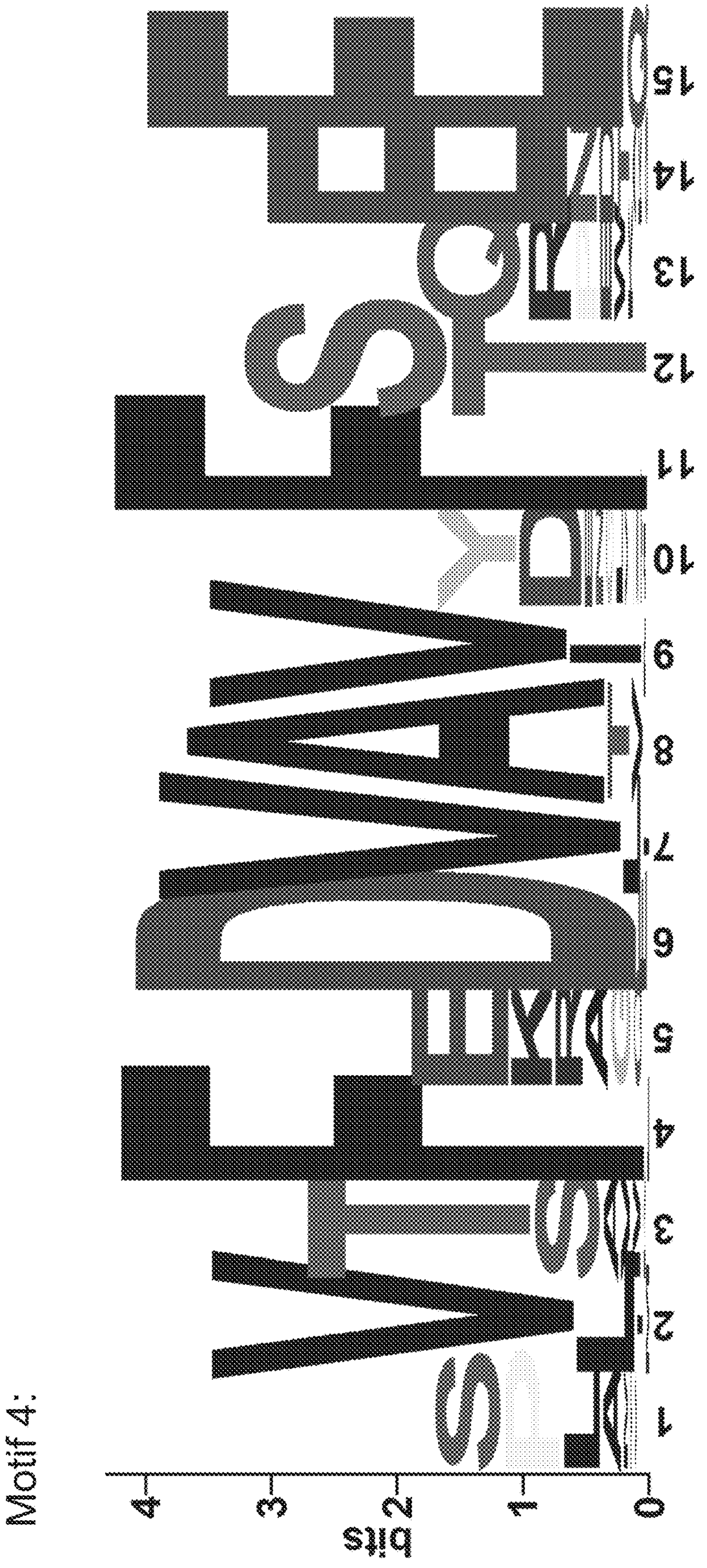
FIG. 19D provides the logo of KRAB domain motif 4 (SEQ ID NO: 59346), as described in Example 4.
Figure 19E:
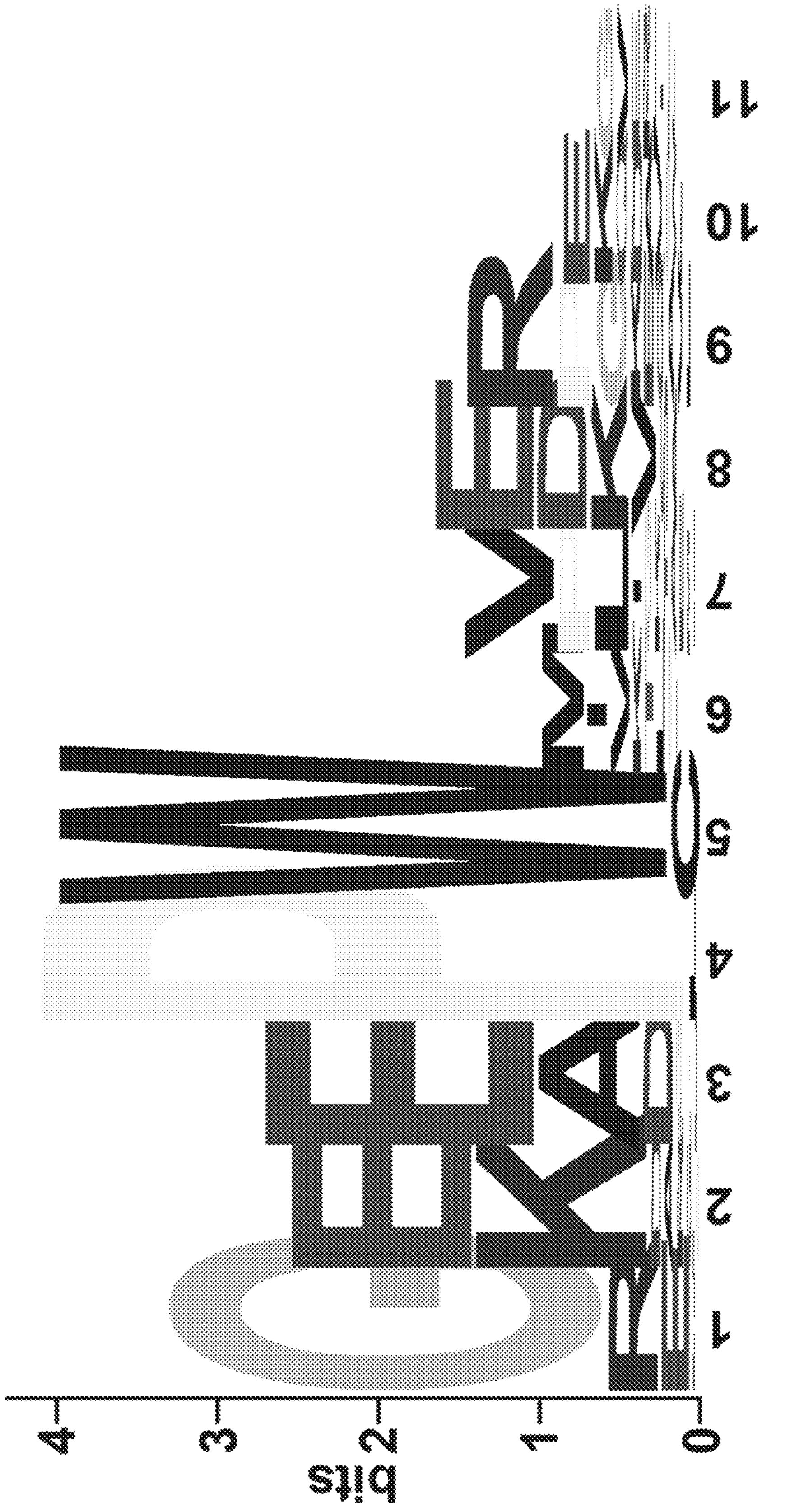
FIG. 19E provides the logo of KRAB domain motif 5 (SEQ ID NO: 59347), as described in Example 4.
Figure 19F:
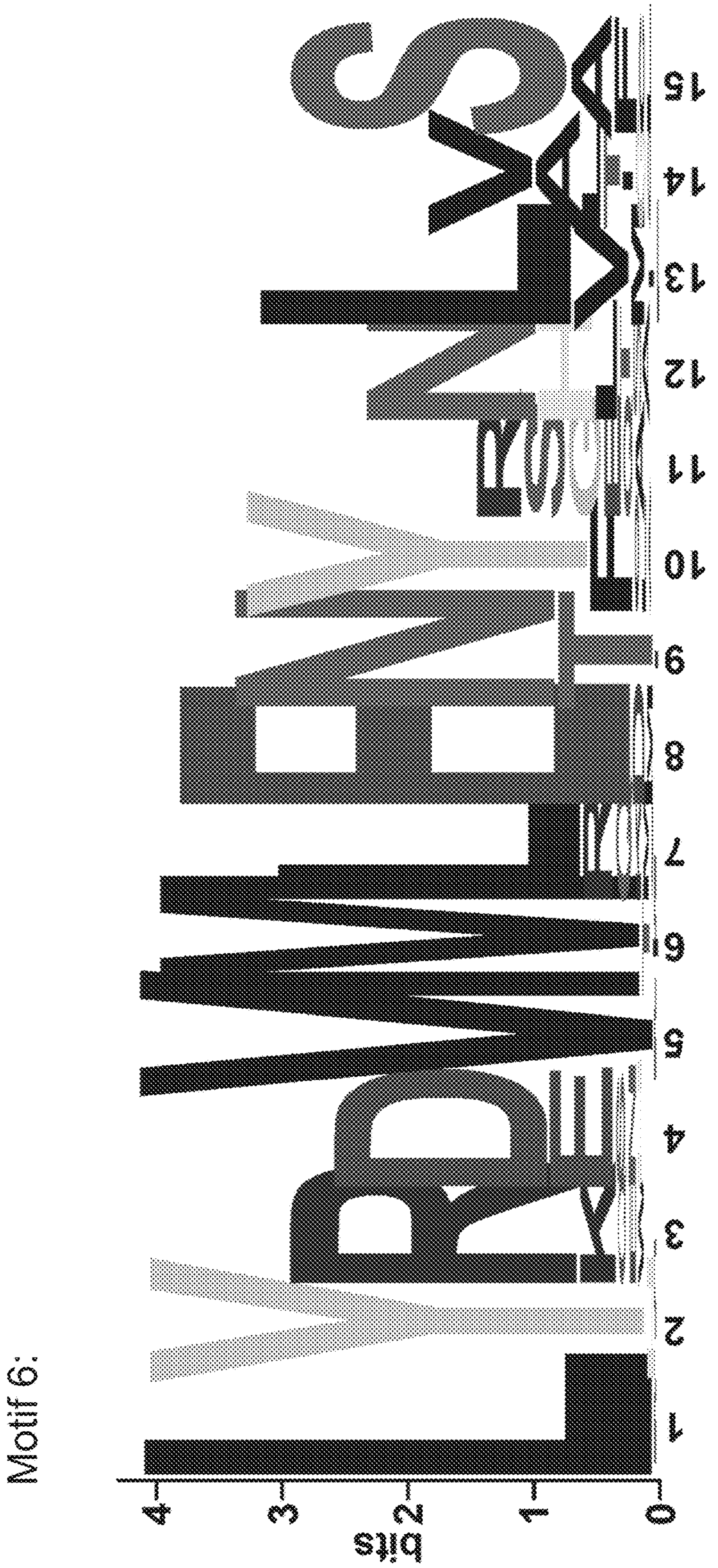
FIG. 19F provides the logo of KRAB domain motif 6 (SEQ ID NO: 59348), as described in Example 4.
Figure 19G:
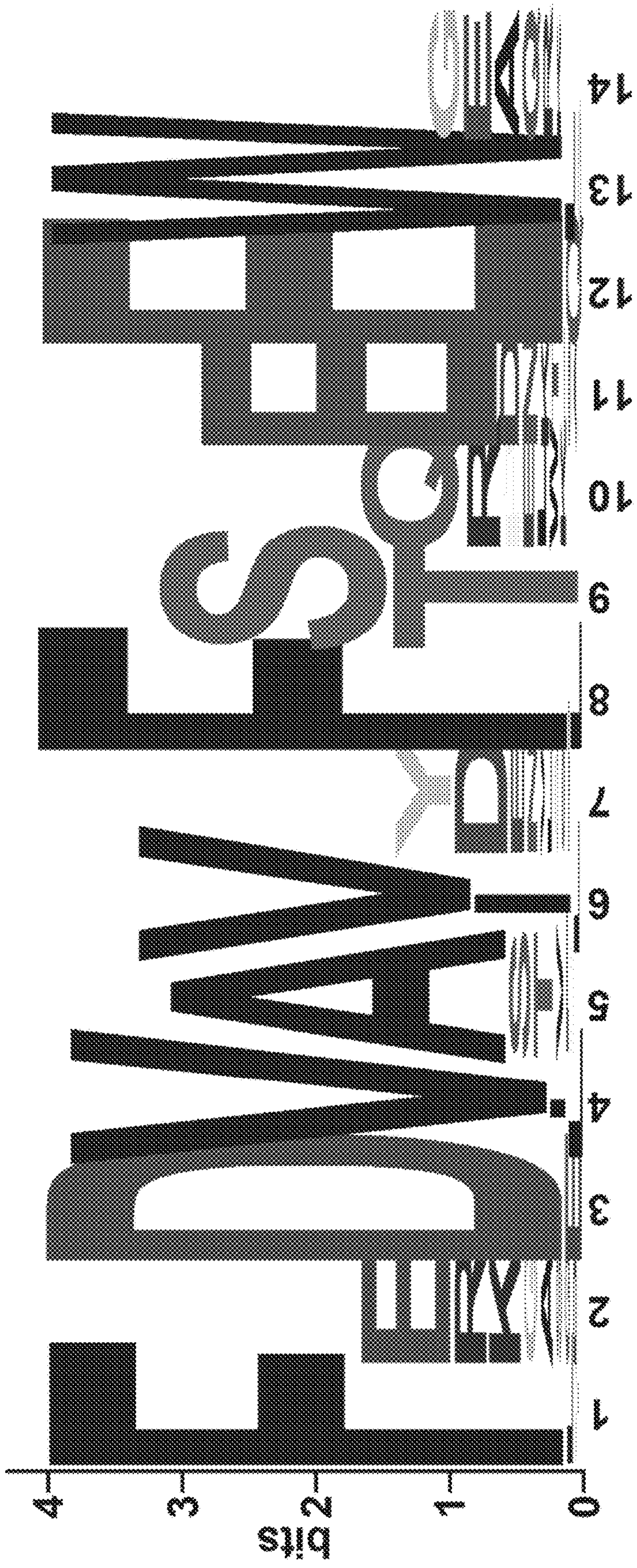
FIG. 19G provides the logo of KRAB domain motif 7 (SEQ ID NO: 59349), as described in Example 4.
Figure 19H:
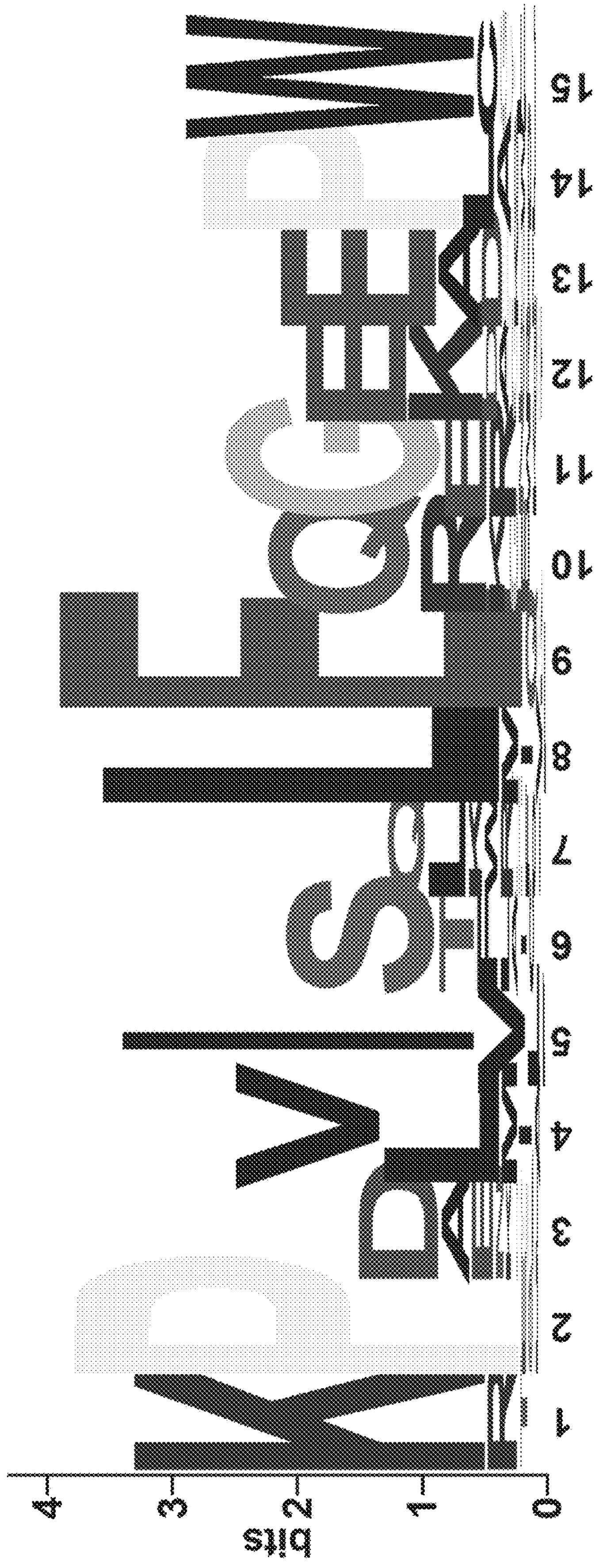
FIG. 19H provides the logo of KRAB domain motif 8, as described in Example 4.
Figure 19I:
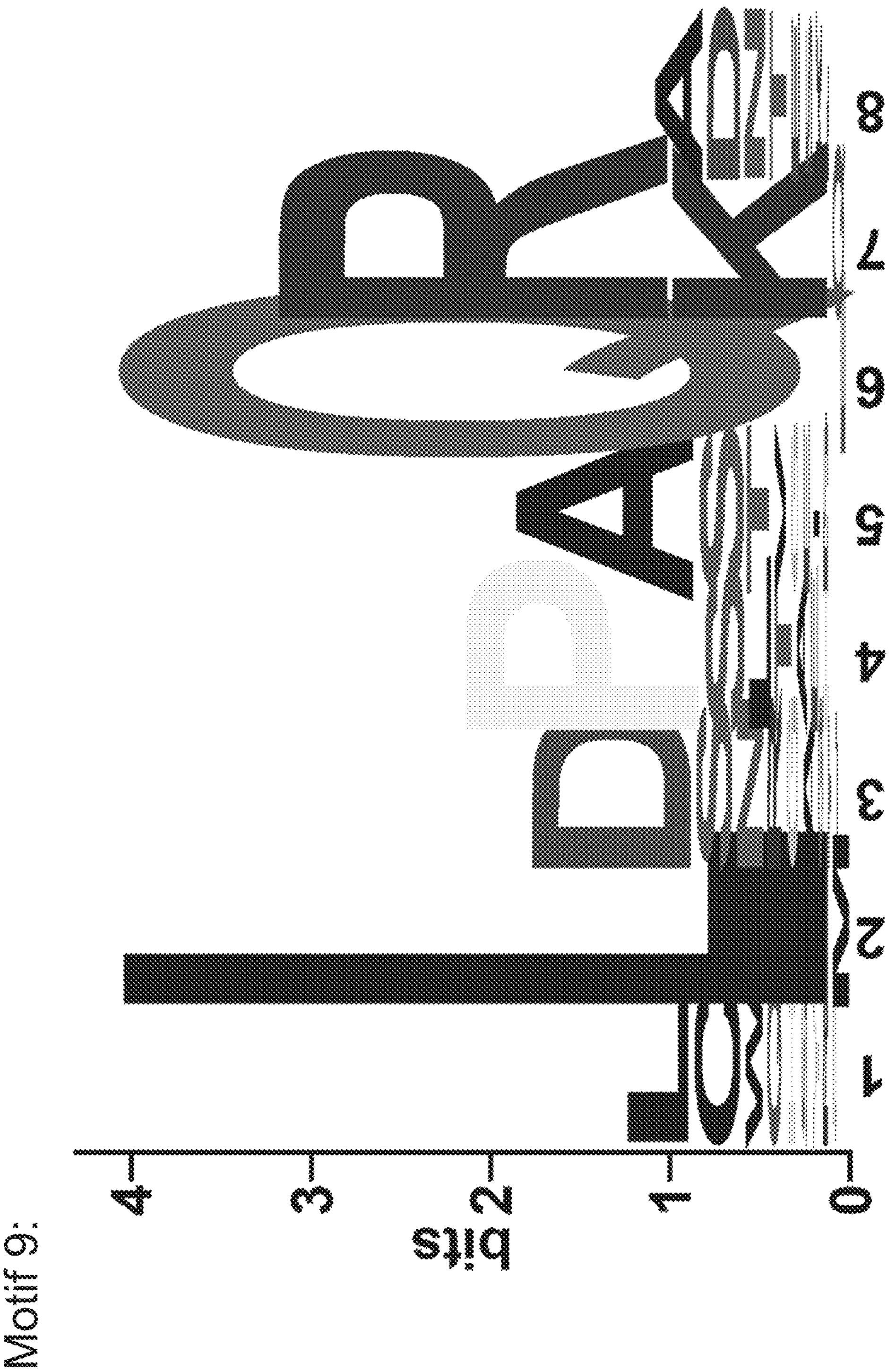
FIG. 19I provides the logo of KRAB domain motif 9, as described in Example 4.

To verify that the KRAB domains identified in the selection supported transcriptional repression in an independent assay, representative members of the top 95 and 1597 KRAB domains were used to generate dXR constructs, and their ability to repress transcription of the B2M locus was tested. As shown in FIG. 17, seven days after transduction, dXRs with all but one of the representative top 95 or 1597 KRAB domains tested repressed B2M to a greater extent than did the dXR with ZNF10. As shown in FIG. 18, ten days after transduction, the majority of the dXRs with representative top 95 or 1597 KRAB domains tested repressed B2M to a greater extent than did ZNF10 or ZIM3. dXR repression of a target locus tends to deteriorate over time, and ten days following transduction is believed to be a relatively late timepoint for measuring dXR repression. Therefore, it is particularly notable that many of the dXR constructs with KRAB domains in the top 95 and 1597 were able to repress B2M to a greater extent than dXR with KRAB domains derived from ZNF10 or ZIM3 as late as ten days following transduction.

To further understand the basis of the superior ability of the identified KRAB domains to repress transcription, protein sequence motifs were generated for the top 1597 KRAB domains using the STREME algorithm. Specifically, five motifs (motifs 1-5) were generated by comparing the amino acid sequences of the top 1597 KRAB domains to a negative training set of 1506 KRAB domains with p-values less than 0.01, and $log_2$(fold change) values less than 0. Logos of motifs 1-5 are provided in FIGS. 19A, 19B, 19C, 19D, and 19E. In addition, four motifs (motifs 6-9) were generated by comparing the top 1597 KRAB domains to shuffled sequences derived from the 1597 sequences. Logos of motifs 6-9 are provided in FIGS. 19F, 19G, 19H, and 19I.

Table 20, below, provides the p-value, E-value (a measure of statistical significance), and number and percentage of sequences matching the motif in the top 1597 KRAB domains for each of the nine motifs, as calculated by STREME. Table 21 provides the sequences of each motif, showing the amino acid residues present at each position within the motifs (from N- to C-terminus).

TABLE 20

Characteristics of protein sequence motifs of top 1597 KRAB domains.

| Motif ID | P-value | E-value | Number and percentage of sites matching motif in top 1597 KRAB domains |
|---|---|---|---|
| Motifs generated compared to a negative training set | | | |
| 1 | 3.7e−014 | 7.1e−013 | 1158 (72.5%) |
| 2 | 3.4e−012 | 6.4e−011 | 978 (61.2%) |
| 3 | 7.5e−010 | 1.4e−008 | 1017 (63.7%) |
| 4 | 7.0e−008 | 1.3e−006 | 987 (61.8%) |
| 5 | 1.7e−007 | 3.3e−006 | 678 (42.5%) |
| Motifs generated compared to shuffled sequences | | | |
| 6 | 1.2e−048 | 1.5e−047 | 1597 (100.0%) |
| 7 | 1.2e−048 | 1.5e−047 | 1597 (100.0%) |

TABLE 20-continued

| Characteristics of protein sequence motifs of top 1597 KRAB domains. | | | |
|---|---|---|---|
| Motif ID | P-value | E-value | Number and percentage of sites matching motif in top 1597 KRAB domains |
| 8 | 1.3e−042 | 1.6e−041 | 1377 (86.2%) |
| 9 | 2.1e−040 | 2.7e−039 | 1483 (92.9%) |

TABLE 21

Sequences of protein sequence motifs of top 1597 KRAB domains.

| Motif ID | Position in motif | Amino acid residues with >5% representation in motif |
|---|---|---|
| Motifs generated compared to a negative training set | | |
| 1 | 1 | P |
| | 2 | A, D, E, N |
| | 3 | L, V |
| | 4 | I, V |
| | 5 | S, T, F |
| | 6 | H, K, L, Q, R, W |
| | 7 | L, M |
| | 8 | E |
| | 9 | G, K, Q, R |
| 2 | 1 | L, V |
| | 2 | A, G, L, T, V |
| | 3 | A, F, S |
| | 4 | L, V |
| | 5 | G |
| | 6 | C, F, H, I, L, Y |
| | 7 | A, C, P, Q, S |
| | 8 | A, F, G, I, S, V |
| | 9 | A, P, S, T |
| | 10 | K, R |
| 3 | 1 | Q |
| | 2 | K, R |
| | 3 | A, D, E, G, N, S, T |
| | 4 | L |
| | 5 | Y |
| | 6 | R |
| | 7 | D, E, S |
| | 8 | V |
| | 9 | M |
| | 10 | L, R |
| 4 | 1 | A, L, P, S |
| | 2 | L, V |
| | 3 | S, T |
| | 4 | F |
| | 5 | A, E, G, K, R |
| | 6 | D |
| | 7 | V |
| | 8 | A, T |
| | 9 | I, V |
| | 10 | D, E, N, Y |
| | 11 | F |
| | 12 | S, T |
| | 13 | E, P, Q, R, W |
| | 14 | E, N |
| | 15 | E, Q |
| 5 | 1 | E, G, R |
| | 2 | E, K |
| | 3 | A, D, E |
| | 4 | P |
| | 5 | C, W |
| | 6 | I, K, L, M, T, V |
| | 7 | I, L, P, V |
| | 8 | D, E, K, V |

TABLE 21-continued

Sequences of protein sequence motifs of top 1597 KRAB domains.

| Motif ID | Position in motif | Amino acid residues with >5% representation in motif |
|---|---|---|
| | 9 | E, G, K, P, R |
| | 10 | A, D, R, G, K, Q, V |
| | 11 | D, E, G, I, L, R, S, V |
| Motifs generated compared to shuffled sequences | | |
| 6 | 1 | L |
| | 2 | Y |
| | 3 | K, R |
| | 4 | D, E |
| | 5 | V |
| | 6 | M |
| | 7 | L, Q, R |
| | 8 | E |
| | 9 | N, T |
| | 10 | F, Y |
| | 11 | A, E, G, Q, R, S |
| | 12 | H, L, N |
| | 13 | L, V |
| | 14 | A, G, I, L, T, V |
| | 15 | A, F, S |
| 7 | 1 | F |
| | 2 | A, E, G, K, R |
| | 3 | D |
| | 4 | V |
| | 5 | A, S, T |
| | 6 | I, V |
| | 7 | D, E, N, Y |
| | 8 | F |
| | 9 | S, T |
| | 10 | E, L, P, Q, R, W |
| | 11 | D, E |
| | 12 | E |
| | 13 | W |
| | 14 | A, E, G, Q, R |
| 8 | 1 | K, R |
| | 2 | P |
| | 3 | A, D, E, N |
| | 4 | I, L, M, V |
| | 5 | I, V |
| | 6 | F, S, T |
| | 7 | H, K, L, Q, R, W |
| | 8 | L |
| | 9 | E |
| | 10 | K, Q, R |
| | 11 | E, G, R |
| | 12 | D, E, K |
| | 13 | A, D, E |
| | 14 | L, P |
| | 15 | C, W |
| 9 | 1 | C, H, L, Q, W |
| | 2 | L |
| | 3 | D, G, N, R, S |
| | 4 | L, P, S, T |
| | 5 | A, S, T |
| | 6 | Q |
| | 7 | K, R |
| | 8 | A, D, E, K, N, S, T |

Notably, motifs 6 and 7 were present in 100% of the top 1597 KRAB domains. Many of the highly conserved positions in motif 6 (e.g., amino acid residues L1, Y2, V5, M6, and ES) are known to form an interface with Trim2S (also known as Kap1), which is responsible for recruiting transcriptional repressive machinery to a locus. Similarly, residues in motif 7 (D3, V4, E11, E12) all contribute to Trim2S recruitment. It is believed that many of the amino acid residues identified as enriched in the top KRAB domains strengthen Trim2S recruitment.

Notably, some of these residues are lacking in commonly used KRAB domains. Specifically, in the site in ZNF10 that matches motif 6, the residue at the first position is a valine instead of a leucine. In the site in ZIM3 that matches motif 7, the residue at position 11 is a glycine instead of a glutamic acid. Many of the other motifs described above that are not present in all KRAB domains may represent additional and novel mechanisms of repression that are specific to sequence clusters of KRABs.

Taken together, the experiments described herein have identified a suite of KRAB domains that are effective for promoting transcriptional repression in the context of a dXR molecule. These KRAB domains repressed transcription to a greater extent than ZNF10 and ZIM3. Finally, protein sequence motifs were identified that are associated with the KRAB domains that are the strongest transcriptional repressors.

Example 5: Demonstration of a Catalytically-Dead CasX Repressor (dXR) System on Repression of PTBP1 at the Protein Level Experiments were performed to demonstrate that various dXR constructs can act to repress the expression of the PTBP1 (Polypyrimidine Tract Binding Protein 1) protein in primary midbrain astrocyte cultures.

Materials and Methods:

Lentiviral Plasmid Cloning:

Lentiviral plasmid constructs coding for a dXR molecule were built using standard molecular cloning techniques. These constructs comprised of sequences coding for catalytically-dead CasX protein 491 (dCasX491; SEQ ID NO: 18) linked to the ZNF10 KRAB domain, along with guide RNA scaffold variant 174 (SEQ ID NO: 2238) and spacers targeting the PTBP1 locus (Table 23) or a non-targeting (NT; spacer 0.0) spacer. These spacers targeted either exon 1, 2, or 3 of the murine PTBP1 gene. Cloned and sequence-validated constructs were midi-prepped and subjected to quality assessment prior to transfection in HEK293T cells for production of lentiviral particles, which was performed using standard methods.

XDP (a CasX Delivery Particle) Construct Cloning and Production:

XDP plasmid constructs comprising sequences coding for CasX protein variant 491, guide scaffold 174, and a spacer targeting PTBP1 were cloned following standard methods and verified through Sanger sequencing.

XDPs containing ribonucleoproteins (RNPs) of CasX protein variant 491 and gRNA using scaffold 174 and a PTBP1-targeting spacer were produced using either suspension-adapted or adherent HEK293T Lenti-X cells. The methods to produce XDPs are described in WO2021113772A1, incorporated by reference in its entirety. Exemplary plasmids used to create these particles (and their configurations) are shown in FIGS. 4 and 5.

Transduction of Primary Midbrain Mouse Astrocytes and Western Blotting:

Primary midbrain mouse astrocytes were seeded at 150,000 cells per well in a 6-well plate format in NbAstro glial culture medium. Two days post-plating, cells were transduced with lentivirus-packaged dXR2 constructs encoding dCasX491 linked to the ZNF10 KRAB domain and guide scaffold 174 (SEQ ID NO: 2238) with spacers targeting PTBP1 (Table 22) or a non-targeting spacer. As a positive control, cells were transduced with XDP-28.10 containing RNPs of a catalytically-active CasX 491 and guide 174 with PTBP1-targeting spacer 28.10) in a separate well. 11 days post-transduction cells were harvested, pelleted, and lysed with RIPA buffer containing protease inhibitor for western blotting, which was performed following standard methods. Briefly, denatured protein samples were resolved by SDS-PAGE and transferred from gel onto PVDF membrane, which was immunoblotted for the PTBP1 protein. Protein quantification based on the western blot was quantified by densitometry using the Image Lab software. The ratio of PTBP1 protein/total protein for each experimental condition was normalized dXR relative to the ratio determined for the condition using dXR with the NT spacer, and the results were shown in FIG. 6 and Table 23.

TABLE 22

Sequences of mouse PTBP1-targeting spacers tested with dXR molecules in arrayed transductions.

| Spacer ID | Spacer DNA sequence | SEQ ID NO | Spacer RNA sequence | SEQ ID NO |
|---|---|---|---|---|
| 28.5 | CGCTGCGGTCTGTGGGCGTG | 350 | CGCUGCGGUCUGUGGGCGUG | 59635 |
| 28.9 | GTGTGCCATGGACGGGTAAG | 351 | GUGUGCCAUGGACGGGUAAG | 59636 |
| 28.10 | CAGCGGGGATCCGACGAGCT | 352 | CAGCGGGGAUCCGACGAGCU | 59637 |
| 28.11 | CCACGTGTGTCAGCAACGGC | 353 | CCACGUGUGUCAGCAACGGC | 59638 |
| 28.16 | ACAGCATCGTCCCAGACATA | 354 | ACAGCAUCGUCCCAGACAUA | 59639 |

Results

Figure 6:
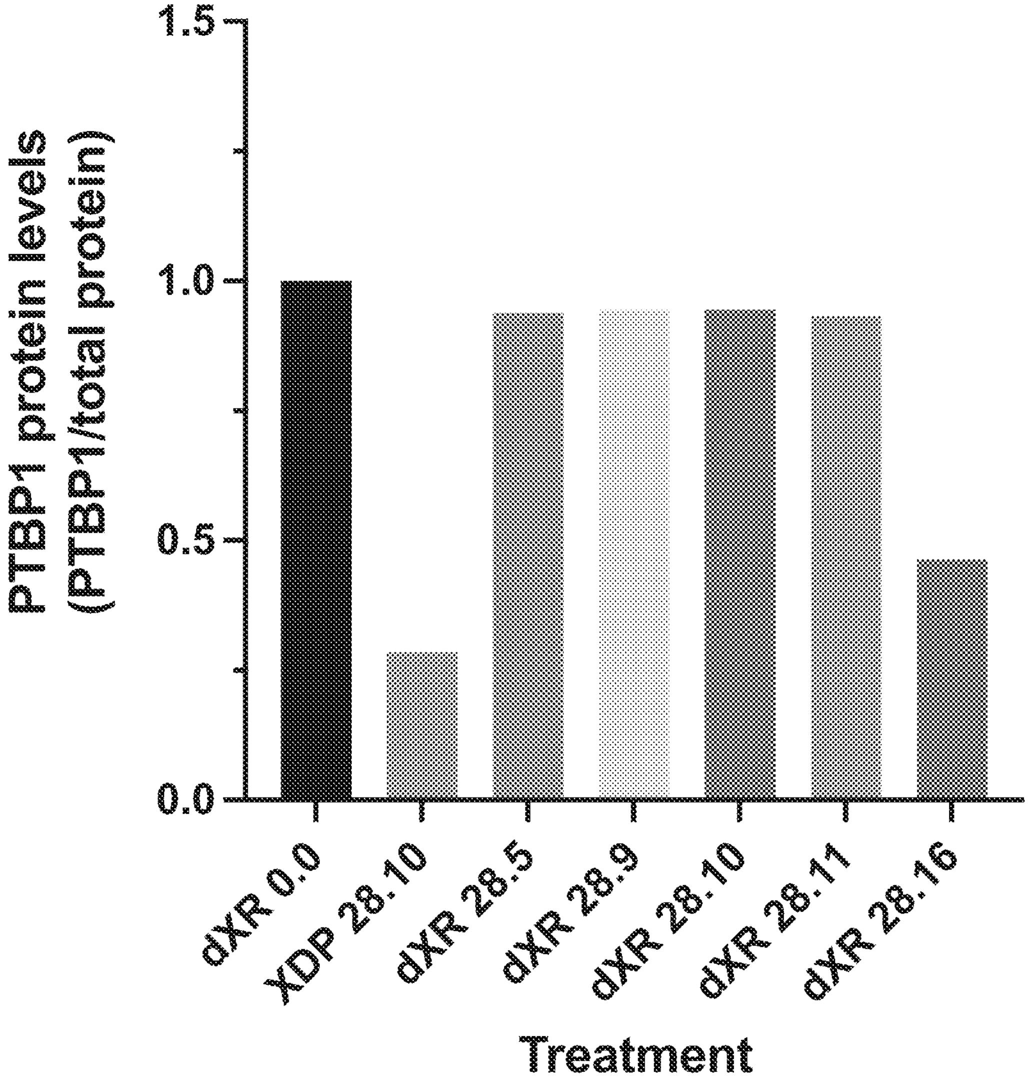
FIG. 6 is a bar graph showing the western blot quantification of PTBP1 protein levels in mouse astrocytes harvested 11 days post-transduction with lentiviral particles containing dXR with the indicated PTBP1-targeting spacer, as described in Example 5. Cells treated with XDPs containing CasX ribonuclear proteins (RNPs) using spacer 28.10 or lentiviral particles with the NT spacer served as experimental controls. The ratio of PTBP1 protein over total protein was normalized to that determined for the NT control in the graph.

Of the various dXR constructs with different PTBP1-targeting spacers delivered via lentiviral particles, treatment with the dXR and gRNA with spacer 28.16 construct showed reduced PTBP1 protein levels, while dXR constructs with guides having spacers 28.5, 28.9, 28.10 or 28.11 did not show any change in protein levels relative to protein levels determined in the NT spacer (dXR 0.0) condition (FIG. 6; Table 23). Specifically, use of spacer 28.16 resulted in nearly a 50% decrease in PTBP1 levels relative to the NT control (FIG. 6; Table 23). As expected, treatment with XDPs containing the catalytically-active CasX RNP showed the strongest decrease (>70%) in PTBP1 protein levels compared relative to the NT control (FIG. 6; Table 23). These data show that a dXR molecule and a guide having a PTBP1-targeting spacer can induce transcriptional repression, which results in decreased PTBP1 protein levels.

The results from these experiments demonstrate that dXR molecules with gRNAs targeting the PTBP1 locus were able to transcriptionally repress the therapeutically-relevant PTBP1 target efficiently in vitro, and the assay was able to distinguish between functional and non-functional spacers in the CasX repressor system.

TABLE 23

| Ratio of PTBP1 protein over total protein determined for each experimental condition and normalized relative to the ratio determined for the NT (dXR 0.0) condition. | |
|---|---|
| Experimental condition | Ratio of PTBP1 protein/total protein |
| dXR 0.0 | 1 |
| XDP 28.10 | 0.285 |
| dXR 28.5 | 0.939 |
| dXR 28.9 | 0.945 |
| dXR 28.10 | 0.945 |
| dXR 28.11 | 0.933 |
| dXR 28.16 | 0.464 |

Example 6: Use of a Catalytically-Dead CasX Repressor (dXR) System Fused with Additional Domains from DNMT3A and DNMT3L to Induce Durable Silencing of the B2M Locus Experiments were performed to determine whether rationally-designed epigenetic long-term CasX repressor (ELXR) molecules, with three repressor domains composed of a KRAB domain, the catalytic domain from DNMT3A and the interaction domain from DNMT3L fused to catalytically-dead CasX 491, would induce durable long-term repression of the endogenous B2M locus in vitro. In addition, multiple configurations of the ELXR molecules, which contain varying placements of the epigenetic domains relative to dCasX, were designed to assess how their arrangement would affect the duration of silencing of the B2M locus, as well as the specificity of their on-target methylation activity.

Materials and Methods:

Generation of ELXR Constructs and Lentiviral Plasmid Cloning:

Lentiviral plasmid constructs coding for an ELXR molecule were built using standard molecular cloning techniques. These constructs comprised of sequences coding for catalytically-dead CasX protein 491 (dCasX491), KRAB domain from ZNF10 or ZIM3, and the catalytic domain and interaction domain from DNMT3A (D3A) and DNMT3L (D3L) respectively. Briefly, constructs were ordered as oligonucleotides and assembled by overlap extension PCR followed by isothermal assembly. The resulting plasmids (sequences of key ELXR elements listed in Table 24 and select plasmid constructs in Table 25) contained constructs positioned in varying configurations to generate an ELXR molecule. The protein sequences for the ELXR molecules are listed in Table 26, and the ELXR configurations are illustrated in FIG. 7. Sequences encoding the ELXR molecules also contained a 2× FLAG tag. Plasmids also harbored sequences encoding gRNA scaffold variant 174 having either a spacer targeting the endogenous B2M locus or a non-targeting control (spacer sequences listed in Table 27). These constructs were all cloned upstream of a P2A-puromycin element on the lentiviral plasmid. Cloned and sequence-validated constructs were midi-prepped and subjected to quality assessment prior to transfection in HEK293T cells.

TABLE 24

Sequences of key ELXR elements (e.g., additional domains fused to CasX) to generate ELXR variant plasmids illustrated in FIG. 7.

| Key component | DNA SEQ ID NO | Protein sequence | Protein SEQ ID NO |
|---|---|---|---|
| ZNF10 KRAB domain | 57610 | MDAKSLTAWSRTLVTFKDVFVDFTREEWKLLDTAQQIV YRNVMLENYKNLVSLGYQLTKPDVILRLEKGEEP | 57611 |
| ZIM3 KRAB domain | 57612 | MNNSQGRVTFEDVTVNFTQGEWQRLNPEQRNLYRDVML ENYSNLVSVGQGETTKPDVILRLEQGKEPWLEEEEVLG SGRAEKNGDIGGQIWKPKDVKESL | 57613 |
| DNMT3A catalytic domain | 57614 | MNHDQEFDPPKVYPPVPAEKRKPIRVLSLFDGIATGLL VLKDLGIQVDRYIASEVCEDSITVGMVRHQGKIMYVGD VRSVTQKHIQEWGPFDLVIGGSPCNDLSIVNPARKGLY EGTGRLFFEFYRLLHDARPKEGDDRPFFWLFENVVAMG VSDKRDISRFLESNPVMIDAKEVSAAHRARYFWGNLPG MNRPLASTVNDKLELQECLEHGRIAKFSKVRTITTRSN SIKQGKDQHFPVFMNEKEDILWCTEMERVFGFPVHYTD VSNMSRLARQRLLGRSWSVPVIRHLFAPLKEYFACV | 57615 |
| DNMT3L interaction domain | 57616 | MGPMEIYKTVSAWKRQPVRVLSLFRNIDKVLKSLGFLE SGSGSGGGTLKYVEDVTNVVRRDVEKWGPFDLVYGSTQ PLGSSCDRCPGWYMFQFHRILQYALPRQESQRPFFWIF MDNLLLTEDDQETTTRFLQTEAVTLQDVRGRDYQNAMR VWSNIPGLKSKHAPLTPKEEEYLQAQVRSRSKLDAPKV DLLVKNCLLPLREYFKYFSQNSLPL | 57617 |
| dCasX491 | 57618 | QEIKRINKIRRRLVKDSNTKKAGKTGPMKTLLVRVMTP DLRERLENLRKKPENIPQPISNTSRANLNKLLTDYTEM KKAILHVYWEEFQKDPVGLMSRVAQPASKKIDQNKLKP EMDEKGNLTTAGFACSQCGQPLFVYKLEQVSEKGKAYT NYFGRCNVAEHEKLILLAQLKPEKDSDEAVTYSLGKFG QRALDFYSIHVTKESTHPVKPLAQIAGNRYASGPVGKA LSDACMGTIASFLSKYQDIIIEHQKVVKGNQKRLESLR ELAGKENLEYPSVTLPPQPHTKEGVDAYNEVIARVRMW VNLNLWQKLKLSRDDAKPLLRLKGFPSFPLVERQANEV | 57619 |

TABLE 24-continued

Sequences of key ELXR elements (e.g., additional domains fused to CasX) to generate ELXR variant plasmids illustrated in FIG. 7.

| Key component | DNA SEQ ID NO | Protein sequence | Protein SEQ ID NO |
|---|---|---|---|
| | | DWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNENFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAV | |
| Linker 1 | 57620 | GGPSSGAPPPSGGSPAGSPTSTEEGTSESATPESGPGTSTEPSEGSAPGSPAGSPTSTEEGTSTEPSEGSAPGTSTEPSE | 57621 |
| Linker 2 | 57622 | SSGNSNANSRGPSFSSGLVPLSLRGSH | 57623 |
| Linker 3A | 57624 | GGSGGGS | 57626 |
| Linker 3B | 57625 | | |
| Linker 4 | 57627 | GSGSGGG | 57628 |
| NLS A | 57629 | PKKKRKV | 57631 |
| NLS B | 57630 | | |

TABLE 25

DNA sequences of ELXR constructs*.

| ELXR ID | DNA sequence of ELXR molecule with the 2x FLAG (SEQ ID NO) |
|---|---|
| 1.A | 59477 |
| 1.B | 59478 |
| 2.A | 59479 |
| 2.B | 59480 |
| 3.A | 59481 |
| 3.B | 59482 |
| 4.A | 59483 |
| 4.B | 59484 |
| 5.A | 59485 |
| 5.B | 59486 |

*See Table 28 and 29 for construct ID.

TABLE 26

Protein sequences of ELXR molecules*.

| ELXR ID | Protein sequence of ELXR molecule (SEQ ID NO) |
|---|---|
| 1.A | 59467 |
| 1.B | 59468 |
| 2.A | 59469 |
| 2.B | 59470 |
| 3.A | 59471 |
| 3.B | 59472 |
| 4.A | 59473 |

TABLE 26-continued

Protein sequences of ELXR molecules*.

| ELXR ID | Protein sequence of ELXR molecule (SEQ ID NO) |
|---|---|
| 4.B | 59474 |
| 5.A | 59475 |
| 5.B | 59476 |

*See Tables 28 and 29 for ELXR construct ID.

TABLE 27

Sequences of spacers used in constructs.

| Spacer ID | Target gene | PAM | Sequence | SEQ ID NO |
|---|---|---|---|---|
| 7.37 | B2M | TTC | GGCCGAGAUGUCUCGCUCCG | 57644 |
| 7.148 | B2M | NGG | CGCGAGCACAGCUAAGGCCA | 57645 |
| 0.0 | Non-target | N/A | CGAGACGUAAUUACGUCUCG | 57646 |

Transfection of HEK293T Cells:

HEK293T cells were seeded at a density of 30,000 cells in each well of a 96-well plate. The next day, each well was transiently transfected using lipofectamine with 100 ng of ELXR variant plasmids, each containing a dCasX:gRNA construct encoding for a differently configured ELXR protein (FIG. 7), with the gRNA having either non-targeting spacer 0.0 or targeting spacer 7.37 to the B2M locus. Specifically, for one experiment, HEK293T cells were transfected with plasmids encoding ELXR proteins #1-3, and in a second experiment, cells were lipofected with plasmids encoding for ELXR protein #1, 4, and 5 (see Table 25 for sequences). In both experiments, ELXR molecules harbored a KRAB domain either from ZNF10 or ZIM3. Experimental controls included dCasX491 (with or without the ZNF10 repressor domain), catalytically-active CasX 491, and a catalytically-dead Cas9 fused to both the ZNF10-KRAB domain and DNMT3A/L domains, each with the same B2M-targeting or non-targeting gRNA. Each construct was tested in triplicate. 24 hours post-transfection, cells were selected with 1 μg/mL puromycin for two days. Six days after transfection, cells were harvested for repression analysis every 2-3 days by analyzing B2M protein expression via HLA immunostaining followed by flow cytometry. B2M expression was determined by using an antibody that would detect the B2M-dependent HLA protein expressed on the cell surface. HLA+ cells were measured using the Attune™ NxT flow cytometer. In addition, in a separate experiment, HEK293T cells transiently transfected with ELXR variant plasmids and the B2M-targeting gRNA or non-targeting gRNA were harvested at five days post-lipofection for genomic DNA (gDNA) extraction for bisulfite sequencing.

Bisulfite Sequencing to Assess ELXR Specificity Measured by Off-Target Methylation Levels at Target Locus:

To determine off-target methylation levels at the B2M locus, gDNA from harvested cells was extracted using the Zymo Quick-DNA Miniprep Plus kit following the manufacturer's instructions. The extracted gDNA was then subjected to bisulfite conversion using the EZ DNA Methylation™ Kit (Zymo) following the manufacturer's protocol, converting any non-methylated cytosine into uracil. The resulting bisulfite-treated DNA was subsequently sequenced using next-generation sequencing (NGS) to determine the levels of off-target methylation at the B2M and VEGFA loci.

NGS Processing and Analysis:

Target amplicons were amplified from 100 ng bisulfite-treated DNA via PCR with a set of primers specific to the bisulfite-converted target locations of interest (human B2M and VEGFA loci). These gene-specific primers contained an additional sequence at the 5' end to introduce an Illumina™ adapter. Amplified DNA products were purified with the Cytiva Sera-Mag Select DNA cleanup kit. Quality and quantification of the amplicon were assessed using a Fragment Analyzer DNA Analysis kit (Agilent, dsDNA 35-1500 bp). Amplicons were sequenced on the Illumina™ Miseq™ according to the manufacturer's instructions. Raw fastq files from sequencing were processed using Bismark Bisulfite Read Mapper and Methylation caller. PCR amplification of the bisulfite-treated DNA would convert all uracil nucleotides into thymine, and sequencing of the PCR product would determine the rate of cytosine-to-thymine conversion as a readout of the level of potential off-target methylation at the B2M and VEGFA loci mediated by each ELXR molecule.

Results

Figure 8A:
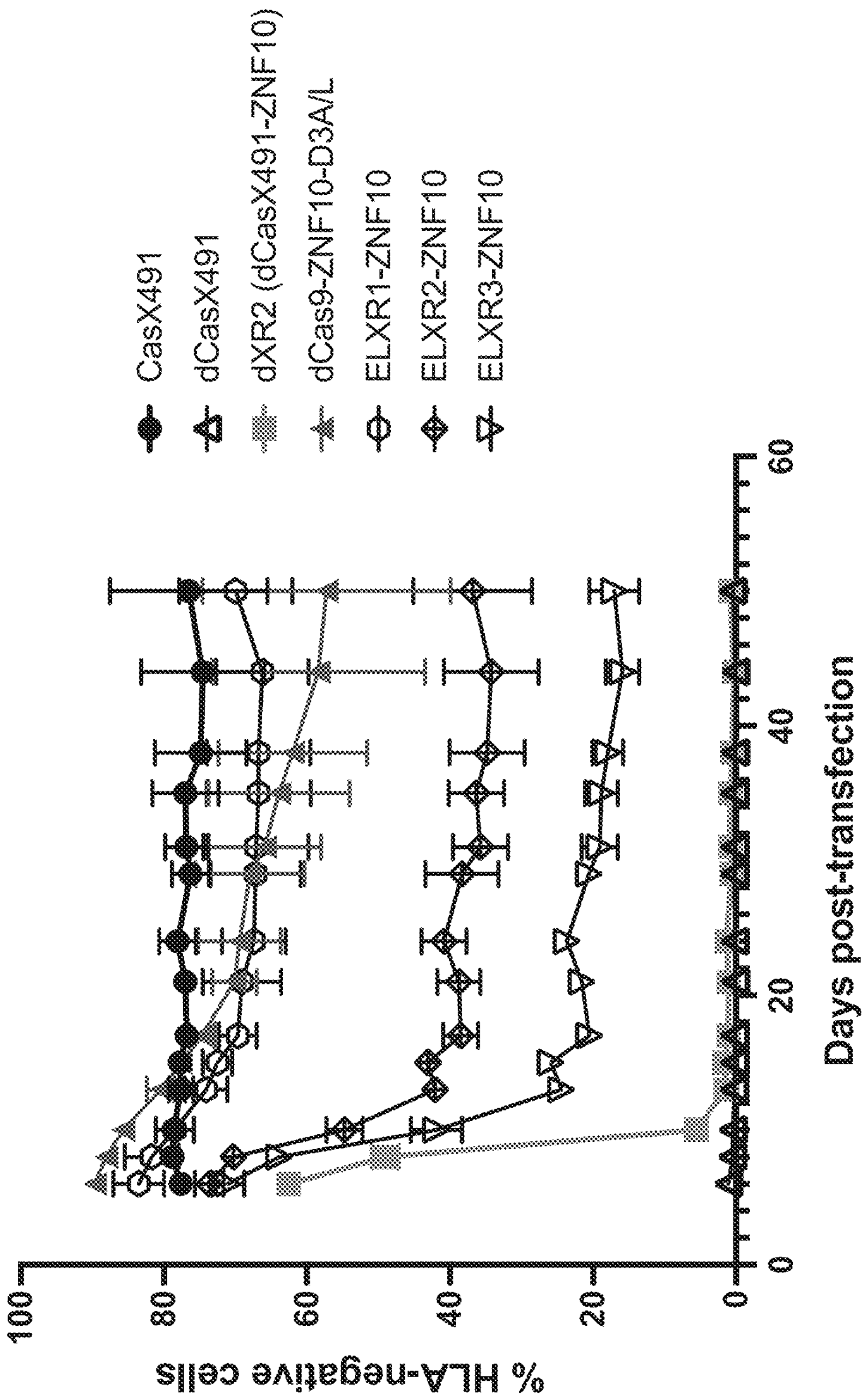
FIG. 8A presents the results of a time-course experiment comparing beta-2-microglobulin (B2M) repression activities (represented as percentage of HLA-negative cells) of ELXR proteins Nos. 1-3, as described in Example 6. Data are presented as mean with standard deviation, N=3.
Figure 8B:
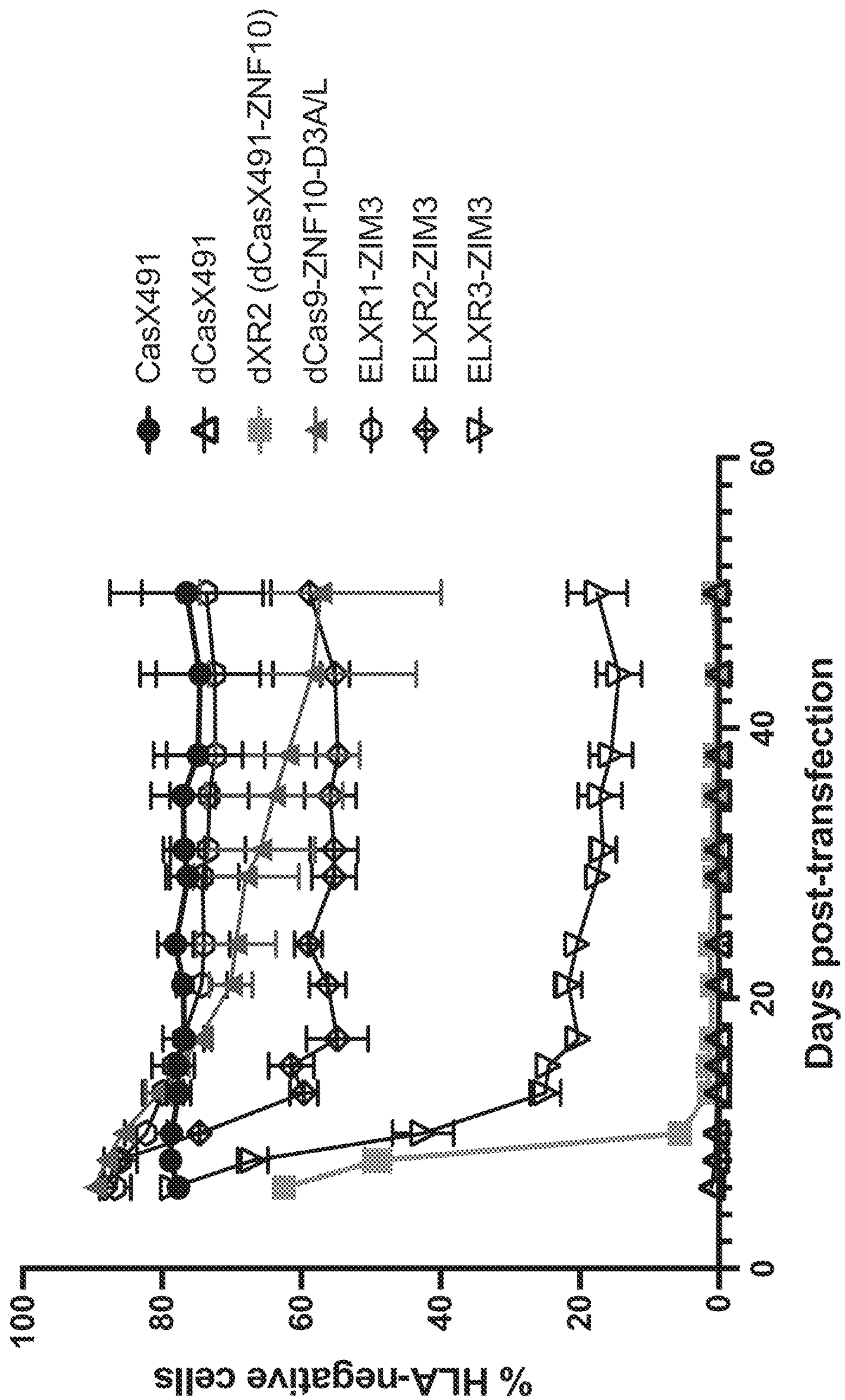
FIG. 8B presents the results of the same time-course experiment shown in FIG. 8A but illustrates the B2M repression activities of ELXR proteins Nos. 1-3 containing the ZIM3-KRAB domain, benchmarked against the same experimental controls, as described in Example 6. Data are presented as mean with standard deviation, N=3.

ELXR variant plasmids encoding for differently configured ELXR proteins (FIG. 7) were transiently transfected into HEK293T cells to determine whether the rationally-designed ELXR molecules could heritably silence gene expression of the target B2M locus in vitro. FIGS. 8A and 8B depict the results of a time-course experiment assessing B2M protein repression mediated by ELXR proteins #1-3, each of which harbored a KRAB domain from ZNF10 (FIG. 8A) or ZIM3 (FIG. 8B). Table 28 shows the average percentage of cells characterized as HLA-negative (indicative of depleted B2M expression) for each condition at 50 days post-transfection. The results illustrate that all ELXR molecules with a gRNA targeting the B2M locus were able to demonstrate sustained B2M repression for 50 days in vitro, although the potency of repression varied by the choice of KRAB domain and ELXR configuration. For instance, harboring a ZIM3-KRAB domain rendered the ELXR protein a more efficacious repressor than harboring a ZNF10-KRAB, and this effect was most prominently observed for ELXR #2 (compare FIG. 8A to FIG. 8B). Furthermore, positioning the DNMT3A/L domains at the N-terminus of dCasX491 (ELXR #1) resulted in more stable silencing of B2M expression compared to effects mediated by ELXRs with DNMT3A/L domains at the C-terminus of dCasX491 (ELXR #2 and #3; FIGS. 8A and 8B). These results also revealed that the relative positioning of the two types of repressor domains (i.e., dCasX491-KRAB-DNMT3A/L for ELXR #2 vs. dCasX491-DNMT3A/L-KRAB for ELXR #3) could also influence the overall potency of the ELXR molecule, despite both configurations being C-terminal fusions of dCasX491 (ELXR #2 and #3; FIGS. 8A and 8B).

Figure 9A:
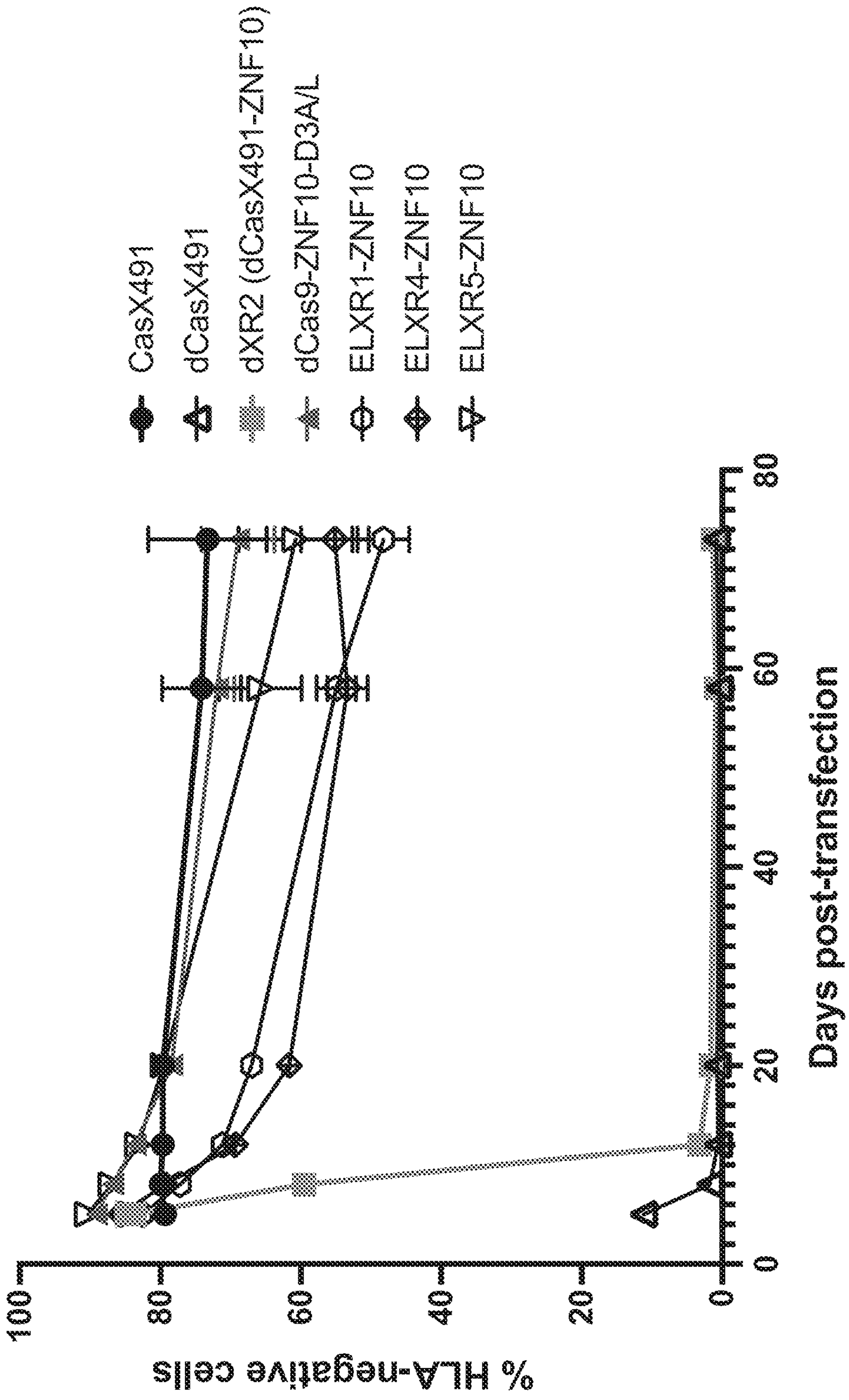
FIG. 9A presents the results of a time-course experiment comparing B2M silencing activities (represented as percentage of HLA-negative cells) of ELXR proteins #1, #4, and #5, as described in Example 6. Data are presented as mean with standard deviation, N=3.
Figure 9B:
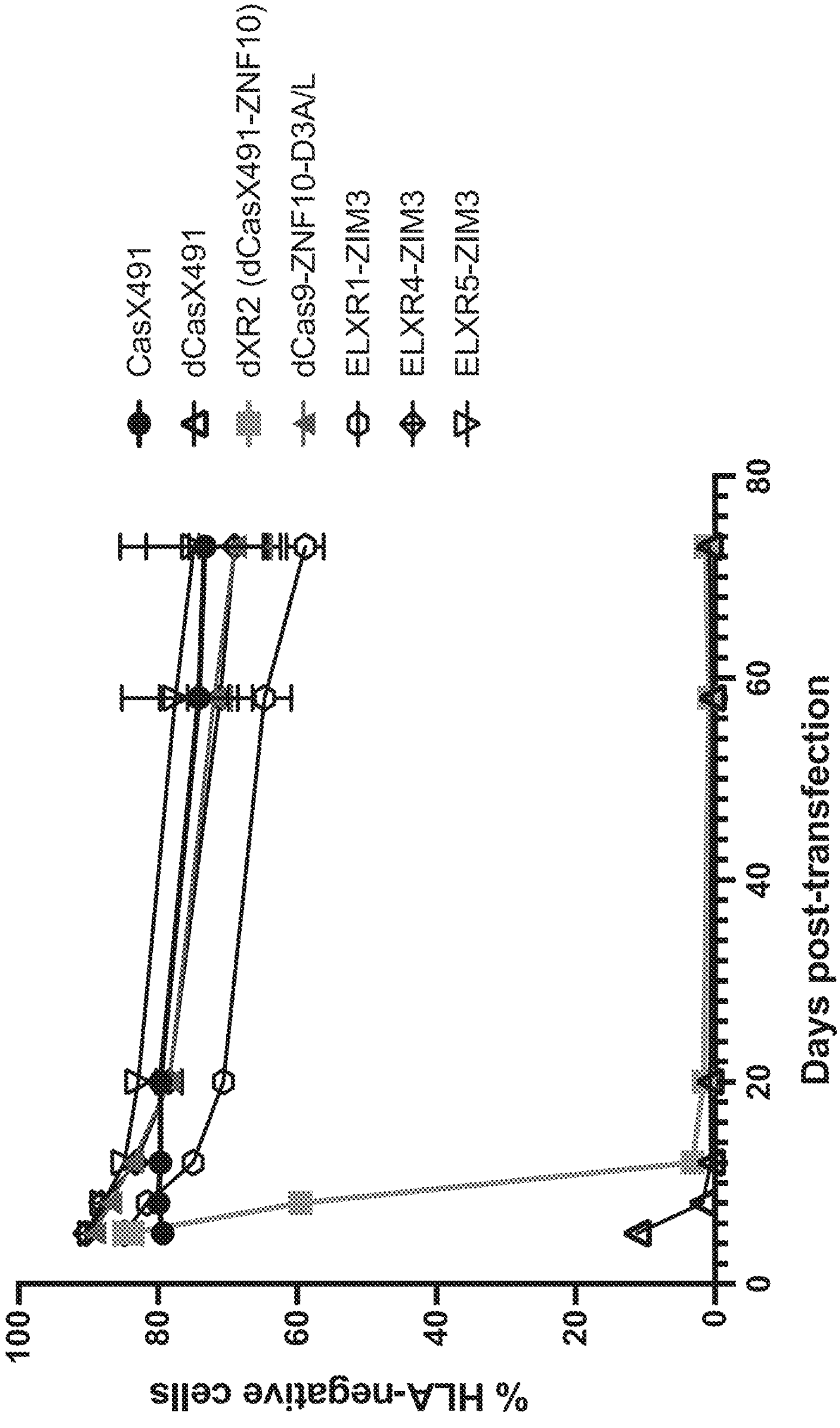
FIG. 9B presents the results of the same time-course experiment shown in FIG. 9A but illustrates the B2M silencing activities of ELXR proteins #1, #4, and #5 containing the ZIM3-KRAB domain, benchmarked against the same experimental controls, as described in Example 6. Data are presented as mean with standard deviation, N=3.

In a second time-course experiment, durable B2M repression was assessed for ELXR proteins #1, #4, and #5, where both the DNMT3A/L and KRAB domains were positioned at the N-terminus of dCasX491 for ELXR #4 and #5 (FIG. 7). Table 29 shows the average percentage of HLA-negative cells for each condition at 73 days post-lipofection. As similarly seen in the first time-course, all ELXR conditions with a B2M-targeting gRNA maintained durable silencing of the B2M locus (FIGS. 9A and 9B; Table 29). In fact, the results in this experiment demonstrate that ELXR #5 was able to achieve and sustain the highest level of B2M repression compared to that achieved by ELXR #1 or ELXR #4 for 73 days in vitro (FIGS. 9A and 9B). Furthermore, ELXR #4 containing the ZIM3-KRAB also appeared to outperform its ELXR #1 counterpart (FIG. 9B). For both time-course experiments discussed above, CasX 491-mediated editing resulted in durable silencing of the B2M expression, while an XR construct fusing only the KRAB domain to dCasx491 (dCasX491-ZNF10) only resulted in transient B2M knockdown.

TABLE 28

Levels of B2M repression mediated by CasX and Cas9 molecules and ELXR constructs #1-3 quantified at 50 days post-transfection.

| Molecule | Spacer | % HLA-negative cells (mean) | Standard deviation |
|---|---|---|---|
| CasX 491 | 0.0 | 0.29 | 0.09 |
| dCasX491 | 0.0 | N/A | N/A |
| dCasX491-ZNF10 | 0.0 | 0.40 | 0.18 |
| dCas9-ZNF10-D3A/L | 0.0 | 1.05 | 0.63 |
| ELXR1-ZNF10 | 0.0 | 0.99 | 0.35 |
| ELXR2-ZNF10 | 0.0 | 0.61 | 0.11 |
| ELXR3-ZNF10 | 0.0 | 0.79 | 0.29 |
| ELXR1-ZIM3 | 0.0 | 0.99 | 0.22 |
| ELXR2-ZIM3 | 0.0 | 0.78 | 0.27 |
| ELXR3-ZIM3 | 0.0 | 0.71 | 0.53 |
| CasX 491 | 7.37 | 76.57 | 11.03 |
| dCasX491 | 7.37 | 0.49 | 0.10 |
| dCasX491-ZNF10 | 7.148 | 0.89 | 0.19 |
| dCas9-ZNF10-D3A/L | 7.148 | 57.30 | 17.36 |
| ELXR1-ZNF10 (ELXR #1.B) | 7.37 | 69.97 | 7.89 |

TABLE 28-continued

Levels of B2M repression mediated by CasX and Cas9 molecules and ELXR constructs #1-3 quantified at 50 days post-transfection.

| Molecule | Spacer | % HLA-negative cells (mean) | Standard deviation |
|---|---|---|---|
| ELXR2-ZNF10 (ELXR #2.B) | 7.37 | 36.87 | 8.31 |
| ELXR3-ZNF10 (ELXR #3.B) | 7.37 | 17.07 | 3.50 |
| ELXR1-ZIM3 (ELXR #1.A) | 7.37 | 73.70 | 9.28 |
| ELXR2-ZIM3 (ELXR #2.A) | 7.37 | 58.83 | 0.87 |
| ELXR3-ZIM3 (ELXR #3.A) | 7.37 | 17.50 | 4.30 |

TABLE 29

Levels of B2M repression mediated by CasX and Cas9 molecules and ELXR constructs #1, #4, and #5 quantified at 73 days post-transfection.

| Molecule | Spacer | % HLA-negative cells (mean) | Standard deviation |
|---|---|---|---|
| CasX 491 | 0.0 | 0.71 | 0.05 |
| dCasX491 | 0.0 | N/A | N/A |
| dCasX491-ZNF10 | 0.0 | 0.76 | 0.12 |
| dCas9-ZNF10-D3A/L | 0.0 | 0.83 | 0.08 |
| ELXR1-ZNF10 | 0.0 | 1.04 | 0.44 |
| ELXR4-ZNF10 | 0.0 | 1.17 | 0.52 |
| ELXR5-ZNF10 | 0.0 | 1.94 | 1.27 |
| ELXR1-ZIM3 | 0.0 | 1.83 | 0.76 |
| ELXR4-ZIM3 | 0.0 | N/A | N/A |
| ELXR5-ZIM3 | 0.0 | 1.15 | 0.26 |
| CasX 491 | 7.37 | 73.30 | 8.43 |
| dCasX491 | 7.37 | 0.83 | 0.16 |
| dCasX491-ZNF10 | 7.148 | 1.37 | 0.37 |
| dCas9-ZNF10-D3A/L | 7.148 | 68.97 | 5.21 |
| ELXR1-ZNF10 (ELXR #1.B) | 7.37 | 48.27 | 3.66 |
| ELXR4-ZNF10 (ELXR #4.B) | 7.37 | 55.17 | 4.83 |
| ELXR5-ZNF10 (ELXR #5.B) | 7.37 | 60.77 | 8.12 |
| ELXR1-ZIM3 (ELXR #1.A) | 7.37 | 58.90 | 2.69 |
| ELXR4-ZIM3 (ELXR #4.A) | 7.37 | 69.00 | 6.58 |
| ELXR5-ZIM3 (ELXR #5.A) | 7.37 | 74.90 | 10.61 |

Figure 10:
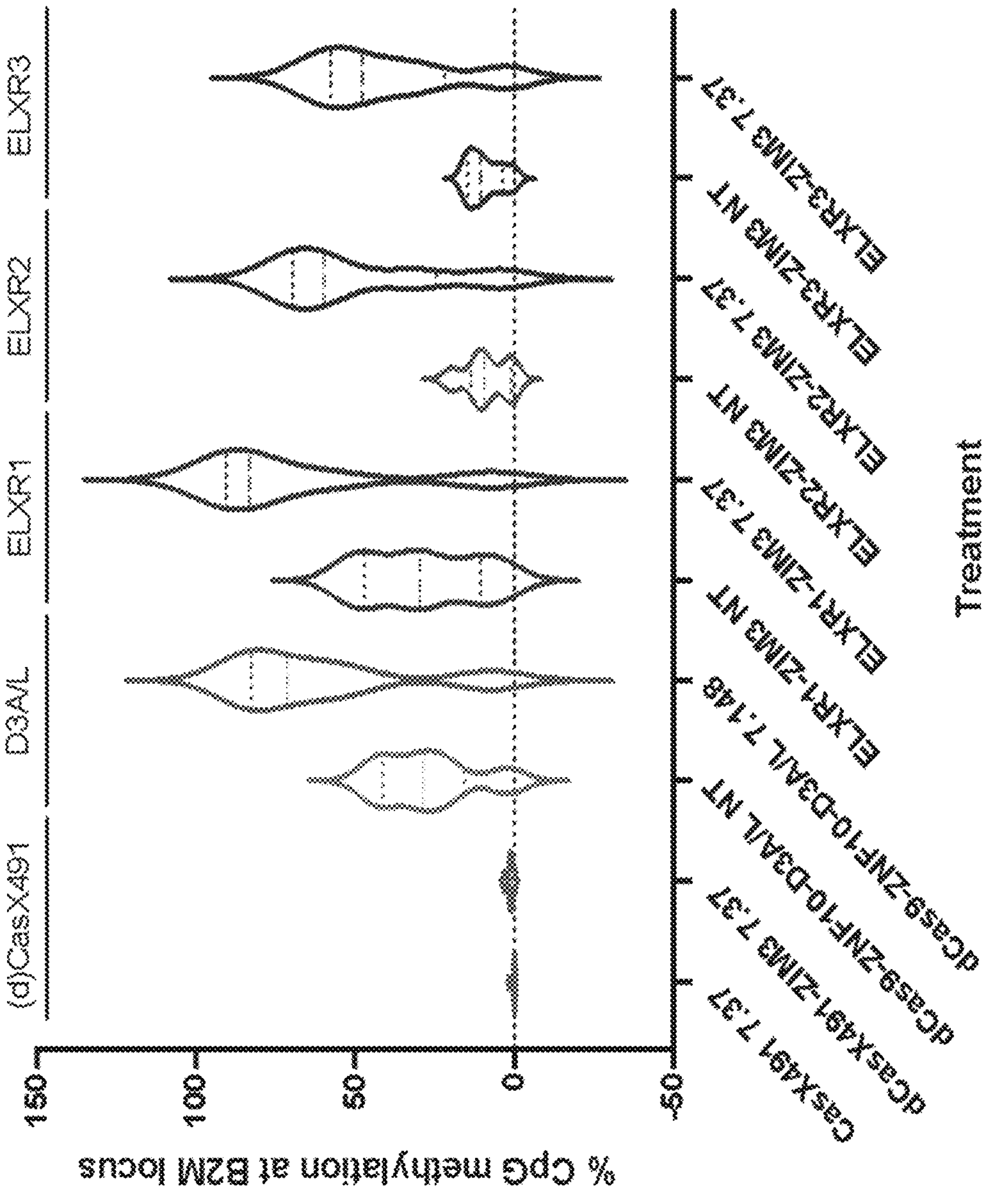
FIG. 10 is a violin plot of percent CpG methylation for CpG sites around the transcription start site of the B2M locus for each indicated experimental condition as described in Example 6.
Figure 11:
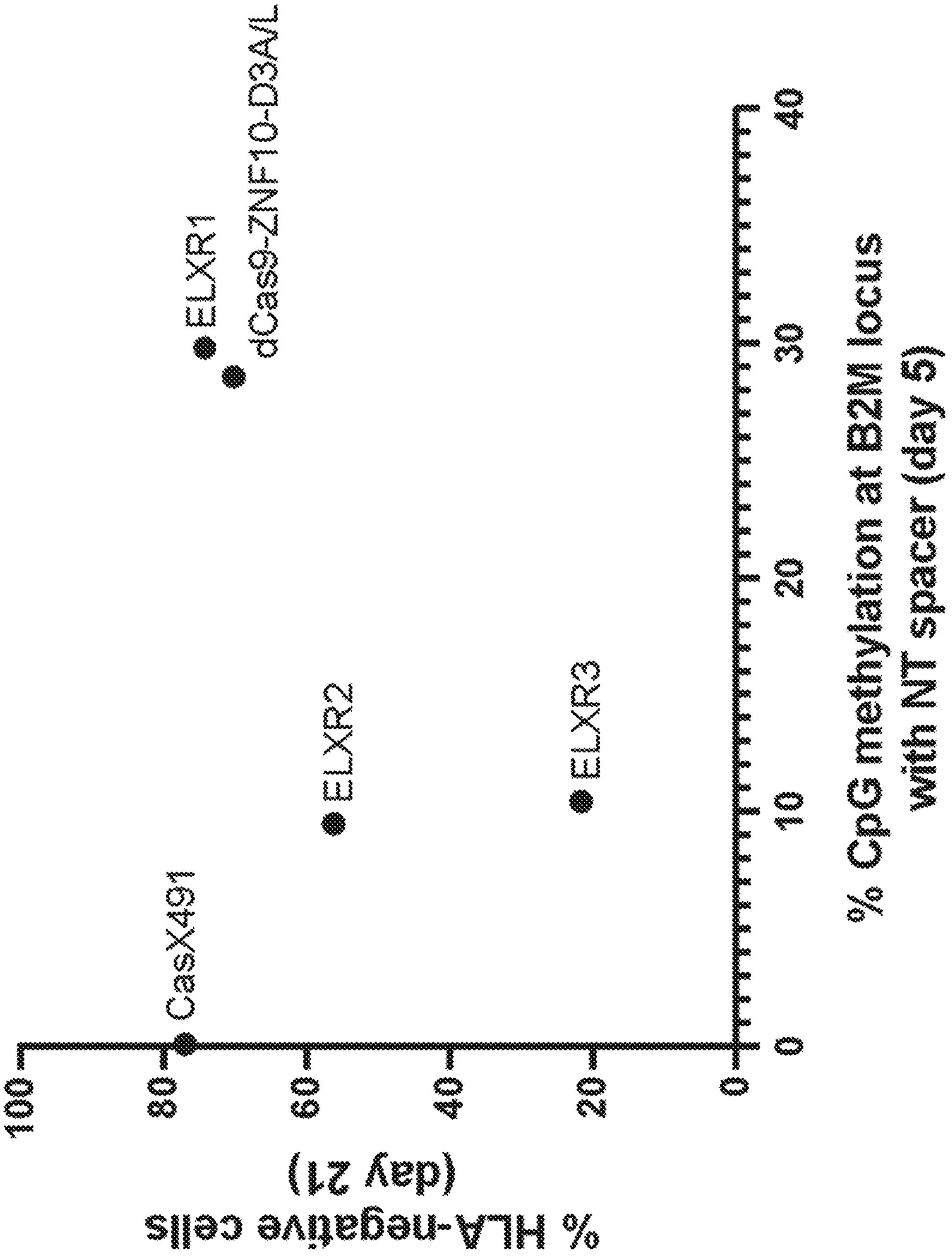
FIG. 11 is a dot plot showing the relative activity (average percentage of HLA-negative cells at day 21) versus specificity (percentage of off-target CpG methylation at the B2M locus quantified at day 5) for ELXR proteins #1-3, benchmarked against catalytically-active CasX 491 and dCas9-ZNF10-DNMT3A/L, as described in Example 6.

To evaluate the degree of off-target CpG methylation at the B2M locus mediated by the DNMT3A/L domains within the ELXR molecules, bisulfite sequencing was performed using genomic DNA extracted from HEK293T cells treated with ELXR proteins #1-3 containing the ZIM3-KRAB domain and harvested at five days post-lipofection. FIG. 10 illustrates the findings from bisulfite sequencing, specifically showing the distribution of the number of CpG sites around the transcription start site of the B2M locus that harbored a certain level of CpG methylation for each experimental condition. The results revealed that while ELXR #1 demonstrated the strongest on-target CpG-methylating activity (ELXR1-ZIM3 7.37), it induced the highest level of off-target CpG methylation (ELXR1-ZIM3 NT). ELXR #2 and ELXR #3 displayed weaker on-target CpG-methylating activity but relatively lower off-target methylation (FIG. 10). FIG. 11 is a scatterplot mapping the activity-specificity profiles for ELXR proteins #1-3 benchmarked against CasX 491 and dCas9-ZNF10-DNMT3A/L, where activity was measured as the average percentage of HLA-negative cells at day 21, and specificity was represented by the percentage of off-target CpG methylation at the B2M locus quantified at day 5.

Figure 12:
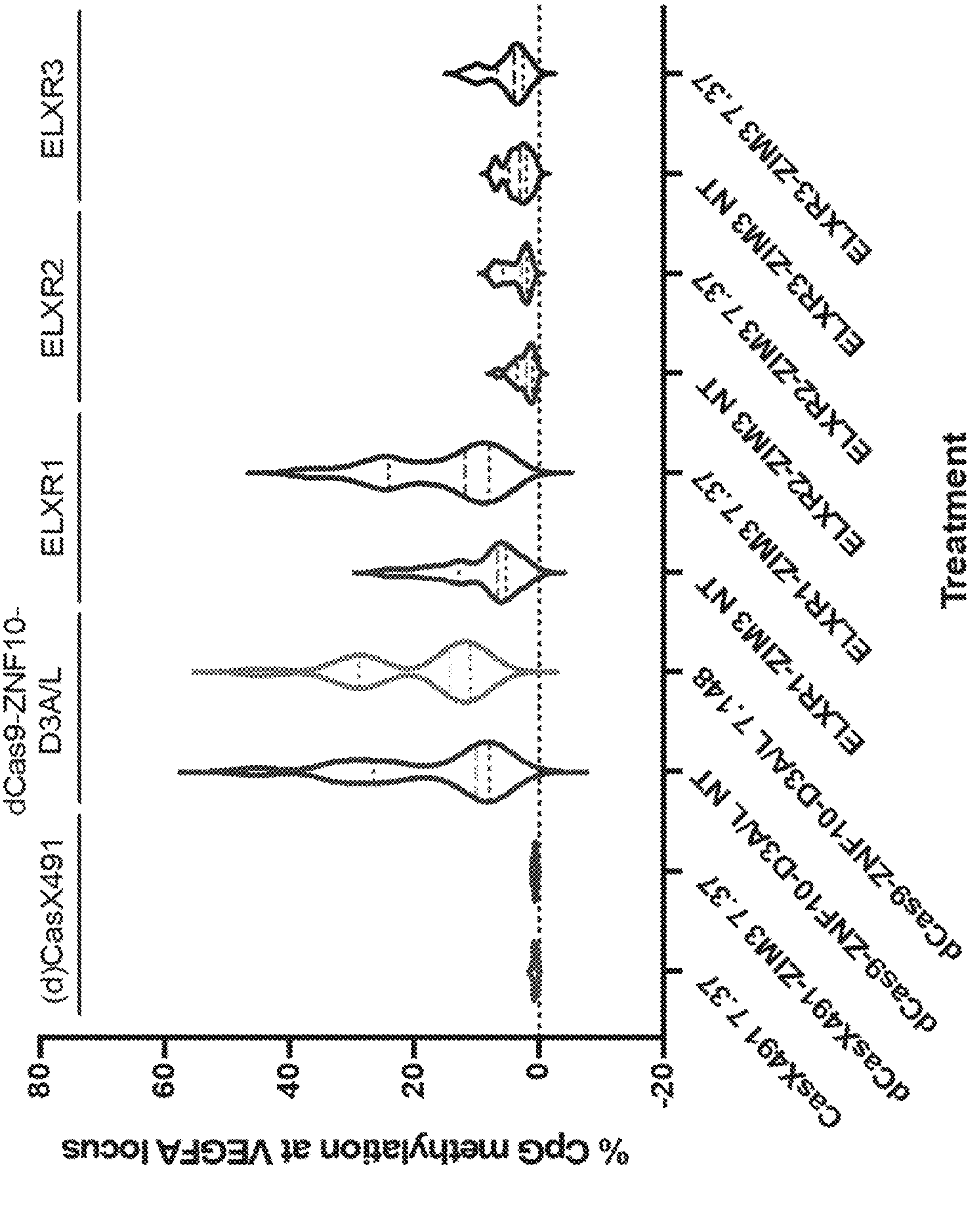
FIG. 12 is a violin plot of percent CpG methylation for CpG sites downstream of the transcription start site of the VEGFA locus for each indicated experimental condition as described in Example 6.

The degree of off-target CpG methylation mediated by the DNMT3A/L domain was further evaluated by assessing the level of CpG methylation at a different locus, i.e., VEGFA, by performing bisulfite sequencing using the same extracted gDNA as was used previously for FIG. 10. The violin plot in FIG. 12 illustrates the bisulfite sequencing results showing the distribution of CpG sites with CpG methylation at the VEGFA locus in cells treated with ELXR proteins #1-3 containing the ZIM3-KRAB domain and a B2M-targeting gRNA. The findings further demonstrate that use of ELXR #1 resulted in the highest level of off-target CpG methylation, supporting the data shown earlier in FIG. 10. In comparison, use of either ELXR #2 or ELXR #3 resulted in substantially lower off-target methylation at the −3 locus (FIG. 12).

Figure 13B:
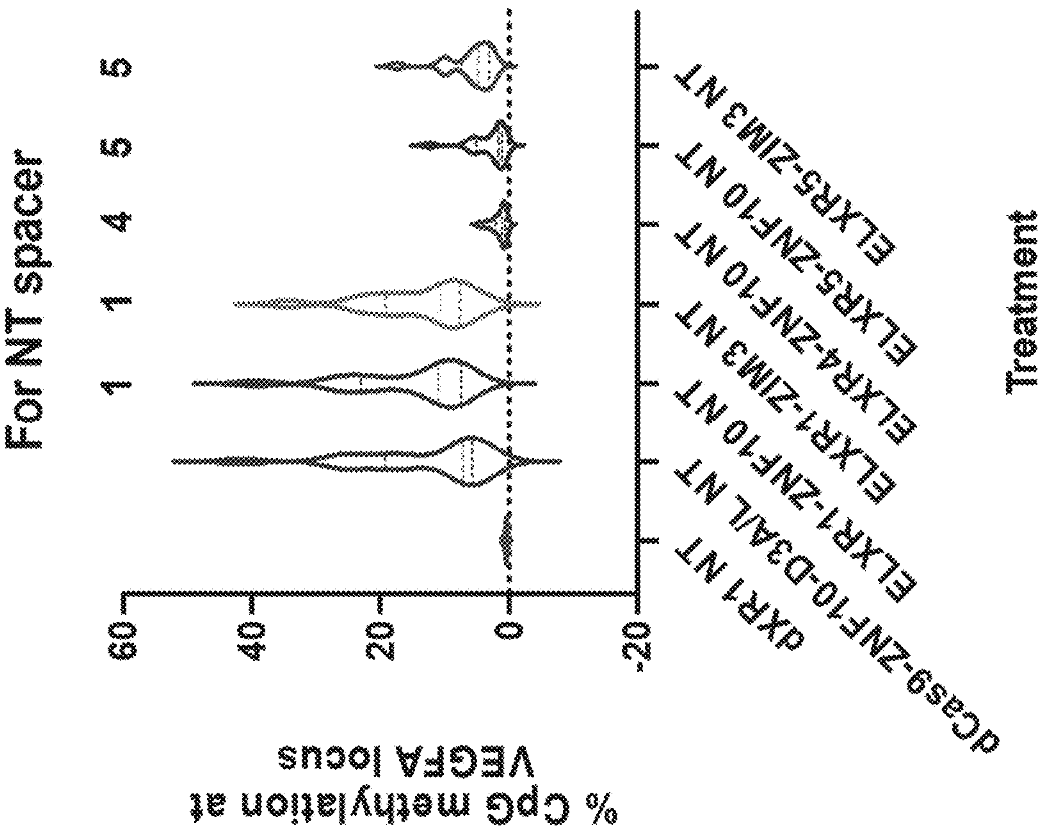
FIG. 13B is a violin plot of percent CpG methylation for CpG sites around the transcription start site of the VEGFA locus for each indicated experimental condition assessing ELXR #1, 4, and 5 with the non-targeting spacer as described in Example 6.
Figure 13A:
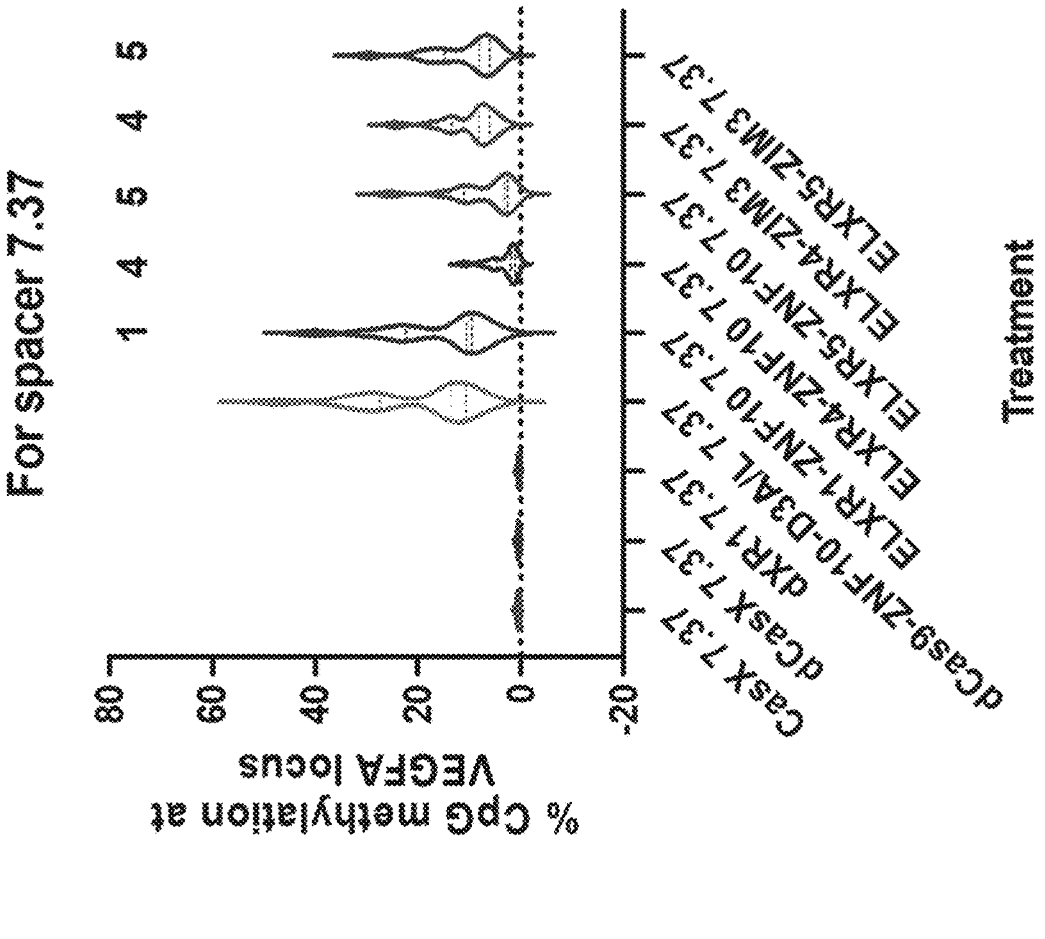
FIG. 13A is a violin plot of percent CpG methylation for CpG sites around the transcription start site of the VEGFA locus for each indicated experimental condition assessing ELXR #1, 4, and 5 with the B2M-targeting spacer as described in Example 6.

The extent of off-target CpG methylation at the VEGFA locus for ELXR molecules #1, #4, and #5 was also analyzed. The plots in FIGS. 13A-13B illustrate bisulfite sequencing results showing the distribution of CpG-methylated sites at the VEGFA locus in cells treated with ELXR #1, 4, and 5 containing a ZNF10 or ZIM3-KRAB domain and either a non-targeting gRNA (FIG. 13B) or a B2M-targeting gRNA (FIG. 13A). The data in FIG. 13B show that use of ELXR4-ZNF10, ELXR5-ZFN10, or ELXR5-ZIM3 resulted in markedly lower off-target CpG methylation at the VEGFA locus in comparison to use of ELXR1-ZNF10 or ELXR1-ZIM3. Similarly, the data in FIG. 13A show that use of ELXR #4 or ELXR #5 with either KRAB domain resulted in substantially lower levels of off-target CpG methylated sites compared to use with ELXR1-ZNF10. As exhibited in both FIGS. 13A and 13B, the level of non-specific CpG methylation demonstrated by ELXR #1 is comparable to that achieved by the dCas9-ZNF10-DNMT3A/L benchmark.

Figure 14:
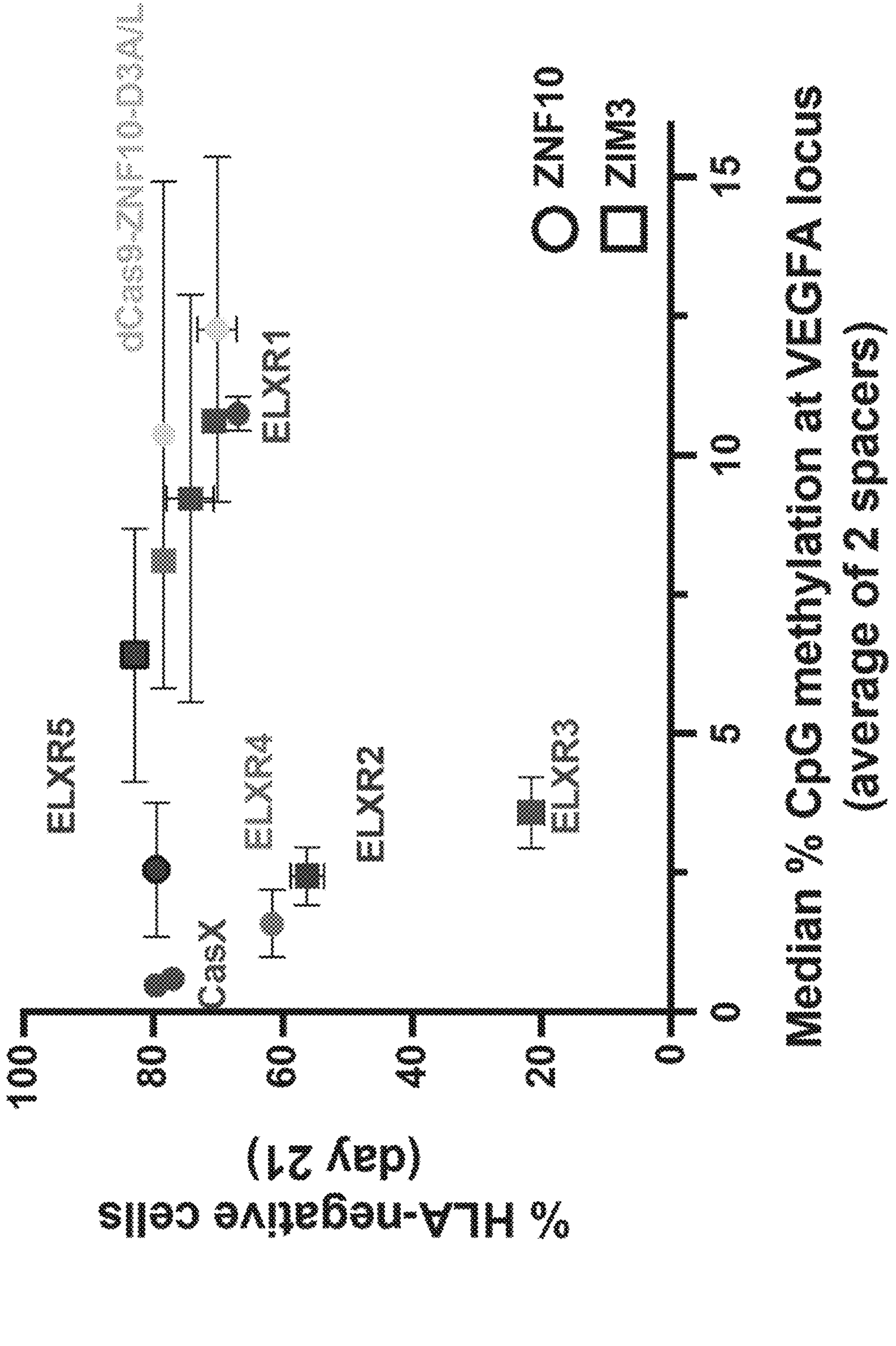
FIG. 14 is a scatterplot showing the relative activity (average percentage of HLA-negative cells at day 21) versus specificity (median percentage of off-target CpG methylation at the VEGFA locus quantified at day 5) for ELXR proteins #1-5 harboring either the ZNF10- or ZIM-KRAB domain, and the ELXR proteins were benchmarked against catalytically-active CasX 491 and dCas9-ZNF10-DNMT3A/L, as described in Example 6.

FIG. 14 is a scatterplot mapping the activity-specificity profiles for ELXR molecules #1-5, containing either ZNF10- or ZIM3-KRAB domain, benchmarked against CasX 491 and dCas9-ZNF10-DNMT3A/L, where activity was measured as the average percentage of HLA-negative cells at day 21, and specificity was represented by the median percentage of off-target CpG methylation at the VEGFA locus detected at day 5. The data show that of the five ELXR molecules assessed, use of ELXR #5 resulted in the highest level of repressive activity, while use of ELXR #4 resulted in the strongest level of specificity.

The experiments demonstrate that the rationally-engineered ELXR molecules were able to transcriptionally and heritably repress the endogenous B2M locus, resulting in sustained depletion of the target protein. The findings also show that the choice of KRAB domain and position and relative configuration of the DNMT3A/L domains could affect the overall potency and specificity of the ELXR molecule in durably silencing the target locus.

Example 7: Development of Functional Screens to Assess the Activity and Specificity of Rationally-Engineered Improved ELXR Variants To engineer ELXR variants with improved repression activity and target methylation specificity, a pooled screening assay will be developed. Briefly, systematic mutagenesis of the DNMT3A catalytic domain is performed to generate a library of DNMT3A variants (SEQ ID NOS: 33625-

57543) that will be tested in an ELXR molecule to screen for improved ELXR variants using various functional assays.

Materials and Methods:

Generation of a Library of DNMT3A Catalytic Domain Variants:

The following methods will be used to construct a DME library of the DNMT3A catalytic domain variants. A staging vector will be created to harbor the DNMT3A sequence flanked by restriction sites compatible with the destination vectors used for screening. The DNMT3A catalytic domain sequence will be divided into five ~200 bp fragments, and each fragment will be synthesized as an oligonucleotide pool. Each oligonucleotide pool will be constructed to contain three different types of modification libraries. First, a substitution oligonucleotide library that will result in each codon of the DNMT3A catalytic domain fragment being replaced with one of the 19 possible alternative codons coding for the 19 possible amino acid mutations. Second, a deletion oligonucleotide library will be prepared that will result in each codon of the fragment being systematically removed to delete that amino acid. Third, an insertion oligonucleotide library will be prepared that will insert one of the 20 possible codons at every position of the DNMT3A catalytic domain fragment. These oligonucleotide pools will be amplified and cloned into the staging vector using Golden Gate reactions and PCR-generated backbones. The pooled DNMT3A catalytic domain DME libraries will then be transferred into the lentiviral ELXR constructs coding for the ELXR molecule as described in Example 6 via restriction enzyme digestion and ligation prior to library amplification. To determine adequate library coverage, each fragment of the DNMT3A catalytic domain DME will be PCR amplified separately with gene specific primers, followed by NGS on the Illumina™ Miseq™ using overlapping paired end sequencing.

High-Throughput Screening of ELXR Variants Generated Using DNMT3A Catalytic Domain DME Libraries:

After following standard protocols for lentivirus production and titering, the resulting lentiviral library of ELXR variants will be subjected to different high-throughput functional screens. These functional screens are briefly described below.

A specificity-focused screen aims to identify DNMT3A catalytic domain variants that will yield ELXR molecules with decreased off-target methylation. For instance, an in vitro dropout assay could be used to identify DNMT3A catalytic domain variants that would not induce deleterious nonspecific methylation. Overexpression of DNMT3A leads to extraneous methylation which adversely affects cell growth, likely due to increased repression of genes critical for cell survival and proliferation. In this assay, HEK293T cells will be transduced with the lentiviral ELXR library at a low multiplicity of infection (MOI), and an initial population of transduced cells will be harvested prior to selection with puromycin for five days. After selection, multiple time point populations will be harvested at days 5, 7, 10 and 14, and gDNA will be extracted from all populations and subjected to PCR amplification and NGS sequencing of target amplicons containing the DNMT3A catalytic domain variants. Comparing the library composition readout between the initial and terminal populations will yield non-deleterious DNMT3A catalytic domain variants that confer cell survivability and growth. In parallel, methylation-sensitive promoters coupled to GFP have been developed in which overexpression of untargeted ELXR molecules lead to GFP repression due to off-target global methylation. An orthogonal screen will therefore be performed in which the DNMT3A catalytic domain DME libraries will be transduced in cell lines harboring these methylation-sensitive reporters, and quantification of GFP levels would allow assessment and identification of ELXR variants that cause off-target methylation over time.

An activity-focused screen aims to identify DNMT3A catalytic domain variants that will reveal ELXR molecules with increased on-target methylating activity. Here, the approach can leverage the spreading of DNA methylation to potentially repress the activity of a nearby promoter to identify ELXR-specific spacers and evaluate ELXR molecule activity at earlier time points. Briefly, HEK293T suspension cells will be transduced with the lentiviral ELXR library with the spacer targeting the B2M locus and selected with puromycin for five days. After selection, B2M protein expression will be measured by immunostaining, and cells that exhibit B2M repression (indicated by HLA-negative cells) will be sorted by FACS. Genomic DNA will be extracted from sorted HLA-negative cells for NGS analysis. Enrichment scores for each variant can be calculated by comparing the frequency of mutations in the sorted population relative to the naive cells to identify the DNMT3A catalytic domain variants that more potently repress B2M expression.

In addition to screening the library of DNMT3A catalytic domain variants, screening the library of KRAB repressor domains in parallel, which is described in Example 4 above, will help identify ELXR variants with improved activity and specificity profiles.

The experiments described in this example are expected to identify additional ELXR leads with improved durable repression activity and specificity. These improved ELXR molecules will be tested in various cell types against a therapeutic target of interest to further characterize and identify lead candidates for development.

Example 8: Demonstration that Catalytically-Dead CasX does not Edit at the Endogenous B2M Locus In Vitro Experiments were performed to demonstrate that catalytically-dead CasX is unable to edit the endogenous B2M gene in an in vitro assay.

Materials and Methods:

Generation of Catalytically-Dead CasX (dCasX) Constructs and Cloning:

CasX variants 491, 527, 668 and 676 with gRNA scaffold variant 174 were used in these experiments. To generate catalytically-dead CasX 491 (dCasX491; SEQ ID NO: 18) and catalytically-dead CasX 527 (dCasX527; SEQ ID NO: 24), the D659, E756, D921 catalytic residues of the RuvC domain of CasX variant 491, and D660, E757, and the D922 catalytic residue of the RuvC domain of CasX variant 527 were mutated to alanine to abolish the endonuclease activity. Similarly, D660, E757, D923-to-alanine mutations at catalytic residues within the RuvC domain of CasX variants 668 and 676 were designed to generate catalytically-dead CasX 668 (dCasX668; SEQ ID NO: 59355) and catalytically-dead CasX 676 (dCasX676; SEQ ID NO: 59357). The resulting plasmids contained constructs with the following configuration: Ef1α-SV40NLS-dCasX variant-SV40NLS. Plasmids also contained sequences encoding a gRNA scaffold variant 174 having a B2M-targeting spacer (spacer. 7.37; GGCCGAGAUGUCUCGCUCCG, SEQ ID NO: 59628) or a non-targeting spacer control (spacer 0.0; CGAGACGUAAUUACGUCUCG; SEQ ID NO: 59630).

Plasmids encoding for the catalytically-dead CasX variants (dCasX491, dCasX527, dCasX668, and dCasX676) were generated using standard molecular cloning methods and validated using Sanger-sequencing. Sequence-validated constructs were midi-prepped for subsequent transfection into HEK293T cells.

Plasmid Transfection into HEK293T Cells:

~30,000 HEK293T cells were seeded in each well of a 96-well plate; the next day, cells were transiently transfected with a plasmid containing a dCasX:gRNA construct encoding for dCasX491, dCasX527, dCasX668, or dCasX676 (sequences in Table 4), with the gRNA having either non-targeting spacer 0.0 or targeting spacer 7.37 to the B2M locus. Each construct was tested in triplicate. 24 hours post-transfection, cells were selected with puromycin, and six days after transfection, cells were harvested for editing analysis at the B2M locus by NGS. The following experimental controls were also included in this experiment: 1) catalytically-active CasX 491 with a B2M-targeting gRNA or a non-targeting gRNA; 2) catalytically-dead variant of Cas9 (dCas9) with the appropriate gRNAs; and 3) mock (no plasmid) transfection.

NGS Processing and Analysis:

Using the Zymo Quick-DNA Miniprep Plus kit following the manufacturer's instructions, gDNA was extracted from harvested cells. Target amplicons were amplified from extracted gDNA with a set of primers specific to the human B2M locus. These gene-specific primers contained an additional sequence at the 5' end to introduce an Illumina™ adapter and a 16-nucleotide unique molecule identifier. Amplified DNA products were purified with the Ampure XP DNA cleanup kit. Quality and quantification of the amplicon were assessed using a Fragment Analyzer DNA Analysis kit (Agilent, dsDNA 35-1500 bp). Amplicons were sequenced on the Illumina™ Miseq™ according to the manufacturer's instructions. Raw fastq files from sequencing were quality-controlled and processed using cutadapt v2.1, flash2 v2.2.00, and CRISPResso2 v2.0.29. Each sequence was quantified for containing an insertion or deletion (indel) relative to the reference sequence, in a window around the 3' end of the spacer (30 bp window centered at −3 bp from 3' end of spacer). CasX activity was quantified as the total percent of reads that contain insertions, substitutions, and/or deletions anywhere within this window for each sample.

Results

Figure 15:
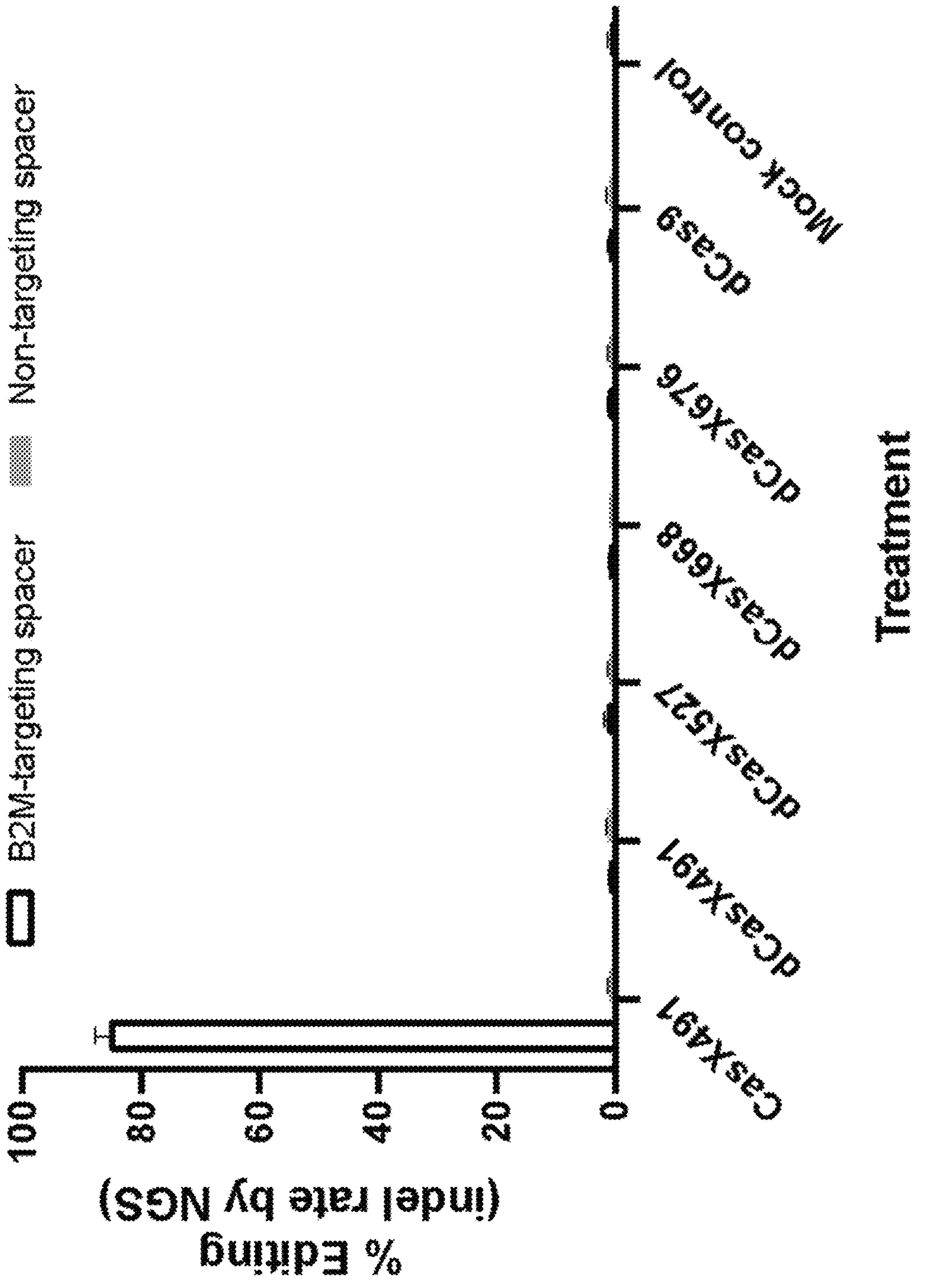
FIG. 15 is a quantification of percent editing measured as indel rate detected by NGS at the human B2M locus for each of the indicated catalytically-dead CasX variant with either a B2M-targeting spacer or a non-targeting spacer, as described in Example 8. Catalytically-active CasX 491, catalytically-inactive CasX9 (dCas9), and a mock transfection served as experimental controls.

The plot in FIG. 15 shows the results of the editing analysis, specifically the percent editing at the B2M locus measured as indel rate detected by NGS for each of the indicated treatment conditions. The data demonstrate that >80% editing was achieved at the B2M locus mediated by catalytically-active CasX 491. On the other hand, dCasX491, dCasX527, dCasX668, and dCasX676 did not exhibit editing at the B2M locus with the B2M-targeting spacer.

The results of this experiment demonstrate that catalytically-dead CasX does not edit at an endogenous target locus in vitro.

Example 9: Demonstration that Use of ELXR Molecules can Induce Durable Silencing of the Endogenous CD151 Gene Experiments were performed to demonstrate that ELXR molecules can induce long-term repression of an alternative endogenous locus, i.e., the CD151 gene, in a cell-based assay.

Materials and Methods:

ELXR molecules #1, #4, and #5 containing the ZIM3-KRAB domain (see FIG. 7 for specific configurations and Table 25 for encoding sequences) were assessed in this experiment.

Figure 20A:
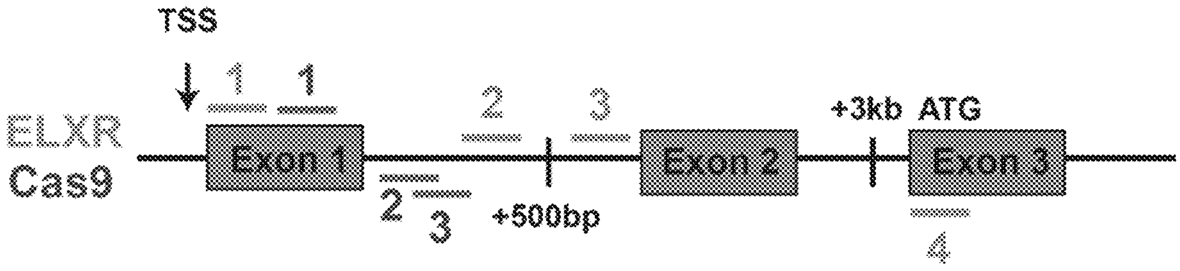
FIG. 20A is a schematic illustrating the relative positions of the CD151 sequences targeted by spacers for the assayed ELXR molecules and the dCas9-ZNF10-DNMT3A/L control, as described in Example 9. Positions targeted by gRNAs are indicated by light (paired with ELXRs) and dark gray (paired with dCas9-ZNF10-DNMT3A/L) bars.

Transfection of HEK293T Cells:

Seeded HEK293T cells were transiently transfected with 100 ng of ELXR variant plasmids, each containing an ELXR:gRNA construct encoding for ELXR molecule #1, #4, or #5, with four different gRNAs targeting the CD151 gene that encodes for an endogenous cell surface receptor (spacer sequences listed in Table 30). The next day, cells were selected with puromycin for four days. Cells were harvested for repression analysis at day 6, day 15, and day 22 after transfection. Repression analysis was performed by quantifying the level of CD151 protein expression via CD151 immunolabeling followed by flow cytometry using the Attune™ NxT flow cytometer. As experimental controls, HEK293T cells were also transfected with dCas9-ZNF10-DNMT3A/L with the appropriate CD151-targeting gRNAs (with targeting spacers 1-3 listed in Table 30). FIG. 20A is a schematic illustrating the relative positions of the targeting spacers listed in Table 30.

TABLE 30

Sequences of human CD151-targeting spacers used in constructs.

| Spacer ID | DNA sequence | SEQ ID NO | RNA sequence | SEQ ID NO |
|---|---|---|---|---|
| 39.1 | CAGCGCTGGGAGCCGCCGCC | 59640 | CAGCGCUGGGAGCCGCCGCC | 59647 |
| 39.2 | GCCCAGGGGTCCCGGGACGC | 59641 | GCCCAGGGGUCCCGGGACGC | 59648 |
| 39.3 | CTCCGCCCGCAGCAGCCCCC | 59642 | CUCCGCCCGCAGCAGCCCCC | 59649 |
| 39.4 | GACCTGCCGAGCGCCCGCCG | 59643 | GACCUGCCGAGCGCCCGCCG | 59650 |
| dCas9 spacer 1 | ACCACGCGTCCGAGTCCGG | 59644 | ACCACGCGUCCGAGUCCGG | 59651 |
| dCas9 spacer 2 | TGCTCATTGTCCCTGGACA | 59645 | UGCUCAUUGUCCCUGGACA | 59652 |
| dCas9 spacer 3 | GGACACCCTGCTCATTGTC | 59646 | GGACACCCUGCUCAUUGUC | 59653 |

Results

Figure 20B:
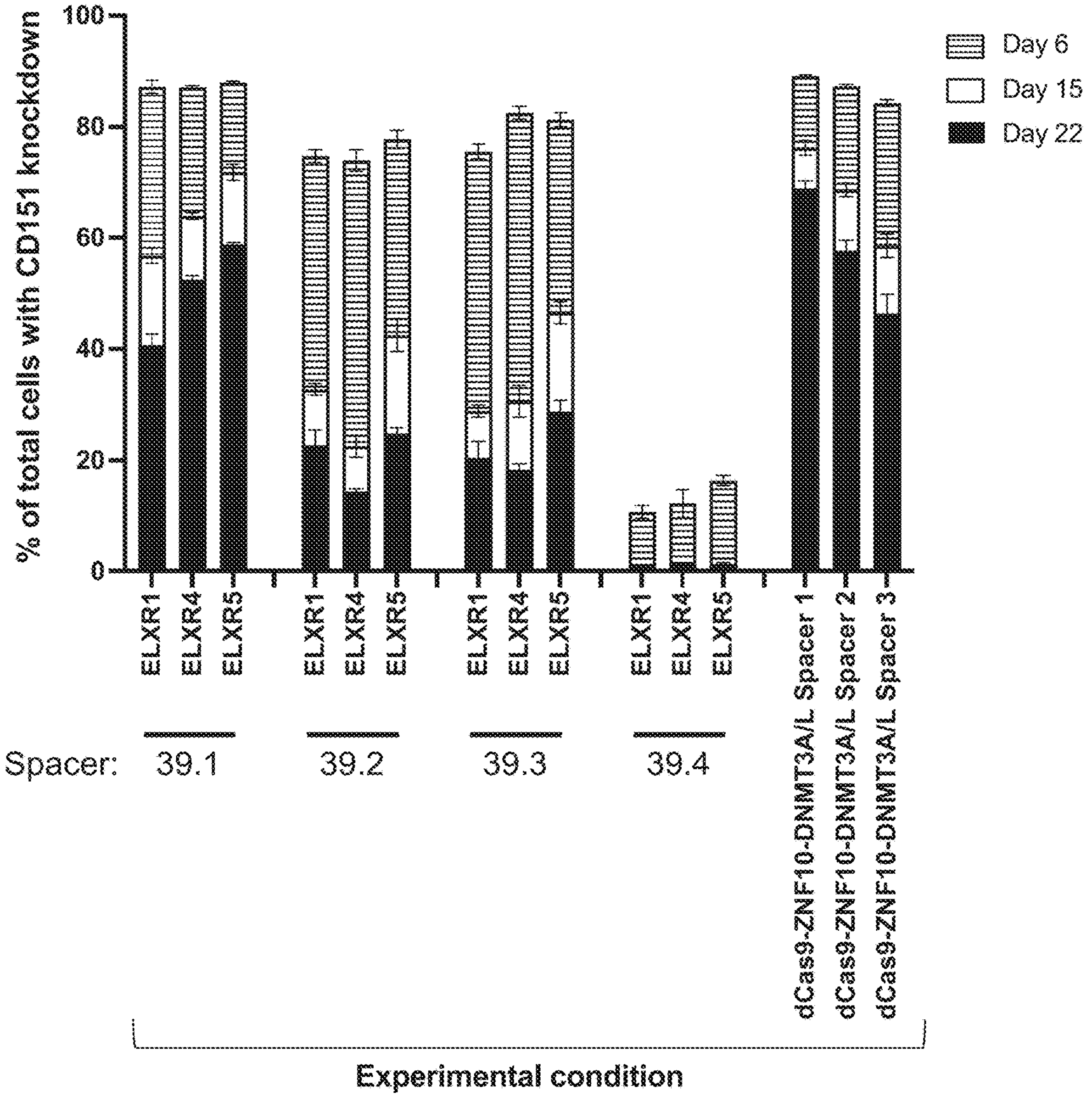
FIG. 20B is a bar graph that illustrates the results of a time-course experiment comparing CD151 repression activities (represented as percentage of total cells with CD151 knockdown) of ELXR proteins #1, #4, and #5 containing the ZIM3-KRAB domain with the indicated targeting spacers, as described in Example 9. Data for each timepoint (day 6, day 15, and day 22) are superimposed and are presented as mean with standard deviation, N=3.

ELXR variant plasmids encoding for ELXR #1, #4, and #5 harboring the ZIM3-KRAB domain were transiently transfected into HEK293T cells to determine whether these ELXR molecules could durably silence expression of the target CD151 gene in a cell-based assay. Quantification of the resulting CD151 knockdown by ELXRs is illustrated in FIG. 20B. The data demonstrate that use of three of the four tested targeting spacers resulted in durable silencing of the CD151 locus through 22 days post-transfection, albeit to varying levels of knockdown. Specifically, use of ELXR #1, #4, or #5 with targeting spacer 39.1 resulted in the strongest durable CD151 knockdown compared to that achieved when using other targeting spacers (FIG. 20B). The findings also show that use of ELXR #5 resulted in the strongest repressive activity, observable at Day 15 and Day 22 post-transfection across the tested spacers (FIG. 20B). Transfections with ELXR #5 and spacer pool or dCas9-ZNF10-DNMT3A/L and the appropriate gRNAs similarly resulted in durable silencing of the CD151 locus.

The results of this experiment demonstrate that ELXR molecules can induce heritable silencing of an alternative endogenous locus in vitro. Furthermore, the findings show that use of the ELXR #5 molecule resulted in the highest repression activity among the various ELXR configurations tested, indicating that position and relative arrangement of the DNMT3A/L domains affect overall activity of the ELXR molecule at the target locus.

Example 10: Demonstration that ELXRs have a Broader Targeting Window Compared to dXRs Experiments were performed to determine the targeting window of ELXR molecules at a gene promoter and to demonstrate that ELXRs have a wider targeting window compared to that of dXR molecules. As described in earlier examples, dXR is dCasX fused with a KRAB repressor domain, while ELXR is dCasX fused with a KRAB domain, DNMT3A catalytic domain, and a DNMT3L interaction domain.

Materials and Methods:

ELXR #1 containing the ZIM3-KRAB domain, as described in Example 6, and dXR1, as described in Example 1, were assessed in this experiment. Various gRNAs with scaffold 174 containing a B2M-targeting spacer were used in this experiment.

Figure 21A:
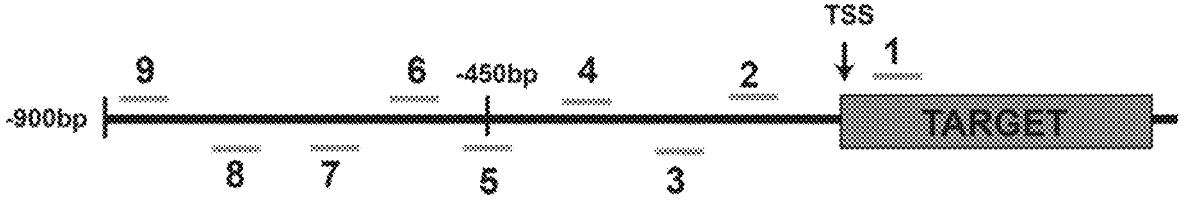
FIG. 21A is a schematic showing the positions of the various B2M-targeting gRNAs tiled across a ~1 KB window at the promoter region of the B2M gene, as described in Example 10. The numbers correspond to a particular B2M-targeting spacer shown in FIG. 21B. Targeting gRNAs are indicated by gray bars.

Transfection of HEK293T Cells:

Seeded HEK293T cells were lipofected with 100 ng of a plasmid containing a CasX:gRNA construct encoding for either XR1 or an ELXR #1 containing the ZIM3-KRAB domain, with nine different targeting gRNAs that tiled across ~1 KB region of the B2M promoter (spacer sequences listed in Table 31). The next day, cells were selected with puromycin for four additional days. Cells were harvested at six days after lipofection to determine B2M protein expression by flow cytometry as described in Example 6. HEK293T cells transfected with either ELXR #1 or dXR1 with a non-targeting gRNA was included as an experimental control. FIG. 21A is a schematic illustrating the tiling of the various B2M-targeting gRNAs (spacers listed in Table 31) within a ~1 KB window of the B2M promoter.

TABLE 31

Sequences of human B2M-targeting spacers used in constructs in this experiment.

| Spacer ID | DNA sequence | SEQ ID NO | RNA sequence | SEQ ID NO |
|---|---|---|---|---|
| 7.37 | GGCCGAGATGTCTCGCTCCG | 341 | GGCCGAGAUGUCUCGCUCCG | 59628 |
| 7.160 | TAAACATCACGAGACTCTAA | 59654 | UAAACAUCACGAGACUCUAA | 59662 |
| 7.161 | AGGACTTCAGGCTGGAGGCA | 59655 | AGGACUUCAGGCUGGAGGCA | 59663 |
| 7.162 | CGAATGAAAAATGCAGGTCC | 59656 | CGAAUGAAAAAUGCAGGUCC | 59664 |
| 7.163 | GITTATAACTACAGCTTGGG | 59657 | GUUUAUAACUACAGCUUGGG | 59665 |
| 7.164 | CTGAGCTGTCCTCAGGATGC | 59658 | CUGAGCUGUCCUCAGGAUGC | 59666 |
| 7.165 | TCCCTATGTCCTTGCTGTTT | 59659 | UCCCUAUGUCCUUGCUGUUU | 59667 |
| 7.166 | AGCGCCCTCTAGGTACATCA | 59660 | AGCGCCCUCUAGGUACAUCA | 59668 |
| 7.167 | GTTTACTGAGTACCTACTAT | 59661 | GUUUACUGAGUACCUACUAU | 59669 |

Results

Figure 21B:
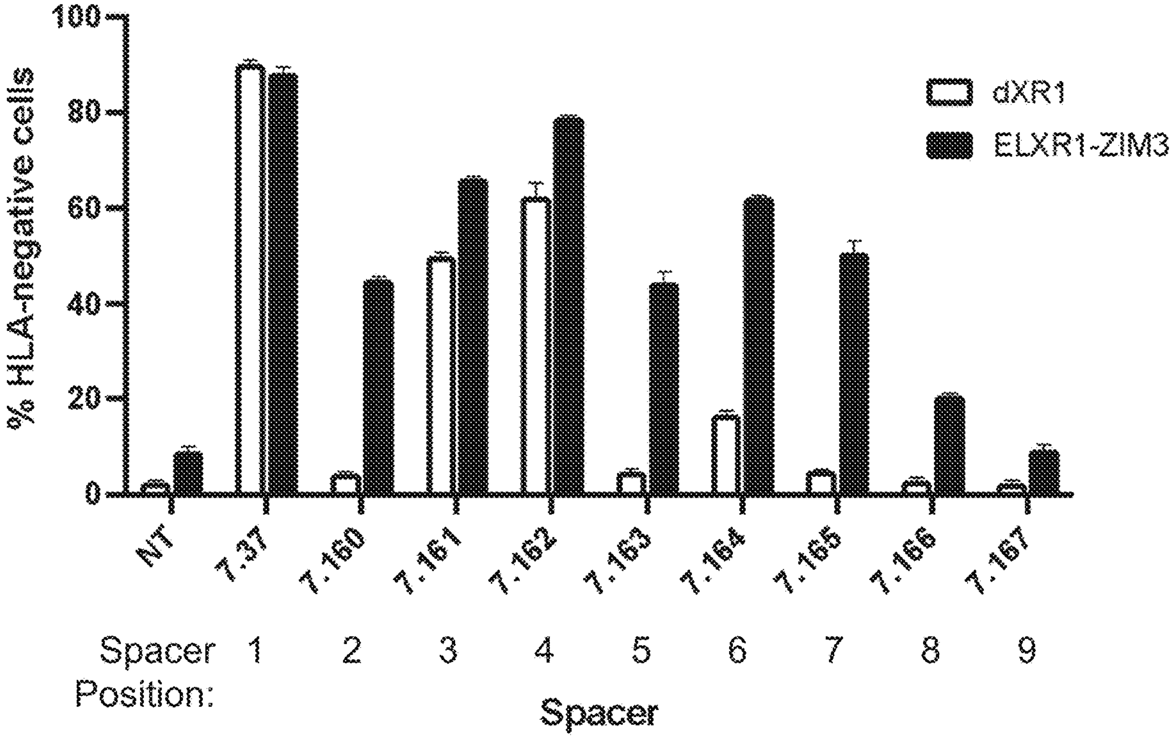
FIG. 21B is a bar graph that illustrates the quantification of B2M repression, represented as the average percentage of HLA-negative cells, mediated by either dXR1 or ELXR #1 with the indicated B2M-targeting spacers, as described in Example 10. Data are presented as mean with standard deviation, N=3. NT=non-targeting spacer.

To determine and compare the targeting window of ELXR molecules with that of dXR molecules, HEK293T cells were transfected with a plasmid encoding for either ELXR #1 or dXR1 with the various B2M-targeting gRNAs tiled across a ~1 KB region of the B2M promoter (Table 31). FIG. 21B is a plot depicting the results of the experiment assessing B2M protein repression (indicated by average percentage of cells characterized as HLA-negative) mediated by ELXR #1 compared with that mediated by dXR1 for the various B2M-targeting spacers. The data demonstrate that ELXR #1 was able to induce substantial B2M repression with more targeting spacers compared to that observed with dXR1 (FIG. 21B). Specifically, unlike the effects seen with dXR1, ELXR #1 was able to achieve meaningful B2M repression with spacers 7.160, 7.163, 7.164, and 7.165, suggesting that these four spacers are ELXR-specific spacers at the B2M locus. As anticipated, both ELXR #1 and dXR1 were able to induce a marked decrease in B2M protein expression with spacer 7.37 and a negligible decrease with a non-targeting spacer (FIG. 21B).

The results of this experiment demonstrate that ELXR molecules have a broader targeting window at the target locus compared to that of dXR molecules, and that ELXRs can function at longer distances from the gene promoter to induce repression of the target gene.

Example 11: Demonstration that Inclusion of the ADD Domain from DNMT3A Enhances Activity and Specificity of ELXR Molecules In addition to its C-terminal methyltransferase domain, DNMT3A contains two N-terminal domains that regulate its function and recruitment to chromatin: the ADD domain and the PWWP domain. The PWWP domain reportedly interacts with methylated histone tails, including H3K36me3. The ADD domain is known to have two key functions: 1) it allosterically regulates the catalytic activity of DNMT3A by serving as a methyltransferase auto-inhibitory domain, and 2) it recognizes unmethylated H3K4 (H3K4me0). The interaction of the ADD domain with the H3K4me0 mark unveils the catalytic site of DNMT3A, thereby recruiting an active DNMT3A to chromatin to implement de novo methylation at these sites.

Given these functions of the ADD domain, it is possible that including the ADD domain could enhance the activity and specificity of ELXR molecules. Here, experiments were performed to assess whether the incorporation of the ADD domain into the ELXR #5 molecule, described previously in Example 6, would result in improved long-term repression of the target locus and reduced off-target methylation. The effect of incorporating the PWWP domain along with the ADD domain on ELXR activity and specificity was also assessed.

Figure 36:
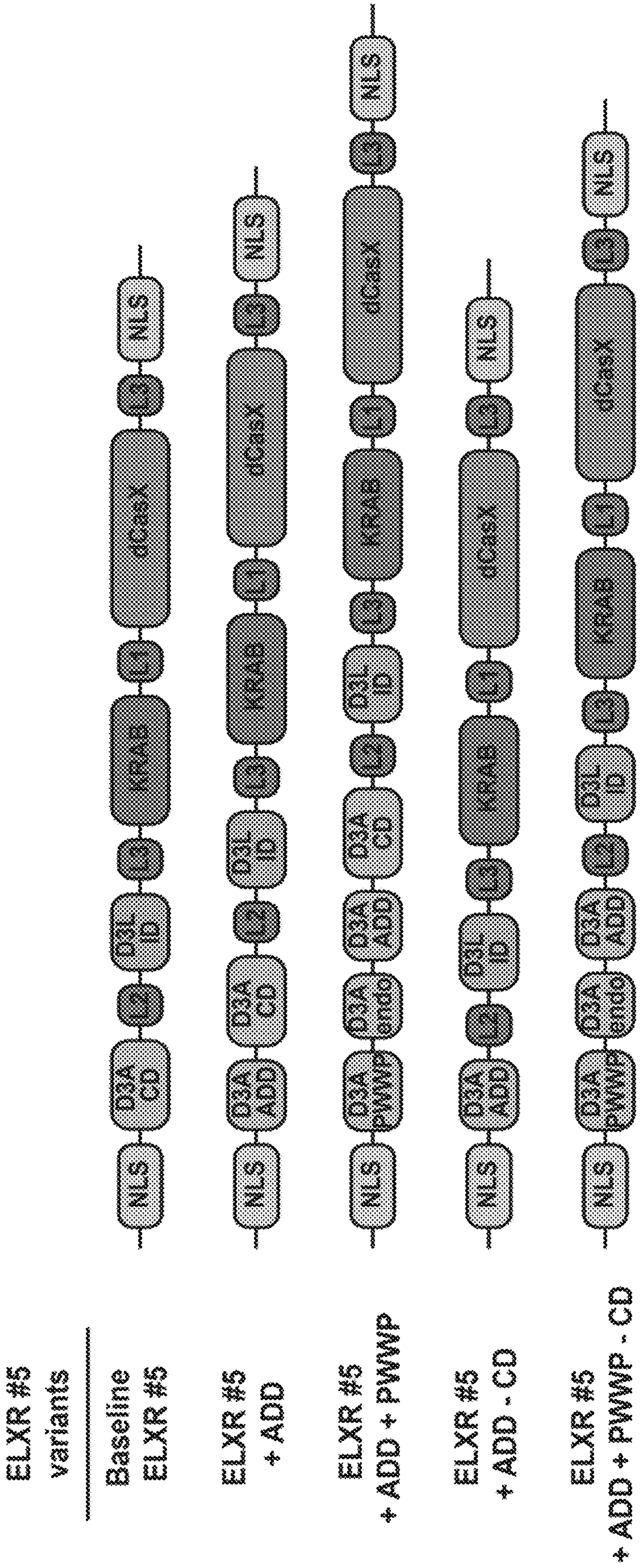
FIG. 36 illustrates the schematics of the various ELXR #5 architectures, where the additional DNMT3A domains were incorporated, as described in Example 11. The additional DNMT3A domains were the ADD domain of DNMT3A ("D3A ADD") and the PWWP domain of DNMT3A ("D3A PWWP"). "D3A endo" encodes for an endogenous sequence that occurs between DNMT3A PWWP and ADD domains. "D3A CD" and "D3L ID" denote the catalytic domain of DNMT3A and the interaction domain of DNMT3L respectively. "L1-L3" are linkers. "NLS" is the nuclear localization signal. See Table 33 for ELXR sequences.

Materials and Methods:

Generation of ELXR Constructs and Plasmid Cloning:

Plasmid constructs encoding for variants of the ELXR #5 construct with the ZIM3-KRAB domain (ELXR #5.A; see FIG. 7 for ELXR #5 configuration) were built using standard molecular cloning techniques. The resulting constructs comprised of sequences encoding for one of the following four alternative variations of ELXR5-ZIM3, where the additional DNMT3A domains were incorporated: 1) ELXR5-ZIM3+ADD; 2) ELXR5-ZIM3+ADD+PWWP; 3) ELXR5-ZIM3+ADD without the DNMT3A catalytic domain; and 4) ELXR5-ZIM3+ADD+PWWP without the DNMT3A catalytic domain. The sequences of key elements within the ELXR5-ZIM3 molecule and its variants are listed in Table 32, with the full encoding sequences for each ELXR5-ZIM3 and its variants listed in Table 33. FIG. 36 is a schematic that illustrates the various ELXR #5 architectures assayed in this example. Sequences encoding the ELXR molecules also contained a 2× FLAG tag. Plasmids also harbored constructs encoding for the gRNA scaffold variant 174 having either a spacer targeting the endogenous B2M locus or a non-targeting control (spacer sequences listed in Table 34).

TABLE 32

Sequences of key ELXR elements (e.g., additional domains fused to dCasX) to generate ELXR5 variant plasmids illustrated in FIG. 36.

| Key component | DNA Sequence (SEQ ID NO) | Protein sequence | SEQ ID NO |
|---|---|---|---|
| ZIM3 KRAB domain | 57612 | MNNSQGRVTFEDVTVNFTQGEWQRLNPEQRNLYRDVMLENYSNLVSVGQ GETTKPDVILRLEQGKEPWLEEEEVLGSGRAEKNGDIGGQIWKPKDVKE SL | 57613 |
| DNMT3A catalytic domain (CD) | 59444 | NHDQEFDPPKVYPPVPAEKRKPIRVLSLFDGIATGLLVLKDLGIQVDRY IASEVCEDSITVGMVRHQGKIMYVGDVRSVTQKHIQEWGPFDLVIGGSP CNDLSIVNPARKGLYEGTGRLFFEFYRLLHDARPKEGDDRPFFWLFENV VAMGVSDKRDISRFLESNPVMIDAKEVSAAHRARYFWGNLPGMNRPLAS TVNDKLELQECLEHGRIAKFSKVRTITTRSNSIKQGKDQHFPVFMNEKE DILWCTEMERVFGFPVHYTDVSNMSRLARQRLLGRSWSVPVIRHLFAPL KEYFACV | 59450 |
| DNMT3L interaction domain | 59445 | MGPMEIYKTVSAWKRQPVRVLSLFRNIDKVLKSLGFLESGSGSGGGTLK YVEDVTNVVRRDVEKWGPFDLVYGSTQPLGSSCDRCPGWYMFQFHRILQ YALPRQESQRPFFWIFMDNLLLTEDDQETTTRFLQTEAVTLQDVRGRDY QNAMRVWSNIPGLKSKHAPLTPKEEEYLQAQVRSRSKLDAPKVDLLVKN CLLPLREYFKYFSQNSLPL | 57617 |
| dCasX491 | 57618 | QEIKRINKIRRRLVKDSNTKKAGKTGPMKTLLVRVMTPDLRERLENLRK KPENIPQPISNTSRANLNKLLTDYTEMKKAILHVYWEEFQKDPVGLMSR VAQPASKKIDQNKLKPEMDEKGNLTTAGFACSQCGQPLFVYKLEQVSEK GKAYTNYFGRCNVAEHEKLILLAQLKPEKDSDEAVTYSLGKFGQRALDF YSIHVTKESTHPVKPLAQIAGNRYASGPVGKALSDACMGTIASFLSKYQ DIIIEHQKVVKGNQKRLESLRELAGKENLEYPSVTLPPQPHTKEGVDAY NEVIARVRMWVNLNLWQKLKLSRDDAKPLLRLKGFPSFPLVERQANEVD WWDMVCNVKKLINEKKEDGKVFWQNLAGYKRQEALRPYLSSEEDRKKGK KFARYQLGDLLLHLEKKHGEDWGKVYDEAWERIDKKVEGLSKHIKLEEE RRSEDAQSKAALTDWLRAKASFVIEGLKEADKDEFCRCELKLQKWYGDL RGKPFAIEAENSILDISGFSKQYNCAFIWQKDGVKKLNLYLIINYFKGG KLRFKKIKPEAFEANRFYTVINKKSGEIVPMEVNENFDDPNLIILPLAF GKRQGREFIWNDLLSLETGSLKLANGRVIEKTLYNRRTRQDEPALFVAL TFERREVLDSSNIKPMNLIGVARGENIPAVIALTDPEGCPLSRFKDSLG NPTHILRIGESYKEKQRTIQAKKEVEQRRAGGYSRKYASKAKNLADDMV RNTARDLLYYAVTQDAMLIFANLSRGFGRQGKRTFMAERQYTRMEDWLT AKLAYEGLSKTYLSKTLAQYTSKTCSNCGFTITSADYDRVLEKLKKTAT GWMTTINGKELKVEGQITYYNRYKRQNVVKDLSVELDRLSEESVNNDIS | 57619 |

TABLE 32-continued

| Sequences of key ELXR elements (e.g., additional domains fused to dCasX) to generate ELXR5 variant plasmids illustrated in FIG. 36. | | | |
|---|---|---|---|
| Key component | DNA Sequence (SEQ ID NO) | Protein sequence | SEQ ID NO |
| | | SWTKGRSGEALSLLKKRFSHRPVQEKFVCLNCGFETHAAEQAALNIARS WLFLRSQEYKKYQTNKTTGNTDKRAFVETWQSFYRKKLKEVWKPAV | |
| Linker 1 | 57620 | GGPSSGAPPPSGGSPAGSPTSTEEGTSESATPESGPGTSTEPSEGSAPG SPAGSPTSTEEGTSTEPSEGSAPGTSTEPSE | 57621 |
| Linker 2 | 57622 | SSGNSNANSRGPSFSSGLVPLSLRGSH | 57623 |
| Linker 3A' | 59446 | GGSGGG | 59451 |
| Linker 3B | 57625 | GGSGGGS | 57626 |
| Linker 4 | 57627 | GSGSGGG | 57628 |
| NLS A | 57629 | PKKKRKV | 57631 |
| NLS B | 57630 | | |
| DNMT3A ADD domain | 59447 | ERLVYEVRQKCRNIEDICISCGSLNVTLEHPLFIGGMCQNCKNCFLECA YQYDDDGYQSYCTICCGGREVLMCGNNNCCRCFCVECVDLLVGPGAAQA AIKEDPWNCYMCGHKGTYGLLRRREDWPSRLQMFFAN | 59452 |
| DNMT3A PWWP domain | 59448 | TKAADDEPEYEDGRGFGIGELVWGKLRGFSWWPGRIVSWWMTGRSRAAE GTRWVMWFGDGKFSVVCVEKLMPLSSFCSAFHQATYNKQPMYRKAIYEV LQVASSRAGKLFPACHDSDESDSGKAVEVQNKQMIEWALGGFQPSGPKG LEPPEEEKNPYKEV | 59453 |
| Endogenous sequence between DNMT3A PWWP and ADD domains (endo) | 59449 | YTDMWVEPEAAAYAPPPPAKKPRKSTTEKPKVKEIIDERTR | 59454 |

TABLE 33

| DNA sequences of constructs encoding ELXR5 variants assayed in this example, and protein sequences of ELXR5 variants. | | |
|---|---|---|
| ELXR ID | DNA Sequence (SEQ ID NO) | Protein SEQ ID NO |
| ELXR5-ZIM3 | 59455 | 59460 |
| ELXR5-ZIM3 + ADD | 59456 | 59461 |
| ELXR5-ZIM3 + ADD + PWWP | 59457 | 59462 |
| ELXR5-ZIM3 + ADD − CD | 59458 | 59463 |
| ELXR5-ZIM3 + ADD + PWWP − CD | 59459 | 59464 |

TABLE 34

| Sequences of spacers used in constructs. | | | |
|---|---|---|---|
| Spacer ID | Target gene | Sequence | SEQ ID NO |
| 0.0 | Non-target | CGAGACGUAAUUACGUCUCG | 57646 |
| 7.37 | B2M | GGCCGAGAUGUCUCGCUCCG | 57644 |
| 7.160 | B2M | UAAACAUCACGAGACUCUAA | 59662 |
| 7.165 | B2M | UCCCUAUGUCCUUGCUGUUU | 59667 |

Transfection of HEK293T Cells:

Seeded HEK293T cells were transiently transfected with 100 ng of ELXR5 variant plasmids, each containing an ELXR:gRNA construct encoding for ELXR5-ZIM3 or one of its alternative variations (FIG. 36; Table 33 for sequences), with the gRNA having either non-targeting spacer 0.0 or a B2M-targeting spacer (Table 34 for spacer sequences). The results in Example 10 identified spacers 7.160 and 7.165 to be ELXR-specific spacers. Each construct was tested in triplicate. 24 hours post-transfection, cells were selected with 1p g/mL puromycin for three days. Cells were harvested for repression analysis at day 5, day 12, day 21, and day 51 post-transfection. Briefly, repression analysis was conducted by analyzing B2M protein expression via HLA immunostaining followed by flow cytometry, as described in Example 6. In addition, HEK293T cells transiently transfected with ELXR5 variant plasmids and a B2M-targeting gRNA or non-targeting gRNA were harvested at seven days post-transfection for gDNA extraction for bisulfite sequencing to assess off-target methylation at the VEGFA locus, which was performed as described in Example 6.

Results

Figure 22:
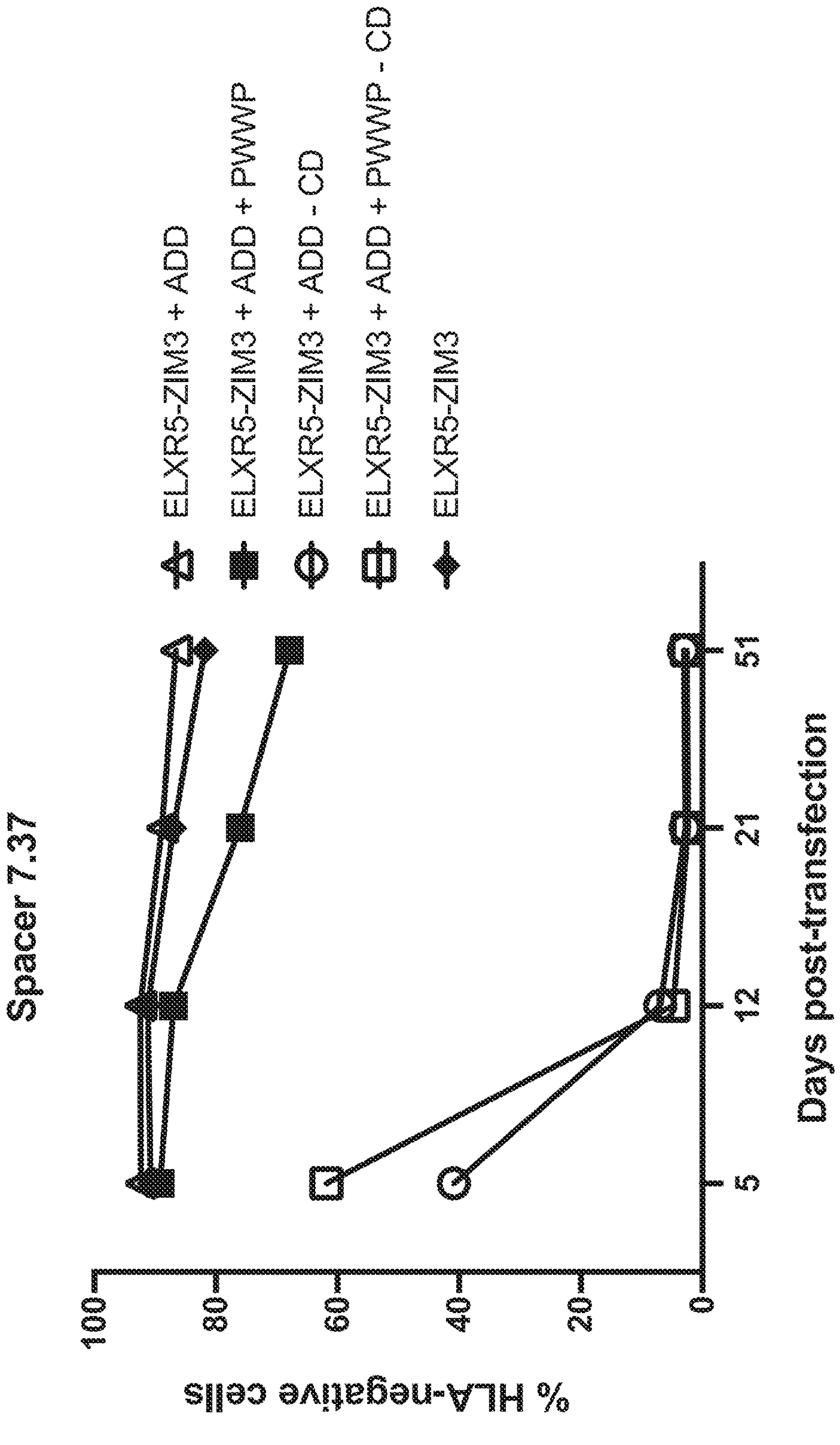
FIG. 22 presents the results of a time-course experiment comparing B2M repression activities (represented as percentage of HLA-negative cells) of the indicated ELXR5-ZIM3 and its variants with B2M-targeting gRNA using spacer 7.37, as described in Example 11. Data are presented as mean with standard deviation, N=3. CD=catalytic domain of DNMT3A.
Figure 23:
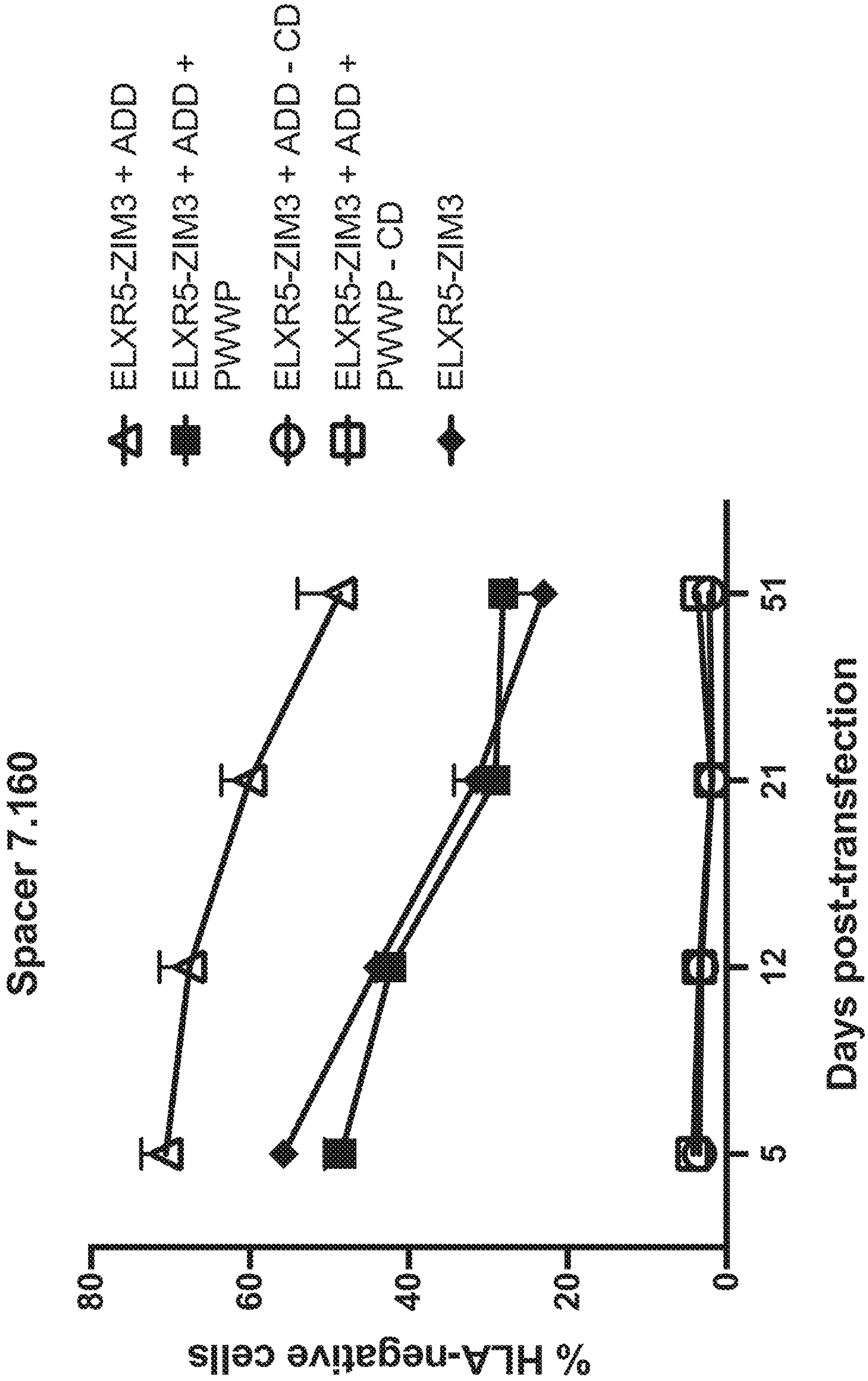
FIG. 23 presents the results of the same time-course experiment shown in FIG. 22 but shows B2M repression activities of the indicated ELXR5-ZIM3 variants with B2M-targeting gRNA using spacer 7.160, as described in Example 11. Data are presented as mean with standard deviation, N=3.
Figure 24:
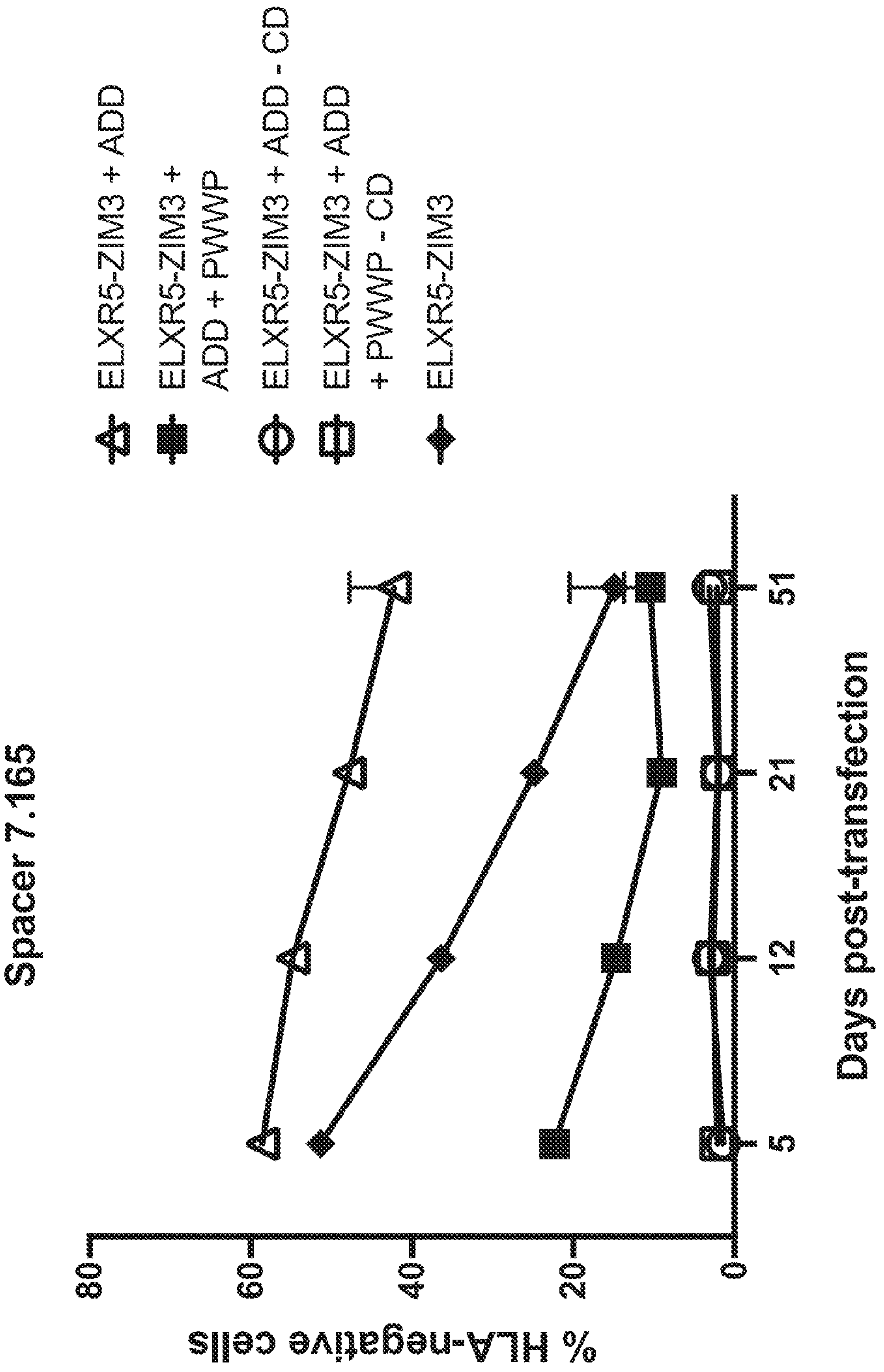
FIG. 24 presents the results of the same time-course experiment shown in FIG. 22 but shows B2M repression activities of the indicated ELXR5-ZIM3 variants with B2M-targeting gRNA using spacer 7.165, as described in Example 11. Data are presented as mean with standard deviation, N=3.
Figure 25:
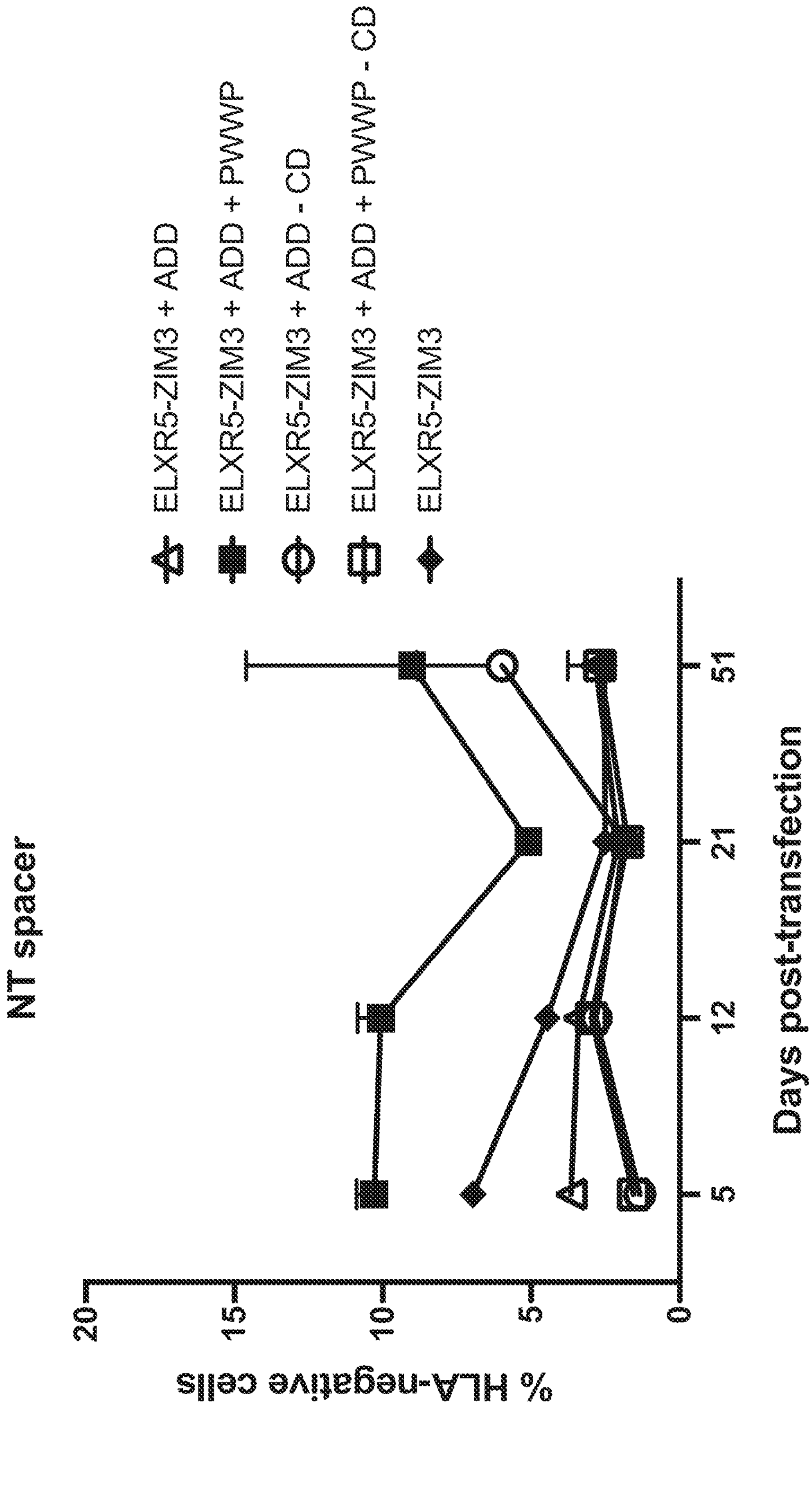
FIG. 25 presents the results of the same time-course experiment shown in FIG. 22 but shows B2M repression activities of the indicated ELXR5-ZIM3 variants with a non-targeting gRNA, as described in Example 11. Data are presented as mean with standard deviation, N=3.

The effects of incorporating the ADD domain with or without the PWWP domain into the ELXR5 molecule on increasing long-term repression of the target B2M locus and reducing off-target methylation were assessed. Variations of the ELXR5-ZIM3 molecule were evaluated with either a B2M-targeting gRNA (with spacer 7.37 and ELXR-specific spacers 7.160 and 7.165) or a non-targeting gRNA, and the results are depicted in the plots in FIGS. 22-25. FIG. 22 shows that use of spacer 7.37 resulted in saturating levels of repression activity when paired with ELXR5-ZIM3, ELXR5-ZIM3+ADD, and ELXR5-ZIM3+ADD+PWWP, rendering it more challenging to assess activity differences among the ELXR5 variants. However, the differences in repression activity among the ELXR5 variants were more pronounced when using spacers 7.160 and 7.165 (FIGS. 23 and 24). The data demonstrate that incorporation of the ADD domain resulted in a significant increase in long-term repression when paired with the two ELXR-specific spacers compared to the repression levels achieved with the other ELXR5-ZIM3 molecules. Meanwhile, incorporation of both ADD and PWWP domains did not result in improved repression of the B2M locus, especially compared to the baseline ELXR5-ZIM3 molecule. As anticipated, the two ELXR5 variants without the DNMT3A catalytic domain exhibited poor long-term repression. Furthermore, FIG. 25 indicates that addition of the ADD domain appeared to result in increased specificity, given the lower percentage of HLA-negative cells observed, relative to the baseline ELXR5-ZIM3 molecule.

Figure 26:
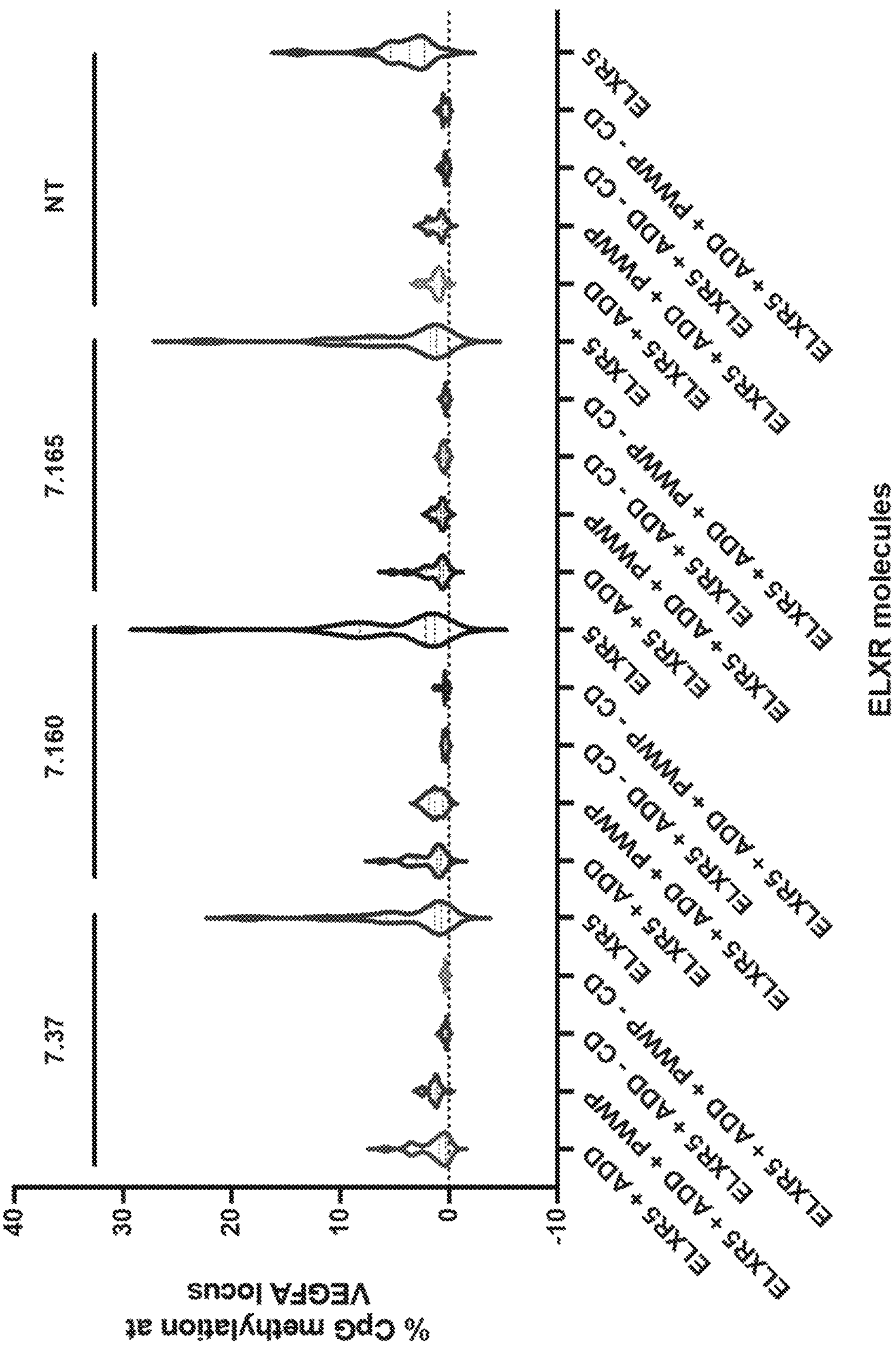
FIG. 26 is a violin plot of percent CpG methylation for CpG sites downstream of the transcription start site of the VEGFA locus for each indicated ELXR5-ZIM3 variant for the three B2M-targeting gRNA and non-targeting gRNA, as described in Example 11.
Figure 27:
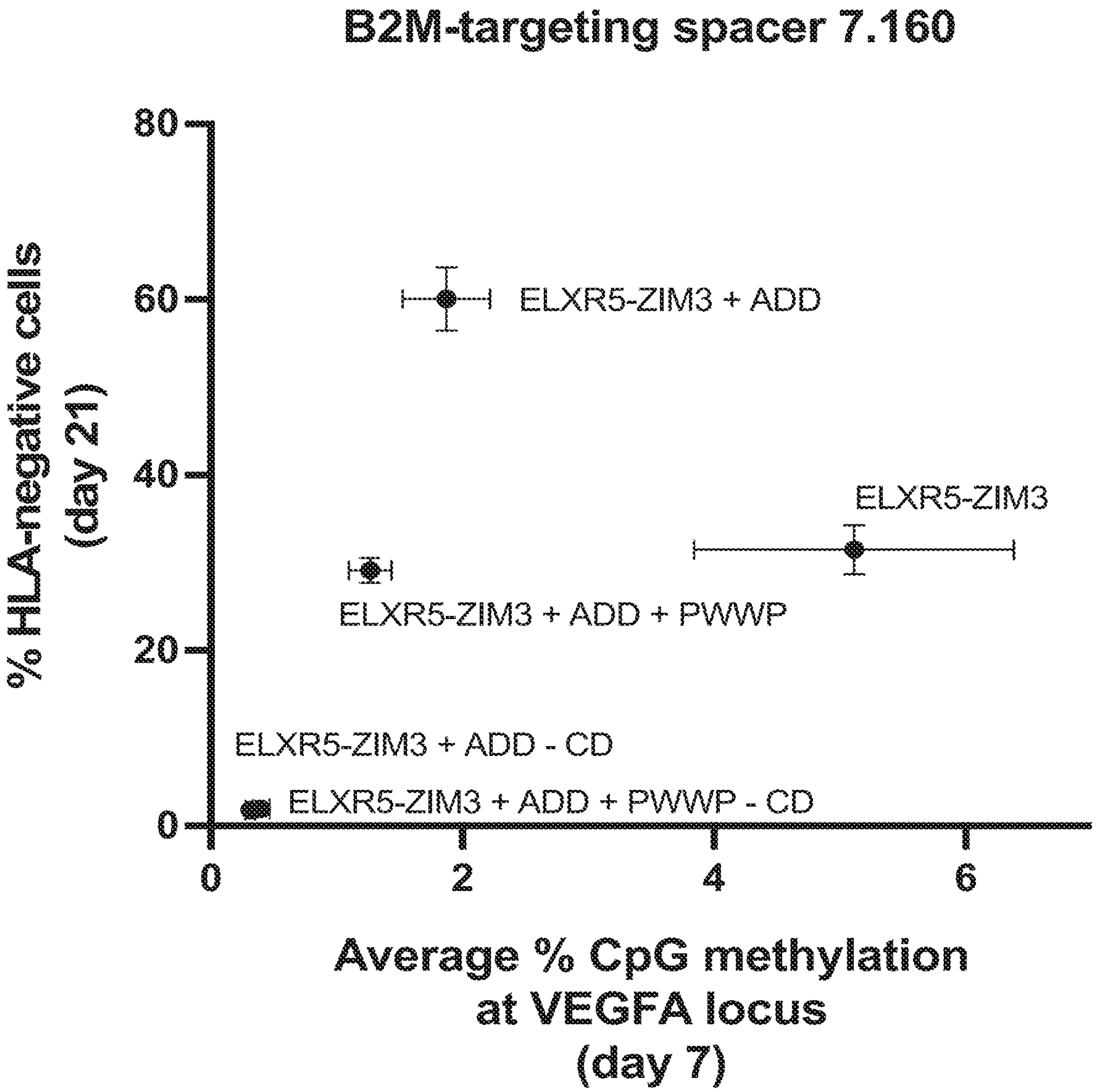
FIG. 27 is a scatterplot showing the relative activity (average percentage of HLA-negative cells at day 21 for spacer 7.160) versus specificity (percentage of off-target CpG methylation at the VEGFA locus quantified at day 7 for spacer 7.160) for the indicated ELXR5-ZIM3 variants, as described in Example 11.

Off-target CpG methylation at the VEGFA locus potentially mediated by the ELXR5 variants was assessed using bisulfite sequencing. FIG. 26 depicts the results from bisulfite sequencing, specifically showing the percentage of CpG methylation around the VEGFA locus. The results demonstrate that for all the B2M-targeting gRNAs, as well as the non-targeting gRNA, incorporation of the ADD domain into the ELXR5-ZIM3 molecule dramatically reduced the level of off-target methylation at the VEGFA locus (FIG. 26). FIG. 27 is a scatterplot mapping the activity-specificity profiles for the ELXR5-ZIM3 variants investigated in this example, where activity was measured as the average percentage of HLA-negative cells at day 21 when paired with spacer 7.160, and specificity was represented by the percentage of off-target CpG methylation at the VEGFA locus quantified at day 7 when paired with spacer 7.160. The scatterplot clearly shows that addition of the ADD domain significantly increases activity of the ELXR5 molecule relative to the baseline ELX5 molecule without the ADD domain (FIG. 27).

The experiments demonstrate that inclusion of the DNMT3A ADD domain, but not inclusion of both the ADD and PWWP domains, improves repression activity and specificity of ELXR molecules. This enhancement of activity and specificity is observed with multiple gRNAs, demonstrating the significance of the incorporation of the ADD domain into ELXRs.

Example 12: Demonstration that Silencing of a Target Locus Mediated by ELXR Molecules is Reversible Using a DNMT1 Inhibitor Experiments were performed to demonstrate that durable repression of a target locus mediated by ELXR molecules is reversible, such that treatment with a DNMT1 inhibitor would remove methyl marks to reactivate expression of the target gene.

Materials and Methods:

ELXR #5 containing the ZIM3-KRAB domain, which was generated as described in Example 6, and CasX variant 491 were used in this experiment. A B2M-targeting gRNA with scaffold 174 containing spacer 7.37 (SEQ ID NO: 57644) or a non-targeting gRNA containing spacer 0.0 (SEQ ID NO: 57646) were used in this experiment.

Transfection of HEK293T Cells:

HEK293T cells were transfected with 100 ng of a plasmid containing a construct encoding for either CasX 491 or ELXR #5 containing the ZIM3-KRAB domain with a B2M-targeting gRNA or non-targeting gRNA and cultured for 58 days. These transfected HEK293T cells were subsequently re-seeded at ~30,000 cells well of a 96-well plate and were treated with 5-aza-2'-deoxycytidine (5-azadC), a DNMT1 inhibitor, at concentrations ranging from 0 μM to 20 μM. Six days post-treatment with 5-azadC, cells were harvested for B2M silencing analysis at day 5, day 12, and day 21 post-transfection. Briefly, repression analysis was conducted by analyzing B2M protein expression via HLA immunostaining followed by flow cytometry, as described in Example 6. Treatments for each dose of 5-azadC for each experimental condition were performed in triplicates.

Results

Figure 34:
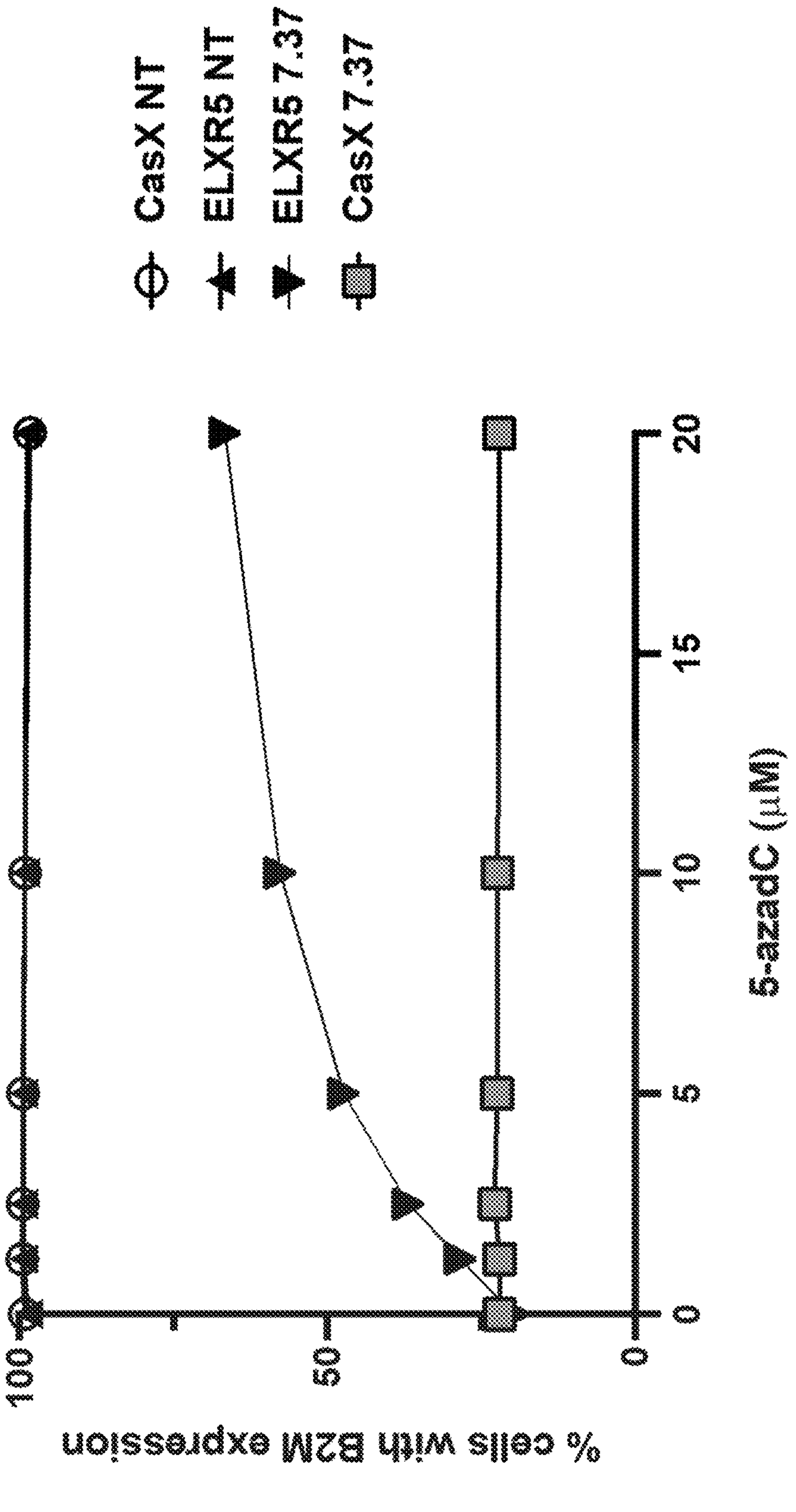
FIG. 34 is a plot illustrating percentage of HEK293T cells, transfected with a plasmid encoding the indicated CasX or ELXR:gRNA construct, that expressed B2M six days post-treatment with the DNMT1 inhibitor 5-azadC at varying concentrations, as described in Example 12.
Figure 35:
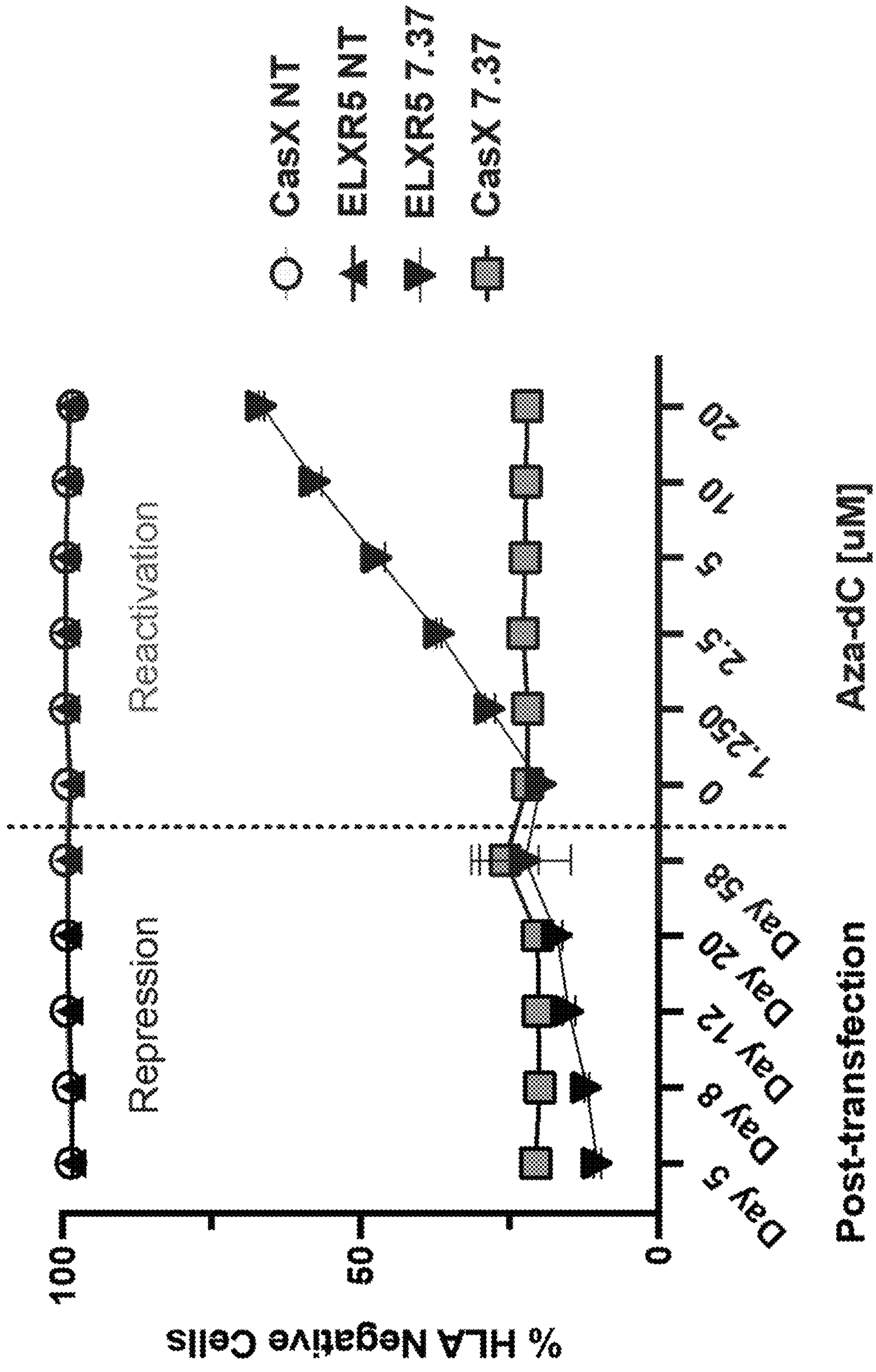
FIG. 35 is a plot that juxtaposes the quantification of B2M repression in HEK293T cells transfected with a plasmid encoding the indicated CasX or ELXR:gRNA construct and cultured for 58 days, with the quantification of B2M reactivation upon treatment of transfected cells with 5-azadC, as described in Example 12.

The plot in FIG. 34 shows the percentage of transfected HEK293T cells treated with the indicated concentrations of 5-azadC that expressed the B2M protein. The data demonstrate that 5-azadC treatment of cells transfected with a plasmid encoding ELXR5-ZIM3 with the B2M-targeting gRNA resulted in a reactivation of the B2M gene (FIG. 34). Specifically, ~75% of treated cells exhibited B2M expression with 20 μM 5-azadC, compared to the 25% of cells with B2M expression at 0 μM concentration (FIG. 34). Furthermore, 5-azadC treatment of cells transfected with a plasmid encoding CasX 491 with the B2M-targeting gRNA did not exhibit reactivation of the B2M gene. FIG. 35 is a plot that juxtaposes B2M repression activity with gene reactivation upon 5-azadC treatment. The data show B2M repression post-transfection with either CasX 491 or ELXR5-ZIM3 with the B2M-targeting gRNA, resulting in ~75% repression of B2M expression by day 58; however, B2M expression is increased upon 5-azadC treatment (FIG. 35). As anticipated, 5-azadC treatment of cells transfected with either CasX 491 or ELXR5-ZIM3 with the non-targeting gRNA did not demonstrate repression or reactivation (FIGS. 34-35).

The experiments demonstrate reversibility of ELXR-mediated repression of a target locus. By using a DNMT1 inhibitor to remove methyl marks implemented by ELXR molecules, the silenced target gene was reactivated to induce expression of the target protein.

Example 13: Demonstration that Inclusion of the ADD Domain from DNMT3A into ELXRs Enhances On-Target Activity and Decreases Off-Target Methylation Experiments were performed to assess the effects of incorporating the ADD domain into ELXR molecules having configurations #1, #4, and #5, described previously in Example 6, on long-term repression of the target locus and off-target methylation.

Figure 37:
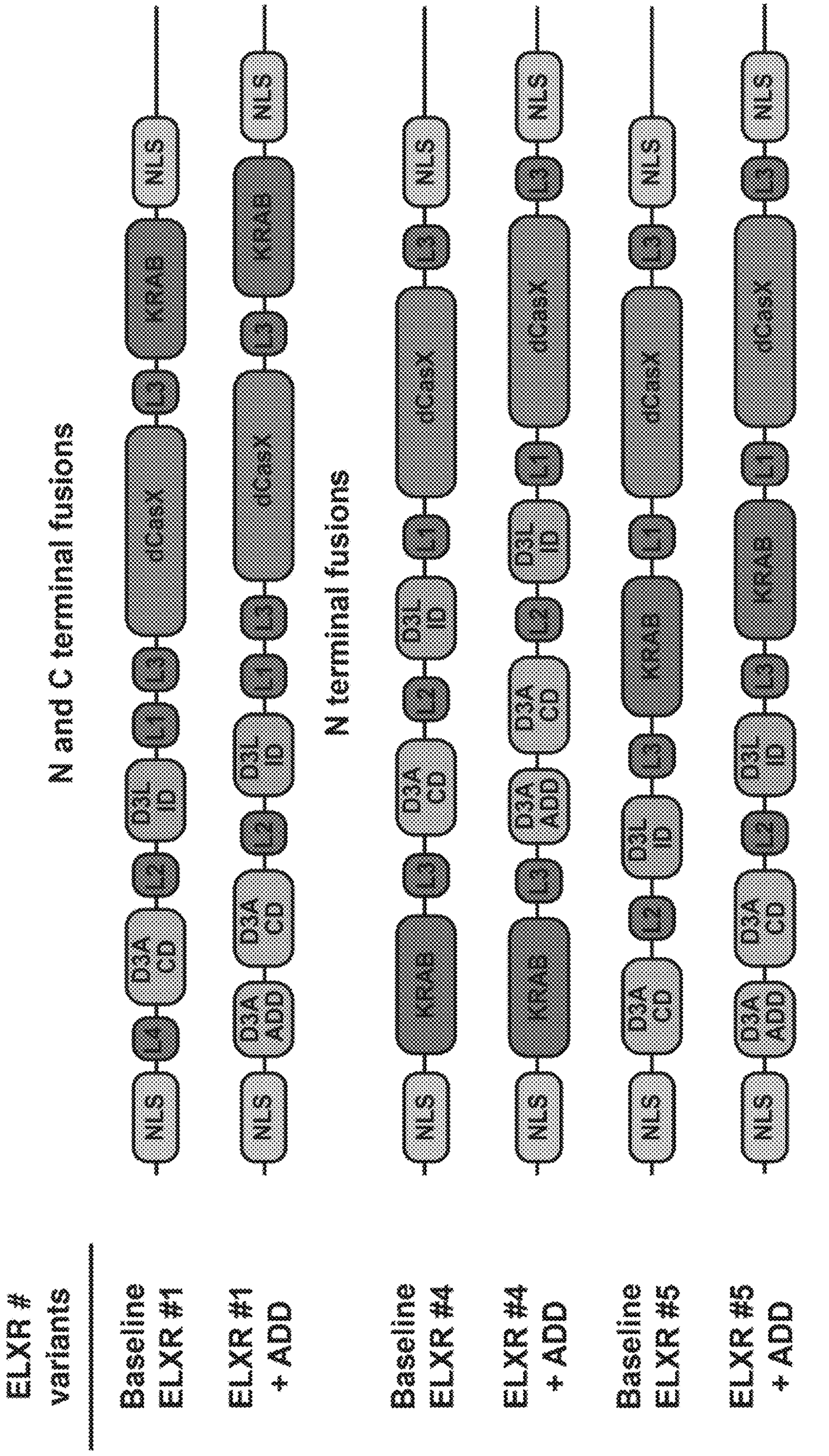
FIG. 37 illustrates the schematics of the general architectures of the ELXR molecules with the ADD domain for ELXR configuration #1, #4, and #5 tested in Example 13. "D3A ADD", "D3A CD" and "D3L ID" denote the ADD domain of DNMT3A, the catalytic domain of DNMT3A, and the interaction domain of DNMT3L respectively, as described in Example 13. "L1-L4" are linkers. "NLS" is the nuclear localization signal. See Table 35 for ELXR sequences.

Materials and Methods:

Generation of ELXR Constructs and Plasmid Cloning:

Plasmid constructs encoding for ELXR molecules having configurations #1, #4, and #5 with the ZNF10-KRAB or ZIM3-KRAB domain and the DNMT3A ADD domain were built using standard molecular cloning techniques. Sequences of the resulting ELXR molecules are listed in Table 35, which also shows the abbreviated construct names for a particular ELXR molecule (e.g., ELXR #1.A, #1.B). FIG. 37 is a schematic that illustrates the general architectures of ELXR molecules with the ADD domain incorporated for ELXR configuration #1, #4, and #5. Sequences encoding the ELXR molecules also contained a 2× FLAG tag. Plasmids also harbored sequences encoding gRNA scaffold 174 having either a spacer targeting the endogenous B2M locus or a non-targeting control (spacer sequences listed in Table 34).

Transfection of HEK293T Cells:

Seeded HEK293T cells were transiently transfected with 100 ng of ELXR variant plasmids, each containing an ELXR:gRNA construct encoding for an ELXR molecule (Table 35; FIG. 37), with the gRNA having either non-targeting spacer 0.0 or a B2M-targeting spacer (Table 34). Each construct was tested in triplicate. 24 hours post-transfection, cells were selected with 1 μg/mL puromycin for 3 days. Cells were harvested for repression analysis at day 8, day 13, day 20, and day 27 post-transfection. Briefly, repression analysis was conducted by analyzing B2M protein expression via HLA immunostaining followed by flow cytometry, as described in Example 6. In addition, cells were also harvested on day 5 post-transfection for gDNA extraction for bisulfite sequencing to assess off-target methylation at the non-targeted VEGFA locus, which was performed using similar methods as described in Example 6.

Results

The effects of incorporating the ADD domain into the ELXR molecules having configurations #1, #4, or #5, with either a ZNF10 or ZIM-KRAB, on long-term repression of the B2M locus and off-target methylation were evaluated. ELXR molecules were tested with either a B2M-targeting gRNA or a non-targeting gRNA, and the results are depicted in the plots in FIGS. 39A-42B. The data demonstrate that incorporation of the ADD domain into the ELXR molecules

TABLE 35

DNA and protein sequences of the various ELXR #1, #4, and #5 variants assayed in this example.

Figure 39A:
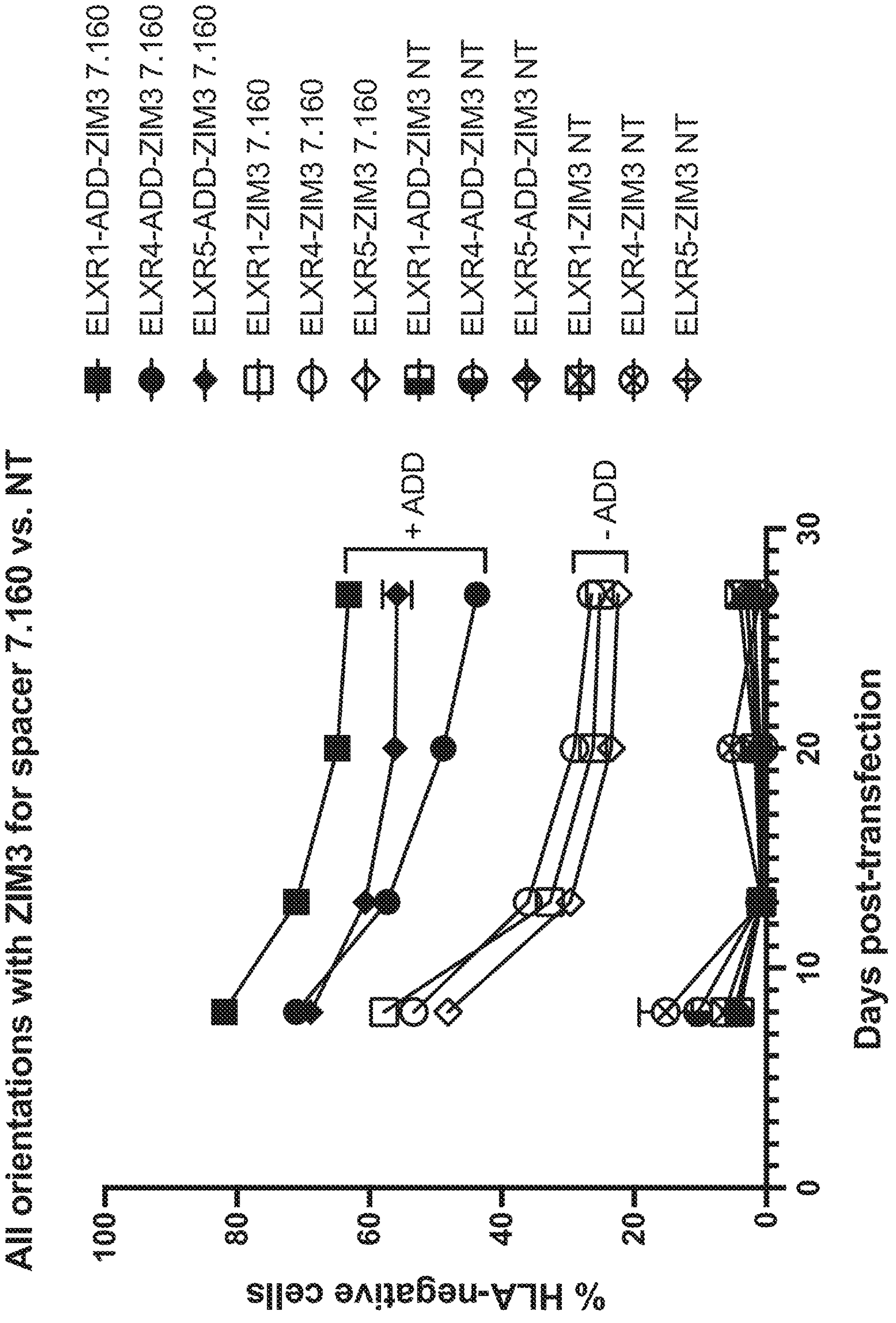
FIG. 39A presents the results of a time-course experiment comparing B2M repression activities (represented as percentage of HLA-negative cells) of ELXRs with the ZIM3-KRAB domain having configuration #1, #4, or #5 with or without the DNMT3A ADD domain when paired with the B2M-targeting gRNA with spacer 7.160, as described in Example 13. Data are presented as mean with standard deviation, N=3. "NT" is a gRNA with a non-targeting spacer.
Figure 39B:
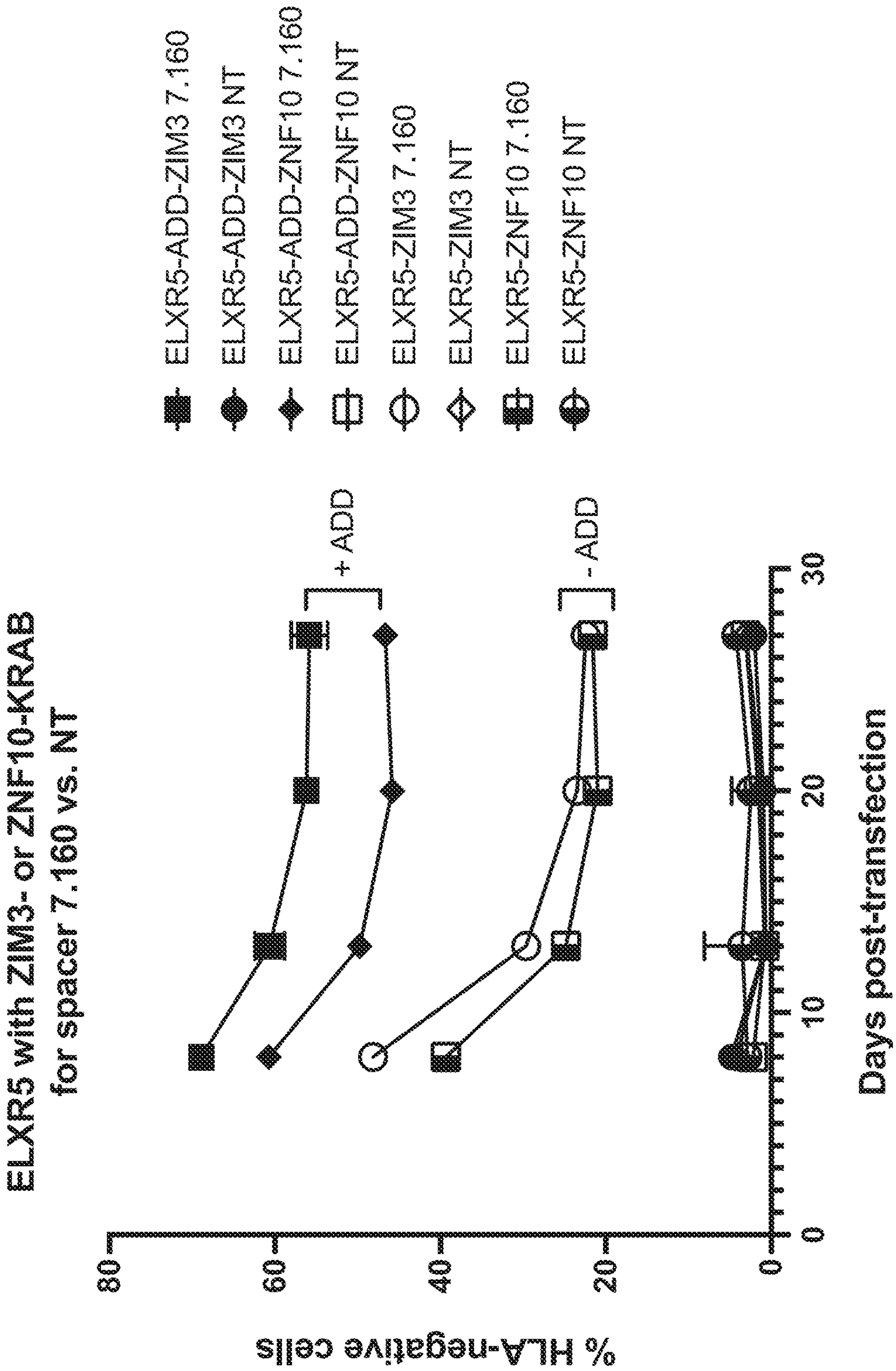
FIG. 39B is a plot showing the results of the same time-course experiment shown in FIG. 39A but illustrates B2M repression activities for ELXR #5 with the ZNF10 or ZIM3-KRAB domain, with or without the DNMT3A ADD domain, paired with the B2M-targeting gRNA with spacer 7.160, as described in Example 13. Data are presented as mean with standard deviation, N=3. "NT" is a gRNA with a non-targeting spacer.
Figure 39C:
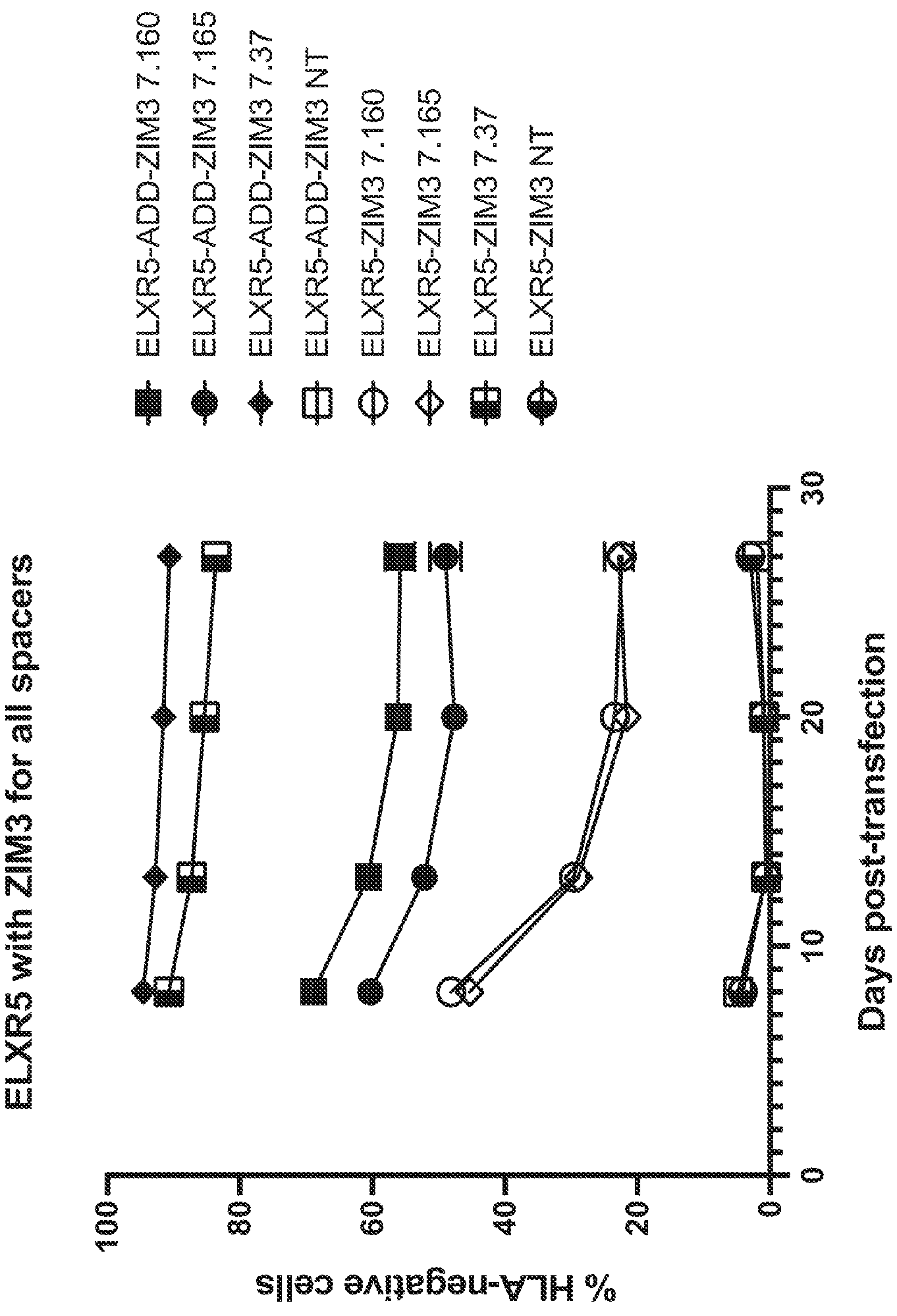
FIG. 39C is a plot showing the results of the same time-course experiment shown in FIG. 39A but illustrates B2M repression activities for ELXR5-ZIM3 with or without the DNMT3A ADD domain paired with a B2M-targeting gRNA with the indicated spacers, as described in Example 13. Data are presented as mean with standard deviation, N=3. "NT" is a gRNA with a non-targeting spacer.

| ELXR # | Domains | DNA SEQ ID NO | Protein SEQ ID NO |
|---|---|---|---|
| ELXR #1 | ZNF10-KRAB, DNMT3A ADD, DNMT3A CD, DNMT3L Interaction (ELXR #1.D) | 59488 | 59498 |
| | ZIM3-KRAB, DNMT3A ADD, DNMT3A CD, DNMT3L Interaction (ELXR #1.C) | 59489 | 59499 |
| | ZNF10-KRAB, DNMT3A CD, DNMT3L Interaction (ELXR #1.B) | 59490 | 59500 |
| | ZIM3-KRAB, DNMT3A CD, DNMT3L Interaction (ELXR #1.A) | 59491 | 59501 |
| ELXR #4 | ZNF10-KRAB, DNMT3A ADD, DNMT3A CD, DNMT3L Interaction (ELXR #4.D) | 59492 | 59502 |
| | ZIM3-KRAB, DNMT3A ADD, DNMT3A CD, DNMT3L Interaction (ELXR #4.C) | 59493 | 59503 |
| | ZNF10-KRAB, DNMT3A CD, DNMT3L Interaction (ELXR #4.B) | 59494 | 59504 |
| | ZIM3-KRAB, DNMT3A CD, DNMT3L Interaction (ELXR #4.A) | 59495 | 59507 |
| ELXR #5 | ZNF10-KRAB, DNMT3A ADD, DNMT3A CD, DNMT3L Interaction (ELXR #5.D) | 59496 | 59505 |
| | ZIM3-KRAB, DNMT3A ADD, DNMT3A CD, DNMT3L Interaction (ELXR #5.C) | 59456 | 59461 |
| | ZNF10-KRAB, DNMT3A CD, DNMT3L Interaction (ELXR #5.B) | 59497 | 59509 |
| | ZIM3-KRAB, DNMT3A CD, DNMT3L Interaction (ELXR #5.A) | 59455 | 59460 |

clearly resulted in a substantial increase in B2M repression across all the time points for all ELXR orientations containing the ZIM3-KRAB when using spacer 7.160 (FIG. 39A), and similar findings were observed when using spacers 7.165 and 7.37 (data not shown). FIG. 39B shows the resulting B2M repression upon use of ELXR #5 containing either the ZNF10 or ZIM3-KRAB when paired with a gRNA with spacer 7.160; the data demonstrate that including the ADD domain increased durable B2M repression overall, with ELXR5-ZIM3+ADD having a higher activity compared with that of ELXR5-ZNF10+ADD. Similar time course findings were observed for ELXR #1 and ELXR #4 and the other two spacers (data not shown). FIG. 39C shows the resulting B2M repression upon use of ELXR #5 containing the ZIM3-KRAB when paired with any of the three B2M-targeting gRNAs, and the data demonstrate that inclusion of the ADD domain resulted in higher B2M repression overall. Similar time course findings were also observed for ELXR #1 and ELXR #4 (data not shown).

Figure 40A:
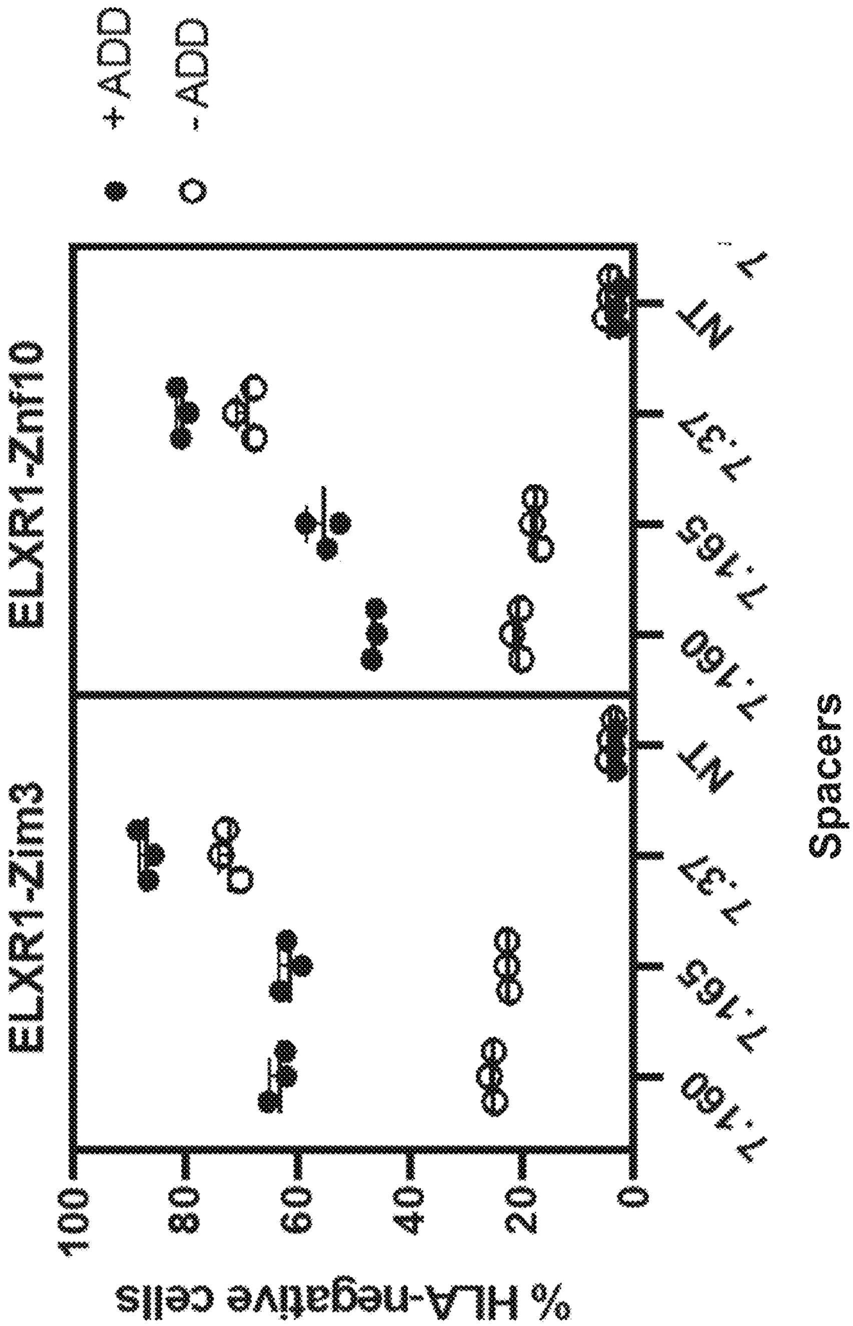
FIG. 40A is a plot illustrating the results of B2M repression activities on day 27 post-transfection for ELXRs with either the ZNF10 or ZIM3-KRAB domain having configuration #1 with or without the DNMT3A ADD domain for the indicated gRNAs, as described in Example 13. Data are presented as mean with standard deviation, N=3. "NT" is a gRNA with a non-targeting spacer.
Figure 40B:
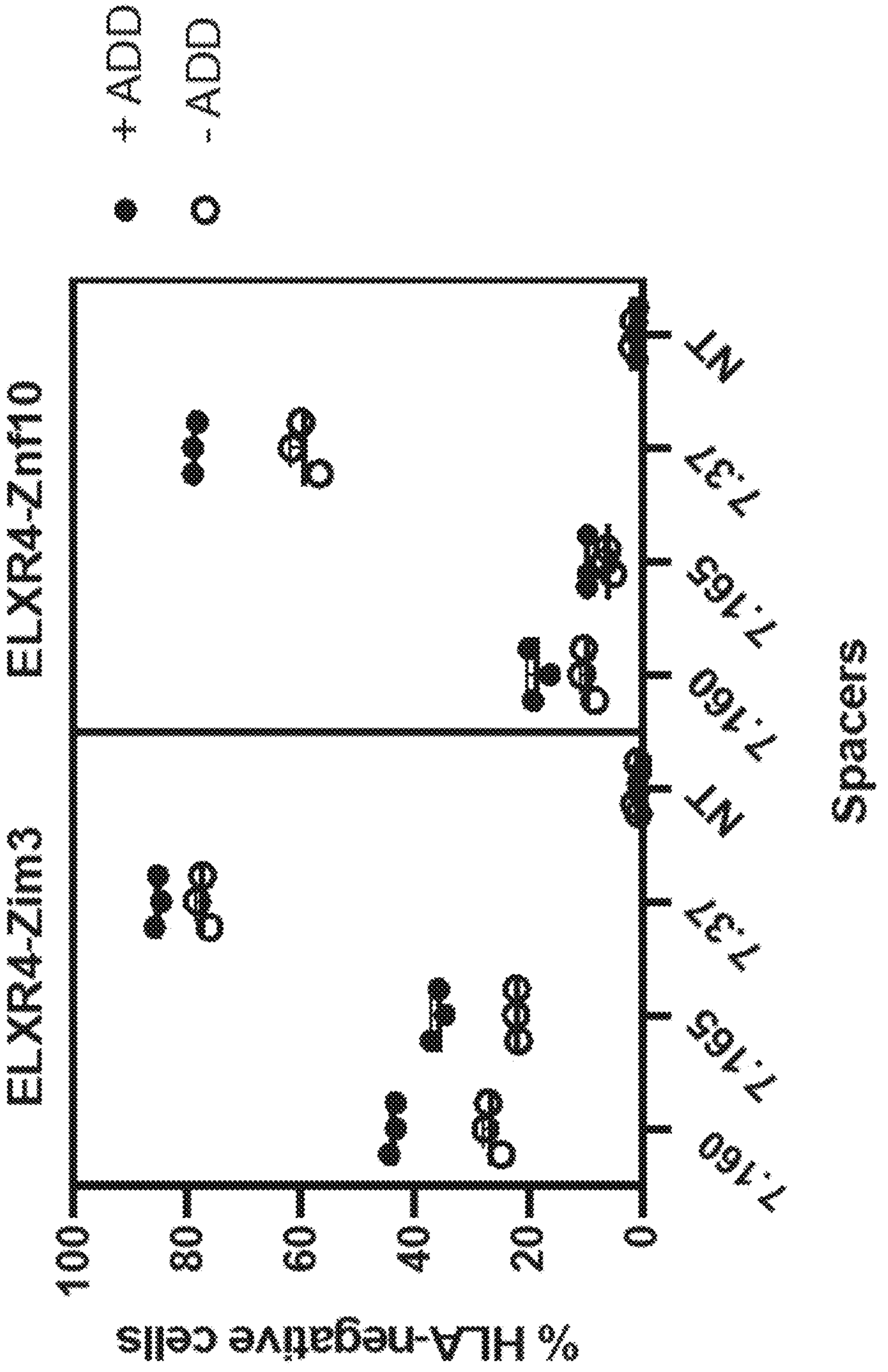
FIG. 40B is a plot illustrating the results of B2M repression activities on day 27 post-transfection for ELXRs with either the ZNF10 or ZIM3-KRAB domain having configuration #4 with or without the DNMT3A ADD domain for the indicated gRNAs, as described in Example 13. Data are presented as mean with standard deviation, N=3. "NT" is a gRNA with a non-targeting spacer.
Figure 40C:
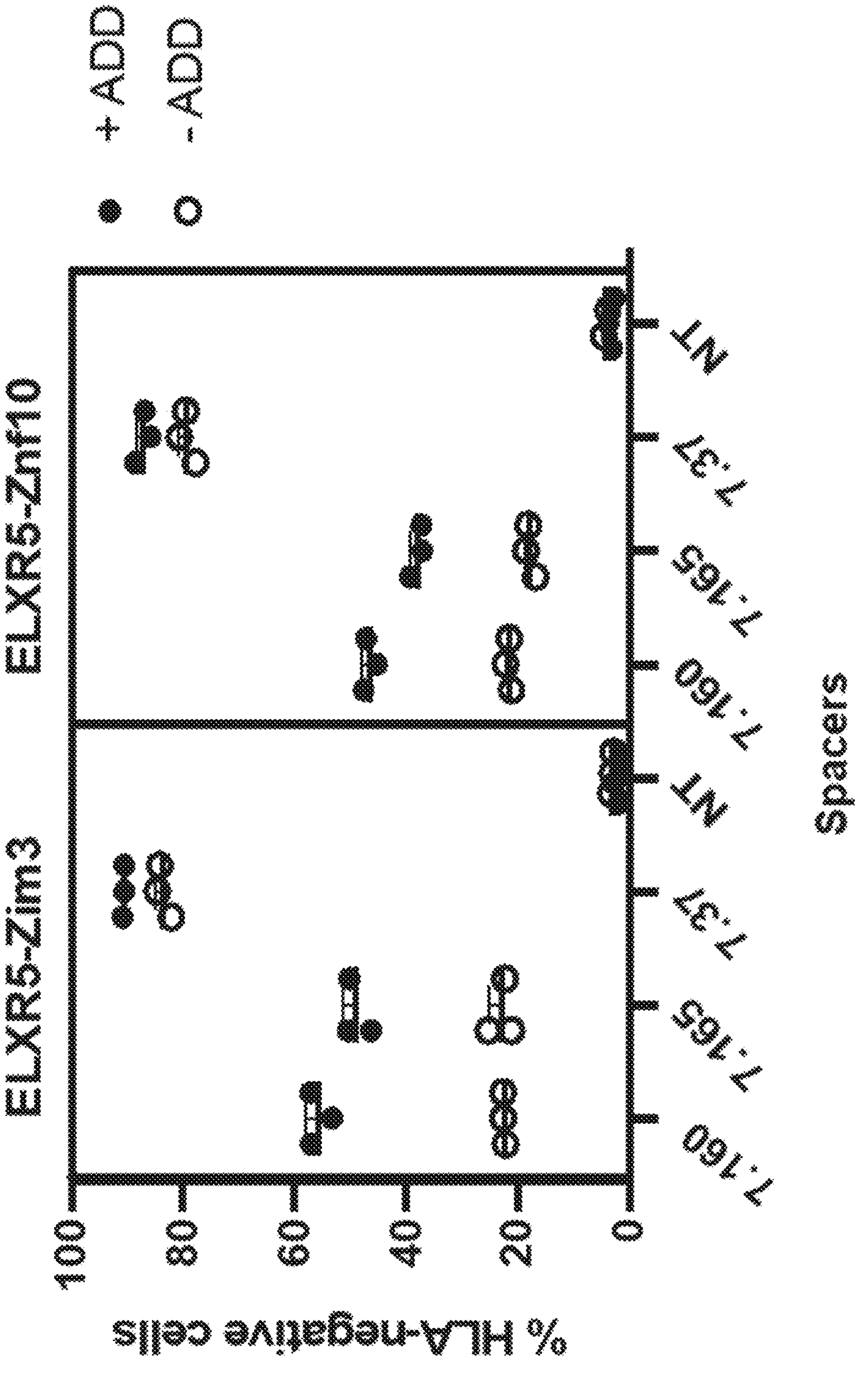
FIG. 40C is a plot illustrating the results of B2M repression activities on day 27 post-transfection for ELXRs with either the ZNF10 or ZIM3-KRAB domain having configuration #5 with or without the DNMT3A ADD domain for the indicated gRNAs, as described in Example 13. Data are presented as mean with standard deviation, N=3. "NT" is a gRNA with a non-targeting spacer.

FIGS. 40A-40C shows the resulting B2M repression at the day 27 time point for all the ELXR configurations and gRNAs tested. The results show that the increase in B2M repression activity is more prominent with use of the sub-optimal spacers 7.160 and 7.165 compared to use of spacer 7.37. Furthermore, use of ELXR #1 and ELXR #5, which contained the DNMT3A and DNMT3L domains on the N-terminus of the molecule, resulted in the highest increase in B2M repression upon addition of the DNMT3A ADD domain (FIGS. 40A-40C). Use of ELXR #4, which harbored the DNMT3A/3L domains 3' to the KRAB domain and 5' to the dCasX, resulted in lower activity gains, which may be attributable to a decreased ability of the ADD domain to interact with chromatin properly.

Figure 41A:
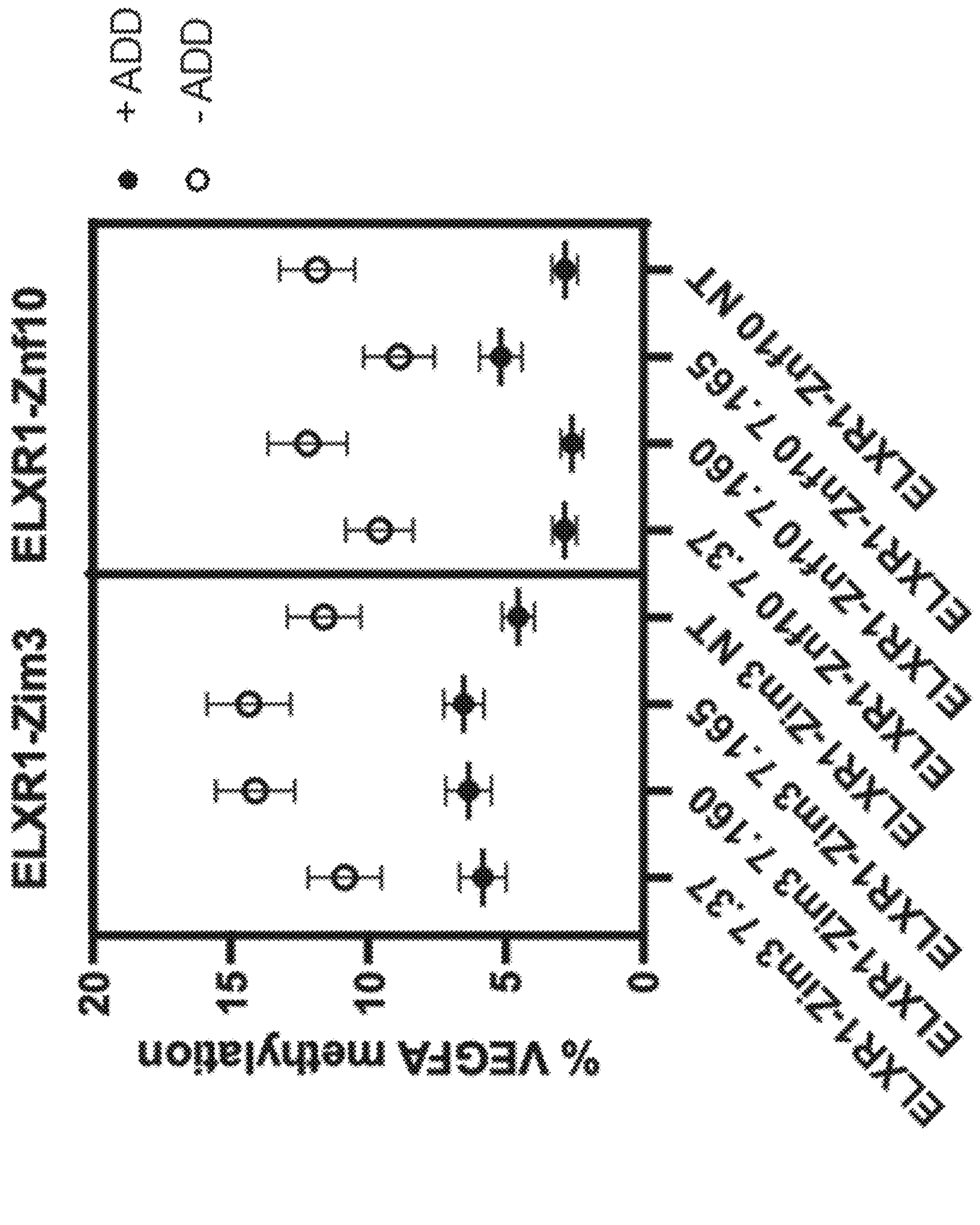
FIG. 41A is a plot illustrating the results of bisulfite sequencing used to determine off-target methylation at the VEGFA locus on day 5 post-transfection for ELXRs with either the ZNF10 or ZIM3-KRAB domain having configuration #1 with or without the DNMT3A ADD domain for the indicated gRNAs, as described in Example 13. Data are presented as mean percentage of CpG methylation for CpG sites near the VEGFA locus; standard error of the mean is also presented; N=3. "NT" is a gRNA with a non-targeting spacer.
Figure 41B:
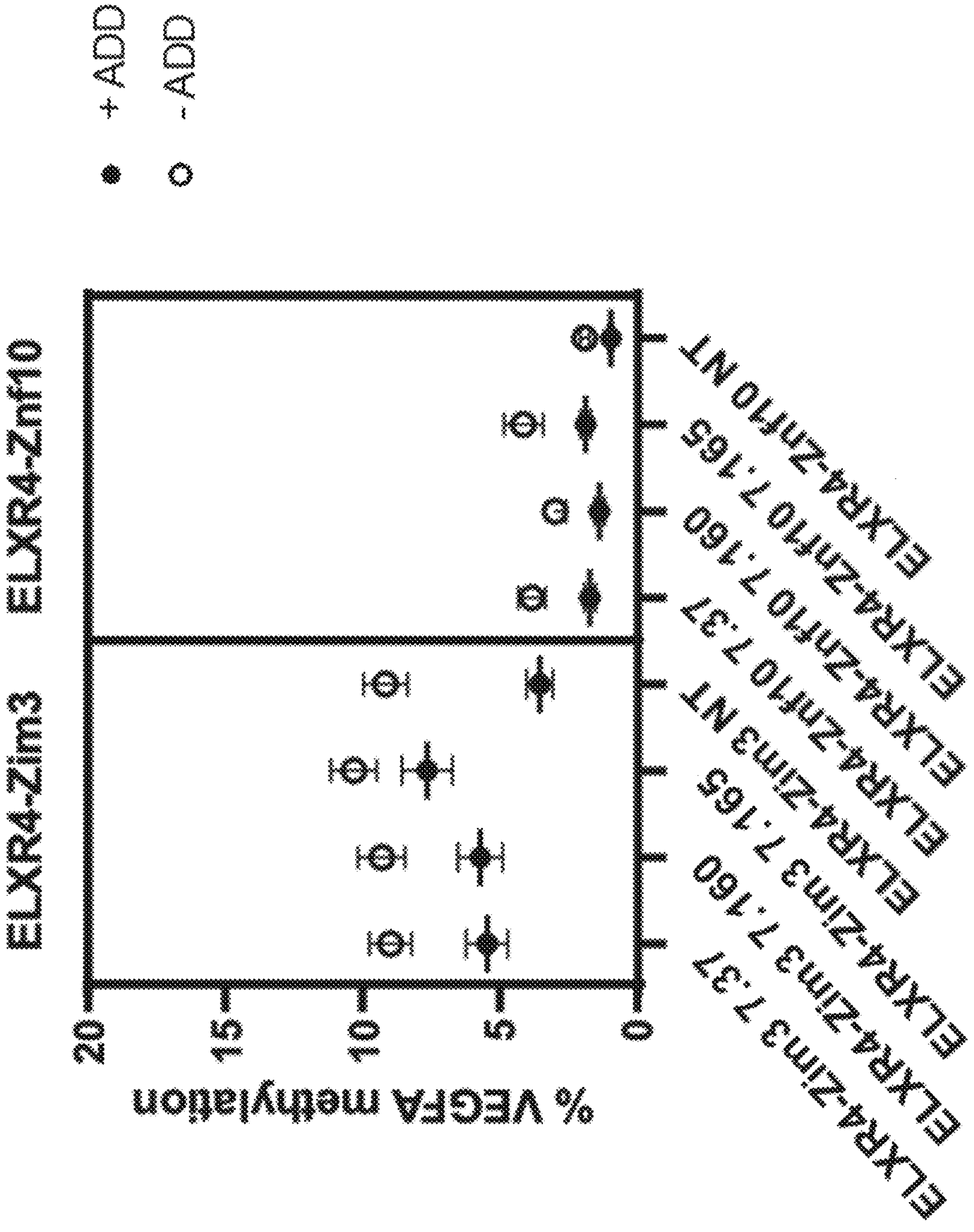
FIG. 41B is a plot illustrating the results of bisulfite sequencing used to determine off-target methylation at the VEGFA locus on day 5 post-transfection for ELXRs with either the ZNF10 or ZIM3-KRAB domain having configuration #4 with or without the DNMT3A ADD domain for the indicated gRNAs, as described in Example 13. Data are presented as mean percentage of CpG methylation for CpG sites near the VEGFA locus; standard error of the mean is also presented; N=3. "NT" is a gRNA with a non-targeting spacer.
Figure 41C:
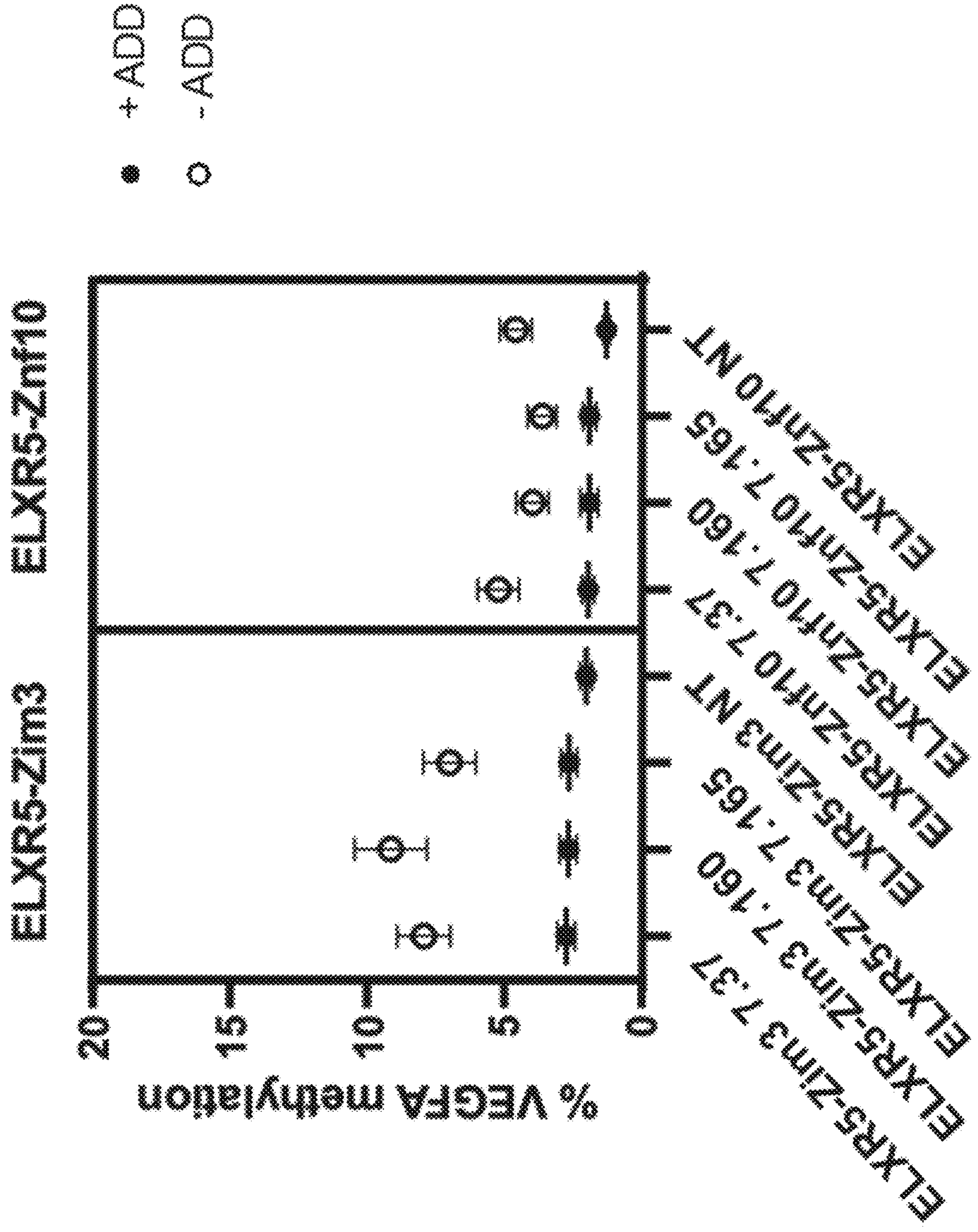
FIG. 41C is a plot illustrating the results of bisulfite sequencing used to determine off-target methylation at the VEGFA locus on day 5 post-transfection for ELXRs with either the ZNF10 or ZIM3-KRAB domain having configuration #5 with or without the DNMT3A ADD domain for the indicated gRNAs, as described in Example 13. Data are presented as mean percentage of CpG methylation for CpG sites near the VEGFA locus; standard error of the mean is also presented; N=3. "NT" is a gRNA with a non-targeting spacer.
Figure 42A:
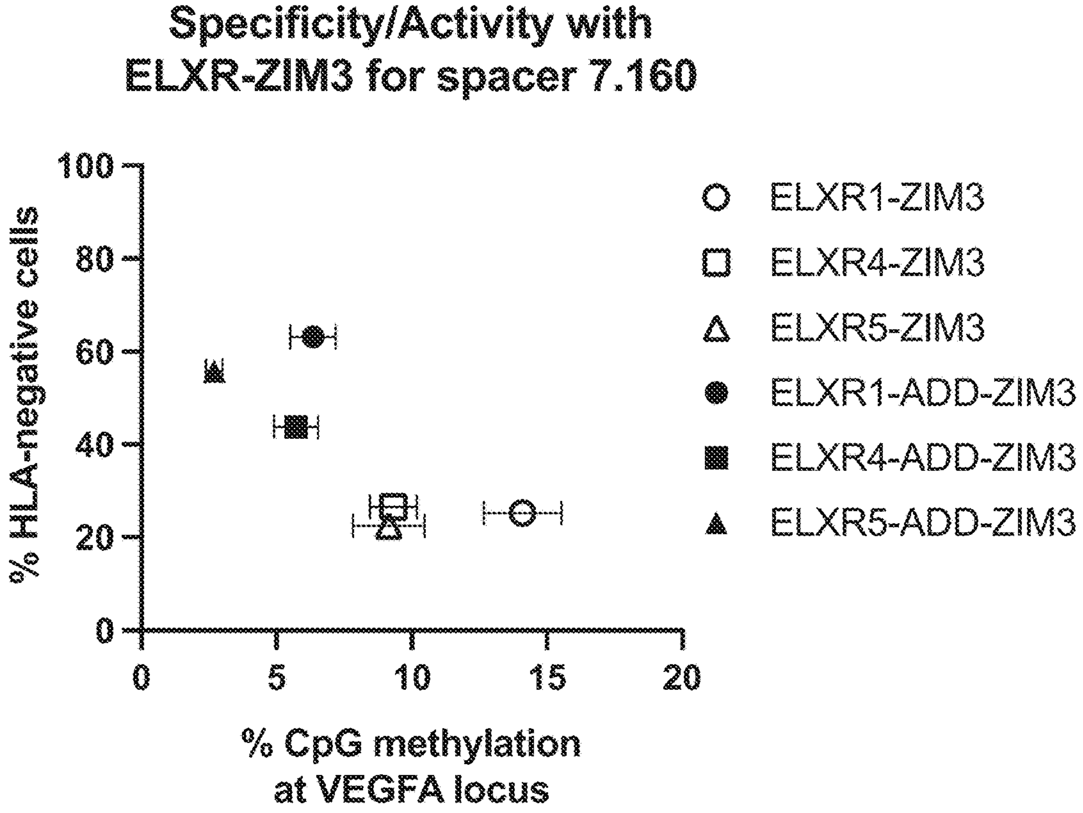
FIG. 42A is a dot plot showing the relative activity (average percentage of HLA-negative cells at day 27) versus specificity (percentage of off-target CpG methylation at the VEGFA locus quantified at day 5) for the ELXR molecules with the ZIM3-KRAB domain having configurations #1, #4, and #5, for B2M-targeting gRNA with spacer 7.160, as described in Example 13.
Figure 42B:
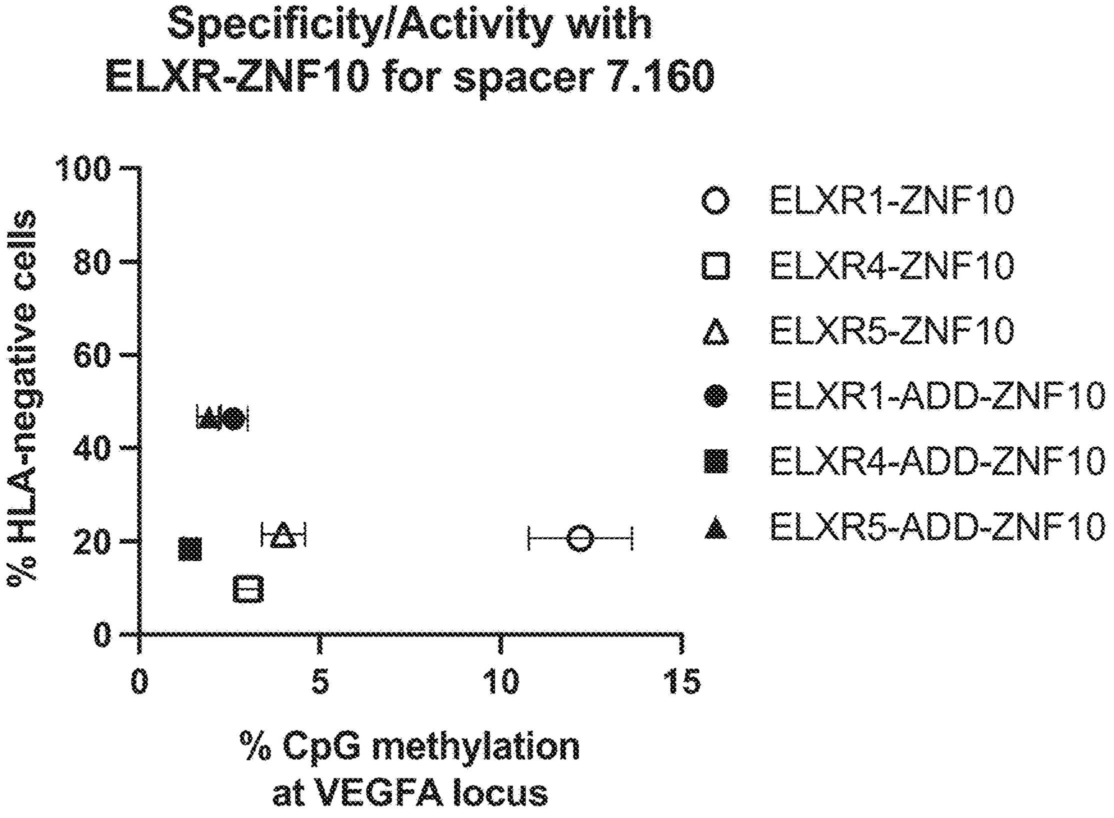
FIG. 42B is a dot plot showing the relative activity (average percentage of HLA-negative cells at day 27) versus specificity (percentage of off-target CpG methylation at the VEGFA locus quantified at day 5) for the ELXR molecules with the ZNF10-KRAB domain having configurations #1, #4, and #5, for B2M-targeting gRNA with spacer 7.160, as described in Example 13.
Figure 43A:
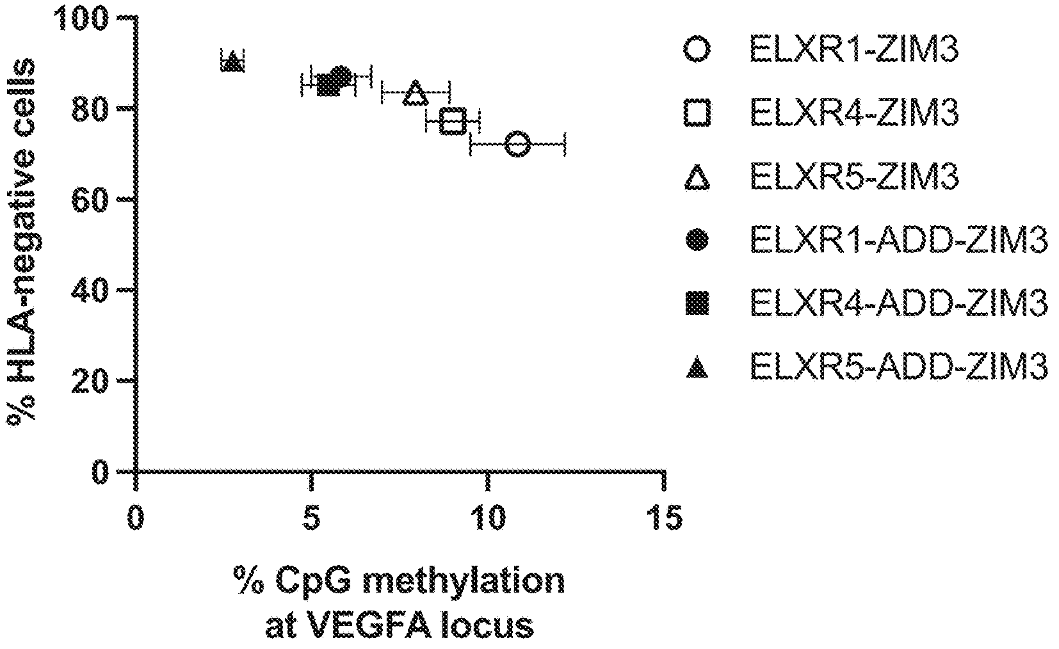
FIG. 43A is a dot plot showing the relative activity (average percentage of HLA-negative cells at day 27) versus specificity (percentage of off-target CpG methylation at the VEGFA locus quantified at day 5) for the ELXR molecules with the ZIM3-KRAB domain having configurations #1, #4, and #5, for B2M-targeting gRNA with spacer 7.37, as described in Example 13.
Figure 43B:
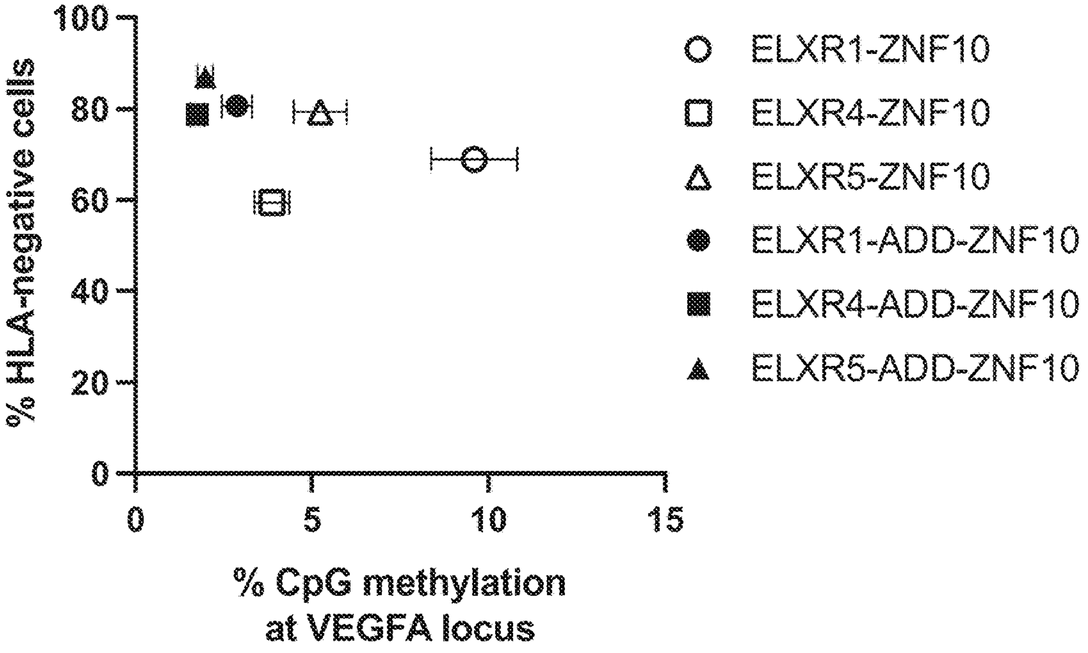
FIG. 43B is a dot plot showing the relative activity (average percentage of HLA-negative cells at day 27) versus specificity (percentage of off-target CpG methylation at the VEGFA locus quantified at day 5) for the ELXR molecules with the ZNF10-KRAB domain having configurations #1, #4, and #5, for B2M-targeting gRNA with spacer 7.37, as described in Example 13.
Figure 44A:
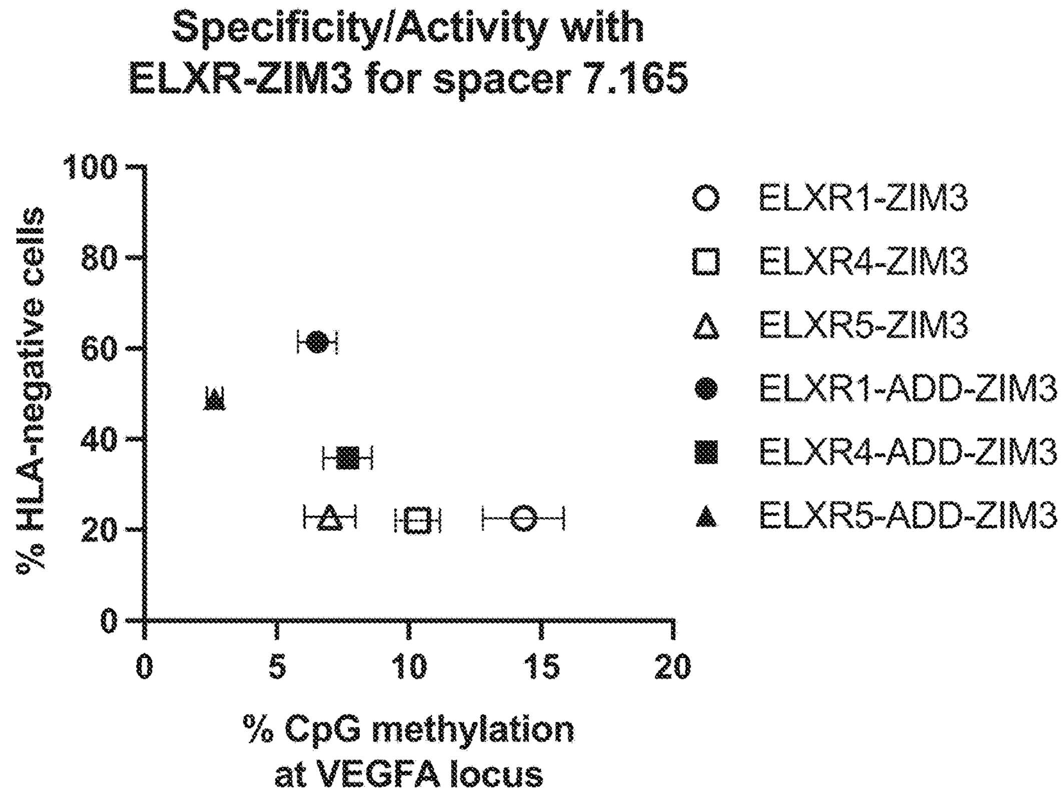
FIG. 44A is a dot plot showing the relative activity (average percentage of HLA-negative cells at day 27) versus specificity (percentage of off-target CpG methylation at the VEGFA locus quantified at day 5) for the ELXR molecules with the ZIM3-KRAB domain having configurations #1, #4, and #5, for B2M-targeting gRNA with spacer 7.165, as described in Example 13.
Figure 44B:
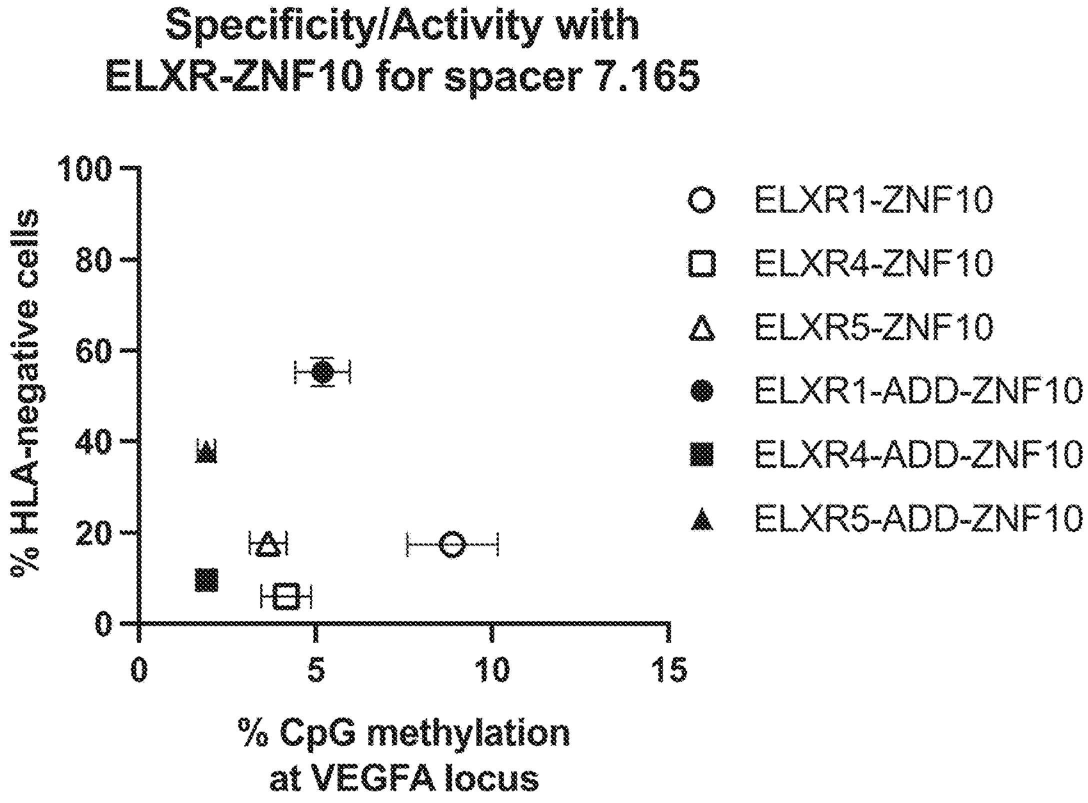
FIG. 44B is a dot plot showing the relative activity (average percentage of HLA-negative cells at day 27) versus specificity (percentage of off-target CpG methylation at the VEGFA locus quantified at day 5) for the ELXR molecules with the ZNF10-KRAB domain having configurations #1, #4, and #5, for B2M-targeting gRNA with spacer 7.165, as described in Example 13.

The specificity of ELXR molecules was determined by profiling the level of CpG methylation at the VEGFA gene, an off-target locus, using bisulfite sequencing, and the data are illustrated in FIGS. 41A-44B. The data demonstrate that inclusion of the DNMT3A ADD domain resulted in a substantial decrease in off-target methylation of the VEGFA locus across all conditions tested (FIGS. 41A-41C). Notably, the increased specificity mediated by the inclusion of the ADD domain was most prominent with the ELXR #1 and ELXR #5 configurations, both of which harbored the DNMT3A/3L domains on the N-terminal end of the molecule. Interestingly, ELXR molecules containing the ZIM3-KRAB domain led to stronger off-target methylation of the VEGFA locus. Furthermore, use of ELXR #4 and #5 configurations, even in the absence of an ADD domain, resulted in higher specificity compared to use of the ELXR #1 configuration. Compared to ELXR1-ZIM3 and ELXR4-ZIM3 configurations, inclusion of the ADD domain into ELXR5-ZIM3 resulted in the lowest off-target methylation.

FIGS. 42A-44B are a series of scatterplots mapping the activity-specificity profiles for the various ELXR molecules, where activity was measured as the average percentage of HLA-negative cells at day 27, and specificity was determined by the percentage of off-target CpG methylation at the VEGFA locus at day 5. The data demonstrate that across all three B2M-targeting spacers tested, inclusion of the ADD domain resulted in increased on-target B2M repression and decreased off-target methylation at the VEGFA locus. ELXR molecules having #1 and #5 configurations exhibited the greatest increases in activity and specificity at each spacer tested.

The results of the experiments discussed in this example support the findings in Example 11, in that the data demonstrate that inclusion of the DNMT3A ADD domain enhances both the strength of repression at early timepoints and the heritability of silencing across cell divisions, as well as decreases the off-target methylation incurred by the DNMT3A catalytic domain in the ELXR molecules. The data also confirm that different ELXR orientations have intrinsic differences in specificity, which can be exacerbated by use of a more potent KRAB domain. This decrease in specificity can be mitigated by inclusion of the DNMT3A ADD domain, which also can lead to greater on-target repression overall. The gains in repression activity are believed to be mediated by the function of the DNMT3A ADD domain to recognize H3K4me0 and subsequent recruitment to chromatin. The gains in specificity are believed to be mediated via the function of the DNMT3A ADD domain to induce allosteric inhibition of the catalytic domain of DNMT3A in the absence of binding to H3K4me0. The results also highlight that positioning of the ADD domain in the different configurations tested is important to achieve the strongest gains in both specificity and activity of ELXR molecules.

Example 14: Demonstration that Use of ELXRs can Induce Silencing of an Endogenous Locus in Mouse Hepa 1-6 Cells Experiments were performed to demonstrate the ability of ELXRs to induce durable repression of an alternative endogenous locus in mouse Hepa 1-6 liver cells, when delivered as mRNA co-transfected with a targeting gRNA.

Materials and Methods

Experiment #1: dXR1 vs. ELXR #1 in Hepa1-6 cells when delivered as mRNA Generation of dXR1 and ELXR #1 mRNA:

mRNA encoding dXR1 or ELXR #1 containing the ZIM3-KRAB domain was generated by in vitro transcription (IVT). Briefly, constructs encoding for a 5'UTR region, dXR1 or ELXR #1 harboring the ZIM3-KRAB domain with flanking SV40 NLSes, and a 3'UTR region were generated and cloned into a plasmid containing a T7 promoter and 80-nucleotide poly(A) tail. These constructs also contained a 2× FLAG sequence. Sequences encoding the dXR1 and ELXR #1 molecules were codon-optimized using a codon utilization table based on ribosomal protein codon usage, in addition to using a variety of publicly available codon optimization tools and adjusting parameters such as GC content as needed. The resulting plasmid was linearized prior to use for IVT reactions, which were carried out with CleanCap® AG and N1-methyl-pseudouridine. IVT reactions were then subjected to DNase digestion and oligodT purification on-column. For experiment #1, the DNA sequences encoding the dXR1 and ELXR #1 molecules are listed in Table 36. The corresponding mRNA sequences encoding the dXR1 and ELXR #1 mRNAs are listed in Table 37. The protein sequences of the dXR1 and ELXR #1 are shown in Table 38.

TABLE 36

Encoding sequences of the dXR1 and ELXR #1 containing the ZIM3-KRAB domain mRNA molecules assessed in experiment #1 of this example*.

| XR or ELXR ID | Component | DNA SEQ ID NO |
| --- | --- | --- |
| dXR1 (codon-optimized) | 5'UTR | 59568 |
| | START codon + NLS + linker | 59569 |
| | dCasX491 | 59570 |
| | Linker + buffer sequence | 59571 |
| | ZIM3-KRAB | 59572 |
| | Buffer sequence + NLS | 59573 |
| | Tag | 59574 |
| | STOP codon + buffer sequence | 59575 |
| | 3'UTR | 59576 |
| | Buffer sequence | 59577 |
| | Poly(A) tail | 59578 |
| ELXR #1 (codon-optimized) | 5'UTR | 59568 |
| | START codon + NLS + buffer sequence + linker | 59579 |

TABLE 36-continued

Encoding sequences of the dXR1 and ELXR #1 containing the ZIM3-KRAB domain mRNA molecules assessed in experiment #1 of this example*.

| XR or ELXR ID | Component | DNA SEQ ID NO |
| --- | --- | --- |
| | START codon + DNMT3A catalytic domain | 59580 |
| | Linker | 59581 |
| | DNMT3L interaction domain | 59582 |
| | Linker | 59583 |
| | dCasX491 | 59570 |
| | Linker | 59571 |
| | ZIM3-KRAB | 59572 |
| | Buffer sequence + NLS | 59573 |
| | Tag | 59574 |
| | STOP codons + buffer sequence | 59575 |
| | 3'UTR | 59576 |
| | Buffer sequence | 59577 |
| | Poly(A) tail | 59578 |

*Components are listed in a 5' to 3' order within the constructs

TABLE 37

Full-length RNA sequences of dXR1 and ELXR #1 containing the ZIM3-KRAB domain mRNA molecules assessed in experiment #1 of this example. Modification 'mψ' = N1-methyl-pseudouridine.

| XR or ELXR ID | RNA sequence | SEQ ID NO |
| --- | --- | --- |
| dXR1 | AAAmψAAGAGAGAAAAGAAGAGmWAAGAAGAAAmψAmψAAGAGCCACCAmψGGCC<br>CCmψAAGAAGAAGCGmψAAAGmψGAGCCGGGGCGGCAGCGGCGGCGGCAGCGCCC<br>AGGAGAmψmψAAACGGAmψCAACAAGAmψCAGAAGAAGACmψmψGmψGAAAGACA<br>GCAACACCAAGAAGGCCGGCAAGACAGGCCCCAmψGAAAACCCmψGCmψGGmψmψ<br>AGAGmψGAmψGACACCCGAmψCmψGAGAGAGCGGCmψGGAAAACCmψGAGAAAGA<br>AGCCmψGAAAAmψAmψCCCCCAGCCCAmψCAGCAAmψACAmψCmψAGAGCCAACC<br>mψGAAmψAAGCmψGCmψGACCGAmψmψACACCGAAAmψGAAGAAGGCGAmψCCmψ<br>GCAmψGmψGmψACmψGGGAAGAGmψmψCCAGAAGGACCCmψGmψGGGCCmψGAmψ<br>GAGCCGGGmψGGCCCAGCCmψGCCAGCAAGAAGAmψCGAmψCAGAACAAGCmψGA<br>AACCmψGAGAmψGGACGAGAAGGGCAACCmψGACCACCGCCGGCmψmψmψGCCmψ<br>GCmψCmψCAGmψGmψGGCCAGCCCCmψGmψmψCGmψGmψACAAGCmψGGAGCAGG<br>mψGmψCmψGAGAAGGGCAAGGCmψmψACACCAACmψACmψmψCGGACGGmψGCAA<br>mψGmψGGCCGAGCACGAAAAGCmψGAmψCCmψGCmψGGCCCAGCmψGAAGCCCGA<br>GAAGGAmψAGCGACGAAGCCGmψGACAmψAmψAGCCmψGGGAAAGmψmψmψGGGC<br>AGAGGGCCCmψGGAmψmψmψCmψACAGCAmψmψCAmψGmψGACCAAGGAGmψCCA<br>CCCACCCCGmψGAAGCCCCmψGGCCCAGAmψCGCCGGAAACAGAmψACGCCmψCC<br>GGACCmψGmψGGGAAAGGCCCmψGAGCGACGCAmψGmψAmψGGGCACAAmψCGCC<br>mψCCmψmψCCmψGmψCmψAAGmψACCAGGACAmψCAmψCAmψCGAACACCAGAAG<br>GmψGGmψGAAGGGCAACCAGAAGAGACmψGGAGAGCCmψGCGGGAGCmψGGCCGG<br>CAAGGAAAACCmψGGAAmψACCCmψAGCGmψGACCCmψGCCACCmψCAGCCmψCA<br>CACCAAGGAGGGCGmψmψGAmψGCCmψACAACGAAGmψGAmψCGCCCGGGmψGCG<br>AAmψGmψGGGmψGAACCmψGAACCmψGmψGGCAGAAGCmψGAAGCmψAAGCAGAG<br>AmψGAmψGCCAAGCCmψCmψGCmψGAGACmψGAAGGGAmψmψCCCmψmψCCmψmψ<br>mψCCmψCmψGGmψCGAGAGACAGGCCAACGAAGmψGGACmψGGmψGGGACAmψGG<br>mψGmψGmψAACGmψGAAGAAGCmψGAmψCAACGAGAAAAAGGAGGAmψGGCAAGG<br>mψGmψmψmψmψGGCAGAAmψCmψGGCmψGGCmψACAAGAGACAGGAAGCCCmψGA<br>GACCAmψACCmψGAGCAGCGAGGAAGAmψCGGAAGAAGGGAAAGAAAmψmψCGCm<br>ψCGGmψACCAGCmψGGGCGACCmψGCmψGCmψGCACCmψGGAAAAGAAGCACGGC<br>GAGGACmψGGGGAAAGGmψGmψACGACGAGGCCmψGGGAGCGGAmψmψGACAAGA<br>AAGmψGGAAGGCCmψGAGCAAGCACAmψCAAGCmψGGAAGAGGAACGGAGAAGCG<br>AGGACGCCCAGAGCAAGGCCGCCCmψGACCGACmψGGCmψGCGGGCmψAAGGCCA<br>GCmψmψCGmψGAmψCGAGGGCCmψGAAGGAGGCCGACAAGGACGAGmψmψCmψGC<br>AGAmψGCGAGCmψGAAGCmψGCAGAAGmψGGmψACGGGGACCmψGCGGGGAAAGC<br>CCmψmψCGCCAmψCGAAGCCGAGAACAGCAmψCCmψGGACAmψCAGCGGCmψmψC<br>AGCAAGCAGmψACAACmψGmψGCCmψmψCAmψCmψGGCAGAAGGACGGCGmψGAA<br>GAAGCmψGAACCmψGmψACCmψGAmψCAmψCAACmψACmψmψCAAGGGCGGCAAG<br>CmψGCGGmψmψCAAGAAGAmψCAAACCmψGAAGCCmψmψCGAAGCCAACAGAmψm<br>ψCmψACACCGmψGAmψCAACAAAAAGAGCGGCGAGAmψCGmψGCCCAmψGGAGGm<br>ψGAACmψmψCAACmψmψCGACGACCCCAACCmψGAmψCAmψCCmψGCCmψCmψGG<br>CCmψmψmψGGCAAGAGACAGGGCAGAGAAmψmψCAmψCmψGGAACGACCmψGCmψ<br>GmψCCCmψGGAAACCGGCAGCCmψGAAGCmψGGCCAACGGAAGAGmψGAmψCGAG<br>AAGACACmψGmψACAACAGAAGAACCCGGCAGGAmψGAGCCmψGCCCmψGmψmψC<br>GmψGGCCCmψGACCmψmψCGAGCGGCGGGAGGmψCCmψGGACmψCCmψCCAAmψA<br>mψCAAACCAAmψGAACCmψGAmψCGGCGmψGGCAAGAGGCGAAAACAmψCCCCGC<br>CGmψGAmψCGCCCmψGACCGACCCCGAGGGCmψGCCCACmψGAGCCGGmψmψmψA | 59584 |

TABLE 37-continued

Full-length RNA sequences of dXR1 and ELXR #1 containing the ZIM3-KRAB domain mRNA molecules assessed in experiment #1 of this example. Modification 'mψ' = N1-methyl-pseudouridine.

| XR or ELXR ID | RNA sequence | SEQ ID NO |
|---|---|---|
| | AGGAmψAGCCmψGGGAAACCCAACCCACAmψCCmψGAGAAmψCGGCGAGAGCmψA<br>mψAAGGAGAAGCAGCGGACCAmψCCAGGCCAAGAAGGAGGmψGGAGCAGCGGAGA<br>GCCGGCGGCmψACAGCCGGAAGmψACGCCAGCAAAGCCAAGAAmψCmUGGCAGAC<br>GAmψAmψGGmψGAGAAACACCGCmψAGAGAmψCmψGCmψGmψACmψACGCCGmψG<br>ACCCAGGAmψGCCAmψGCmψGAmψCmψmψCGCCAACCmψGAGCCGGGGCmψmψCG<br>GCCGGCAGGGCAAGCGGACCmψmψCAmψGGCCGAGAGACAGmψACACACGGAmψG<br>GAGGACmψGGCmψGACCGCCAAGCmψGGCCmψACGAGGGCCmψGAGCAAGACCmψ<br>ACCmψGmψCCAAGACACmψGGCCCAGmψACACCmψCCAAGACAmψGCAGCAACmψ<br>GmψGGGmψmψmψACCAmψCACCAGCGCCGACmψACGACAGGGmψGCmψGGAGAAG<br>CmψGAAGAAGACAGCAACAGGCmψGGAmψGACCACAAmψmψAACGGCAAGGAGCm<br>ψGAAGGmψGGAGGGCCAGAmψmψACCmψACmψACAACAGAmψACAAGAGACAGAA<br>CGmψAGmψCAAGGACCmψGmψCCGmψCGAGCmψGGAmψAGACmψGAGCGAAGAAm<br>ψCmψGmψGAACAACGACAmψCmψCCmψCCmψGGACAAAGGGCAGAAGCGGAGAAG<br>CmψCmψGAGCCmψCCmψGAAGAAAAGAmψmψCmψCCCAmψAGACCCGmψGCAGGA<br>GAAGmψmψCGmψGmψGCCmψGAACmψGCGGCmψmψCGAGACACACGCAGCCGAGC<br>AAGCCGCCCmψGAACAmψCGCCAGAmψCCmψGGCmψGmψmψCCmψGCGGAGCCAG<br>GAGmψACAAGAAAmψACCAGACAAACAAGACAACCGGCAACACCGAmψAAGAGAG<br>CCmψmψCGmψCGAGACCmψGGCAGmψCCmψmψmψmψACCGGAAGAAGCmψmψAAG<br>GAGGmψGmψGGAAACCmψGCCGmψGCGGmψCmψGGCGGAmψCmψGGCGGAGGCmψ<br>CCACAAGCAmψGAACAACmψCCCAGGGCAGAGmψGACCmψmψCGAGGACGmψGAC<br>CGmψGAAmψmψmψmψACACAGGGAGAGmψGGCAGAGACmψGAACCCCGAGCAGAG<br>AAACCmψGmψACCGGGAmψGmψGAmψGCmψGGAAAACmψACAGCAAmψCmψGGmψ<br>GmψCCGmψGGGCCAGGGCGAGACCACAAAGCCmψGACGmψGAmψCCmψGCGmψCm<br>ψGGAGCAGGGCAAGGAACCCmψGGCmψGGAGGAGGAGGAGGmψGCmψGGGAAGCG<br>GACGGGCCGAGAAGAACGGCGACAmψCGGCGGACAGAmψCmψGGAAGCCmψAAGG<br>ACGmψGAAAGAAAGCCmψGACCAGCCCCAAGAAAAAGAGAAAAGmψCGACmψACA<br>AGGAmψGACGAmψGACAAGGACmψACAAGGAmψGACGACGACAAGmψAAmψAGAm<br>ψAAGCGGCCGCmψmψAAmψmψAAGCmψGCCmψmψCmψGCGGGGCmψmψGCCmψmψ<br>CmψGGCCAmψGCCCmψmψCmψmψCmψCmψCCCmψmψGCACCmψGmψACCmψCmψm<br>ψGGmψCmψmψmψGAAmψAAAGCCmψGAGmψAGGAAGmψcmψagaaaaaaaaaaaa<br>aaaaaaaaaaaaaaaaaaaaaaaaaaaaaaaaaaaaaaaaaaaaaaaaaaaaaaa<br>aaaaaaaaaaaaa | |
| ELXR #1 | AAAmψAAGAGAGAAAAGAAGAGmψAAGAAGAAAmψAmψAAGAGCCACCAmψGGCC<br>CCmψAAGAAGAAGCGmψAAAGmψGAGCCGGGmψGAACGGCAGCGGCAGCGGCGGC<br>GGCAmψGAACCACGACCAGGAGmψmψCGACCCCCCmψAAGGmψGmψACCCmψCCC<br>GmψCCCCGCCGAGAAGAGAAAGCCCAmψCCGGGmψCCmψGAGCCmψGmψmψCGAm<br>ψGGCAmψCGCCACCGGmψCmψGCmψGGmψGCmψGAAGGACCmψGGGCAmψCCAGG<br>mψGGAmψAGGmψACAmψmψGCCmψCCGAGGmψGmψGCGAGGACmψCCAmψCACCG<br>mψGGGAAmψGGmψGCGmψCAmψCAGGGCAAGAmψCAmψGmψACGmψGGGCGACGm<br>ψGCGGAGCGmψGACACAGAAGCAmψAmψCCAGGAGmψGGGGCCmψmψmψCGACC<br>mψGGmψGAmψCGGCGGCAGCCCmψmψGCAAmψGACCmψGAGCAmψCGmψGAACCC<br>AGCCCGGAAGGGCCmψGmψACGAGGGAACCGGCAGACmψGmψmψCmψmψCGAGmψ<br>mψmψmψACAGACmψGCmψGCACGACGCCCGGCCmψAAGGAAGGCGACGACCGGCC<br>CmψmψCmψmψmψmψGGCmψGmψmψCGAGAAmψGmψGGmψGGCCAmψGGGAGmψCA<br>GCGACAAGCGGGAmψAmψmψAGCCGGmψmψCCmψGGAGAGCAACCCCGmψGAmψG<br>AmψCGAmψGCCAAGGAAGmψGAGCGCCGCCCACCGGGCCAGAmψACmψmψCmψGG<br>GGCAAmψCmψGCCmψGGCAmψGAACAGACCCCmψGGCCAGCACCGmψGAACGACA<br>AGCmψGGAGCmψGCAGGAGmψGCCmψGGAGCACGGCCGGAmψCGCCAAGmψmψCA<br>GCAAGGmψGAGAACCAmψCACCACCCGAAGCAACAGCAmψCAAACAAGGCAAGGA<br>CCAGCACmψmψmψCCmψGmψGmψmψCAmψGAACGAGAAGGAGGACAmψCCmψGmψ<br>GGmψGmψACCGAGAmψGGAGAGAGmψGmψmψCGGGmψmψCCCAGmψCCACmψACA<br>CAGAmψGmψCAGCAACAmψGmψCmψAGACmψGGCCAGACAGAGACmψGCmψGGGA<br>AGAAGCmψGGmψCCGmψCCCmψGmψGAmψCAGACACCmψGmψmψCGCCCCmψCmψ<br>GAAGGAGmψACmψmψCGCCmψGCGmψGAGCAGCGGCAACAGCAACGCCAACAGCC<br>GGGGCCCCAGCmψmψCmψCmψAGCGGCCmψGGmψGCCACmψGmψCCCmψGAGAGG<br>GAGCCACAmψGGGCCCCAmψGGAGAmψCmψACAAAACCGmψGAGCGCCmψGGAAG<br>CGGCAGCCmψGmψGCGCGmψGCmψGAGCCmψGmψmψmψCGGAAmψAmψCGAmψAA<br>AGmψCCmψGAAAAGCCmψGGGAmψmψCCmψGGAGAGCGGCmψCmψGGCmψCCGGC<br>GGmψGGCACCCmψGAAGmψACGmψGGAGGAmψGmψGACAAACGmψGGmψCAGACG<br>GGAmψGmψGGAGAAGmψGGGGCCCCmψmψCGAmψCmψGGmψGmψACGGCAGCACC<br>CAACCCCmψGGGCAGCmψCmψmψGmψGACCGGmψGCCCmψGGCmψGGmψACAmψG<br>mψmψmψCAGmψmψCCACCGGAmψCCmψGCAGmψACGCCCmψGCCGAGACAGGAGm<br>ψCCCAGCGGCCAmψmψCmψmψmψmψGGAmψmψmψmψCAmψGGACAACmψmψGCmψ<br>GCmψGACCGAGGAmψGACCAGGAAACmψACCACmψCGGmψmψCCmψGCAGACCGA<br>AGCCGmψGACCCmψGCAGGACGmψGAGAGGCCGGGACmψACCAGAACGCCAmψGC<br>GGGmψGmψGGmψCCAACAmψCCCmψGGACmψGAAAAGCAAGCACGCACCmψCmψG<br>ACCCCmψAAAGAAGAGGAGmψACCmψGCAGGCCCAGGmψGCGGAGCAGAAGCAAG<br>CmψGGACGCCCCmψAAGGmψGGAmψCmψGCmψGGmψGAAGAAmψmψGCCmψCCmψ<br>GCCCCmψGAGAGAGmψACmψmψCAAGmψAmψmψmψCAGCCAGAAmψAGmψCmψGC<br>CCCmψGGGCGGCCCAAGCAGCGGCGCCCCmψCCmψCCCAGCGGCGGCAGCCCAGC<br>CGGCmψCCCCAACCmψCmψACCGAGGAGGGCACCmψCmψGAGmψCCGCCACCCCC | 59585 |

TABLE 37-continued

Full-length RNA sequences of dXR1 and ELXR #1 containing the ZIM3-KRAB domain mRNA molecules assessed in experiment #1 of this example. Modification 'mψ' = N1-methyl-pseudouridine.

| XR or ELXR ID | RNA sequence | SEQ ID NO |
|---|---|---|
| | GAGAGCGGCCCmψGGCACCmψCCACCGAGCCCAGCGAGGGCAGCGCACCCGGCAG<br>CCCmψGCCGGCAGCCCCACCmψCCACAGAGGAGGGAACCAGCACCGAGCCCAGCG<br>AAGGCAGCGCCCCAGGCACCAGCACCGAGCCmψAGmψGAGGGCGGCmψCmψGGCG<br>GCGGCAGCGCCCAGGAGAmψmψAAACGGAmψCAACAAGAmψCAGAAGAAGACmψm<br>ψGmψGAAAGACAGCAACACCAAGAAGGCCGGCAAGACAGGCCCCAmψGAAAACCC<br>mψGCmψGGmψmψAGAGmψGAmψGACACCCGAmψCmψGAGAGAGCGGCmψGGAAAA<br>CCmψGAGAAAGAAGCCmψGAAAAmψAmψCCCCCAGCCCAmψCAGCAAmψACAmψC<br>mψAGAGCCAACCmψGAAmψAAGCmψGCmψGACCGAmψmψACACCGAAAmψGAAGA<br>AGGCGAmψCCmψGCAmψGmψGmψACmψGGGAAGAGmψmψCCAGAAGGACCCmψGm<br>ψGGGCCmψGAmψGAGCCGGGmψGGCCCAGCCmψGCCAGCAAGAAGAmψCGAmψCA<br>GAACAAGCmψGAAACCmψGAGAmψGGACGAGAAGGGCAACCmψGACCACCGCCGG<br>CmψmψmψGCCmψGCmψCmψCAGmψGmψGGCCAGCCCCmψGmψmψCGmψGmψACAA<br>GCmψGGAGCAGGmψGmψCmψGAGAAGGGCAAGGCmψmψACACCAACmψACmψmψC<br>GGACGGmψGCAAmψGmψGGCCGAGCACGAAAAGCmψGAmψCCmψGCmψGGCCCAG<br>CmψGAAGCCCGAGAAGGAmψAGCGACGAAGCCGmψGACAmψAmψAGCCmψGGGAA<br>AGmψmψmψGGGCAGAGGGCCCmψGGAmψmψmψCmψACAGCAmψmψCAmψGmψGAC<br>CAAGGAGmψCCACCCACCCCGmψGAAGCCCCmψGGCCCAGAmψCGCCGGAAACAG<br>AmψACGCCmψCCGGACCmψGmψGGGAAAGGCCCmψGAGCGACGCAmψGmψAmψGG<br>GCACAAmψCGCCmψCCmψmψCCmψGmψCmψAAGmψACCAGGACAmψCAmψCAmψC<br>GAACACCAGAAGGmψGGmψGAAGGGCAACCAGAAGAGACmψGGAGAGCCmψGCGG<br>GAGCmψGGCCGGCAAGGAAAACCmψGGAAmψACCCmψAGCGmψGACCCmψGCCAC<br>CmψCAGCCmψCACACCAAGGAGGGCGmψmψGAmψGCCmψACAACGAAGmψGAmψC<br>GCCCGGGmψGCGAAmψGmψGGGmψGAACCmψGAACCmψGmψGGCAGAAGCmψGAA<br>GCmψAAGCAGAGAmψGAmψGCCAAGCCmψCmψGCmψGAGACmψGAAGGGAmψmψC<br>CCmψmψCCmψmψmψCCmψCmψGGmψCGAGAGACAGGCCAACGAAGmψGGACmψGG<br>mψGGGACAmψGGmψGmψGmψAACGmψGAAGAAGCmψGAmψCAACGAGAAAAAGGA<br>GGAmψGGCAAGGmψGmψmψmψmψGGCAGAAmψCmψGGCmψGGCmψACAAGAGACA<br>GGAAGCCCmψGAGACCAmψACCmψGAGCAGCGAGGAAGAmψCGGAAGAAGGGAAA<br>GAAAmψmψCGCmψCGGmψACCAGCmψGGGCGACCmψGCmψGCmψGCACCmψGGAA<br>AAGAAGCACGGCGAGGACmψGGGGAAAGGmψGmψACGACGAGGCCmψGGGAGCGG<br>AmψmψGACAAGAAAGmψGGAAGGCCmψGAGCAAGCACAmψCAAGCmψGGAAGAGG<br>AACGGAGAAGCGAGGACGCCCAGAGCAAGGCCGCCCmψGACCGACmψGGCmψGCG<br>GGCmψAAGGCCAGCmψmψCGmψGAmψCGAGGGCCmψGAAGGAGGCCGACAAGGAC<br>GAGmψmψCmψGCAGAmψGCGAGCmψGAAGCmψGCAGAAGmψGGmψACGGGGACCm<br>ψGCGGGGAAAGCCCmψmψCGCCAmψCGAAGCCGAGAACAGCAmψCCmψGGACAmψ<br>CAGCGGCmψmψCAGCAAGCAGmψACAACmψGmψGCCmψmψCAmψCmψGGCAGAAG<br>GACGGCGmψGAAGAAGCmψGAACCmψGmψACCmψGAmψCAmψCAACmψACmψmψC<br>AAGGGCGGCAAGCmψGCGGmψmψCAAGAAGAmψCAAACCmψGAAGCCmψmψCGAA<br>GCCAACAGAmψmψCmψACACCGmψGAmψCAACAAAAAGAGCGGCGAGAmψCGmψG<br>CCCAmψGGAGGmψGAACmψmψCAACmψmψCGACGACCCCAACCmψGAmψCAmψCC<br>mψGCCmψCmψGGCCmψmψmψGGCAAGAGACAGGGCAGAGAAmψmvCAmψCmψGGA<br>ACGACCmψGCmψGmψCCCmψGGAAACCGGCAGCCmψGAAGCmψGGCCAACGGAAG<br>AGmψGAmψCGAGAAGACACmψGmψACAACAGAAGAACCCGGCAGGAmψGAGCCmψ<br>GCCCmψGmψmψCGmψGGCCCmψGACCmψmψCGAGCGGCGGGAGGmψCCmψGGACm<br>ψCCmψCCAAmψAmψCAAACCAAmψGAACCmψGAmψCGGCGmψGGCAAGAGGCGAA<br>AACAmψCCCCGCCGmψGAmψCGCCCmψGACCGACCCCGAGGGCmψGCCCACmψGA<br>GCCGGmψmψmψAAGGAmψAGCCmψGGGAAACCCAACCCACAmψCCmψGAGAAmψC<br>GGCGAGAGCmψAmψAAGGAGAAGCAGCGGACCAmψCCAGGCCAAGAAGGAGGmψG<br>GAGCAGCGGAGAGCCGGCGGCmψACAGCCGGAAGmψACGCCAGCAAAGCCAAGAA<br>mψCmψGGCAGACGAmψAmψGGmψGAGAAACACCGCmψAGAGAmψCmψGCmψGmψA<br>CmψACGCCGmψGACCCAGGAmψGCCAmψGCmψGAmψCmψmψCGCCAACCmψGAGC<br>CGGGGCmψmψCGGCCGGCAGGGCAAGCGGACCmψmψCAmψGGCCGAGAGACAGmψ<br>ACACACGGAmψGGAGGACmψGGCmψGACCGCCAAGCmψGGCCmψACGAGGGCCmψ<br>GAGCAAGACCmψACCmψGmψCCAAGACACmψGGCCCAGmψACACCmψCCAAGACA<br>mψGCAGCAACmψGmψGGGmψmψmψACCAmψCACCAGCGCCGACmψACGACAGGGm<br>ψGCmψGGAGAAGCmψGAAGAAGACAGCAACAGGCmψGGAmψGACCACAAmψmψAA<br>CGGCAAGGAGCmψGAAGGmψGGAGGGCCAGAmψmψACCmψACmψACAACAGAmψA<br>CAAGAGACAGAACGmψAGmψCAAGGACCmψGmψCCGmψCGAGCmψGGAmψAGACm<br>ψGAGCGAAGAAmψCmψGmψGAACAACGACAmψCmψCCmψCCmψGGACAAAGGGCA<br>GAAGCGGAGAAGCmψCmψGAGCCmψCCmψGAAGAAAAGAmψmψCmψCCCAmψAGA<br>CCCGmψGCAGGAGAAGmψmψCGmψGmψGCCmψGAACmψGCGGCmψmψCGAGACAC<br>ACGCAGCCGAGCAAGCCGCCCmψGAACAmψCGCCAGAmψCCmψGGCmψGmψmψCC<br>mψGCGGAGCCAGGAGmψACAAGAAAmψACCAGACAAACAAGACAACCGGCAACAC<br>CGAmψAAGAGAGCCmψmψCGmψCGAGACCmψGGCAGmψCCmψmψmψmψACCGGAA<br>GAAGCmψmψAAGGAGGmψGmψGGAAACCmψGCCGmψGCGGmψCmψGGCGGAmψCm<br>ψGGCGGAGGCmψCCACAAGCAmψGAACAACmψCCCAGGGCAGAGmψGACCmψmψC<br>GAGGACGmψGACCGmψGAAmψmψmψmψACACAGGGAGAGmψGGCAGAGACmψGAA<br>CCCCGAGCAGAGAAACCmψGmψACCGGGAmψGmψGAmψGCmψGGAAAACmψACAG<br>CAAmψCmψGGmψGmψCCGmψGGGCCAGGGCGAGACCACAAAGCCmψGACGmψGAm<br>ψCCmψGCGmψCmψGGAGCAGGGCAAGGAACCCmψGGCmψGGAGGAGGAGGAGGmψ<br>GCmψGGGAAGCGGACGGGCCGAGAAGAACGGCGACAmψCGGCGGACAGAmψCmψG<br>GAAGCCmψAAGGACGmψGAAAGAAAGCCmψGACCAGCCCCAAGAAAAAGAGAAAA | |

TABLE 37-continued

Full-length RNA sequences of dXR1 and ELXR #1 containing the ZIM3-KRAB domain mRNA molecules assessed in experiment #1 of this example. Modification 'mψ' = N1-methyl-pseudouridine.

| XR or ELXR ID | RNA sequence | SEQ ID NO |
|---|---|---|
| | GmψCGACmψACAAGGAmψGACGAmψGACAAGGACmψACAAGGAmψGACGACGACA AGmψAAmψAGAmψAAGCGGCCGCmψmψAAmψmψAAGCmψGCCmψmψCmψGCGGGG CmψmψGCCmψmψCmψGGCCAmψGCCCmψmψCmψmψCmψCmψCCCmψmψGCACCmψ GmψACCmψCmψmψGGmψCmψmvmψGAAmψAAAGCCmψGAGmψAGGAAGmψcmψag aaaaaaaaaaaaaaaaaaaaaaaaaaaaaaaaaaaaaaaaaaaaaaaaaaaaaaa aaaaaaaaaaaaaaaaaaaaaaaaa | |

TABLE 38

Full-length protein sequences of dXR1 and ELXR #1 containing the ZIM3-KRAB domain molecules assessed in experiment #1 of this example. Modification 'mψ' = N1-methyl-pseudouridine.

| XR or ELXR ID | Protein SEQ ID NO |
|---|---|
| dXR1 | 59586 |
| ELXR #1 | 59467 |

Synthesis of gRNAs:

In this experiment #1, gRNAs targeting the PCSK9 locus were designed using gRNA scaffold 174 and chemically synthesized. The sequences of the PCSK9-targeting spacers are listed in Table 39.

mouse IgG secondary antibody (Thermo Fisher). Fluorescence levels were measured using the Attune™ NxT flow cytometer, and data were analyzed using the FlowJo™ software. Cell populations were gated using the non-targeting gRNA as a negative control.

Experiment #2: ELXR #1 vs. ELXR #5 in Hepa1-6 Cells when Delivered as mRNA

Generation of mRNA:

mRNA encoding ELXR #1 or ELXR #5 containing the ZIM3-KRAB domain was generated by IVT in-house using PCR templates. Briefly, PCR was performed on plasmids encoding ELXR #1 or ELXR #5 harboring the ZIM3-KRAB domain with flanking NLSes with a forward primer containing a T7 promoter and reverse primer encoding a 120-nucleotide poly(A) tail. These constructs also contained a 2× FLAG sequence. DNA sequences encoding these molecules are listed in Table 40. The resulting PCR templates were used for IVT reactions, which were carried out with CleanCap® AG and N1-methyl-pseudouridine. IVT reactions were then subjected to DNase digestion and on-column oligo dT purification. Full-length RNA sequences encoding the ELXR mRNAs are listed in Table 41.

As experimental controls, mRNA encoding catalytically-active CasX 491 was also similarly generated by IVT using a PCR template as described. Generation of mRNAs encoding ELXR #1 containing the ZIM3-KRAB domain and dCas9-ZNF10-DNMT3A/3L (described in Example 6) by IVT by a third-party was performed as described above for experiment #1.

TABLE 39

Sequences of spacers targeting the PCSK9 locus used in this example.

| gRNA ID (scaffold-variant spacer) | Target | Targeting spacer sequence (RNA) | SEQ ID NO: |
|---|---|---|---|
| 174-6.7 | human PCSK9 | UCCUGGCUUCCUGGUGAAGA | 59587 |
| 174-27.1 | mouse PCSK9 | GCCUCGCCCUCCCCAGACAG | 59588 |
| 174-27.88 | mouse PCSK9 | CGCUACCUGCCUAAACUUUG | 59589 |
| 174-27.92 | mouse PCSK9 | CCCUCCAACAAUAUUAACUA | 59590 |
| 174-27.93 | mouse PCSK9 | GGGGUCUCCCAGCCACCCCU | 59591 |
| 174-27.94 | mouse PCSK9 | CCCCUCUUAAUCCCCACUCC | 59592 |
| 174-27.100 | mouse PCSK9 | CUCUCUCUUUCUGAGGCUAG | 59593 |
| 174-27.103 | mouse PCSK9 | UAAUCUCCAUCCUCGUCCUG | 59594 |

Transfection of mRNA and gRNA into Hepa1-6 Cells and Intracellular PCSK9 Staining:

Seeded Hepa1-6 cells treated with the NATE™ inhibitor were lipofected with 300 ng of mRNA encoding dXR1 or ELXR #1 with a ZIM3-KRAB domain (Table 37) and 150 ng of a PCSK9-targeting gRNA (Table 39). Seven different gRNAs spanning the promoter region of the mouse PCSK9 locus were tested, in addition to a non-targeting sequence complementary to the human PCSK9 gene (Table 39). Cells were harvested at 6, 13, and 25 days after transfection to measure intracellular levels of the PCSK9 protein using an intracellular flow cytometry staining protocol. Briefly, cells were fixed using 4% paraformaldehyde in PBS, permeabilized, and stained using a mouse anti-PCSK9 primary antibody (R&D Systems), followed by a fluorescent goat anti-

TABLE 40

Encoding sequences of the ELXR #1 and ELXR #5 containing the ZIM3-KRAB domain mRNA molecules assessed in experiment #2 of this example*

| ELXR ID | Component | DNA SEQ ID NO |
|---|---|---|
| ELXR #1 - ZIM3-KRAB | 5'UTR | 59595 |
| | START codon + NLS + linker | 59596 |
| | START codon + DNMT3A catalytic domain | 59597 |
| | Linker | 59598 |
| | DNMT3L interaction domain | 59445 |
| | Linker | 59599 |
| | Linker + buffer | 59600 |
| | dCasX491 | 59601 |
| | Linker + buffer | 59602 |
| | ZIM3-KRAB | 59603 |
| | Buffer + NLS | 59604 |
| | Tag | 59605 |
| | Buffer | 59606 |
| | Poly(A) tail | 59607 |

TABLE 40-continued

Encoding sequences of the ELXR #1 and ELXR #5 containing the ZIM3-KRAB domain mRNA molecules assessed in experiment #2 of this example*

| ELXR ID | Component | DNA SEQ ID NO |
|---|---|---|
| ELXR #5 - ZIM3-KRAB | 5'UTR | 59595 |
| | START codon + NLS + buffer | 59608 |
| | START codon + DNMT3A catalytic domain | 59597 |
| | Linker | 59598 |
| | DNMT3L interaction domain | 59445 |
| | Linker | 59446 |
| | ZIM3-KRAB | 59603 |
| | Linker | 59599 |
| | dCasX491 | 59601 |
| | Linker + buffer | 59602 |
| | NLS | 59609 |
| | Tag | 59605 |
| | Buffer | 59606 |
| | Poly(A) tail | 59607 |

*Components are listed in a 5' to 3' order within the constructs

TABLE 41

Full-length RNA sequences of ELXR #1 and ELXR #5 containing the ZIM3-KRAB domain mRNA molecules assessed in experiment #2 of this example. Modification 'mψ' = N1-methyl-pseudouridine.

| ELXR ID | RNA sequence | SEQ ID NO |
|---|---|---|
| ELXR #1-ZIM3-KRAB | GACCGGCCGCCACCAmψGGCCCCAAAGAAGAAGCGGAAGGmψCmψCmψAGAGmψmψAACGGAmψ<br>CAGGCmψCmψGGAGGmψGGAAmψGAACCAmψGACCAGGAAmψmψmψGACCCCCCAAAGGmψmψm<br>ψACCCACCmψGmψGCCAGCmψGAGAAGAGGAAGCCCAmψCCGCGmψGCmψGmψCmψCmψCmψmψ<br>mψGAmψGGGAmψmψGCmψACAGGGCmψCCmψGGmψGCmψGAAGGACCmψGGGCAmψCCAAGmψG<br>GACCGCmψACAmψCGCCmψCCGAGGmψGmψGmψGAGGACmψCCAmψCACGGmψGGGCAmψGGmψ<br>GCGGCACCAGGGAAAGAmψCAmψGmψACGmψCGGGGACGmψCCGCAGCGmψCACACAGAAGCAm<br>ψAmψCCAGGAGmψGGGGCCCAmψmψCGACCmψGGmψGAmψmψGGAGGCAGmψCCCmψGCAACGA<br>CCmψCmψCCAmψmψGmψCAACCCmψGCCCGCAAGGGACmψmψmψAmψGAGGGmψACmψGGCCGC<br>CmψCmψmψCmψmψmψGAGmψmψCmψACCGCCmψCCmψGCAmψGAmψGCGCGGCCCAAGGAGGGA<br>GAmψGAmψCGCCCCmψmψCmψmψCmψGGCmψCmψmψmψGAGAAmψGmψGGmψGGCCAmψGGGCG<br>mψmψAGmψGACAAGAGGGACAmψCmψCGCGAmψmψmψCmψmψGAGmψCmψAACCCCGmψGAmψG<br>AmψmψGACGCCAAAGAAGmψGmψCmψGCmψGCACACAGGGCCCGmψmψACmψmψCmψGGGGmψA<br>ACCmψmψCCmψGGCAmψGAACAGGCCmψmψmψGGCAmψCCACmψGmψGAAmψGAmψAAGCmψGG<br>AGCmψGCAAGAGmψGmψCmψGGAGCACGGCAGAAmψAGCCAAGmψmψCAGCAAAGmψGAGGACC<br>AmψmψACCACCAGGmψCAAACmψCmψAmψAAAGCAGGGCAAAGACCAGCAmψmψmψCCCCGmψC<br>mψmψCAmψGAACGAGAAGGAGGACAmψCCmψGmψGGmψGCACmψGAAAmψGGAAAGGGmψGmψm<br>ψmψGGCmψmψCCCCGmψCCACmψACACAGACGmψGmψCCAACAmψGAGCCGCmψmψGGCGAGGC<br>AGAGACmψGCmψGGGCCGGmψCGmψGGAGCGmψGCCGGmψCAmψCCGCCACCmψCmψmψCGCmψ<br>CCGCmψGAAGGAAmψAmψmψmψmψGCmψmψGmψGmψGmψCmψAGCGGCAAmψAGmψAACGCmψA<br>ACAGCCGCGGGCCGAGCmψmψCAGCAGCGGCCmψGGmψGCCGmψmψAAGCmψmψGCGCGGCAGC<br>CAmψAmψGGGCCCmψAmψGGAGAmψAmψACAAGACAGmψGmψCmψGCAmψGGAAGAGACAGCCA<br>GmψGCGGGmψACmψGAGCCmψCmψmψCAGAAACAmψCGACAAGGmψACmψAAAGAGmψmψmψGG<br>GCmψmψCmψmψGGAAAGCGGmψmψCmψGGmψmψCmψGGGGGAGGAACGCmψGAAGmψACGmψGG<br>AAGAmψGmψCACAAAmψGmψCGmψGAGGAGGGACGmψGGAGAAAmψGGGGCCCCmψmψmψGACC<br>mψGGmψGmψACGGCmψCGACGCAGCCCCmψAGGCAGCmψCmψmψGmψGAmψCGCmψGmψCCCGG<br>CmψGAGGAmψGACCAAGAGACAACmψACCCGCmψmψCCmψmψCAGACAGAGGCmψGmψGACCCm<br>GGAGAGmψCAGCGGCCCmψmψCmψmψCmψGGAmψAmψmψCAmψGGACAAmψCmψGCmψGCmψGA<br>CmψGAGGAmψGACCAAGAGACAACmψACCCGCmψmψCCmψmψCAGACAGAGGCmψGmψGACCCm<br>ψCCAGGAmψGmψCCGmψGGCAGAGACmψACCAGAAmψGCmψAmψGCGGGmψGmψGGAGCAACAm<br>ψmψCCAGGGCmψGAAGAGCAAGCAmψGCGCCCCmψGACCCCAAAGGAAGAAGAGmψAmψCmψGC<br>AAGCCCAAGmψCAGAAGCAGGAGCAAGCmψGGACGCCCCGAAAGmψmψGACCmψCCmψGGmψGA<br>AGAACmψGCCmψmψCmψCCCGCmψGAGAGAGmψACmψmψCAAGmψAmψmψmψmψmψCmψCAAAA<br>CmqCACmψmψCCmψCmψmψGGAGGGCCGAGCmψCmψGGCGCACCCCCCACCAAGmψGGAGGGmψC<br>mψCCmψGCCGGGmψCCCCAACAmψCmψACmψGAAGAAGGCACCAGCGAAmψCCGCAACGCCCGA<br>GmψCAGGCCCmψGGmψACCmψCCACAGAACCAmψCmψGAAGGmψAGmψGCGCCmψGGmψmψCCC<br>CAGCmψGGAAGCCCmψACmψmψCCACCGAAGAAGGCACGmψCAACCGAACCAAGmψGAAGGAmψ<br>CmψGCCCCmψGGGACCAGCACmψGAACCAmψCmψGAGGGCGGmψmψCCGGCGGAGGAAGCGCmψ<br>CAAGAGAmψCAAGAGAAmψCAACAAGAmψCAGAAGGAGACmψGGmψCAAGGACAGCAACACAAA<br>GAAGGCCGGCAAGACAGGCCCCAmψGAAAACCCmψGCmψCGmψCAGAGmψGAmψGACCCCmψGA<br>CCmψGAGAGAGCGGCmψGGAAAACCmψGAGAAAGAAGCCCGAGAACAmψCCCmψCAGCCmψAmψ<br>CAGCAACACCAGCAGGGCCAACCmψGAACAAGCmψGCmψGACCGACmψACACCGAGAmψGAAGA<br>AAGCCAmψCCmψGCaCGmψGmψACmψGGGAAGAGmψmψCCAGAAAGACCCCGmψGGGCCmψGAm<br>ψGAGCAGAGmψmψGCmψCAGCCmψGCCAGCAAGAAGAmψCGACCAGAACAAGCmψGAAGCCCGA<br>GAmψGGACGAGAAGGGCAAmψCmψGACCACAGCCGGCmψmψmψGCCmψGCm4Cm4CAGmψGmψG | 59610 |

TABLE 41-continued

Full-length RNA sequences of ELXR #1 and ELXR #5 containing the ZIM3-KRAB domain mRNA molecules assessed in experiment #2 of this example. Modification 'mψ' = N1-methyl-pseudouridine.

| ELXR ID | RNA sequence | SEQ ID NO |
|---|---|---|
| | GCCAGCCmψCmψGmψmψCGmψGmψACAAGCmψGGAACAGGmψGmψCCGAGAAAGGCAAGGCCmψ<br>ACACCAACmψACmψmψCGGCAGAmψGmψAACGmψGGCCGAGCACGAGAAGCmψGAmψmψCmψGC<br>mψGGCCCAGCmψGAAACCmψGAGAAGGACmψCmψGAmψGAGGCCGmψGACCmψACAGCCmψGGG<br>CAAGmψmψmψGGACAGAGAGCCCmψGGACmψmψCmψACAGCAmψCCACGmψGACCAAAGAAAGC<br>ACACACCCCGmψGAAGCCCCmGGCmψCAGAmψCGCCGGCAAmψTAGAmψACGCCmψCmψGGACC<br>mψGmψGGGCAAAGCCCmψGmψCCGAmψGCCmψGCAmψGGGAACAAmψCGCCAGCmψmψCCmψGA<br>GCAAGmψACCAGGACAmψCAmψCAmψCGAGCACCAGAAGGmψGGmψCAAGGGCAACCAGAAGAG<br>ACmψGGAAAGCCmψGAGGGAGCmψGGCCGGCAAAGAGAACCmψGGAAmψACCCCAGCGmψGACC<br>CmψGCCmψCCmψCAGCCmψCACACAAAAGAAGGCGmψGGACGCCmψACAACGAAGmψGAmψCGC<br>CAGAGmψGAGAAmψGmψGGGmψCAACCmψGAACCmψGmψGGCAGAAGCmψGAAACmψGmψCCAG<br>GGACGACGCCAAGCCmψCmψGCmψGAGACmψGAAGGGCmψmψCCCmψAGCmψmψCCCmψCmψGG<br>mψGGAAAGACAGGCCAAmψGAAGmψGGAmψmψGGmψGGGACAmψGGmψCmψGCAACGmψGAAGA<br>AGCmψGAmψCAACGAGAAGAAAGAGGAmψGGCAAGGmψmψmψmψCmψGGCAGAACCmψGGCCGG<br>CmψACAAGAGACAAGAAGCCCmψGAGGCCmψmψACCmψGAGCAGCGAAGAGGACCGGAAGAAGG<br>GCAAGAAGmψmψCGCCAGAmψACCAGCmψGGGCGACCmψGCmψGCmψGCACCmψGGAAAAGAAG<br>CACGGCGAGGACmψGGGGCAAAGmψGmψACGAmψGAGGCCmψGGGAGAGAAmψCGACAAGAAGG<br>mψGGAAGGCCmψGAGCAAGCACAmψmψAAGCmψGGAAGAGGAAAGAAGGAGCGAGGACGCCCAA<br>mψCmψAAAGCCGCmψCmψGACCGAmψmψGGCmψGAGAGCCAAGGCCAGCmψmψmψGmψGAmψCG<br>AGGGCCmψGAAAGAGGCCGACAAGGACGAGmψmψCmψGCAGAmψGCGAGCmψGAAGCmψGCAGA<br>AGmψGGmψACGGCGAmψCmψGAGAGGCAAGCCCmψmψCGCCAmψmψGAGGCCGAGAACAGCAmψ<br>CCmψGGACAmψCAGCGGCmψmψCAGCAAGCAGmψACAACmψGCGCCmψmψCAmψmψmψGGCAGA<br>AAGACGGCGmψCAAGAAACmψGAACCmψGmψACCmψGAmψCAmψCAAmψmψACmψmψCAAAGGC<br>GGCAAGCmψGCGGmψmψCAAGAAGAmψCAAACCCGAGGCCmψmψCGAGGCmψAACAGAmψmψCm<br>ψACACCGmψGAmψCAACAAAAAGmψCCGGCGAGAmψCGmψGCCCAmψGGAAGmψGAACmψmψCA<br>ACmψmψCGACGACCCCAACCmψGAmψmψAmψCCmψGCCmψCmψGGCCmψmψCGGCAAGAGACAG<br>GGCAGAGAGmψmψCAmψCmψGGAACGAmψCmψGCmψGAGCCmψGGAAACCGGCmψCmψCmψGAA<br>GCmψGGCCAAmψGGCAGAGmψGAmψCGAGAAAACCCmψGmψACAACAGGAGAACCAGACAGGAC<br>GAGCCmψGCmψCmψGmψmψmψGmψGGCCCmψGACCmψmψCGAGAGAAGAGAGGmψGCmψGGACa<br>GCAGCAACAmψCAAGCCCAmψGAACCmψGAmψCGGCGmψGGCCCGGGGCGAGAAmψAmψCCCmψ<br>GCmψGmψGAmψCGCCCmψGACAGACCCmψGAAGGAmψGCCCACmψGAGCAGAmψmψCAAGGACm<br>ψCCCmqGGGCAACCCmψACACACAmψCCmψGAGAAmψCGGCGAGAGCmψACAAAGAGAAGCAGA<br>GGACAAmψCCAGGCCAAGAAAGAGGmψGGAACAGAGAAGAGCCGGCGGAmψACmψCmψAGGAAG<br>mψACGCCAGCAAGGCCAAGAAmψCmψGGCCGACGACAmψGGmψCCGAAACACCGCCAGAGAmψC<br>mψGCmψGmψACmψACGCCGmψGACACAGGACGCCAmψGCmψGAmψCmψmψCGCGAAmψCmψGAG<br>CAGAGGCmψmψCGGCCGGCAGGGCAAGAGAACCmψmψmψAmψGGCCGAGAGGCAGmψACACCAG<br>AAmψGGAAGAmψmψGGCmψCACAGCmψAAACmψGGCCmψACGAGGGACmψGAGCAAGACCmψAC<br>CmψGmψCCAAAACACmψGGCCCAGmψAmψACCmψCCAAGACCmψGCAGCAAmψmψGCGGCmψmψ<br>CACCAmψCACCAGCGCCGACmψACGACAGAGmψGCmψGGAAAAGCmψCAAGAAAACCGCCACCG<br>GCmψGGAmψGACCACCAmψCAACGGCAAAGAGCmψGAAGGmψmψGAGGGCCAGAmψCACCmψAC<br>mψACAACAGGmψACAAGAGGCAGAACGmψCGmψGAAGGAmψCmψGAGCGmψGGAACmψGGACAG<br>ACmψGAGCGAAGAGAGCGmψGAACAACGACAmψCAGCAGCmψGGACAAAGGGCAGAmψCAGGCG<br>AGGCmψCmψGAGCCmψGCmψGAAGAAGAGGmψmψmψAGCCACAGACCmψGmψGCAAGAGAAGmψ<br>mψCGmψGmψGCCmψGAACmψGCGGCmψmψCGAGACACACGCCGCmψGAACAGGCmψGCCCmψGA<br>ACAmψmψGCCAGAAGCmψGGCmψGmψmψCCmψGAGAAGCCAAGAGmψACAAGAAGmψACCAGAC<br>CAACAAGACCACCGGCAACACCGACAAGAGGGCCmψmψmψGmψGGAAACCmψGGCAGAGCmψmψ<br>CmψACAGAAAAAAGCmψGAAAGAAGmψCmψGGAAGCCCGCCGmψGCGAmψCGGGCGGmψmψCCG<br>GCGGAGGmψmψCCACmψAGmψAmψGAACAAmψmψCCCAGGGAAGAGmψGACCmψmψCGAGGAmψ<br>GmψCACmψGmψGAACmψmψCACCCAGGGGGAGmψGGCAGCGGCmψGAAmψCCCGAACAGAGAAA<br>CmψmψGmψACAGGGAmψGmψGAmψGCmψGGAGAAmψmψACAGCAACCmψmψGmψCmψCmψGmψG<br>GGACAAGGGGAAACCACCAAACCCGAmψGmψGAmt CmψmψGAGGmψmψGGAACAAGGAAAGGAG<br>CCAmψGGmψmψGGAGGAAGAGGAAGmψGCmψGGGAAGmψGGCCGmψGCAGAAAAAAAmψGGGGA<br>CAmψmψGGAGGGCAGAmψmψmψGGAAGCCAAAGGAmψGmψGAAAGAGAGmψCmψCACmψAGmψC<br>CAAAAAAGAAGAGAAAGGmψAGAmψmψACAAAGAmψGACGAmψGACAAAGACmψACAAGGAmψG<br>AmψGAmψGAmψAAGGGAmψCCGGCmψGAAAAAAAAAAAAAAAAAAAAAAAAAAAAAAAAAAAAAA<br>AAAAAAAAAAAAAAAAAAAAAAAAAAAAAAAAAAAAAAAAAAAAAAAAAAAAAAAAAAAAAAAA<br>AAAAAAAAAAAAAAAAAAAA | |
| ELXR #5-ZIM3-KRAB | GACCGGCCGCCACCAmψGGCCCCAAAGAAGAAGCGGAAGGmψCmψCmψAGAAmψGAACCAmψGA<br>CCAGGAAmψmψmψGACCCCCCAAAGGmψmψmψACCCACCmψGmψGCCAGCmψGAGAAGAGGAAG<br>CCCAmψCCGCGmψGCmψGmψCmψCmψCmψmψmψGAmψGGGAmψmψGCmψACAGGGCmψCCmψGG<br>mψGCmψGAAGGACCmψGGGCAmψCCAAGmψGGACCGCmψACAmψCGCCmψCCGAGGmψGmψGmψ<br>GAGGACmψCCAmψCACGGmψGGGCAmψGGmψGCGGCACCAGGGAAAGAmψCAmψGmψACGmψCG<br>GGGACGmψCCGCAGCGmψCACACAGAAGCAmψAmψCCAGGAGmψGGGGCCCAmψmψCGACCmψG<br>GmψGAmψmψGGAGGCAGmψCCCmψGCAACGACCmψCmψCCAmψmψGmψCAACCCmψGCCCGCAA<br>GGGACmψmψmψAmψGAGGGmψACmψGGCCGCCmψCmψmψCmψmψmψGAGmψmψCmψACCGCCmψ<br>CCmψGCAmψGAmψGCGCGGCCCAAGGAGGGAGAmψGAmψCGCCCCmψmψCmψmψCmψGGCmψCm<br>ψmψmψGAGAAmψGmψGGmψGGCCAmψGGGCGmψmψAGmψGACAAGAGGGACAmψCmψCGCGAmψ<br>mψmψCmψmψGAGmψCmψAACCCCGmψGAmψGAmψmψGACGCCAAAGAAGmψGmψCmψGCmψGCA<br>CACAGGGCCCGmψmψACmψmψCmψGGGGmψAACCmψmψCCmψGGCAmψGAACAGGCCmψmψmψG<br>GCAmψCCACmψGmψGAAmψGAmψAAGCmψGGAGCmψGCAAGAGmψGmψCmψGGAGCACGGCAGA<br>AmψAGCCAAGmψmψCAGCAAAGmψGAGGACCAmψmψACCACCAGGmψCAAACmψCmψAmψAAAG<br>CAGGGCAAAGACCAGCAmψmψmψCCCCGmψCmψmψCAmψGAACGAGAAGGAGGACAmψCCmψGm<br>ψGGmψGCACmψGAAAmψGGAAAGGGmψGmψmψmψGGCmψmψCCCCGmψCCACmψACACAGACGm | 59611 |

TABLE 41-continued

Full-length RNA sequences of ELXR #1 and ELXR #5 containing the ZIM3-KRAB domain mRNA molecules assessed in experiment #2 of this example. Modification 'mψ' = N1-methyl-pseudouridine.

| ELXR ID | RNA sequence | SEQ ID NO |
|---|---|---|
| | ψGmψCCAACAmψGAGCCGCmψmψGGCGAGGCAGAGACmψGCmψGGGCCGGmψCGmψGGAGCGmψ | |
| | GCCGGmψCAmψCCGCCACCmψCmψmψCGCmψCCGCmψGAAGGAAmψAmψmψmψmψGCmψmψGmψ | |
| | GmψGmψCmψAGCGGCAAmψAGmψAACGCmψAACAGCCGCGGGCCGAGCmψmψCAGCAGCGGCCm | |
| | ψGGmψGCCGmψmψAAGCmψmψGCGCGGCAGCCAmψAmψGGGCCCmψAmψGGAGAmψAmψACAAG | |
| | ACAGmψGmψCmψGCAmψGGAAGAGACAGCCAGmψGCGGGmψACmψGAGCCmψCmψmψCAGAAAC | |
| | AmψCGACAAGGmψACmψAAAGAGmψmψmψGGGCmψmψCmψmψGGAAAGCGGmψmψCmψGGmψmψ | |
| | CmψGGGGGAGGAACGCmψGAAGmψACGmψGGAAGAmψGmψCACAAAmψGmψCGmψGAGGAGGGA | |
| | CGmψGGAGAAAmψGGGGCCCCmψmψmψGACCmψGGmψGmψACGGCmψCGACGCAGCCCCmψAGG | |
| | CAGCmψCmψmψGmψGAmψCGCmψGmψCCCGGCmψGGmψACAmψGmψmψCCAGmψmψCCACCGGA | |
| | mψCCmψGCAGmψAmψGCGCmψGCCmψCGCCAGGAGAGmψCAGCGGCCCmψmψCmψmψCmψGGAm | |
| | ψAmψmψCAmψGGACAAmψCmψGCmψGCmψGACmψGAGGAmψGACCAAGAGACAACmψACCCGCm | |
| | ψmψCCmψmψCAGACAGAGGCmψGmψGACCCmψCCAGGAmψGmψCCGmψGGCAGAGACmψACCAG | |
| | AAmψGCmψAmψGCGGGmψGmψGGAGCAACAmψmψCCAGGGCmψGAAGAGCAAGCAmψGCGCCCC | |
| | mψGACCCCAAAGGAAGAAGAGmψAmψCmψGCAAGCCCAAGmψCAGAAGCAGGAGCAAGCmψGGA | |
| | CGCCCCGAAAGmψmψGACCmψCCmψGGmψGAAGAACmψGCCmψmψCmψCCCGCmψGAGAGAGmψ | |
| | ACmψmψCAAGmψAmψmψmψmψmψCmψCAAAACmψCACmψmψCCmψCmψmψGGCGGmψmψCCGGC | |
| | GGAGGAAmψGAACAAmψmψCCCAGGGAAGAGmψGACCmψmψCGAGGAmψGmψCACmψGmψGAAC | |
| | mψmψCACCCAGGGGGAGmψGGCAGCGGCmψGAAmψCCCGAACAGAGAAACmψmψGmψACAGGGA | |
| | mψGmψGAmψGCmψGGAGAAmψmψACAGCAACCmψmψGmψCmψCmψGmψGGGACAAGGGGAAACC | |
| | ACCAAACCCGAmψGmψGAmψCmvmψGAGGmψmψGGAACAAGGAAAGGAGCCAmψGGmψmψGGAG | |
| | GAAGAGGAAGmψGCmψGGGAAGmψGGCCGmψGCAGAAAAAAAmψGGGGACAmψmψGGAGGGCAG | |
| | AmψmψmψGGAAGCCAAAGGAmψGmψGAAAGAGAGmψCmψCGGAGGGCCGAGCmψCmψGGCGCAC | |
| | CCCCACCAAGmψGGAGGGmψCmψCCmψGCCGGGmψCCCCAACAmψCmψACmψGAAGAAGGCACC | |
| | AGCGAAmψCCGCAACGCCCGAGmψCAGGCCCmψGGmψACCmψCCACAGAACCAmψCmψGAAGGm | |
| | ψAGmψGCGCCmψGGmψmψCCCCAGCmψGGAAGCCCmψACmψmψCCACCGAAGAAGGCACGmψCA | |
| | ACCGAACCAAGmψGAAGGAmψCmψGCCCCmψGGGACCAGCACmψGAACCAmψCmψGAGCAAGAG | |
| | AmψCAAGAGAAmψCAACAAGAmψCAGAAGGAGACmψGGmψCAAGGACAGCAACACAAAGAAGGC | |
| | CGGCAAGACAGGCCCCAmψGAAAACCCmψGCmψCGmψCAGAGmψGAmψGACCCCmψGACCmψGA | |
| | GAGAGCGGCmψGGAAAACCmψGAGAAAGAAGCCCGAGAACAmψCCCmψCAGCCmψψAmCAGCAA | |
| | CACCAGCAGGGCCAACCmψGAACAAGCmψGCmψGACCGACmψACACCGAGAmψGAAGAAAGCCA | |
| | mψCCmψGCACGmψGmψACmψGGGAAGAGmψmψCCAGAAAGACCCCGmψGGGCCmψGAmψGAGCA | |
| | GAGmψmψGCmψCAGCCmψGCCAGCAAGAAGAmψCGACCAGAACAAGCmψGAAGCCCGAGAmψGG | |
| | ACGAGAAGGGCAAmψCmψGACCACAGCCGGCmψmψmψGCCmψGCmψCmψCAGmψGmψGGCCAGC | |
| | CmψCmψGmψmψCGmψGmψACAAGCmψGGAACAGGmψGmψCCGAGAAAGGCAAGGCCmψACACCA | |
| | ACmψACmψmψCGGCAGAmψGmψAACGmψGGCCGAGCACGAGAAGCmψGAmψmψCmψGCmψGGCC | |
| | CAGCmψGAAACCmψGAGAAGGACmψCmψGAmψGAGGCCGmψGACCmψACAGCCmψGGGCAAGmψ | |
| | mψmψGGACAGAGAGCCCmψGGACmψmψCmψACAGCAmψCCACGmψGACCAAAGAAAGCACACAC | |
| | CCCGmψGAAGCCCCmψGGCmψCAGAmψCGCCGGCAAmψAGAmψACGCCmψCmψGGACCmψGmψG | |
| | GGCAAAGCCCmψGmψCCGAmψGCCmψGCAmψGGGAACAAmψCGCCAGCmψmψCCmψGAGCAAGm | |
| | ψACCAGGACAmψCAmψCAmψCGAGCACCAGAAGGmψGGmψCAAGGGCAACCAGAAGAGACmψGG | |
| | AAAGCCmψGAGGGAGCmψGGCCGGCAAAGAGAACCmψGGAAmψACCCCAGCGmψGACCCmψGCC | |
| | mψCCmψCAGCCmψCACACAAAAGAAGGCGmψGGACGCCmψACAACGAAGmψGAmψCGCCAGAGm | |
| | ψGAGAAmψGmψGGGmψCAACCmψGAACCmψGmψGGCAGAAGCmψGAAACmψGmψCCAGGGACGA | |
| | CGCCAAGCCmψCmψGCmψGAGACmψGAAGGGCmψmψCCCmψAGCmψmψCCCmψCmψGGmψGGAA | |
| | AGACAGGCCAAmψGAAGmψGGAmψmψGGmψGGGACAmψGGmψCmψGCAACGmψGAAGAAGCmψG | |
| | AmψCAACGAGAAGAAAGAGGAmψGGCAAGGmψmψmψmψCmψGGCAGAACCmψGGCCGGCmψACA | |
| | AGAGACAAGAAGCCCmψGAGGCCmψmψACCmψGAGCAGCGAAGAGGACCGGAAGAAGGGCAAGA | |
| | AGmψmψCGCCAGAmψACCAGCmψGGGCGACCmψGCmψGCmψGCACCmψGGAAAAGAAGCACGGC | |
| | GAGGACmψGGGGCAAAGmψGmψACGAmψGAGGCCmψGGGAGAGAAmψCGACAAGAAGGmψGGAA | |
| | GGCCmψGAGCAAGCACAmψmψAAGCmψGGAAGAGGAAAGAAGGAGCGAGGACGCCCAAmψCmψA | |
| | AAGCCGCmψCmψGACCGAmψmψGGCmψGAGAGCCAAGGCCAGCmψmψmψGmψGAmψCGAGGGCC | |
| | mψGAAAGAGGCCGACAAGGACGAGmψmψCmψGCAGAmψGCGAGCmψGAAGCmψGCAGAAGmψGG | |
| | mψACGGCGAmψCmψGAGAGGCAAGCCCmψmψCGCCAmψmψGAGGCCGAGAACAGCAmψCCmψGG | |
| | ACAmψCAGCGGCmψmψCAGCAAGCAGmψACAACmψGCGCCmψmψCAmψmψmψGGCAGAAAGACG | |
| | GCGmψCAAGAAACmψGAACCmψGmψACCmψGAmψCAmψCAAmψmψACmψmψCAAAGGCGGCAAG | |
| | CmψGCGGmψmψCAAGAAGAmψCAAACCCGAGGCCmψmψCGAGGCmψAACAGAmψmψCmψACACC | |
| | GmψGAmψCAACAAAAAGmψCCGGCGAGAmψCGmψGCCCAmψGGAAGmψGAACmψmψCAACmψmψ | |
| | CCAAmψGGCAGAGmψGAmψCGAGAAAACCCmψGmψACAACAGGAGAACCAGACAGGACGAGCCm | |
| | CGACGACCCCAACCmψGAmψmψAmψCCmψGCCmψCmψGGCCmψmψCGGCAAGAGACAGGGCAGA | |
| | GAGmψmψCAmψCmψGGAACGAmψCmψGCmψGAGCCmψGGAAACCGGCmψCmψCmψGAAGCmψGG | |
| | CCAAmψGGCAGAGmψGAmψCGAGAAAACCCmψGmψACAACAGGAGAACCAGACAGGACGAGCCm | |
| | ψGCmψCmψGmψmψmψGmψGGCCCmψGACCmψmψCGAGAGAAGAGAGGmψGCmψGGACAGCAGCA | |
| | ACAmψCAAGCCCAmψGAACCmψGAmψCGGCGmψGGCCCGGGGCGAGAAmψAmψCCCmψGCmψGm | |
| | ψGAmψCGCCCmψGACAGACCCmψGAAGGAmψGCCCACmψGAGCAGAmψmψCAAGGACmψCCCmψ | |
| | GGGCAACCCmψACACACAmψCCmψGAGAAmψCGGCGAGAGCmψACAAAGAGAAGCAGAGGACAA | |
| | mψCCAGGCCAAGAAAGAGGmψGGAACAGAGAAGAGCCGGCGGAmψACmψCmψAGGAAGmψACGC | |
| | CAGCAAGGCCAAGAAmψCmψGGCCGACGACAmψGGmψCCGAAACACCGCCAGAGAmψCmψGCmψ | |
| | GmψACmψACGCCGmψGACACAGGACGCCAmψGCmψGAmψCmψmψCGCGAAmψCmψGAGCAGAGG | |
| | CmψmψCGGCCGGCAGGGCAAGAGAACCmψmψmψAmψGGCCGAGAGGCAGmψACACCAGAAmψGG | |
| | AAGAmψmψGGCmψCACAGCmψAAACmψGGCCmψACGAGGGACmψGAGCAAGACCmψACCmψGmψ | |
| | CCAAAACACmψGGCCCAGmψAmψψACCmψCCAAGACCmψGCAGCAAmψmψGCGGCmψmCACCAm | |
| | ψCACCAGCGCCGACmψACGACAGAGmψGCmψGGAAAAGCmψCAAGAAAACCGCCACCGGCmψGG | |
| | AmψGACCACCAmψCAACGGCAAAGAGCmψGAAGGmψmψGAGGGCCAGAmψCACCmψACmψACAA | |

TABLE 41-continued

Full-length RNA sequences of ELXR #1 and ELXR #5 containing the ZIM3-KRAB domain mRNA molecules assessed in experiment #2 of this example. Modification 'mψ' = N1-methyl-pseudouridine.

| ELXR ID | RNA sequence | SEQ ID NO |
|---|---|---|
| | CAGGmψACAAGAGGCAGAACGmψCGmψGAAGGAmψCmψGAGCGmψGGAACmψGGACAGACmψGA GCGAAGAGAGCGmψGAACAACGACAmψCAGCAGCmψGGACAAAGGGCAGAmψCAGGCGAGGCmψ CmψGAGCCmψGCmψGAAGAAGAGGmψmψmψAGCCACAGACCmψGmψGCAAGAGAAGmψmψCGmψ GmψGCCmψGAACmψGCGGCmψmψCGAGACACACGCCGCmψGAACAGGCmψGCCCmψGAACAmψm ψGCCAGAAGCmψGGCmψGmψmψCCmψGAGAAGCCAAGAGmψACAAGAAGmψACCAGACCAACAA GACCACCGGCAACACCGACAAGAGGGCCmψmψmψGmψGGAAACCmψGGCAGAGCmψmψCmψACA GAAAAAAGCmψGAAAGAAGmψCmψGGAAGCCCGCCGmψGCGAmψCGGGCGGmψmψCCGGCGGAG GmψmψCCACmψAGmψCCAAAAAAGAAGAGAAAGGmψAGAmψmψACAAAGAmψGACGAmψGACAA AGACmψACAAGGAmψGAmψGAmψGAmψAAGGGAmψCCGGCmψGAAAAAAAAAAAAAAAAAAAAA AAAAAAAAAAAAAAAAAAAAAAAAAAAAAAAAAAAAAAAAAAAAAAAAAAAAAAAAAAAAAA AAAAAAAAAAAAAAAAAAAAAAAAAAAAAAAAAAA | |

For experiment #2, synthesis of PCSK9-targeting gRNAs was performed as described above for experiment #1, and the sequences of the targeting spacers are listed in Table 39. For pairing with dCas9-ZNF10-DNMT3A/3L, targeting spacers were as follows: 1) 7.148 (B2M, as non-targeting control; SEQ ID NO: 57645), 27.126 (PCSK9; CACGCCACCCCGAGCCCCAU; SEQ ID NO: 60013), and 27.128 (PCSK9; CAGCCUGCGCGUCCACGUGA; SEQ ID NO: 60014).

Transfection of mRNA and gRNA into Hepa1-6 Cells and Intracellular PCSK9 Staining:

Seeded Hepa1-6 cells treated with the NATE™ inhibitor were lipofected with 300 ng of mRNA encoding ELXR #1 with the ZIM3-KRAB, ELXR #5 with the ZIM3-KRAB, catalytically-active CasX 491, or dCas9-ZNF10-DNMT3A/3L, and 150 ng of PCSK9-targeting gRNA (Table 39). Intracellular levels of PCSK9 protein were measured at day 7 and day 14 post-transfection using an intracellular staining protocol as described earlier for experiment #1.

Results

Figure 28:
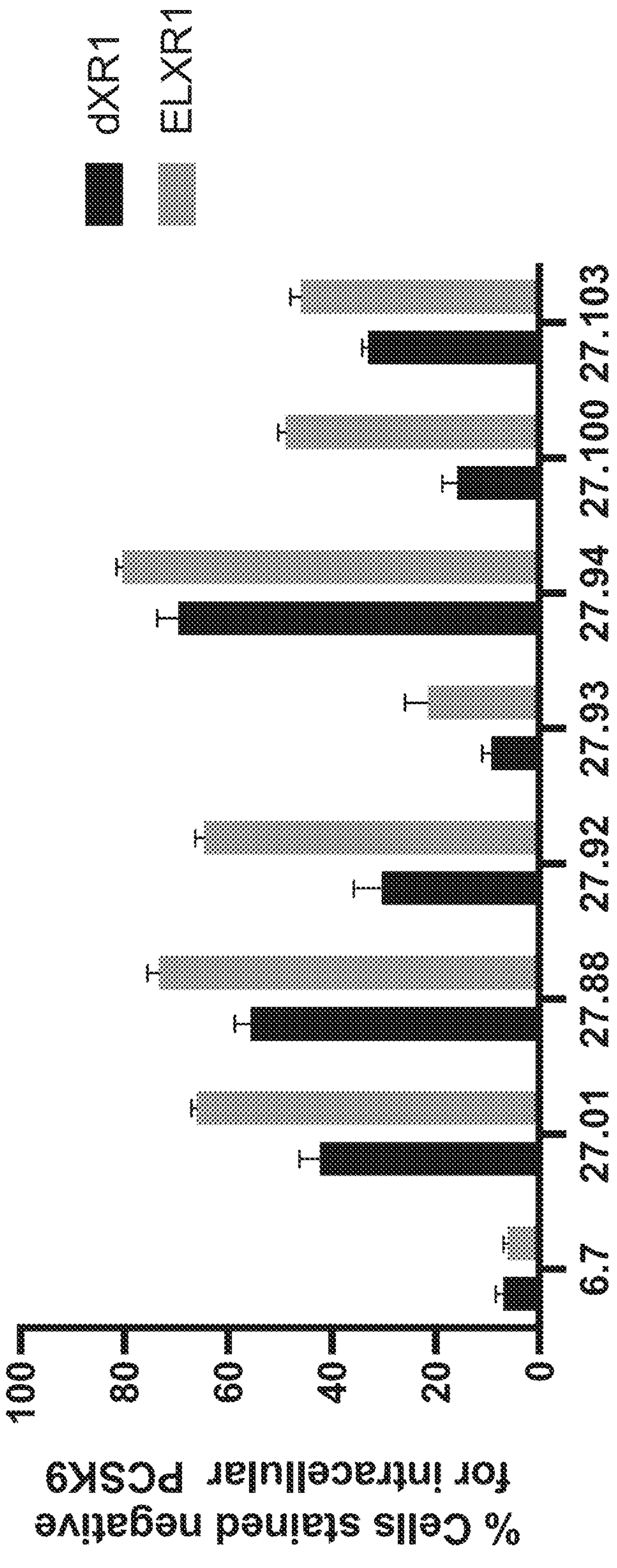
FIG. 28 is a bar plot showing the percentage of mouse Hepa1-6 cells, treated with either dXR1 or ELXR1-ZIM3 mRNA paired with the indicated PCSK9-targeting gRNAs, that stained negative for intracellular PCSK9 at day 6, as described in Example 14. Spacer 6.7 targeting the human PCSK9 locus served as a non-targeting control.
Figure 29:
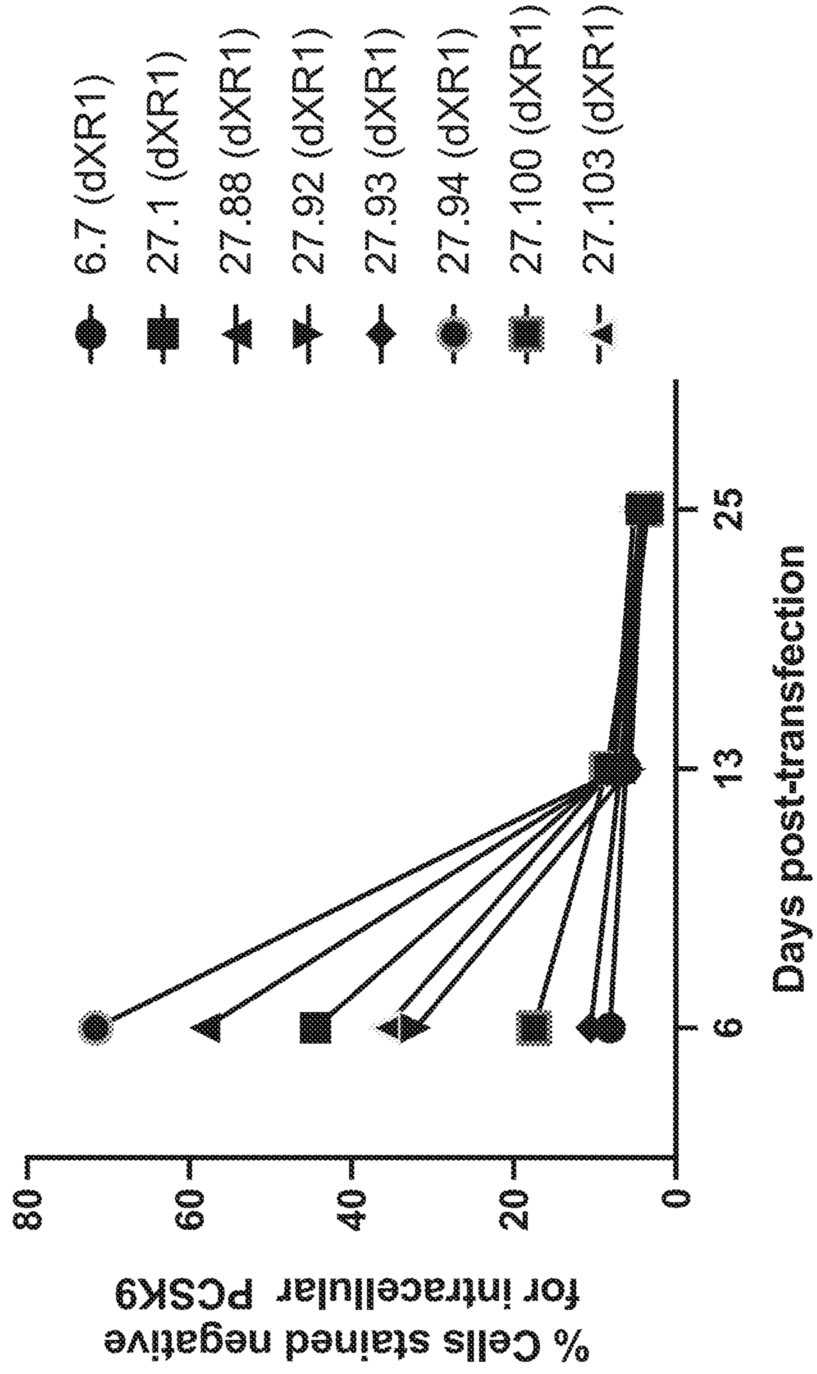
FIG. 29 is a time course plot showing the percentage of mouse Hepa1-6 cells, treated with dXR1 mRNA paired with the indicated PCSK9-targeting gRNAs, that stained negative for intracellular PCSK9 at 6, 13, and 25 days post-delivery, as described in Example 14. Spacer 6.7 targeting the human PCSK9 locus served as a non-targeting control, and treatment with water served as a negative control.
Figure 30:
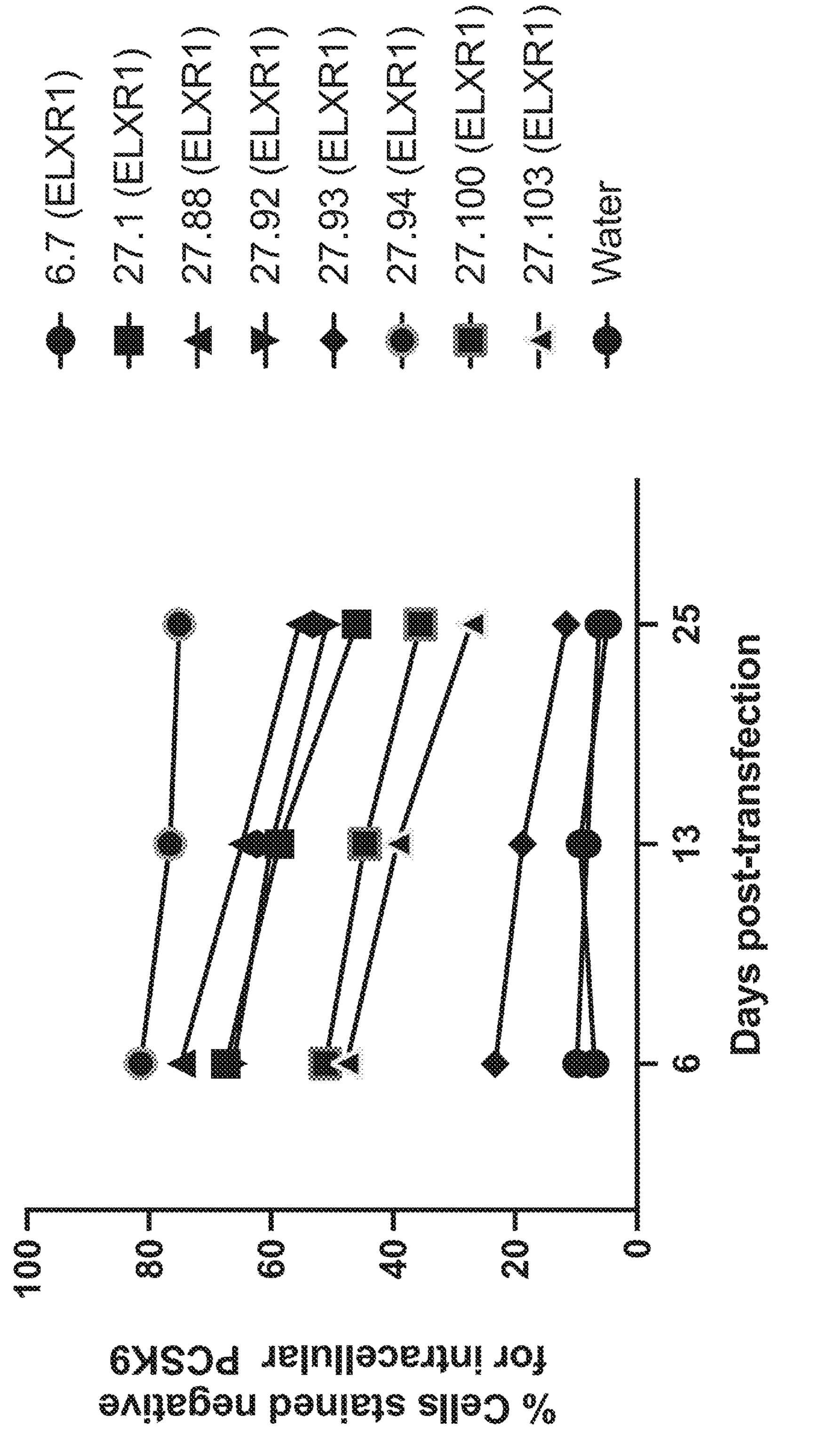
FIG. 30 is a time course plot showing the percentage of mouse Hepa1-6 cells, treated with ELXR1-ZIM3 mRNA paired with the indicated PCSK9-targeting gRNAs, that stained negative for intracellular PCSK9 at 6, 13, and 25 days post-delivery, as described in Example 14. Spacer 6.7 targeting the human PCSK9 locus served as a non-targeting control, and treatment with water served as a negative control.

In experiment #1, mRNAs encoding dXR1 or ELXR #1 containing the ZIM3-KRAB domain were co-transfected with a PCSK9-targeting gRNA into mouse Hepa1-6 cells to assess their ability to induce PCSK9 knockdown by silencing the mouse PCSK9 locus. The quantification of the resulting PCSK9 knockdown is shown in FIGS. 28-30. The data demonstrate that at day 6, use of six out of seven gRNAs targeting the mouse PCSK9 locus with ELXR #1 mRNA resulted in >50% knockdown of intracellular PCSK9, with the top spacer 27.94 achieving>80% repression level (FIG. 28). A similar trend was observed with use of dXR1 mRNA at day 6, although the degree of repression was less substantial when paired with certain spacers, such as spacer 27.92 and 27.100 (FIG. 28). The results also demonstrate that use of ELXR #1 mRNA led to sustained repression of the PCSK9 locus through at least 25 days, with use of the top spacers 27.94 and 27.88 showing the strongest permanence in silencing PCSK9 (FIG. 30). However, the PCSK9 repression mediated by dXR1 that was observed at day 6 reverted to similar levels of PCSK9 as detected with the non-targeting control (spacer 6.7) by day 13; such transient repression was noticeable for all gRNAs assayed that targeted the mouse PCSK9 gene (FIG. 29).

Figure 31:
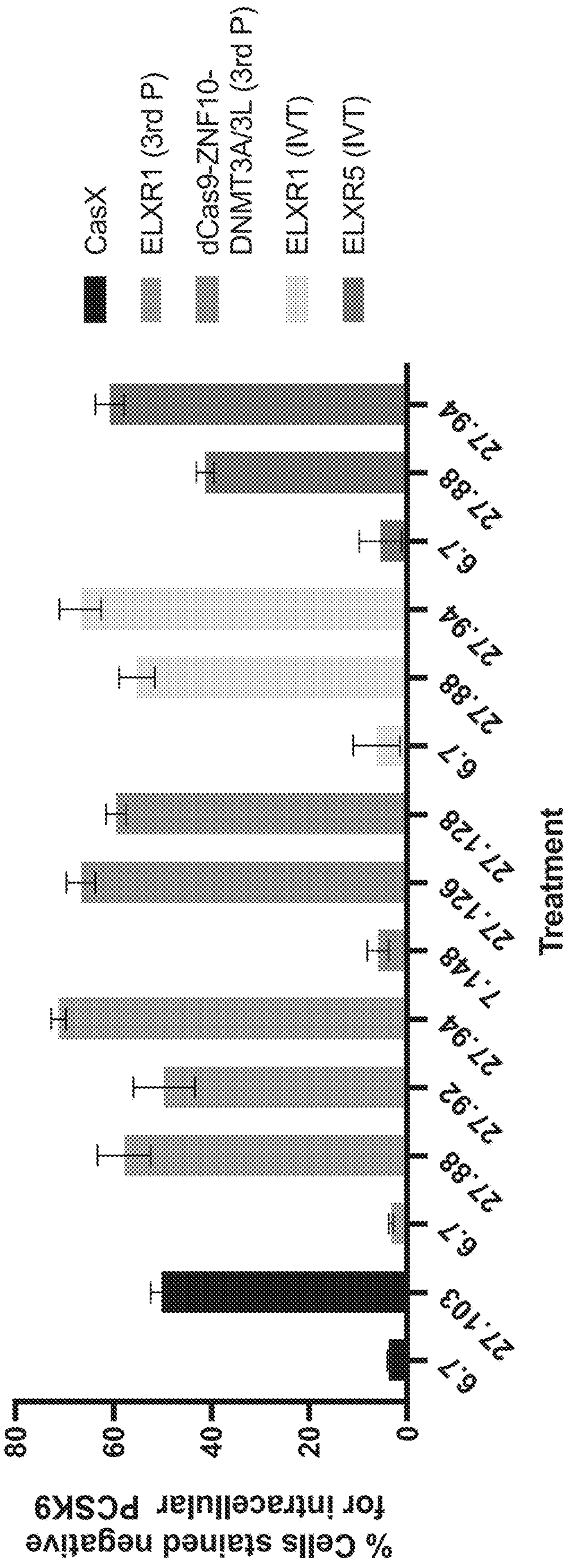
FIG. 31 is a bar plot showing the percentage of mouse Hepa1-6 cells, treated with ELXR1-ZIM3, ELXR5-ZIM3, catalytically active CasX491, or dCas9-ZNF10-DNMT3A/3L mRNA paired with the indicated PCSK9-targeting gRNAs, that stained negative for intracellular PCSK9 at day 7, as described in Example 14. Spacer 6.7 targeting the human PCSK9 locus served as a non-targeting control. Production of mRNA by in-house IVT or a third-party is indicated in parentheses.
Figure 32:
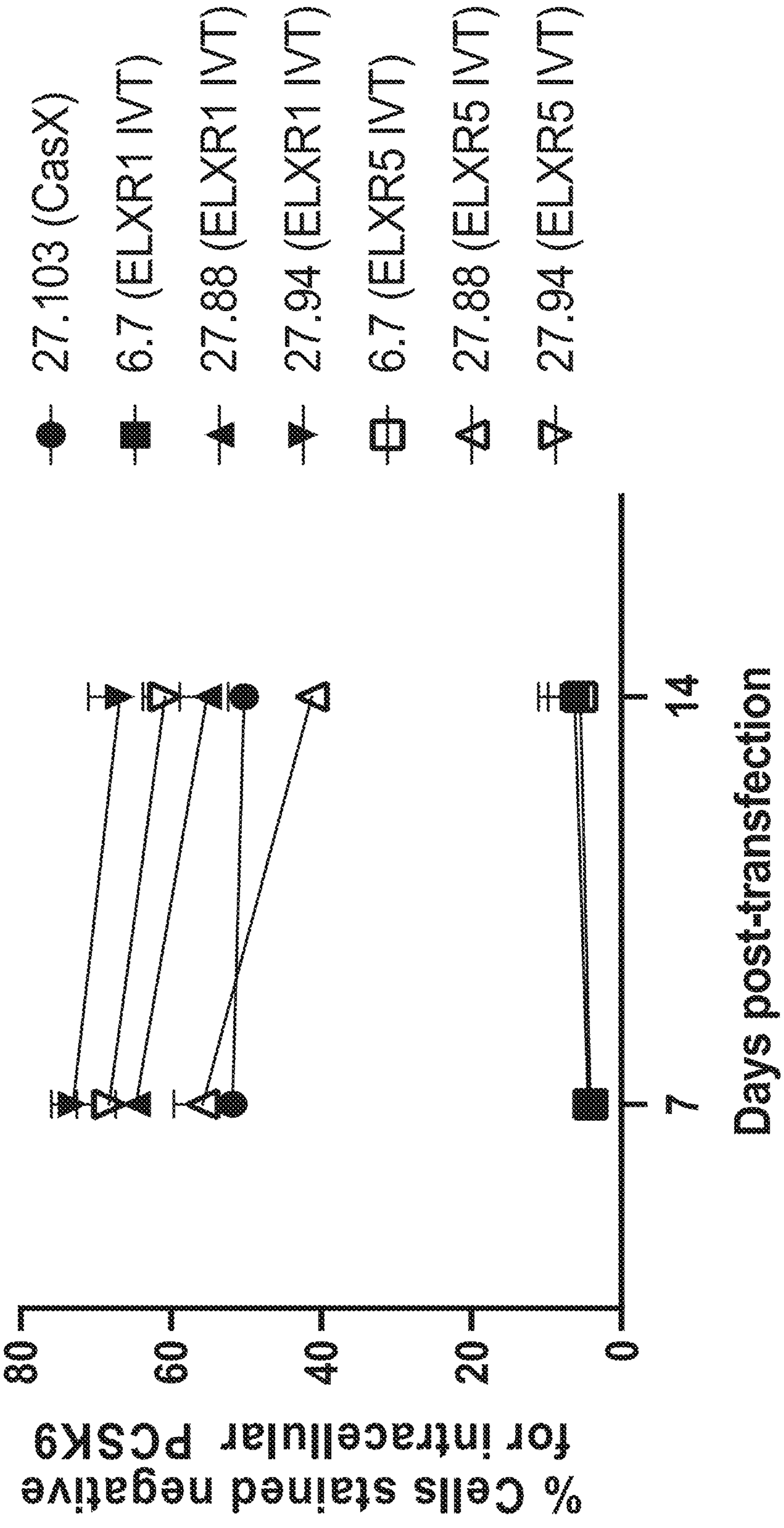
FIG. 32 is a time course plot showing the percentage of mouse Hepa1-6 cells, treated with IVT-produced ELXR1-ZIM3 vs. ELXR5-ZIM5 mRNA paired with the indicated PCSK9-targeting gRNAs, that stained negative for intracellular PCSK9 at 7 and 14 days post-delivery, as described in Example 14.
Figure 33:
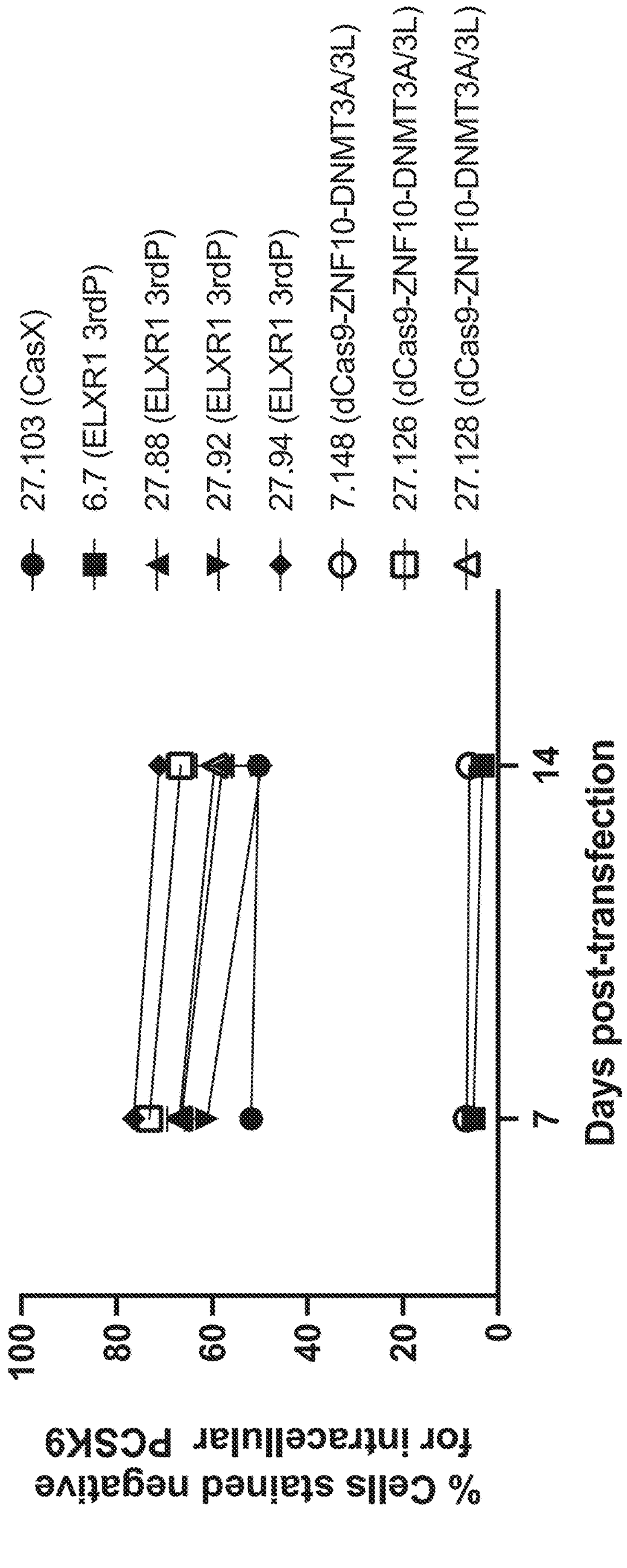
FIG. 33 is a time course plot showing the percentage of mouse Hepa1-6 cells, treated with third-party-produced ELXR1-ZIM3 vs. dCas9-ZNF10-DNMT3A/3L mRNA paired with the indicated PCSK9-targeting gRNAs, that stained negative for intracellular PCSK9 at 7 and 14 days post-delivery, as described in Example 14.

In experiment #2, mRNAs encoding ELXR #1 or ELXR #5 containing the ZIM3-KRAB domain, dCas9-ZNF10-DNMT3A/3L, or catalytically active CasX491 were co-transfected with a PCSK9-targeting gRNA into mouse Hepa1-6 cells to assess their ability to induce PCSK9 knockdown by silencing the mouse PCSK9 locus. The quantification of the resulting PCSK9 repression is shown in FIGS. 31-33. The data demonstrate that delivery of IVT-produced ELXR #1 or ELXR #5 mRNA resulted in comparable levels of sustained PCSK9 knockdown when paired with a targeting gRNA with the top spacer 27.94 (>70%), while use of gRNA with spacer 27.88 resulted in slightly higher repression with ELXR #1 than with ELXR #5 (FIGS. 31-33). Furthermore, third-party-produced mRNA encoding ELXR #1 and dCas9-ZNF10-DNMT3A/3L led to similar levels (>70%) of durable PCSK9 knockdown when paired with gRNAs containing the top spacers (FIGS. 31-33).

These experiments demonstrate that ELXR molecules, having different configurations, can induce heritable silencing of an endogenous locus in a mouse liver cell line. Meanwhile, as anticipated, use of dXR constructs result in efficient repression of the target locus at early timepoints, but their use does not lead to durable silencing. These findings also show that dXR and ELXR molecules (of different configurations) can be delivered as mRNA and co-transfected with a targeting gRNA to cells, indicating that the transient nature of this delivery modality is still sufficient to induce silencing.

Example 15: ELXR mRNA and Targeting gRNA can be Delivered Via LNPs to Achieve Repression of Target Locus In Vitro Experiments will be performed to demonstrate that delivery of lipid nanoparticles (LNPs) encapsulating ELXR mRNA and targeting gRNA will induce durable repression of a target endogenous locus in a cell-based assay.

Materials and Methods:

Generation of ELXR mRNAs:

mRNA encoding an ELXR molecule will be generated by IVT, as described earlier in Example 14. Sequences encoding the ELXR molecule will be codon-optimized as briefly described in Example 14. Examples of DNA sequences encoding ELXR mRNA are listed in Table 36 and Table 40, with the corresponding mRNA sequences listed in Table 37 and Table 41. Additional examples of DNA sequences encoding ELXR mRNA are presented in Table 42 below, with their corresponding mRNA sequences shown in Table 43.

TABLE 42

Encoding sequences of additional ELXR mRNA molecules that may be assessed*.

| ELXR ID | Component | DNA SEQ ID NO |
| --- | --- | --- |
| ELXR1-ZIM3_vs2 | 5'UTR | 59568 |
| | START codon + NLS + linker | 59612 |
| | START codon + DNMT3A catalytic domain | 59580 |
| | Linker | 59581 |
| | DNMT3L interaction domain | 59582 |
| | Linker | 59583 |
| | dCasX491 | 59570 |
| | Linker | 59571 |
| | ZIM3-KRAB | 59572 |
| | Buffer sequence + NLS | 59613 |
| | STOP codons + buffer sequence | 59575 |
| | 3'UTR | 59576 |
| | Buffer sequence | 59577 |
| | Poly(A) tail | 59578 |
| ELXR5-ZIM3 | 5'UTR | 59568 |
| | START codon + NLS + linker | 59614 |
| | START codon + DNMT3A catalytic domain | 59580 |
| | Linker | 59581 |
| | DNMT3L interaction domain | 59582 |
| | Linker | 59615 |
| | ZIM3-KRAB | 59572 |
| | Linker | 59616 |
| | dCasX491 | 59570 |
| | Buffer + linker | 59617 |
| | NLS + STOP codon + buffer sequence | 59618 |
| | 3'UTR | 59576 |
| | Buffer sequence | 59577 |
| | Poly(A) tail | 59618 |
| ELXR5-ZIM3 + ADD | 5'UTR | 59568 |
| | START codon + NLS + linker | 59614 |
| | START codon + DNMT3A ADD domain | 59620 |
| | DNMT3A catalytic domain | 59621 |
| | Linker | 59581 |
| | DNMT3L interaction domain | 59582 |
| | Linker | 59615 |
| | ZIM3-KRAB | 59572 |
| | Linker | 59616 |
| | dCasX491 | 59570 |
| | Buffer + linker | 59617 |
| | NLS + STOP codon + buffer sequence | 59618 |
| | 3'UTR | 59576 |
| | Buffer sequence | 59577 |
| | Poly(A) tail | 59619 |

*Components are listed in a 5' to 3' order within the constructs

TABLE 43

Full-length RNA sequences of additional ELXR mRNA molecψles in Table 42 for assessment. Modification 'mψ' = N1-methyl-pseudouridine.

| ELXR ID | RNA sequence | SEQ ID NO |
| --- | --- | --- |
| ELXR 1-ZIM3_vs2 | AAAmψAAGAGAGAAAAGAAGAGmψAAGAAGAAAmψAmψAAGAGCCACCAmψGGCCCCCGCCGCCAAGAGAGmψGAAGCmψGGAmψmψCCCGGGmψGAAmψGGCAGCGGCAGCGGGGGCGGCAmψGAACCACGACCAGGAGmψmψCGACCCCCCmψAAGGmψGmψACCCmψCCCGmψCCCCGCCGAGAAGAGAAAGCCCAmψCCGGGmψCCmψGAGCCmψGmψmψCGAmψGGCAmψCGCCACCGGmψCmψGCmψGGmψGCmψGAAGGACCmψGGGCAmψCCAGGmψGGAmψAGGmψACAmψmψGCCmψCCGAGGmψGmψGCGAGGACmψCCAmψCACCGmψGGGAAmψGGmψGCGmψCAmψCAGGGCAAGAmψCAmψGmψACGmψGGGCGACGmψGCGGAGCGmψGACACAGAAGCAmψAmψCCAGGAGmψGGGGCCCmψmψmψCGACCmψGGmψGAmψCGGCGGCAGCCCmψmψGCAAmψGACCmψGAGCAmψCGmψGAACCCAGCCCGGAAGGGCCmψGmψACGAGGGAACCGGCAGACmψGmψmψCmψmψCGAGmψmψmψmψACAGACmψGCmψGCACGACGCCCGGCCmψAAGGAAGGCGACGACCGGCCCmψmψCmψmψmψmψGGCmψGmψmψCGAGAAmψGmψGGmψGGCCAmψGGGAGmψCAGCGACAAGCGGGAmψAmψmψAGCCGGmψmψCCmψGGAGAGCAACCCCGmψGAmψGAmψCGAmψGCCAAGGAAGmψGAGCGCCGCCCACCGGGCCAGAmψACmψmψCmψGGGGCAAmψCmψGCCmψGGCAmψGAACAGACCCCmψGGCCAGCACCGmψGAACGACAAGCmψGGAGCmψGCAGGAGmψGCCmψGGAGCACGGCCGGAmψCGCCAAGmψmψCAGCAAGGmψGAGAACCAmψCACCACCCGAAGCAACAGCAmψCAAACAAGGCAAGGACCAGCACmψmψmψCCmψGmψGmψmψCAmψGAACGAGAAGGAGGACAmψCCmψGmψGGmψGmψACCGAGAmψGGAGAGAGmψGmψmψCGGGmψmψCCCAGmψCCACmψACACAGAmψGmψCAGCAACAmψGmψCmψAGACmψGGCCAGACAGAGACmψGCmψGGGAAGAAGCmψGGmψCCGmψCCCmψGmψGAmψCAGACACCmψGmψmψCGCCCCmψCmψGAAGGAGmψACmψmψCGCCmψGCGmψGAGCAGCGGCAACAGCAACGCCAACAGCCGGGGCCCCAGCmψmψCmψCmψAGCGGCCmψGGmψGCCACmψGmψCCCmψGAGAGGGAGCCACAmψGGGCCCCAmψGGAGAmψCmψACAAAACCGmψGAGCGCCmψGGAAGCGGCAGCCmψGmψGCGCGmψGCmψGAGCCmψGmψmψmψCGGAAmψAmψCGAmψAAAGmψCCmψGAAAAGCCmψGGGAmψmψCCmψGGAGAGCGGCmψCmψGGCmψCCGGCGGmψGGCACCCmψGAAGmψACGmψGGAGGAmψGmψGACAAACGmψGGmψCAGACGGGAmψGmψGGAGAAGmψGGGGCCCCmψmψCGAmψCmψGGmψGmψACGGCAGCACCCAACCCCmψGGGCAGCmψCmψmψGmψGACCGGmψGCCCmψGGCmψGGmψACAmψGmψmψmψCAGmψmψCCACCGGAmψCCmψGCAGmψACGCCCmψGCCGAGACAGGAGmψCCCAGCGGCCAmψmψCmψmψmψmψGGAmψmψmψmψCAmψGGACAACmmψGCmψGCmψGACCCGAGGAmψGACCAGGAAACmψACCACmψCGGmψmψCCmψGCaGACCGAAGCCGmψGACCCmψGCAGGACGmψGAGAGGCCGGGACmψACCAGAACGCCAmψGCGGGmψGmψGGmψCCAACAmψCCCmψGGACmψGAAAAGCAAGCACGCACCmψCmψGACCCCmψAAAGAAGAGGAGmψACCmψGCAGGCCCAGGmψGCGGAGCAGAAGCAAGCmψGGACGCCCCmψAAGGmψGGAmψCmψGCmψGGmψGAAGAAmψmψGCCmψCCmψGCCCCmψGAGAGAGmvACmψmψCAAGmψAmψmψmψCAGCCAGAAmψAGmψCmψGCCCCmψGGGCGGCCCAAGCAGCGGCGCCCCmψCCmψCCCAGCGGCGGCAGCCCAGCCGGCmψCCCCAACCmψCmψACCGAGGAGGGCACCmψCmψGAGmψCCGCCACCCCCGAGAGCGGCCCmψGGCACCmψCCACCGAGCCCAGCGAGGGCAGCGCACCCGGCAGCCCmψGCCGGCAGCCCCACCmψCCACAGAGGAGGGAACCAGCACCGAGCCCAGCGAAGGCAGCGCCCCAGGCACCAGCACCGAGCCmψAGmψGAGGGCGGCmψCmψGGCGGCGGCAGCGCCCAGGAGAmψmψAAACGGAmψCAACAAGAmψCAGAAGAAG | 59622 |

TABLE 43-continued

| Full-length RNA sequences of additional ELXR mRNA molecψles in Table 42 for assessment. Modification 'mψ' = N1-methyl-pseudouridine. | | |
|---|---|---|
| ELXR ID | RNA sequence | SEQ ID NO |
| | ACmψmψGmψGAAAGACAGCAACACCAAGAAGGCCGGCAAGACAGGCCCCAmψGAAAACCCmψGC<br>mψGGmψmψAGAGmψGAmψGACACCCGAmψCmψGAGAGAGCGGCmψGGAAAACCmψGAGAAAGAA<br>GCCmψGAAAAmψAmψCCCCCAGCCCAmψCAGCAAmψACAmψCmψAGAGCCAACCmψGAAmψAAG<br>CmqGCmψGACCGAmψmψACACCGAAAψGAAGAAGGCGAmψCCmψGCAmψGmψψGmψACmψGGGA<br>AGAGmψmψCCAGAAGGACCCmψGmψGGGCCmψGAmψGAGCCGGGmψGGCCCAGCCmψGCCAGCA<br>AGAAGAmψCGAmψCAGAACAAGCmψGAAACCmψGAGAmψGGACGAGAAGGGCAACCmψGACCAC<br>CGCCGGCmψmψmψGCCmψGCmψCmψCAGmψGmψGGCCAGCCCCmψGmψmψCGmψGmψACAAGCm<br>ψGGAGCAGGmψGmψCmψGAGAAGGGCAAGGCmψmψACACCAACmψACmψmψCGGACGGmψGCAA<br>mψGmψGGCCGAGCACGAAAAGCmψGAmψCCmψGCmψGGCCCAGCmψGAAGCCCGAGAAGGAmψA<br>GCGACGAAGCCGmψGACAmψAmψAGCCmψGGGAAAGmψmψmψGGGCAGAGGGCCCmψGGAmψmψ<br>mψCmψACAGCAmψmψCAmψGmψGACCAAGGAGmψCCACCCACCCCGmψGAAGCCCCmψGGCCCA<br>GAmψCGCCGGAAACAGAmψACGCCmψCCGGACCmψGmψGGGAAAGGCCCmψGAGCGACGCAmψG<br>mψAmψGGGCACAAmψCGCCmψCCmψmψCCmψGmψCmψAAGmψACCAGGACAmψCAmψCAmψCGA<br>ACACCAGAAGGmψGGmψGAAGGGCAACCAGAAGAGACmψGGAGAGCCmψGCGGGAGCmψGGCCG<br>GCAAGGAAAACCmψGGAAmψACCCmψAGCGmψGACCCmψGCCACCmψCAGCCmψCACACCAAGG<br>AGGGCGmψmψGAmψGCCmψACAACGAAGmψGAmψCGCCCGGGmψGCGAAmψGmψGGGmψGAACC<br>mψGAACCmψGmψGGCAGAAGCmψGAAGCmψAAGCAGAGAmψGAmψGCCAAGCCmψCmψGCmψGA<br>GACmψGAAGGGAmψmψCCCmψmψCCmψmψmψCCmψCmψGGmψCGAGAGACAGGCCAACGAAGmψ<br>GGACmψGGmψGGGACAmψGGmψGmψGmψAACGmψGAAGAAGCmψGAmψCAACGAGAAAAAGGAG<br>GAmψGGCAAGGmψGmψmψmψmψGGCAGAAmψCmψGGCmψGGCmψACAAGAGACAGGAAGCCCmψ<br>GAGACCAmψACCmψGAGCAGCGAGGAAGAmψCGGAAGAAGGGAAAGAAAmψmψCGCmψCGGmψA<br>CCAGCmψGGGCGACCmψGCmψGCmψGCACCmψGGAAAAGAAGCACGGCGAGGACmψGGGGAAAG<br>GmψGmψACGACGAGGCCmψGGGAGCGGAmψmψGACAAGAAAGmψGGAAGGCCmψGAGCAAGCAC<br>AmψCAAGCmψGGAAGAGGAACGGAGAAGCGAGGACGCCCAGAGCAAGGCCGCCCmψGACCGACm<br>ψGGCmψGCGGGCmψAAGGCCAGCmψmψCGmψGAmψCGAGGGCCmψGAAGGAGGCCGACAAGGAC<br>GAGmψmψCmψGCAGAmψGCGAGCmψGAAGCmψGCAGAAGmψGGmψACGGGGACCmψGCGGGGAA<br>AGCCCmψmψCGCCAmψCGAAGCCGAGAACAGCAmψCCmψGGACAmψCAGCGGCmψmψCAGCAAG<br>CAGmψACAACmψGmψGCCmψmψCAmψCmψGGCAGAAGGACGGCGmψGAAGAAGCmψGAACCmψG<br>mψACCmψGAmψCAmψCAACmψACmψmψCAAGGGCGGCAAGCmGCGGmψψmψCAAGAAGAmψCAA<br>ACCmψGAAGCCmψmψCGAAGCCAACAGAmψmψCmψACACCGmψGAmψCAACAAAAAGAGCGGCG<br>AGAmψCGmψGCCCAmψGGAGGmψGAACmψmψCAACmψmψCGACGACCCCAACCmψGAmψCAmψC<br>CmψGCCmψCmψGGCCmψmψmψGGCAAGAGACAGGGCAGAGAAmψmψCAmψCmψGGAACGACCmψ<br>GCmψGmψCCCmψGGAAACCGGCAGCCmψGAAGCmψGGCCAACGGAAGAGmψGAmψCGAGAAGAC<br>ACmψGmψACAACAGAAGAACCCGGCAGGAmψGAGCCmψGCCCmψGmψmψCGmψGGCCCmψGACC<br>mψmψCGAGCGGCGGGAGGmψCCmψGGACmψCCmψCCAAmψAmψCAAACCAAmψGAACCmψGAmψ<br>CGGCGmψGGCAAGAGGCGAAAACAmψCCCCGCCGmψGAmψCGCCCmψGACCGACCCCGAGGGCm<br>ψGCCCACmψGAGCCGGmψmψmψAAGGAmψAGCCmψGGGAAACCCAACCCACAmψCCmψGAGAAm<br>ψCGGCGAGAGCmψAmψAAGGAGAAGCAGCGGACCAmψCCAGGCCAAGAAGGAGGmψGGAGCAGC<br>GGAGAGCCGGCGGCmψACAGCCGGAAGmψACGCCAGCAAAGCCAAGAAmψCmψGGCAGACGAmψ<br>AmψGGmψGAGAAACACCGCmψAGAGAmψCmψGCmψGmψACmψACGCCGmψGACCCAGGAmψGCC<br>AmψGCmψGAmψCmψmψCGCCAACCmψGAGCCGGGGCmψmψCGGCCGGCAGGGCAAGCGGACCmψ<br>mψCAmψGGCCGAGAGACAGmψACACACGGAmψGGAGGACmψGGCmψGACCGCCAAGCmψGGCCm<br>ψACGAGGGCCmψGAGCAAGACCmψACCmψGmψCCAAGACACmψGGCCCAGmψACACCmψCCAAG<br>ACAmψGCAGCAACmψGmψGGGmψmψmψACCAmψCACCAGCGCCGACmψACGACAGGGmψGCmψG<br>GAGAAGCmψGAAGAAGACAGCAACAGGCmψGGAmψGACCACAAmψmψAACGGCAAGGAGCmψGA<br>AGGmψGGAGGGCCAGAmψmψACCmψACmψACAACAGAmψACAAGAGACAGAACGmψAGmψCAAG<br>GACCmψGmψCCGmψCGAGCmψGGAmψAGACmψGAGCGAAGAAmψCmψGmψGAACAACGACAmψC<br>mψCCmψCCmψGGACAAAGGGCAGAAGCGGAGAAGCmψCmψGAGCCmψCCmψGAAGAAAAGAmψm<br>ψCmψCCCAmψAGACCCGmψGCAGGAGAAGmψmψCGmψGmψGCCmψGAACmψGCGGCmψmψCGAG<br>ACACACGCAGCCGAGCAAGCCGCCCmψGAACAmψCGCCAGAmψCCmψGGCmψGmψmψCCmψGCG<br>GAGCCAGGAGmψACAAGAAAmψACCAGACAAACAAGACAACCGGCAACACCGAmψAAGAGAGCC<br>mψmψCGmψCGAGACCmψGGCAGmψCCmψmψmψmψACCGGAAGAAGCmψmψAAGGAGGmψGmψGG<br>AAACCmψGCCGmψGCGGmψCmψGGCGGAmψCmψGGCGGAGGCmψCCACAAGCAmψGAACAACmψ<br>CCCAGGGCAGAGmψGACCmψmψCGAGGACGmψGACCGmψGAAmψmψmψmψACACAGGGAGAGmψ<br>GGCAGAGACmψGAACCCCGAGCAGAGAAACCmψGmψACCGGGAmψGmψGAmψGCmψGGAAAACm<br>ψACAGCAAmψCmψGGmψGmψCCGmψGGGCCAGGGCGAGACCACAAAGCCmψGACGmψGAmψCCm<br>ψGCGmψCmψGGAGCAGGGCAAGGAACCCmψGGCmψGGAGGAGGAGGAGGmψGCmψGGGAAGCGG<br>ACGGGCCGAGAAGAACGGCGACAmψCGGCGGACAGAmψCmψGGAAGCCmψAAGGACGmψGAAAG<br>AAAGCCmψGGGCmψCmψCCCGCCGCCAAGAGAGmψGAAGCmψGGACmψAAmψAGAmψAAGCGGC<br>CGCmψmψAAmψmψAAGCmψGCCmψmψCmψGCGGGGCmψmψGCCmψmψCmψGGCCAmψGCCCmψm<br>ψCmψmψCmψCmψCCCmψmψGCACCmψGmψACCmψCmψmψGGmψCmψmψmψGAAmψAAAGCCmψG<br>AGmψAGGAAGmψCmψAGAAAAAAAAAAAAAAAAAAAAAAAAAAAAAAAAAAAAAAAAAAAAAAAA<br>AAAAAAAAAAAAAAAAAAAAAAAAAAAAAAAAA | |
| ELXR 5-ZIM3 | AAAmψAAGAGAGAAAAGAAGAGmψAAGAAGAAAmψAmψAAGAGCCACCAmψGGCCCCmψAAGAA<br>GAAGCGmψAAAGmψGAGCCGGAmψGAACCACGACCAGGAGmψmψCGACCCCCCmψAAGGmψGmψ<br>ACCCmψCCCGmψCCCCGCCGAGAAGAGAAAGCCCAmψCCGGGmψCCmψGAGCCmψGmψmψCGAm<br>ψGGCAmψCGCCACCGGmψCmψGCmψGGmψGCmψGAAGGACCmψGGGCAmψCCAGGmψGGAmψAG<br>GmψACAmψmψGCCmψCCGAGGmψGmψGCGAGGACmψCCAmψCACCGmψGGGAAmψGGmψGCGmψ<br>CAmψCAGGGCAAGAmψCAmψGmψACGmψGGGCGACGmψGCGGAGCGmψGACACAGAAGCAmψAm<br>ψCCAGGAGmψGGGGCCCmψmψmψCGACCmψGGmψGAmψCGGCGGCAGCCCmvmψGCAAmψGACC<br>mψGAGCAmψCGmψGAACCCAGCCCGGAAGGGCCmψGmψACGAGGGAACCGGCAGACmψGmψmψC<br>mψmψCGAGmψmψmψmψACAGACmψGCmψGCACGACGCCCGGCCmψAAGGAAGGCGACGACCGGC | 59623 |

TABLE 43-continued

Full-length RNA sequences of additional ELXR mRNA molecψles in Table 42 for assessment. Modification 'mψ' = N1-methyl-pseudouridine.

| ELXR ID | RNA sequence | SEQ ID NO |
|---|---|---|
| | CCmψmψCmψmψmψmψGGCmψGmψmψCGAGAAmψGmψGGmψGGCCAmψGGGAGmψCAGCGACAAG | |
| | CGGGAmψAmψmψAGCCGGmψmψCCmψGGAGAGCAACCCCGmψGAmψGAmψCGAmψGCCAAGGAA | |
| | GmψGAGCGCCGCCCACCGGGCCAGAmψACmψmψCmψGGGGCAAmψCmψGCCmψGGCAmψGAACA | |
| | GACCCCmψGGCCAGCACCGmψGAACGACAAGCmψGGAGCmψGCAGGAGmψGCCmψGGAGCACGG | |
| | CCGGAmψCGCCAAGmψmψCAGCAAGGmψGAGAACCAmψCACCACCCGAAGCAACAGCAmψCAAA | |
| | CAAGGCAAGGACCAGCACmψmψmψCCmψGmψGmψmψCAmψGAACGAGAAGGAGGACAmψCCmψG | |
| | mψGGmψGmψACCGAGAmψGGAGAGAGmψGmψmψCGGGmψmψCCCAGmψCCACmψACACAGAmψG | |
| | mψCAGCAACAmψGmψCmψAGACmψGGCCAGACAGAGACmψGCmψGGGAAGAAGCmψGGmψCCGm | |
| | ψCCCmψGmψGAmψCAGACACCmψGmψmψCGCCCCmψCmψGAAGGAGmψACmψmψCGCCmψGCGm | |
| | ψGAGCAGCGGCAACAGCAACGCCAACAGCCGGGGCCCCAGCmψmψCmψCmψAGCGGCCmψGGmψ | |
| | GCCACmψGmψCCCmψGAGAGGGAGCCACAmψGGGCCCCAmψGGAGAmψCmψACAAAACCGmψGA | |
| | GCGCCmψGGAAGCGGCAGCCmψGmψGCGCGmψGCmψGAGCCmψGmψmψmψCGGAAmψAmψCGAm | |
| | ψAAAGmψCCmψGAAAAGCCmψGGGAmψmψCCmψGGAGAGCGGCmψCmψGGCmψCCGGCGGmψGG | |
| | CACCCmψGAAGmψACGmψGGAGGAmψGmψGACAAACGmψGGmψCAGACGGGAmψGmψGGAGAAG | |
| | mψGGGGCCCCmψmψCGAmψCmψGGmψGmψACGGCAGCACCCAACCCCmψGGGCAGCmψCmψmψG | |
| | mψGACCGGmψGCCCmψGGCmψGGmψACAmψGmψmψmψCAGmψmψCCACCGGAmψCCmψGCAGmψ | |
| | ACGCCCmψGCCGAGACAGGAGmψCCCAGCGGCCAmψmψCmψmψmψmψGGAmψmψmψmψCAmψGG | |
| | ACAACmψmψGCmψGCmψGACCGAGGAmψGACCAGGAAACmψACCACmψCGGmψmψCCmψGCAGA | |
| | CCGAAGCCGmψGACCCmψGCAGGACGmψGAGAGGCCGGGACmψACCAGAACGCCAmψGCGGGmψ | |
| | GmψGGmψCCAACAmψCCCmψGGACmψGAAAAGCAAGCACGCACCmψCmψGACCCCmvAAAGAAG | |
| | AGGAGmψACCmψGCAGGCCCAGGmψGCGGAGCAGAAGCAAGCmψGGACGCCCCmψAAGGmψGGA | |
| | mψCmψGCmψGGmψGAAGAAmψmψGCCmψCCmψGCCCCmψGAGAGAGmψACmψmψCAAGmψAmψm | |
| | ψmψCAGCCAGAAmψAGmψCmψGCCCCmψGGGAGGCAGCGGCGGCAmψGAACAACmψCCCAG | |
| | GGCAGAGmψGACCmψmψCGAGGACGmψGACCGmψGAAmψmψmψmψACACAGGGAGAGmψGGCAG | |
| | AGACmψGAACCCCGAGCAGAGAAACCmψGmψACCGGGAmψGmψGAmψGCmψGGAAAACnψACAG | |
| | CAAmψCmψGGmψGmψCCGmψGGGCCAGGGCGAGACCACAAAGCCmψGACGmψGAmψCCmψGCGm | |
| | ψCmψGGAGCAGGGCAAGGAACCCmψGGCmψGGAGGAGGAGGAGGmψGCmψGGGAAGCGGACGGG | |
| | CCGAGAAGAACGGCGACAmψCGGCGGACAGAmψCmψGGAAGCCmψAAGGACGmψGAAAGAAAGC | |
| | CmψGGGCGGCCCAAGCAGCGGCGCCCCmψCCmψCCCAGCGGCGGCAGCCCAGCCGGCmψCCCCA | |
| | ACCmψCmψACCGAGGAGGGCACCmψCmψGAGmψCCGCCACCCCCGAGAGCGGCCCmψGGCACCm | |
| | ψCCACCGAGCCCAGCGAGGGCAGCGCACCCGGCAGCCCmψGCCGGCAGCCCCACCmψCCACAGA | |
| | GGAGGGAACCAGCACCGAGCCCAGCGAAGGCAGCGCCCCAGGCACCAGCACCGAGCCmψAGmψG | |
| | AGCAGGAGAmψmψAAACGGAmCAACAAGAmψCAGAAGAAGACmψmψψGmψGAAAGACAGCAACA | |
| | CCAAGAAGGCCGGCAAGACAGGCCCCAmψGAAAACCCmψGCmψGGmψmψAGAGmψGAmψGACAC | |
| | CCGAmψCmψGAGAGAGCGGCmψGGAAAACCmψGAGAAAGAAGCCmψGAAAAm;AmψCCCCCAGC | |
| | CCAmψCAGCAAmψACAmψCmψAGAGCCAACCmψGAAmψAAGCmψGCmψGACCGAmψmψACACCG | |
| | AAAmψGAAGAAGGCGAmψCCmψGCAmψGmψGmψACmψGGGAAGAGmψmψCCAGAAGGACCCmψG | |
| | mψGGGCCmψGAmψGAGCCGGGmψGGCCCAGCCmψGCCAGCAAGAAGAmψCGAmψCAGAACAAGC | |
| | mψGAAACCmψGAGAmψGGACGAGAAGGGCAACCmψGACCACCGCCGGCmψmψmψGCCmψGCmψC | |
| | mψCAGmψGmψGGCCAGCCCCmψGmψmψCGmψGmψACAAGCmψGGAGCAGGmψGmψCmψGAGAAG | |
| | GGCAAGGCmψmψACACCAACmψACmψmψCGGACGGmψGCAAmψGmψGGCCGAGCACGAAAAGCm | |
| | ψGAmψCCmψGCmψGGCCCAGCmψGAAGCCCGAGAAGGAmψAGCGACGAAGCCGmψGACAmψAmψ | |
| | AGCCmψGGGAAAGmψmψmψGGGCAGAGGGCCCmψGGAmψmψmψCmψACAGCAmψmψCAmψGmψG | |
| | ACCAAGGAGmψCCACCCACCCCGmψGAAGCCCCmψGGCCCAGAmψCGCCGGAAACAGAmψACGC | |
| | CmψCCGGACCmψGmψGGGAAAGGCCCmψGAGCGACGCAmψGmψAmψGGGCACAAmψCGCCmψCC | |
| | mψmψCCmψGmψCmψAAGmψACCAGGACAmψCAmψCAmψCGAACACCAGAAGGmψGGmψGAAGGG | |
| | CAACCAGAAGAGACmψGGAGAGCCmψGCGGGAGCmψGGCCGGCAAGGAAAACCmψGGAAmψACC | |
| | CmψAGCGmψGACCCmψGCCACCmψCAGCCmψCACACCAAGGAGGGCGmψmψGAmψGCCmψACAA | |
| | CGAAGmψGAmψCGCCCGGGmψGCGAAmψGmψGGGmψGAACCmψGAACCmψGmψGGCAGAAGCmψ | |
| | GAAGCmψAAGCAGAGAmψGAmψGCCAAGCCmψCmψGCmψGAGACmψGAAGGGAmψmψCCCmψmψ | |
| | CCmψmψmψCCmψCmψGGmψCGAGAGACAGGCCAACGAAGmψGGACmψGGmψGGGACAmψGGmψG | |
| | mψGmψAACGmψGAAGAAGCmψGAmψCAACGAGAAAAAGGAGGAmψGGCAAGGmψGmψmψmψmψG | |
| | GCAGAAmψCmψGGCmψGGCmψACAAGAGACAGGAAGCCCmψGAGACCAmψACCmψGAGCAGCGA | |
| | GGAAGAmψCGGAAGAAGGGAAAGAAAmψmψCGCmψCGGmψACCAGCmψGGGCGACCmψGCmψGC | |
| | mψGCACCmψGGAAAAGAAGCACGGCGAGGACmψGGGGAAAGGmψGmψACGACGAGGCCmψGGGA | |
| | GCGGAmψmψGACAAGAAAGmψGGAAGGCCmψGAGCAAGCACAmψCAAGCmψGGAAGAGGAACGG | |
| | AGAAGCGAGGACGCCCAGAGCAAGGCCGCCCmψGACCGACmψGGCmψGCGGGCmψAAGGCCAGC | |
| | mψmψCGmψGAmψCGAGGGCCmψGAAGGAGGCCGACAAGGACGAGmψmψCmψGCAGAmψGCGAGC | |
| | mψGAAGCmψGCAGAAGmψGGmψACGGGGACCmψGCGGGGAAAGCCCmψmψCGCCAmψCGAAGCC | |
| | GAGAACAGCAmψCCmψGGACAmψCAGCGGCmψmψCAGCAAGCAGmψACAACmψGmψGCCmψmψC | |
| | AmψCmψGGCAGAAGGACGGCGmψGAAGAAGCmψGAACCmψGmψACCmψGAmψCAmψCAACmψAC | |
| | mψmψCAAGGGCGGCAAGCmψGCGGmψmψCAAGAAGAmψCAAACCmψGAAGCCmψmψCGAAGCCA | |
| | ACAGAmψmψCmψACACCGmψGAmψCAACAAAAAGAGCGGCGAGAmψCGmψGCCCAmψGGAGGmψ | |
| | GAACmψmψCAACmψmψCGACGACCCCAACCmψGAmψCAmψCCmψGCCmψCmψGGCCmψmψmψGG | |
| | CAAGAGACAGGGCAGAGAAmψmψCAmψCmψGGAACGACCmψGCmψGmψCCCmψGGAAACCGGCA | |
| | GCCmψGAAGCmψGGCCAACGGAAGAGmψGAmψCGAGAAGACACmψGmψACAACAGAAGAACCCG | |
| | GCAGGAmψGAGCCmψGCCCmψGmψmψCGmψGGCCCmψGACCmψmψCGAGGCGGGGGAGGmψCCm | |
| | ψGGACmψCCmψCCAAmψAmψCAAACCAAmψGAACCmψGAmψCGGCGmψGGCAAGAGGCGAAAAC | |
| | AmψCCCCGCCGmGAmψCGCCCmψGACCGACCCCGAGGGCmψGCCCACmψGAGCCGGmψψmψmψA | |
| | AGGAmψAGCCmψGGGAAACCCAACCCACAmψCCmψGAGAAmψCGGCGAGAGCmψAmψAAGGAGA | |
| | AGCAGCGGACCAmψCCAGGCCAAGAAGGAGGmψGGAGCAGCGGAGAGCCGGCGGCmψACAGCCG | |
| | GAAGmψACGCCAGCAAAGCCAAGAAmψCmψGGCAGACGAmψAmψGGmψGAGAAACACCGCmψAG | |
| | AGAmψCmψGCmψGmψACmψACGCCGmψGACCCAGGAmψGCCAmψGCmψGAmψCmψmψCGCCAAC | |

TABLE 43-continued

Full-length RNA sequences of additional ELXR mRNA molecψles in Table 42 for assessment. Modification 'mψ' = N1-methyl-pseudouridine.

| ELXR ID | RNA sequence | SEQ ID NO |
|---|---|---|
| | CmψGAGCCGGGGCmψmψCGGCCGGCAGGGCAAGCGGACCmψmψCAmψGGCCGAGAGACAGmψAC ACACGGAmψGGAGGACmψGGCmψGACCGCCAAGCmψGGCCmψACGAGGGCCmψGAGCAAGACCm ψACCmψGmψCCAAGACACmψGGCCCAGmψACACCmψCCAAGACAmψGCAGCAACmψGmψGGGmψ mψmψACCAmψCACCAGCGCCGACmψACGACAGGGmψGCmψGGAGAAGCmψGAAGAAGACAGCAA CAGGCmψGGAmψGACCACAAmψmψAACGGCAAGGAGCmψGAAGGmψGGAGGGCCAGAmψmψACC mψACmψACAACAGAmψACAAGAGACAGAACGmψAGmψCAAGGACCmψGmψCCGmψCGAGCmψGG AmψAGACmψGAGCGAAGAAmψCmψGmψGAACAACGACAmψCmψCCmψCCmψGGACAAAGGGCAG AAGCGGAGAAGCmψCmψGAGCCmψCCmψGAAGAAAAGAmψmψCmψCCCAmψAGACCCGmψGCAG GAGAAGmψmψCGmψGmψGCCmψGAACmψGCGGCmψmψCGAGACACACGCAGCCGAGCAAGCCGC CCmψGAACAmψCGCCAGAmψCCmψGGCmψGmψmψCCmψGCGGAGCCAGGAGmψACAAGAAAmψA CCAGACAAACAAGACAACCGGCAACACCGAmTAAGAGAGCCmψmψCGmψCGAGACCmψGGCAGm ψCCmψmψmψmψACCGGAAGAAGCmψmψAAGGAGGmψGmψGGAAACCmψGCCGmψGCGGmψCmψG GCGGAmψCmψGGCGGAGGCmψCCACCAGCCCCAAGAAAAAGAGAAAAGmψCmψAAmψAGAmψAA GCmψGCCmψmψCmψGCGGGGCmψmψGCCmψmψCmψGGCCAmψGCCCmψmψCmψmψCmψCmψCCC mψmψGCACCmψGmψACCmψCmψmψGGmψCmψmψmψGAAmψAAAGCCmψGAGmψAGGAAGmψCmψ AGAAAAAAAAAAAAAAAAAAAAAAAAAAAAAAAAAAAAAAAAAAAAAAAAAAAAAAAAAA AAAAAAAAAAAAAAAA | |
| ELXR 5-ZIM3 + ADD | AAAmψAAGAGAGAAAAGAAGAGmψAAGAAGAAAmψAmψAAGAGCCACCAmψGGCCCCmψAAGAA GAAGCGmψAAAGmψGAGCCGGAmψGGAACGCCmψCGmψCmψACGAGGmψGCGGCAGAAGmψGCA GAAACAmψCGAGGACAmψCmψGCAmψCmψCCmψGCGGAmCmψψCmψGAACGmψGACCCmψGGAG CACCCACmψGmψmψCAmψCGGCGGCAmψGmψGCCAGAACmψGmψAAAAACmψGmψmψmψmψCmψ GGAGmψGmψGCCmψAmψCAAmψACGACGAmψGACGGCmψACCAGAGCmψACmψGCACCAmψCmψ GmψmψGCGGCGGAAGAGAGGmψGCmψGAmψGmψGmψGGAAAmψAACAACmψGCmψGCCGGmψGC mψmψCmψGCGmψGGAAmψGCGmψGGACCmψGCmψGGmψGGGCCCCGGCGCCGCCCAGGCCGCmψ AmψmψAAGGAAGAmψCCmψmψGGAACmψGCmψACAmψGmψGCGGCCACAAGGGCACAmψACGGC CmψGCmψGAGACGGAGAGAGGACmψGGCCmψAGCAGACmψGCAGAmψGmψmψCmψmψCGCCAAm ψAACCACGACCAGGAGmψmψCGACCCCCmψAAGGmψGmψACCCmψCCCGmψCCCCGCCGAGAA GAGAAAGCCCAmψCCGGGmψCCmψGAGCCmψGmψmψCGAmψGGCAmψCGCCACCGGmψCmψGCm ψGGmψGCmψGAAGGACCmψGGGCAmψCCAGGmψGGAmψAGGmψACAmψmψGCCmψCCGAGGmψG mψGCGAGGACmψCCAmψCACCGmψGGGAAmψGGmψGCGmψCAmψCAGGGCAAGAmψCAmψGmψA CGmψGGGCGACGmψGCGGAGCGmψGACACAGAAGCAmψAmψCCAGGAGmψGGGGCCCmψmψmψC GACCmψGGmψGAmψCGGCGGCAGCCCmψmψGCAAmψGACCmψGAGCAmψCGmψGAACCCAGCCC GGAAGGGCCmψGmψACGAGGGAACCGGCAGACmψGmψmψCmψmψCGAGmψmψmψmψACAGACmψ GCmψGCACGACGCCCGGCCmψAAGGAAGGCGACGACCGGCCCmψmψCmψmψmψmψGGCmψGmψm ψCGAGAAmψGmψGGmψGGCCAmψGGGAGmψCAGCGACAAGCGGGAmψAmψmψAGCCGGmψmψCC mψGGAGAGCAACCCCGmψGAmψGAmψCGAmψGCCAAGGAAGmψGAGCGCCGCCCACCGGGCCAG AmψACmψmψCmψGGGGCAAmψCmψGCCmψGGCAmψGAACAGACCCCmψGGCCAGCACCGmψGAA CGACAAGCmψGGAGCmψGCAGGAGmψGCCmψGGAGCACGGCCGGAmψCGCCAAGmψmψCAGCAA GGmψGAGAACCAmψCACCACCCGAAGCAACAGCAmψCAAACAAGGCAAGGACCAGCACmψmψmψ CCmψGmψGmψmψCAmψGAACGAGAAGGAGGACAmψCCmψGmψGGmψGmψACCGAGAmψGGAGAG AGmψGmψmψCGGGmψmψCCCAGmψCCACmψACACAGAmψGmψCAGCAACAmψGmψCmψAGACmψ GGCCAGACAGAGACmψGCmψGGGAAGAAGCmψGGmψCCGmψCCCmψGmψGAmψCAGACACCmψG mψmψCGCCCCmψCmψGAAGGAGmψACmψmψCGCCmψGCGmψGAGCAGCGGCAACAGCAACGCCA ACAGCCGGGGCCCCAGCmψmψCmψCmψAGCGGCCmψGGmψGCCACmψGmψCCCmψGAGAGGGAG CCACAmψGGGCCCCAmψGGAGAmψCmψACAAAACCGmψGAGCGCCmψGGAAGCGGCAGCCmψGm ψGCGCGmψGCmψGAGCCmψGmψmψmψCGGAAmψAmψCGAmψAAAGmψCCmψGAAAAGCCmψGGG AmψmψCCmψGGAGAGCGGCmψCmψGGCmψCCGGCGGmψGGCACCCmψGAAGmψACGmψGGAGGA mψGmψGACAAACGmψGGmψCAGACGGGAmψGmψGGAGAAGmψGGGGCCCmψmψCGAmψCmψGG mψGmψACGGCAGCACCCAACCCCmψGGGCAGCmψCmψmψGmψGACCGGmψGCCCmψGGCmψGGm ψACAmψGmψmψmψCAGmψmψCCACCGGAmψCCmψGCAGmψACGCCCmψGCCGAGACAGGAGmψC CCAGCGGCCAmψmψCmψmψmψmψGGAmψmψmψmψCAmψGGACAACmψmψGCmψGCmψGACCGAG GAmψGACCAGGAAACmψACCACmψCGGmψmψCCmψGCAGACCGAAGCCGmψGACCCmψGCAGGA CGmψGAGAGGCCGGGACmψACCAGAACGCCAmψGCGGGmψGmψGGmψCCAACAmψCCCmψGGAC mψGAAAAGCAAGCACGCACCmψCmψGACCCCmψAAAGAAGAGGAGmψACCmψGCAGGCCCAGGm ψGCGGAGCAGAAGCAAGCmψGGACGCCCCmψAAGGmψGGAmψCmψGCmψGGmψGAAGAAmψmψG CCmψCCmψGCCCCmψGAGAGAGmψACmψmψCAAGmψAmψmψmψCAGCCAGAAmψAGmψCmψGCC CCmψGGGAGGCAGCGGCGGCGGCAmψGAACAACmψCCCAGGGCAGAGmψGACCmψmψCGAGGAC GmψGACCGmψGAAmψmψmψmψACACAGGGAGAGmψGGCAGAGACmψGAACCCCGAGCAGAGAAA CCmψGmψACCGGGAmψGmψGAmψGCmψGGAAAACmψACAGCAAmψCmψGGmψGmψCCGmψGGGC CAGGGCGAGACCACAAAGCCmψGACGmψGAmψCCmψGCGmψCmψGGAGCAGGGCAAGGAACCCm ψGGCmψGGAGGAGGAGGAGGmψGCmψGGGAAGCGGACGGGCCGAGAAGAACGGCGACAmψCGGC GGACAGAmψCmψGGAAGCCmψAAGGACGmψGAAAGAAAGCCmψGGGCGGCCCAAGCAGCGGCGC CCCCmψCCmψCCCAGCGGCGGCAGCCCAGCCGGCmψCCCCAACCmψCmψACCGAGGAGGGCACCm ψCmψGAGmψCCGCCACCCCCGAGAGCGGCCCmψGGCACCmψCCACCGAGCCCAGCGAGGGCAGC GCACCCGGCAGCCCmψGCCGGCAGCCCCACCmψCCACAGAGGAGGGAACCAGCACCGAGCCCAG CGAAGGCAGCGCCCCAGGCACCAGCACCGAGCCmψAGmψGAGCAGGAGAmψmψAAACGGAmψCA ACAAGAmψCAGAAGAAGACmψmψGmψGAAAGACAGCAACACCAAGAAGGCCGGCAAGACAGGCC CCAmψGAAAACCCmψGCmψGGmψmψAGAGmψGAmψGACACCCGAmψCmψGAGAGAGCGGCmψGG AAAACCmψGAGAAAGAAGCCmψGAAAAmψAmψCCCCCAGCCCAmψCAGCAAmψACAmψCmψAGA GCCAACCmψGAAmψAAGCmψGCmψGACCGAmψmψACACCGAAAmψGAAGAAGGCGAmψCCmψGC AmψGmψGmψACmψGGGAAGAGmψmψCCAGAAGGACCCmψGmψGGGCCmψGAmψGAGCCGGGmψG GCCCAGCCmψGCCAGCAAGAAGAmψCGAmψCAGAACAAGCmψGAAACCmψGAGAmψGGACGAGA | 59624 |

TABLE 43-continued

Full-length RNA sequences of additional ELXR mRNA molecψles in Table 42 for assessment. Modification 'mψ' = N1-methyl-pseudouridine.

| ELXR ID | RNA sequence | SEQ ID NO |
|---|---|---|
| | AGGGCAACCmψGACCACCGCCGGCmψmψmψGCCmψGCmψCmψCAGmψGmψGGCCAGCCCCmψGm<br>ψmψCGmψGmψACAAGCmψGGAGCAGGmψGmψCmψGAGAAGGGCAAGGCmψmψACACCAACmψAC<br>ψmψmψCGGACGGmψGCAAmψGmψGGCCGAGCACGAAAAGCmψGAmψCCmψGCmψGGCCCAGCmG<br>AAGCCCGAGAAGGAmψAGCGACGAAGCCGmψGACAmψAmψAGCCmψGGGAAAGmψmψmψGGGCA<br>GAGGGCCCmψGGAmψmψmψCmψACAGCAmψmψCAmψGmψGACCAAGGAGmψCCACCCACCCCGm<br>ψGAAGCCCCmψGGCCCAGAmψCGCCGGAAACAGAmψACGCCmψCCGGACCmψGmψGGGAAAGGC<br>CCmψGAGCGACGCAmψGmψAmψGGGCACAAmψCGCCmψCCmψmψCCmψGmψCmψAAGmψACCAG<br>GACAmψCAmψCAmψCGAACACCAGAAGGmψGGmψGAAGGGCAACCAGAAGAGACmψGGAGAGCC<br>mψGCGGGAGCmψGGCCGGCAAGGAAAACCmψGGAAmψACCCmψAGCGmψGACCCmψGCCACCmψ<br>CAGCCmψCACACCAAGGAGGGCGmψmψGAmψGCCmψACAACGAAGmψGAmψCGCCCGGGmψGCG<br>AAmψGmψGGGmψGAACCmψGAACCmψGmψGGCAGAAGCmψGAAGCmψAAGCAGAGAmψGAmψGC<br>CAAGCCmψCmψGCmψGAGACmψGAAGGGAmψmψCCCmψmψCCmψmψmψCCmψCmψGGmψCGAGA<br>GACAGGCCAACGAAGmψGGACmψGGmψGGGACAmψGGmψGmψGmψAACGmψGAAGAAGCmψGAm<br>ψCAACGAGAAAAAGGAGGAmψGGCAAGGmψGmψmψmψmψGGCAGAAmψCmψGGCmψGGCmψACA<br>AGAGACAGGAAGCCCmψGAGACCAmψACCmψGAGCAGCGAGGAAGAmψCGGAAGAAGGGAAAGA<br>AAmψmψCGCmψCGGmψACCAGCmψGGGCGACCmψGCmψGCmψGCACCmψGGAAAAGAAGCACGG<br>CGAGGACmψGGGGAAAGGmψGmψACGACGAGGCCmψGGGAGCGGAmψmψGACAAGAAAGmψGGA<br>AGGCCmψGAGCAAGCACAmψCAAGCmψGGAAGAGGAACGGAGAAGCGAGGACGCCCAGAGCAAG<br>GCCGCCCmψGACCGACmψGGCmψGCGGGCmψAAGGCCAGCmψmψCGmψGAmψCGAGGGCCmψGA<br>AGGAGGCCGACAAGGACGAGmψmψCmψGCAGAmψGCGAGCmψGAAGCmψGCAGAAGmψGGmψAC<br>GGGGACCmψGCGGGGAAAGCCCmψmψCGCCAmψCGAAGCCGAGAACAGCAmψCCmψGGACAmψC<br>AGCGGCmψmψCAGCAAGCAGmψACAACmψGmψGCCmψmψCAmψCmψGGCAGAAGGACGGCGmψG<br>AAGAAGCmψGAACCmψGmψACCmψGAmψCAmψCAACmψACmψmψCAAGGGCGGCAAGCmψGCGG<br>mψmψCAAGAAGAmψCAAACCmψGAAGCCmψmψCGAAGCCAACAGAmψmψCmψACACCGmψGAmψ<br>CAACAAAAAGAGCGGCGAGAmψCGmψGCCCAmψGGAGGmψGAACmψmψCAACmψmψCGACGACC<br>CCAACCmψGAmψCAmψCCmψGCCmψCmψGGCCmψmψmψGGCAAGAGACAGGGCAGAGAAmψmψC<br>AmψCmψGGAACGACCmψGCmψGmψCCCmψGGAAACCGGCAGCCmψGAAGCmψGGCCAACGGAAG<br>AGmψGAmψCGAGAAGACACmψGmψACAACAGAAGAACCCGGCAGGAmψGAGCCmψGCCCmψGmψ<br>mψCGmψGGCCCmψGACCmψmψCGAGCGGCGGGAGGmψCCmψGGACmψCCmψCCAAmψAmψCAAA<br>CCAAmψGAACCmψGAmψCGGCGmψGGCAAGAGGCGAAAACAmψCCCCGCCGmψGAmψCGCCCmψ<br>GACCGACCCCGAGGGCmψGCCCACmψGAGCCGGmψmψmψAAGGAmψAGCCmψGGGAAACCCAAC<br>CCACAmψCCmψGAGAAmψCGGCGAGAGCmψAmψAAGGAGAAGCAGCGGACCAmψCCAGGCCAAG<br>AAGGAGGmψGGAGCAGCGGAGAGCCGGCGGCmψACAGCCGGAAGmψACGCCAGCAAAGCCAAGA<br>AmψCmψGGCAGACGAmψAmψGGmψGAGAAACACCGCmψAGAGAmψCmψGCmψGmψACmψACGCC<br>GmψGACCCAGGAmψGCCAmψGCmψGAmψCmψmψCGCCAACCmψGAGCCGGGGCmψmψCGGCCGG<br>CAGGGCAAGCGGACCmψmψCAmψGGCCGAGAGACAGmψACACACGGAmψGGAGGACmψGGCmψG<br>ACCGCCAAGCmψGGCCmψACGAGGGCCmψGAGCAAGACCmψACCmψGmψCCAAGACACmψGGCC<br>CAGmψACACCmψCCAAGACAmψGCAGCAACmψGmψGGGmψmψmψACCAmψCACCAGCGCCGACm<br>ψACGACAGGGmψGCmψGGAGAAGCmψGAAGAAGACAGCAACAGGCmψGGAmψGACCACAAmψmψ<br>AACGGCAAGGAGCmψGAAGGmψGGAGGGCCAGAmmψACCmψψACmψACAACAGAmψACAAGAGA<br>CAGAACGmψAGmψCAAGGACCmψGmψCCGmψCGAGCmψGGAmψAGACmψGAGCGAAGAAmψCmψ<br>GmψGAACAACGACAmψCmψCCmψCCmψGGACAAAGGGCAGAAGCGGAGAAGCmψCmψGAGCCmψ<br>CCmψGAAGAAAAGAmψmψCmψCCCAmψAGACCCGmψGCAGGAGAAGmψmψCGmψGmψGCCmψGA<br>ACmψGCGGCmψmψCGAGACACACGCAGCCGAGCAAGCCGCCCmψGAACAmψCGCCAGAmψCCmψ<br>GGCmψGmψmψCCmψGCGGAGCCAGGAGmψACAAGAAAmψACCAGACAAACAAGACAACCGGCAA<br>CACCGAmψAAGAGAGCCmψmψCGmψCGAGACCmψGGCAGmψCCmψmψmψmψACCGGAAGAAGCm<br>ψmψAAGGAGGmψGmψGGAAACCmψGCCGmψGCGGmψCmψGGCGGAmψCmψGGCGGAGGCmψCCA<br>CCAGCCCCAAGAAAAAGAGAAAAGmψCmψAAmψAGAmψAAGCmψGCCmψmψCmψGCGGGGCmψm<br>ψGCCmψmψCmvGGCCAmψGCCCmψmψCmψmψCmψCmψCCCmψmψGCACCmψGmψACCmψCmψmψ<br>GGmψCmψmψmψGAAmψAAAGCCmψGAGmψAGGAAGmψCmψAGAAAAAAAAAAAAAAAAAAAAAA<br>AAAAAAAAAAAAAAAAAAAAAAAAAAAAAAAAAAAAAAAAAAAAAAAAAAAAAAAAAAAAAAAAAAAAAA | |

Synthesis of targeting gRNAs (e.g., targeting the endogenous B2M locus) will be performed as described above in Example 14.

LNP formulations will be performed as described in Example 16.

Delivery of LNPs encapsulating ELXR mRNA and targeting gRNAs into mouse liver Hepa1-6 cells:

Hepa1-6 cells will be seeded in a 96-well plate. The next day, seeded cells will be treated with varying concentrations of LNPs, which will be prepared in six 2-fold serial dilutions starting at 250 ng. These LNPs will be formulated to encapsulate an ELXR mRNA and a B2M-targeting gRNA. Media will be changed 24 hours after LNP treatment, and cells will be cultured before being harvested at multiple timepoints (e.g., 7, 14, 21, 28, and 56 days post-treatment) for gDNA extraction for editing assessment at the B2M locus by NGS and for bisulfite sequencing to assess off-target methylation at the VEGFA locus as described in Example 6.

The results from this experiment are expected to show that ELXR mRNA and targeting gRNA can be co-encapsulated within LNPs to be delivered to target cells to induce heritable silencing of a target endogenous locus.

Example 16: Formulation of Lipid Nanoparticles (LNPs) to Deliver XR or ELXR mRNA and gRNA Payloads to Target Cells and Tissue Experiments will be performed to encapsulate XR or ELXR mRNA and gRNA into LNPs for delivery to target cells and tissue. Here, XR or ELXR mRNA and gRNA will be encapsulated into LNPs using GenVoy-ILM™ lipids using the Precision NanoSystems Inc. (PNI) Ignite™ Benchtop System, following the manufacturer's guidelines. GenVoy-ILM™ lipids are a composition of ionizable lipid: DSPC:cholesterol:stabilizer at 50:10:37.5:2.5 mol %. Briefly, to formulate LNPs, equal mass ratios of XR or ELXR mRNA and gRNA will be diluted in PNI Formulation Buffer, pH 4.0. GenVoy-ILM™ lipids will be diluted 1:1 in anhydrous ethanol. mRNA/gRNA co-formulations will be performed using a predetermined N/P ratio. The RNA and lipids will be run through a PNI laminar flow cartridge at a predetermined flow rate ratio on the PNI Ignite™ Benchtop System. After formulation, the LNPs will be diluted in PBS, pH 7.4, to decrease the ethanol concentration and increase the pH, which increases the stability of the particles. Buffer exchange of the mRNA/sgRNA-LNPs will be achieved by overnight dialysis into PBS, pH 7.4, at 4° C. using 10k Slide-A-Lyzer™ Dialysis Cassettes (Thermo Scientific™). Following dialysis, the mRNA/gRNA-LNPs will be concentrated to >0.5 mg/mL using 100 kDa Amicon®-Ultra Centrifugal Filters (Millipore) and then filter-sterilized. Formulated LNPs will be analyzed on a Stunner (Unchained Labs) to determine their diameter and polydispersity index (PDI). Encapsulation efficiency and RNA concentration will be determined by RiboGreen™ assay using Invitrogen's Quant-iT™ RiboGreen™ RNA assay kit. LNPs will be used in various experiments to deliver XR or ELXR mRNA and gRNA to target cells and tissue.

Example 17: Members of the Top 95 KRAB Domains Increase ELXR5 Activity

As described in Example 4, KRAB domains were identified that were superior repressors in the context of dXR constructs. As described herein, experiments were performed to test whether the KRAB domains identified in Example 4 were also superior transcriptional repressors in Example 4 in the context of ELXR5.

Materials and Methods:

Representative KRAB domains identified in Example 4 and determined to be members of the top 95 performing repressors were cloned into an ELXR5 construct (see FIG. 7 for ELXR #5 configuration). The ELXR5 constructs were constructed as described in Example 6 (Table 25 and Table 26), except that an SV40 NLS was present downstream of the KRAB domains. An ELXR5 molecule with a KRAB domain derived from ZIM3 was used as a control. A separate plasmid was used to encode guide scaffold 316 (SEQ ID NO: 59352) with spacer 7.165 (UCCCUAUGUCC-UUGCUGUUU; SEQ ID NO: 59667) targeting the B2M locus. Additional controls included a dXR molecule with a KRAB domain derived from ZIM3 with the same guide and spacer, and ELXR5 and dXR molecules with KRAB domains derived from ZIM3 and non-targeting 0.0 spacers (SEQ ID NO: 57646). Notably, spacer 7.165 was chosen because it is known to be a relatively inefficient spacer which would therefore increase the dynamic range of the assay for discerning differences between the various ELXR molecules tested.

HEK293T cells were transfected as described in Example 11, except that the cells were transfected with 50 ng each of a plasmid encoding the ELXR construct and a plasmid encoding the sgRNA. Repression analysis was conducted by analyzing B2M protein expression via HLA immunostaining followed by flow cytometry seven days following transfection, as described in Example 6.

Results

The results of the 1B2M assay are provided in Table 44, below.

TABLE 44

Levels of B2M repression mediated by XR and ELXR constructs with various KRAB domains quantified at seven days post-transfection.

| Repressor construct | KRAB domain | Spacer | Mean % HLA negative cells | Standard deviation | Sample size |
|---|---|---|---|---|---|
| ELXR5 | ZIM3 | 0.0 | 6.703333 | 1.169031 | 3 |
| XR | ZIM3 | 7.165 | 7.36 | 1.626346 | 2 |
| XR | ZIM3 | 0.0 | 7.786667 | 0.721757 | 3 |
| ELXR5 | DOMAIN_27811 | 7.165 | 22.63333 | 0.64291 | 3 |
| ELXR5 | DOMAIN_17317 | 7.165 | 25.93333 | 0.585947 | 3 |
| ELXR5 | DOMAIN_17358 | 7.165 | 27.76667 | 3.06159 | 3 |
| ELXR5 | DOMAIN_18258 | 7.165 | 29.13333 | 0.776745 | 3 |
| ELXR5 | DOMAIN_8503 | 7.165 | 29.7 | 0.888819 | 3 |
| ELXR5 | DOMAIN_4968 | 7.165 | 30.13333 | 2.804164 | 3 |
| ELXR5 | DOMAIN_15126 | 7.165 | 30.33333 | 0.305505 | 3 |
| ELXR5 | DOMAIN_28803 | 7.165 | 30.36667 | 0.90185 | 3 |
| ELXR5 | DOMAIN_19949 | 7.165 | 31.96667 | 2.510644 | 3 |
| ELXR5 | DOMAIN_22270 | 7.165 | 32.5 | 1.1 | 3 |
| ELXR5 | DOMAIN_5463 | 7.165 | 32.53333 | 0.404145 | 3 |
| ELXR5 | DOMAIN_24125 | 7.165 | 32.66667 | 1.289703 | 3 |
| ELXR5 | ZIM3 | 7.165 | 32.9 | 0.43589 | 3 |
| ELXR5 | DOMAIN_23723 | 7.165 | 33.4 | 2.170253 | 3 |
| ELXR5 | DOMAIN_11029 | 7.165 | 33.46667 | 1.289703 | 3 |
| ELXR5 | DOMAIN_19229 | 7.165 | 33.96667 | 0.321455 | 3 |
| ELXR5 | DOMAIN_21603 | 7.165 | 34.36667 | 0.404145 | 3 |
| ELXR5 | DOMAIN_8790 | 7.165 | 34.9 | 0.608276 | 3 |
| ELXR5 | DOMAIN_11386 | 7.165 | 35.63333 | 1.677299 | 3 |
| ELXR5 | DOMAIN_16806 | 7.165 | 35.66667 | 1.450287 | 3 |
| ELXR5 | DOMAIN_6248 | 7.165 | 36 | 2.351595 | 3 |
| ELXR5 | DOMAIN_16444 | 7.165 | 36.36667 | 1.703917 | 3 |
| ELXR5 | DOMAIN_11486 | 7.165 | 36.66667 | 1.320353 | 3 |
| ELXR5 | DOMAIN_4806 | 7.165 | 36.76667 | 1.747379 | 3 |
| ELXR5 | DOMAIN_17905 | 7.165 | 36.93333 | 1.446836 | 3 |
| ELXR5 | DOMAIN_14755 | 7.165 | 37.35 | 0.070711 | 2 |
| ELXR5 | DOMAIN_5066 | 7.165 | 37.83333 | 1.02632 | 3 |
| ELXR5 | DOMAIN_21247 | 7.165 | 37.86667 | 2.218859 | 3 |
| ELXR5 | DOMAIN_14659 | 7.165 | 37.93333 | 1.767295 | 3 |
| ELXR5 | DOMAIN_10331 | 7.165 | 38.3 | 1.30767 | 3 |
| ELXR5 | DOMAIN_11348 | 7.165 | 38.43333 | 1.28582 | 3 |
| ELXR5 | DOMAIN_25289 | 7.165 | 38.53333 | 0.945163 | 3 |
| ELXR5 | DOMAIN_21755 | 7.165 | 38.66667 | 1.497776 | 3 |
| ELXR5 | DOMAIN_13331 | 7.165 | 38.7 | 2.163331 | 3 |
| ELXR5 | DOMAIN_24663 | 7.165 | 39.43333 | 6.047589 | 3 |
| ELXR5 | DOMAIN_27506 | 7.165 | 39.46667 | 1.504438 | 3 |
| ELXR5 | DOMAIN_6807 | 7.165 | 39.5 | 0.43589 | 3 |
| ELXR5 | DOMAIN_28640 | 7.165 | 39.9 | 1.276715 | 3 |
| ELXR5 | DOMAIN_11683 | 7.165 | 40.26667 | 0.152753 | 3 |
| ELXR5 | DOMAIN_12631 | 7.165 | 40.3 | 0.6245 | 3 |
| ELXR5 | DOMAIN_23394 | 7.165 | 40.73333 | 2.285461 | 3 |
| ELXR5 | DOMAIN_13539 | 7.165 | 40.8 | 2.306513 | 3 |
| ELXR5 | DOMAIN_2380 | 7.165 | 41.1 | 1.276715 | 3 |
| ELXR5 | DOMAIN_16643 | 7.165 | 41.13333 | 1.205543 | 3 |
| ELXR5 | DOMAIN_18216 | 7.165 | 41.4 | 0.818535 | 3 |
| ELXR5 | DOMAIN_737 | 7.165 | 41.46667 | 3.257811 | 3 |
| ELXR5 | DOMAIN_16688 | 7.165 | 41.8 | 0.264575 | 3 |
| ELXR5 | DOMAIN_19804 | 7.165 | 42.06667 | 1.913984 | 3 |
| ELXR5 | DOMAIN_10948 | 7.165 | 42.73333 | 0.92376 | 3 |
| ELXR5 | DOMAIN_26322 | 7.165 | 42.76667 | 4.66083 | 3 |
| ELXR5 | DOMAIN_17759 | 7.165 | 43.23333 | 0.92376 | 3 |
| ELXR5 | DOMAIN_9114 | 7.165 | 43.26667 | 1.501111 | 3 |
| ELXR5 | DOMAIN_5290 | 7.165 | 43.4 | 1.135782 | 3 |
| ELXR5 | DOMAIN_221 | 7.165 | 43.43333 | 0.750555 | 3 |
| ELXR5 | DOMAIN_881 | 7.165 | 43.53333 | 1.858315 | 3 |
| ELXR5 | DOMAIN_7255 | 7.165 | 43.56667 | 0.450925 | 3 |
| ELXR5 | DOMAIN_24458 | 7.165 | 43.56667 | 1.331666 | 3 |
| ELXR5 | DOMAIN_19896 | 7.165 | 43.6 | 0.6245 | 3 |
| ELXR5 | DOMAIN_13468 | 7.165 | 43.7 | 1.571623 | 3 |
| ELXR5 | DOMAIN_9960 | 7.165 | 43.96667 | 2.362908 | 3 |
| ELXR5 | DOMAIN_17432 | 7.165 | 43.96667 | 0.907377 | 3 |
| ELXR5 | DOMAIN_18137 | 7.165 | 44.03333 | 0.404145 | 3 |

TABLE 44-continued

Levels of B2M repression mediated by XR and ELXR constructs with various KRAB domains quantified at seven days post-transfection.

| Repressor construct | KRAB domain | Spacer | Mean % HLA negative cells | Standard deviation | Sample size |
|---|---|---|---|---|---|
| ELXR5 | DOMAIN_15507 | 7.165 | 44.06667 | 0.907377 | 3 |
| ELXR5 | DOMAIN_20505 | 7.165 | 45.36667 | 0.568624 | 3 |
| ELXR5 | DOMAIN_6445 | 7.165 | 45.66667 | 2.730079 | 3 |
| ELXR5 | DOMAIN_6802 | 7.165 | 45.76667 | 1.887679 | 3 |
| ELXR5 | DOMAIN_25379 | 7.165 | 46.46667 | 3.868247 | 3 |
| ELXR5 | DOMAIN_22153 | 7.165 | 46.83333 | 0.64291 | 3 |
| ELXR5 | DOMAIN_10123 | 7.165 | 47.83333 | 0.665833 | 3 |
| ELXR5 | DOMAIN_8853 | 7.165 | 48.1 | 4.457578 | 3 |
| ELXR5 | DOMAIN_29304 | 7.165 | 51.7 | 1.4 | 3 |
| ELXR5 | DOMAIN_7694 | 7.165 | 52.4 | 0.43589 | 3 |
| ELXR5 | DOMAIN_30173 | 7.165 | 53.9 | 0.1 | 3 |

As shown in Table 44, constructs with many of the KRAB domains in the top 95 KRAB domains produced higher levels of B2M repression in the context of an ELXR5 molecule with spacer 7.165 compared to an ELXR5 construct with a KRAB domain derived from ZIM3. The highest level of repression was achieved by an ELXR5 molecule with KRAB domain ID 30173, which produced a 35% stronger repression than ELXR5 with a KRAB domain derived from ZIM3. Later timepoints will be assessed to measure the durability of the repression.

Accordingly, the experiments described herein demonstrate that the KRAB domains identified in Example 4 support improved levels of transcriptional repression both in the context of a dXR construct and an ELXR construct.

Example 18: Exemplary Sequences of dXR and ELXR Constructs

Table 45 provides exemplary amino acid sequences of components of dXR and ELXR constructs. In Table 45, the protein domains are shown without starting methionines.

TABLE 45

Exemplary protein sequences of components of dXR and ELXR constructs.

| Key component | Protein sequence | SEQ ID NO |
|---|---|---|
| ZNF10 KRAB domain | DAKSLTAWSRTLVTFKDVFVDFTREEWKLLDTAQQIVYRNVMLENYKNLVSLGYQL TKPDVILRLEKGEEP | 59626 |
| ZIM3 KRAB domain | NNSQGRVTFEDVTVNFTQGEWQRLNPEQRNLYRDVMLENYSNLVSVGQGETTKPDV ILRLEQGKEPWLEEEEVLGSGRAEKNGDIGGQIWKPKDVKESL | 59627 |
| DNMT3A catalψtic domain (CD) | NHDQEFDPPKVYPPVPAEKRKPIRVLSLFDGIATGLLVLKDLGIQVDRYIASEVCE DSITVGMVRHQGKIMYVGDVRSVTQKHIQEWGPFDLVIGGSPCNDLSIVNPARKGL YEGTGRLFFEFYRLLHDARPKEGDDRPFFWLFENVVAMGVSDKRDISRFLESNPVM IDAKEVSAAHRARYFWGNLPGMNRPLASTVNDKLELQECLEHGRIAKFSKVRTITT RSNSIKQGKDQHFPVFMNEKEDILWCTEMERVFGFPVHYTDVSNMSRLARQRLLGR SWSVPVIRHLFAPLKEYFACV | 59450 |
| DNMT3L interaction domain | GPMEIYKTVSAWKRQPVRVLSLFRNIDKVLKSLGFLESGSGSGGGTLKYVEDVTNV VRRDVEKWGPFDLVYGSTQPLGSSCDRCPGWYMFQFHRILQYALPRQESQRPFFWI FMDNLLLTEDDQETTTRFLQTEAVTLQDVRGRDYQNAMRVWSNIPGLKSKHAPLTP KEEEYLQAQVRSRSKLDAPKVDLLVKNCLLPLREYFKYFSQNSLPL | 59625 |
| dCasX491 | QEIKRINKIRRRLVKDSNTKKAGKTGPMKTLLVRVMTPDLRERLENLRKKPENIPQ PISNTSRANLNKLLTDYTEMKKAILHVYWEEFQKDPVGLMSRVAQPASKKIDQNKL KPEMDEKGNLTTAGFACSQCGQPLFVYKLEQVSEKGKAYTNYFGRCNVAEHEKLIL LAQLKPEKDSDEAVTYSLGKFGQRALDFYSIHVTKESTHPVKPLAQIAGNRYASGP VGKALSDACMGTIASFLSKYQDIIIEHQKVVKGNQKRLESLRELAGKENLEYPSVT LPPQPHTKEGVDAYNEVIARVRMWVNLNLWQKLKLSRDDAKPLLRLKGFPSFPLVE RQANEVDWWDMVCNVKKLINEKKEDGKVFWQNLAGYKRQEALRPYLSSEEDRKKGK KFARYQLGDLLLHLEKKHGEDWGKVYDEAWERIDKKVEGLSKHIKLEEERRSEDAQ SKAALTDWLRAKASFVIEGLKEADKDEFCRCELKLQKWYGDLRGKPFAIEAENSIL DISGFSKQYNCAFIWQKDGVKKLNLYLIINYFKGGKLRFKKIKPEAFEANRFYTVI NKKSGEIVPMEVNFNFDDPNLIILPLAFGKRQGREFIWNDLLSLETGSLKLANGRV IEKTLYNRRTRQDEPALFVALTFERREVLDSSNIKPMNLIGVARGENIPAVIALTD PEGCPLSRFKDSLGNPTHILRIGESYKEKQRTIQAKKEVEQRRAGGYSRKYASKAK NLADDMVRNTARDLLYYAVTQDAMLIFANLSRGFGRQGKRTFMAERQYTRMEDWLT AKLAYEGLSKTYLSKTLAQYTSKTCSNCGFTITSADYDRVLEKLKKTATGWMTTIN GKELKVEGQITYYNRYKRQNVVKDLSVELDRLSEESVNNDISSWTKGRSGEALSLL KKRFSHRPVQEKFVCLNCGFETHAAEQAALNIARSWLFLRSQEYKKYQTNKTTGNT DKRAFVETWQSFYRKKLKEVWKPAV | 18 |
| Linker 1 | GGPSSGAPPPSGGSPAGSPTSTEEGTSESATPESGPGTSTEPSEGSAPGSPAGSPT STEEGTSTEPSEGSAPGTSTEPSE | 57621 |
| Linker 2 | SSGNSNANSRGPSFSSGLVPLSLRGSH | 57623 |
| Linker 3A' | GGSGGG | 59451 |
| Linker 3B | GGSGGGS | 57626 |
| Linker 4 | GSGSGGG | 57628 |

TABLE 45-continued

Exemplary protein sequences of components of dXR and ELXR constructs.

| Key component | Protein sequence | SEQ ID NO |
|---|---|---|
| SV40NLS | PKKKRKV | 57631 |
| cMYC NLS | PAAKRVKLD | 33291 |
| DNMT3A | ERLVYEVRQKCRNIEDICISCGSLNVTLEHPLFIGGMCQNCKNCFLECAYQYDDDG | 59452 |
| ADD domain | YQSYCTICCGGREVLMCGNNNCCRCFCVECVDLLVGPGAAQAAIKEDPWNCYMCGH KGTYGLLRRREDWPSRLQMFFAN | |

Table 46 provides exemplary full-length ELXR constructs (including dCaX, NLS, linkers, and repressor domains) in configurations 1, 4, or 5, with or without the ADD domain, with each of the top ten KRAB domains: DOMAIN_737, DOMAIN_10331, DOMAIN_10948, DOMAIN_11029, DOMAIN_17358, DOMAIN_17759, DOMAIN_18258, DOMAIN_19804, DOMAIN_20505, and DOMAIN_26749. Further exemplary full-length ELXR sequences are provided in SEQ ID NOs: 59673-60012.

TABLE 46

Exemplary protein sequences of ELXR molecules containing the top ten KRAB domains with or without the ADD domain and having the #1, #4, or #5 configurations.

| ELXR # | Domains | KRAB domain ID | SEQ ID NO |
|---|---|---|---|
| ELXR #1 | KRAB, DNMT3A CD, DNMT3L Interaction | DOMAIN_737 | 59508 |
| | | DOMAIN_10331 | 59509 |
| | | DOMAIN_10948 | 59510 |
| | | DOMAIN_11029 | 59511 |
| | | DOMAIN_17358 | 59512 |
| | | DOMAIN_17759 | 59513 |
| | | DOMAIN_18258 | 59514 |
| | | DOMAIN_19804 | 59515 |
| | | DOMAIN_20505 | 59516 |
| | | DOMAIN_26749 | 59517 |
| | KRAB, DNMT3A ADD, DNMT3A CD, DNMT3L Interaction | DOMAIN_737 | 59518 |
| | | DOMAIN_10331 | 59519 |
| | | DOMAIN_10948 | 59520 |
| | | DOMAIN_11029 | 59521 |
| | | DOMAIN_17358 | 59522 |
| | | DOMAIN_17759 | 59523 |
| | | DOMAIN_18258 | 59524 |
| | | DOMAIN_19804 | 59525 |
| | | DOMAIN_20505 | 59526 |
| | | DOMAIN_26749 | 59527 |
| ELXR #4 | KRAB, DNMT3A CD, DNMT3L Interaction | DOMAIN_737 | 59528 |
| | | DOMAIN_10331 | 59529 |
| | | DOMAIN_10948 | 59530 |
| | | DOMAIN_11029 | 59531 |
| | | DOMAIN_17358 | 59532 |

TABLE 46-continued

Exemplary protein sequences of ELXR molecules containing the top ten KRAB domains with or without the ADD domain and having the #1, #4, or #5 configurations.

| ELXR # | Domains | KRAB domain ID | SEQ ID NO |
|---|---|---|---|
| | | DOMAIN_17759 | 59533 |
| | | DOMAIN_18258 | 59534 |
| | | DOMAIN_19804 | 59535 |
| | | DOMAIN_20505 | 59536 |
| | | DOMAIN_26749 | 59537 |
| | KRAB, DNMT3A ADD, DNMT3A CD, DNMT3L Interaction | DOMAIN_737 | 59538 |
| | | DOMAIN_10331 | 59539 |
| | | DOMAIN_10948 | 59540 |
| | | DOMAIN_11029 | 59541 |
| | | DOMAIN_17358 | 59542 |
| | | DOMAIN_17759 | 59543 |
| | | DOMAIN_18258 | 59544 |
| | | DOMAIN_19804 | 59545 |
| | | DOMAIN_20505 | 59546 |
| | | DOMAIN_26749 | 59547 |
| ELXR #5 | KRAB, DNMT3A CD, DNMT3L Interaction | DOMAIN_737 | 59548 |
| | | DOMAIN_10331 | 59549 |
| | | DOMAIN_10948 | 59550 |
| | | DOMAIN_11029 | 59551 |
| | | DOMAIN_17358 | 59552 |
| | | DOMAIN_17759 | 59553 |
| | | DOMAIN_18258 | 59554 |
| | | DOMAIN_19804 | 59555 |
| | | DOMAIN_20505 | 59556 |
| | | DOMAIN_26749 | 59557 |
| | KRAB, DNMT3A ADD, DNMT3A CD, DNMT3L Interaction | DOMAIN_737 | 59558 |
| | | DOMAIN_10331 | 59559 |
| | | DOMAIN_10948 | 59560 |
| | | DOMAIN_11029 | 59561 |
| | | DOMAIN_17358 | 59562 |
| | | DOMAIN_17759 | 59563 |
| | | DOMAIN_18258 | 59564 |
| | | DOMAIN_19804 | 59565 |
| | | DOMAIN_20505 | 59566 |
| | | DOMAIN_26749 | 59567 |

SEQUENCE LISTING (60014 sequences)

SEQ ID NO: 1 - protein, 986 aa, Deltaproteobacteria sp.
MEKRINKIRKKLSADNATKPVSRSGPMKTLLVRVMTDDLKKRLEKRRKKPEVMPQVISNNAANNLRMLLDDYTKMKEAILQVYWQEFKDDHVGLMCKFAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPVVERRENEVDWWNTINEVKKLIDAKRDMGRVFWSGVTAEKRNTILEGYNYLPNENDHKKREGSLENPKKPAKRQFGDLLLYLEKKYAGDWGKVFDEAWERIDKKIAGLTSHIEREEARNAEDAQSKAVLTDWLRAKASFVLERLKEMDEKEFYACEIQLQKWYGDLRGNPFAVEAENRVVDISGFSIGSDGHSIQYRNLLAWKYLENGKREFYLLMNYGKKGRIRFTDGTDIKKSGKWQGLLYGGGKAKVIDLTFDPDDEQLIILPLAFGTRQGREFIWNDLLSLETGLIKLANGRVIEKTIYNKKIGRDEPALFVALTFERREVVDPSNIKPVNLIGVDRGENIPAVIALTDPEGCPLPEFKDSSGGPTDILRIGEGYKEKQRAIQAAKEVEQRRAGGYSRKFASKSRNLADDMVRNSARDLFYHAVTHDAVLVFENLSRGFGRQGKRTFMTERQYTKMEDWLTAKLAYEGLTSKTYLSKTLAQYTSKTCSNCGFTITTADYDGMLVRLKKTSDGWATTLNNKELKAEGQITYYNRYKRQTVEKELSAELDRLSEESGNNDISKWTKGRRDEALFLLKKRFSHRPVQEQFVCLDCGHEVHADEQAALNIARSWLFLNSNSTEFKSYKSGKQPFVGAWQAFYKRRLKEVWKPNA

SEQ ID NO: 2 - protein, 978 aa, Planctomycetes sp.
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3 - protein, 855 aa, Candidatus Sungbacteria sp.
MDNANKPSTKSLVNTTRISDHFGVTPGQVTRVFSFGIIPTKRQYAIIERWFAAVEAARERLYGMLYAHFQENPPAYLKEKFSYETFFKGRPVLNGLRDIDPTIMTSAVFTALRHKAEGAMAAFHTNHRRLFEEARKKMREYAECLKANEALLRGAADIDWDKIVNALRTRLNTCLAPEYDAVIADFGALCAFRALIAETNALKGAYNHALNQMLPALVKVDEPEEAEESPRLRFFNGRINDLPKFPVAERETPPDTETIIRQLEDMARVIPDTAEILGYIHRIRHKAARRKPGSAVPLPQRVALYCAIRMERNPEEDPSTVAGHFLGEIDRVCEKRRQGLVRTPFDSQIRARYMDIISFRATLAHPDRWTEIQFLRSNAASRRVRAETISAPFEGFSWTSNRTNPAPQYGMALAKDANAPADAPELCICLSPSSAAFSVREKGGDLIYMRPTGGRRGKDNPGKEITWVPGSFDEYPASGVALKLRLYFGRSQARRMLTNKTWGLLSDNPRVFAANAELVGKKRNPQDRWKLFFHMVISGPPPVEYLDFSSDVRSRARTVIGINRGEVNPLAYAVVSVEDGQVLEEGLLGKKEYIDQLIETRRRISEYQSREQTPPRDLRQRVRHLQDTVLGSARAKIHSLIAFWKGILAIERLDDQFHGREQKIIPKKTYLANKTGFMNALSFSGAVRVDKKGNPWGGMIEIYPGGISRTCTQCGTVWLARRPKNPGHRDAMVVIPDIVDDAAATGFDNVDCDAGTVDYGELFTLSREWVRLTPRYSRVMRGTLGDLERAIRQGDDRKSRQMLELALEPQPQWGQFFCHRCGFNGQSDVLAATNLARRAISLIRRLPDTDTPPTP

SEQ ID NO: 4 - RNA, 108 nt, synthetic construct
  source 1..108: mol_type = other RNA
acatctggcgcgtttattccattactttggagccagtcccagcgactatgtcgtatggacgaagcgcttatttatcggagagaaaccgataagtaaaacgcatcaaag

SEQ ID NO: 5 - RNA, 108 nt, synthetic construct
  source 1..108: mol_type = other RNA
tactggcgcttttatctcattactttgagagccatcaccagcgactatgtcgtatgggtaaagcgcttatttatcggagagaaatccgataaataagaagcatcaaag

SEQ ID NO: 6 - RNA, 81 nt, synthetic construct
  source 1..81: mol_type = other RNA
acatctggcgcgtttattccattactttggagccagtcccagcgactatgtcgtatggacgaagcgcttatttatcggaga

SEQ ID NO: 7 - RNA, 78 nt, synthetic construct
  source 1..78: mol_type = other RNA
acatctggcgcgtttattccattactttggagccagtcccagcgactatgtcgtatggacgaagcgcttatttatcgg

SEQ ID NO: 8 - RNA, 80 nt, synthetic construct
  source 1..80: mol_type = other RNA
tactggcgcttttatctcattactttgagagccatcaccagcgactatgtcgtatgggtaaagcgcttatttatcggaga

SEQ ID NO: 9 - RNA, 77 nt, synthetic construct
  source 1..77: mol_type = other RNA
tactggcgcttttatctcattactttgagagccatcaccagcgactatgtcgtatgggtaaagcgcttatttatcgg

SEQ ID NO: 10 - RNA, 25 nt, synthetic construct
  source 1..25: mol_type = other RNA
gtttacacactccctctcatagggt

SEQ ID NO: 11 - RNA, 25 nt, synthetic construct
  source 1..25: mol_type = other RNA
gtttacacactccctctcatgaggt

SEQ ID NO: 12 - RNA, 25 nt, synthetic construct
  source 1..25: mol_type = other RNA
ttttacataccccctctcatgggat

SEQ ID NO: 13 - RNA, 25 nt, synthetic construct
  source 1..25: mol_type = other RNA
gtttacacactccctctcatggggg

SEQ ID NO: 14 - RNA, 20 nt, synthetic construct
  source 1..20: mol_type = other RNA
ccagcgactatgtcgtatgg

SEQ ID NO: 15 - RNA, 39 nt, synthetic construct
  source 1..39: mol_type = other RNA
gcgcttatttatcggagagaaatccgataaataagaagc

SEQ ID NO: 16 - RNA, 74 nt, synthetic construct
  source 1..74: mol_type = other RNA
ggcgcttttatctcattactttgagagccatcaccagcgactatgtcgtatgggtaaagcgcttatttatcgga

SEQ ID NO: 17 - protein, 979 aa, synthetic construct
QEIKRINKIRRRLVKDSNTKKAGKTRGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASYPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAV

SEQ ID NO: 18 - protein, 977 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAV

SEQ ID NO: 19 - protein, 979 aa, synthetic construct
QEIKRINKIRRRLVKDSNTKKAGKTRGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAV

SEQ ID NO: 20 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASNPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAV

SEQ ID NO: 21 - protein, 979 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGYGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAV

SEQ ID NO: 22 - protein, 979 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGWGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAV

SEQ ID NO: 23 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASYPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAV

SEQ ID NO: 24 - protein, 978 aa, synthetic construct
QEIKRINKIRRRLVKDSNTKKAGKTRGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAV

SEQ ID NO: 25 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAV

SEQ ID NO: 26 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTIHTSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAV

SEQ ID NO: 27 - protein, 977 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNHNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAV

SEQ ID NO: 28 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGAPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAV

SEQ ID NO: 29 - protein, 978 aa, synthetic construct
RQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAV

SEQ ID NO: 30 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHIQLRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAV

SEQ ID NO: 31 - protein, 977 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTTQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAV

SEQ ID NO: 32 - protein, 977 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKRSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAV

SEQ ID NO: 33 - protein, 977 aa, synthetic construct
QEIKRINKIRRRLVKDSNTKKAGKTYPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAV

SEQ ID NO: 34 - protein, 977 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTIHSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAV

SEQ ID NO: 35 - protein, 977 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAATQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAV

SEQ ID NO: 36 - protein, 977 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAAKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAV

SEQ ID NO: 37 - protein, 9 aa, synthetic construct
PKKKRKVSR

SEQ ID NO: 38 - protein, 39 aa, synthetic construct
PKKKRKVGGSPKKKRKVGGSPKKKRKVGGSPKKKRKVSR

SEQ ID NO: 39 - protein, 59 aa, synthetic construct
PKKKRKVGGSPKKKRKVGGSPKKKRKVGGSPKKKRKVGGSPKKKRKVGGSPKKKRKVSR

SEQ ID NO: 40 - protein, 11 aa, synthetic construct
PAAKRVKLDSR

SEQ ID NO: 41 - protein, 23 aa, synthetic construct
PAAKRVKLDGGSPAAKRVKLDSR

SEQ ID NO: 42 - protein, 47 aa, synthetic construct
PAAKRVKLDGGSPAAKRVKLDGGSPAAKRVKLDGGSPAAKRVKLDSR

SEQ ID NO: 43 - protein, 71 aa, synthetic construct
PAAKRVKLDGGSPAAKRVKLDGGSPAAKRVKLDGGSPAAKRVKLDGGSPAAKRVKLDGGSPAAKRVKLDSR

SEQ ID NO: 44 - protein, 18 aa, synthetic construct
KRPAATKKAGQAKKKKSR

SEQ ID NO: 45 - protein, 37 aa, synthetic construct
KRPAATKKAGQAKKKKGGSKRPAATKKAGQAKKKKSR

SEQ ID NO: 46 - protein, 21 aa, synthetic construct
PAAKRVKLDGGSPKKKRKVSR

SEQ ID NO: 47 - protein, 21 aa, synthetic construct
PAAKKKKLDGGSPKKKRKVSR

SEQ ID NO: 48 - protein, 11 aa, synthetic construct
PAAKKKKLDSR

SEQ ID NO: 49 - protein, 35 aa, synthetic construct
PAAKKKKLDGGSPAAKKKKLDGGSPAAKKKKLDSR

SEQ ID NO: 50 - protein, 47 aa, synthetic construct
PAAKKKKLDGGSPAAKKKKLDGGSPAAKKKKLDGGSPAAKKKKLDSR

SEQ ID NO: 51 - protein, 13 aa, synthetic construct
PAKRARRGYKCSR

SEQ ID NO: 52 - protein, 26 aa, synthetic construct
PAKRARRGYKCGSPAKRARRGYKCSR

SEQ ID NO: 53 - protein, 9 aa, synthetic construct
PRRKREESR

SEQ ID NO: 54 - protein, 9 aa, synthetic construct
PYRGRKESR

SEQ ID NO: 55 - protein, 10 aa, synthetic construct
PLRKRPRRSR

SEQ ID NO: 56 - protein, 20 aa, synthetic construct
PLRKRPRRGSPLRKRPRRSR

SEQ ID NO: 57 - protein, 32 aa, synthetic construct
PAAKRVKLDGGKRTADGSEFESPKKKRKVGGS

SEQ ID NO: 58 - protein, 34 aa, synthetic construct
PAAKRVKLDGGKRTADGSEFESPKKKRKVPPPPG

SEQ ID NO: 59 - protein, 39 aa, synthetic construct
PAAKRVKLDGGKRTADGSEFESPKKKRKVGIHGVPAAPG

SEQ ID NO: 60 - protein, 39 aa, synthetic construct
PAAKRVKLDGGKRTADGSEFESPKKKRKVGGGSGGGSPG

SEQ ID NO: 61 - protein, 40 aa, synthetic construct
PAAKRVKLDGGKRTADGSEFESPKKKRKVPGGGSGGGSPG

SEQ ID NO: 62 - protein, 48 aa, synthetic construct
PAAKRVKLDGGKRTADGSEFESPKKKRKVAEAAAKEAAAKEAAAKAPG

SEQ ID NO: 63 - protein, 31 aa, synthetic construct
PAAKRVKLDGGKRTADGSEFESPKKKRKVPG

SEQ ID NO: 64 - protein, 22 aa, synthetic construct
PAAKRVKLDGGSPKKKRKVGGS

SEQ ID NO: 65 - protein, 21 aa, synthetic construct
PAAKRVKLDPPPPKKKRKVPG

SEQ ID NO: 66 - protein, 11 aa, synthetic construct
PAAKRVKLDPG

SEQ ID NO: 67 - protein, 21 aa, synthetic construct
PAAKRVKLDGGGSGGGSGGGS

SEQ ID NO: 68 - protein, 12 aa, synthetic construct
PAAKRVKLDPPP

SEQ ID NO: 69 - protein, 24 aa, synthetic construct
PAAKRVKLDGGGSGGGSGGGSPPP

SEQ ID NO: 70 - protein, 10 aa, synthetic construct
PKKKRKVPPP

SEQ ID NO: 71 - protein, 10 aa, synthetic construct
PKKKRKVGGS

SEQ ID NO: 72 - protein, 9 aa, synthetic construct
GSPKKKRKV

SEQ ID NO: 73 - protein, 39 aa, synthetic construct
GSPKKKRKVGGSPKKKRKVGGSPKKKRKVGGSPKKKRKV

SEQ ID NO: 74 - protein, 59 aa, synthetic construct
GSPKKKRKVGGSPKKKRKVGGSPKKKRKVGGSPKKKRKVGGSPKKKRKVGGSPKKKRKV

SEQ ID NO: 75 - protein, 11 aa, synthetic construct
GSPAAKRVKLD

SEQ ID NO: 76 - protein, 23 aa, synthetic construct
GSPAAKRVKLDGGSPAAKRVKLD

SEQ ID NO: 77 - protein, 47 aa, synthetic construct
GSPAAKRVKLDGGSPAAKRVKLDGGSPAAKRVKLDGGSPAAKRVKLD

SEQ ID NO: 78 - protein, 71 aa, synthetic construct
GSPAAKRVKLDGGSPAAKRVKLDGGSPAAKRVKLDGGSPAAKRVKLDGGSPAAKRVKLDGGSPAAKRVKLD

SEQ ID NO: 79 - protein, 18 aa, synthetic construct
GSKRPAATKKAGQAKKKK

SEQ ID NO: 80 - protein, 35 aa, synthetic construct
KRPAATKKAGQAKKKKGGSKRPAATKKAGQAKKKK

SEQ ID NO: 81 - protein, 41 aa, synthetic construct
GSPAAKRVKLGGSPAAKRVKLGGSPKKKRKVGGSPKKKRKV

SEQ ID NO: 82 - protein, 15 aa, synthetic construct
GSKLGPRKATGRWGS

SEQ ID NO: 83 - protein, 19 aa, synthetic construct
GSKRKGSPERGERKRHWGS

SEQ ID NO: 84 - protein, 31 aa, synthetic construct
GSPKKKRKVGSGSKRPAATKKAGQAKKKKLE

SEQ ID NO: 85 - protein, 30 aa, synthetic construct
GPKRTADSQHSTPPKTKRKVEFEPKKKRKV

SEQ ID NO: 86 - protein, 36 aa, synthetic construct
GGGSGGGSKRTADSQHSTPPKTKRKVEFEPKKKRKV

SEQ ID NO: 87 - protein, 45 aa, synthetic construct
AEAAAKEAAAKEAAAKAKRTADSQHSTPPKTKRKVEFEPKKKRKV

SEQ ID NO: 88 - protein, 40 aa, synthetic construct
GPPKKKRKVGGSKRTADSQHSTPPKTKRKVEFEPKKKRKV

SEQ ID NO: 89 - protein, 28 aa, synthetic construct
GPAEAAAKEAAAKEAAAKAPAAKRVKLD

SEQ ID NO: 90 - protein, 23 aa, synthetic construct
GPGGGSGGGSGGGSPAAKRVKLD

SEQ ID NO: 91 - protein, 21 aa, synthetic construct
GPPKKKRKVPPPPAAKRVKLD

SEQ ID NO: 92 - protein, 11 aa, synthetic construct
GPPAAKRVKLD

SEQ ID NO: 93 - protein, 9 aa, synthetic construct
GSPKKKRKV

SEQ ID NO: 94 - protein, 11 aa, synthetic construct
GSPAAKRVKLD

SEQ ID NO: 95 - protein, 19 aa, synthetic construct
VGSKRPAATKKAGQAKKKK

SEQ ID NO: 96 - protein, 44 aa, synthetic construct
TGGGPGGGAAAGSGSPKKKRKVGSGSKRPAATKKAGQAKKKKLE

SEQ ID NO: 97 - protein, 44 aa, synthetic construct; identical to SEQ ID NO: 96

SEQ ID NO: 98 - protein, 26 aa, synthetic construct
TGGGPGGGAAAGSGSPKKKRKVGSGS

SEQ ID NO: 99 - protein, 13 aa, synthetic construct
PPPPKKKRKVPPP

SEQ ID NO: 100 - protein, 13 aa, synthetic construct
GGSPKKKRKVPPP

SEQ ID NO: 101 - protein, 10 aa, synthetic construct
PPPPKKKRKV

SEQ ID NO: 102 - protein, 10 aa, synthetic construct
GGSPKKKRKV

SEQ ID NO: 103 - protein, 19 aa, synthetic construct
GGSPKKKRKVGGSGGSGGS

SEQ ID NO: 104 - protein, 20 aa, synthetic construct
GGSPKKKRKVGGSPKKKRKV

SEQ ID NO: 105 - protein, 26 aa, synthetic construct
GGSGGSGGSPKKKRKVGGSPKKKRKV

SEQ ID NO: 106 - protein, 22 aa, synthetic construct
VGGGSGGGSGGGSPAAKRVKLD

SEQ ID NO: 107 - protein, 13 aa, synthetic construct
VPPPPAAKRVKLD

SEQ ID NO: 108 - protein, 25 aa, synthetic construct
VPPPGGGSGGGSGGGSPAAKRVKLD

SEQ ID NO: 109 - protein, 22 aa, synthetic construct
VGGGSGGGSGGGSPAAKRVKLD

SEQ ID NO: 110 - protein, 13 aa, synthetic construct
VPPPPAAKRVKLD

SEQ ID NO: 111 - protein, 25 aa, synthetic construct
VPPPGGGSGGGSGGGSPAAKRVKLD

SEQ ID NO: 112 - protein, 12 aa, synthetic construct
VGSPAAKRVKLD

SEQ ID NO: 113 - protein, 511 aa, Vesiculovirus Vesicular Stomatitis virus
MKCLLYLAFLFIGVNCKFTIVFPHNQKGNWKNVPSNYHYCPSSSDLNWHNDLIGTALQVKMPKSHKAIQADGWMCHASKWVTTCDFRWYGPKYITHSIRSFTPSVEQCKESIEQTKQGTWLNPGFPPQSCGYATVTDAEAVIVQVTPHHVLVDEYTGEWVDSQFINGKCSNYICPTVHNSTTWHSDYKVKGLCDSNLISMDITFFSEDGELSSLGKEGTGFRSNYFAYETGGKACKMQYCKHWGVRLPSGVWFEMADKDLFAAARFPECPEGSSISAPSQTSVDVSLIQDVERILDYSLCQETWSKIRAGLPISPVDLSYLAPKNPGTGPAFTIINGTLKYFETRYIRVDIAAPILSRMVGMISGTTTERELWDDWAPYEDVEIGPNGVLRTSSGYKFPLYMIGHGMLDSDLHLSSKAQVFEHPHIQDAASQLPDDESLFFGDTGLSKNPIELVEGWFSSWKSSIASFFFIIGLIIGLFLVLRVGIHLCIKLKHTKKRQIYTDIEMNRLGK

SEQ ID NO: 114 - protein, 511 aa, Lentivirus Human Immunodeficiency virus; identical to SEQ ID NO: 113

SEQ ID NO: 115 - protein, 856 aa, Alpharetrovirus Avian leukosis virus
MRVKEKYQHLWRWGWRWGTMLLGMLMICSATEKLWVTVYYGVPVWKEATTTLFCASDAKAYDTEVHNVWATHACVPTDPNPQEVVLVNVTENFNMWKNDMVEQMHEDIISLWDQSLKPCVKLTPLCVSLKCTDLKNDTNTNSSSGRMIMEKGEIKNCSFNISTSIRGKVQKEYAFFYKLDIIPIDNDTTSYKLTSCNTSVITQACPKVSFEPIPIHYCAPAGFAILKCNNKTFNGTGPCTNVSTVQCTHGIRPVVSTQLLLNGSLAEEEVVIRSVNFTDNAKTIIVQLNTSVEINCTRPNNNTRKRIRIQRGPGRAFVTIGKIGNMRQAHCNISRAKWNNTLKQIASKLREQFGNNKTIIFKQSSGGDPEIVTHSFNCGGEFFYCNSTQLFNSTWFNSTWSTEGSNNTEGSDTITLPCRIKQIINMWQKVGKAMYAPPISGQIRCSSNITGLLLTRDGGNSNNESEIFRPGGGDMRDNWRSELYKYKVVKIEPLGVAPTKAKRRVVQREKRAVGIGALFLGFLGAAGSTMGAASMTLTVQARQLLSGIVQQQNNLLRAIEAQQHLLQLTVWGIKQLQARILAVERYLKDQQLLGIWGCSGKLICTTAVPWNASWSNKSLEQIWNHTTWMEWDREINNYTSLIHSLIEESQNQQEKNEQELLELDKWASLWNWFNITNWLWYIKLFIMIVGGLVGLRIVFAVLSIVNRVRQGYSPLSFQTHLPTPRGPDRPEGIEEEGGERDRDRSIRLVNGSLALIWDDLRSLCLFSYHRLRDLLLIVTRIVELLGRRGWEALKYWWNLLQYWSQELKNSAVSLLNATAIAVAEGTDRVIEVVQGACRAIRHIPRRIRQGLERILL

SEQ ID NO: 116 - protein, 601 aa, Alpharetrovirus Rous Sarcoma virus
MEAVIKAFLTGYPGKTSKKDSKEKPLATSKKDPEKTPLLPTRVNYILIIGVLVLCEVTGVRADVHLLEQPGNLWITWANRTGQTDFCLSTQSATSPFQTCLIGIPSPISEGDFKGYVSDTNCSTVGTDRLVLSASITGGPDNSTTLTYRKVSCLLLKLNVSMWDEPPELQLLGSQSLPNVTNITQVSGVAGGCVYFAPRATGLFLGWSKQGLSRFLLRHPFTSTSNSTEPFTVVTADRHNLFMGSEYCGAYGYRFWEIYNCSQTRNTYRCGDVGGTGLPETWCRGKGGIWVNQSKEINETEPFSFTANCTGSNLGNVSGCCGEPITILPLGAWIDSTQGSFTKPKALPPAIFLICGDRAWQGIPSRPVGGPCYLGKLTMLAPNHTDILKILANSSRTGIRRKRSVSHLDDTCSDEVQLWGPTARIFASILAPGVAAAQALREIERLACWSVKQANLTTSLLGDLLDDVTSIRHAVLQNRAAIDFLLLAHGHGCEDVAGMCCFNLSDHSESIQKKFQLMKKHVNKIGVDSDPIGSWLRGIFGGIGEWAVHLLKGLLLGLVVILLLLVCLPCLLQFVSSSIRKMINSSINYHTEYRKMQGGAV

SEQ ID NO: 117 - protein, 688 aa, Betaretrovirus Mouse mammary tumor virus
MPKHQSGSPTDSSDLLLSGKKQRPHLALRRKRRREMRKINRKVPRMNLVPIKEKTAWQHLQALISEAEEVLKTSQTPQTSLTLFLALLSVLGPPPVTGESYWAYLPKPPILHPVGWGSTDPIRVLTNQTMYLGGSPDFHGFRNMSGNVHFEGKSDTLPICLSFSFSTPTGCFQVDKQVFLSDTPTVDNNKPGGKGDKRRMWELWLTTLGNSGANTKLVPIKKKLPPKYPHCQIAFKKDAFWEGDESAPPRWLPCAFPDQGVSFSPKGALGLLWDFSLPSPSVDQSDQIKSKKNLFGNYTPPVNKEVHRWYEAGWVEPTWFWENSPKDPNDRDFTALVPHTELFRLVAASRHLILKRPGFQEHEMIPTSACVTYPYAILLGLPQLIDIEKRGSTFHISCSSCRLTNCLDSSAYDYAAIIVKRPPYVLLPVDIGDEPWFDDSAIQTFRYATDLIRAKRFVAAIILGISALIAIITSFAVATTALVKEMQTATFVNNLHRNVTLALSEQRIIDLKLEARLNALEEVVLELGQDVANLKTRMSTRCHANYDFICVTPLPYNATENWERTRAHLLGIWNDNEISYNIQELTNLISDMSKQHIDAVDLSGLAQSFANGVKALNPLDWTQYFIFIGVGALLLVIVLMIFPIVFQCLAKSLDQVQSDLNVLLLKKKKGGNAAPAAEMVELPRVSYT

SEQ ID NO: 118 - protein, 488 aa, Deltaretrovirus Human T-lymphotropic virus 1
MGKFLATLILFFQFCPLIFGDYSPSCCTLTIGVSSYHSKPCNPAQPVCSWTLDLLALSADQALQPPCPNLVSYSSYHATYSLYLFPHWTKKPNRNGGGYYSASYSDPCSLKCPYLGCQSWTCPYTGAVSSPYWKFQHDVNFTQEVSRLNINLHFSKCGFPFSLLVDAPGYDPIWFLNTEPSQLPPTAPPLLPHSNLDHILEPSIPWKSKLLTLVQLTLQSTNYTCIVCIDRASLSTWHVLYSPNVSVPSSSSTPLLYPSLALPAPHLTLPFNWTHCFDPQIQAIVSSPCHNSLILPPFSLSPVPTLGSRSRRAVPVAVWLVSALAMGAGVAGGITGSMSLASGKSLLHEVDKDISQLTQAIVKNHKNLLKIAQYAAQNRRGLDLLFWEQGGLCKALQEQCRFPNITNSHVPILQERPPLENRVLTGWGLNWDLGLSQWAREALQTGITLVALLLLVILAGPCILRQLRHLPSRVRYPHYSLIKPESSL

SEQ ID NO: 119 - protein, 565 aa, Gammaretrovirus RD114 Endogenous Feline Retrovirus
MKLPTGMVILCSLIIVRAGFDDPRKAIALVQKQHGKPCECSGGQVSEAPPNSIQQVTCPGKTAYLMTNQKWKCRVTPKNLTPSGGELQNCPCNTFQDSMHSSCYTEYRQCRANNKTYYTATLLKIRSGSLNEVQILQNPNQLLQSPCRGSINQPVCWSATAPIHISDGGGPLDTKRVWTVQKRLEQIHKAMHPELQYHPLALPKVRDDLSLDARTFDILNTTFRLLQMSNFSLAQDCWLCLKLGTPTPLAIPTPSLTYSLADSLANASCQIIPPLLVQPMQFSNSSCLSSPFINDTEQIDLGAVTFTNCTSVANVSSPLCALNGSVFLCGNNMAYTYLPQNWTGLCVQASLLPDIDIIPGDEPVPIPAIDHYIHRPKRAVQFIPLLAGLGITAAFTTGATGLGVSVTQYTKLSHQLISDVQVLSGTIQDLQDQVDSLAEVVLQNRRGLDLLTAEQGGICLALQEKCCFYANKSGIVRNKIRTLQEELQKRRESLASNPLWTGLQGFLPYLLPLLGPLLTLLLILTIGPCVFSRLMAFINDRLNVVHAMVLAQQYQALKAEEEAQD

SEQ ID NO: 120 - protein, 685 aa, Gammaretrovirus Gibbon ape leukemia virus
MVLLPGSMLLTSSLHHLRHQMSPGSWKRLIILLSCVFGGGGTSLQNKNPHQPMTLTWQVLSQTGDVVWDTKAVQPPWTWWPTLKPDICALAAGLESWDIPGTDVSSSKRVRPPDSDYTAAYKQITWGAIGCSYPRARTRMASSTFYVCPRDGRTPSEARRCGGLESLYCKEWNCETTGTGYWLPKSSKDLITGRWDQNSKWDQKFQKCHQTGWCNPLKIDFTDTGKSSRDWIVGKTWGLRFYVHGHPGVQFTIRLKITSMTAVAVGPDPVLVEQGPPRRALALPPPLPPREAPPPPLPDSNSTTLATSAQTPTVGKTIVTLNTPPPTTGDRLFNLVQGAFLTLNATNPGATKSCWLCLAMGPPYYEAITSLGEVAYSTSQDRCHWGTQGKLTLTEVSGHGLCIGKVPFTHQHLCNQTLSINSSEGHQYLLPSNHSWWACSTGLTPCLSTSVFNQSRDFCIQVQLIPRIYYYPEEVLLQAYDDSHPRPKREAVSLTLAVLLGLGITAGIGTGSTALIKGPIDLQQGLTSLQIAIDADLRALQDSVSKLEDSLTSLSEVVLQNRRGLDLLFLKEGGLCAALKEECCFYIDHSGAVRDSMKKLKEKLDKRQLERQKNQNWYEGWFNNSPWFTTLLSTIAGPLLLLLLLLILGPCIINKLVQFINDRVSAVKILVLRTKYQALDNEDNL

SEQ ID NO: 121 - protein, 665 aa, Gammaretrovirus Moloney Murine leukemia virus
MARSTLSKPLKNKVNPRGPLIPLILLMLRGVSTASPGSSPHQVYNITWEVTNGDRETVWATSGNHPLWTWWPDLTPDLCMLAHHGPSYWGLEYQSPFSSPPGPPCCSGGSSPGCSRDCEEPLTSLTPRCNTAWNRLKLDQTTHKSNEGFYVCPGPHRPRESKSCGGPDSFYCAYWGCETTGRAYWKPSSSWDFITVNNNLTSDQAVQVCKDNKWCNPLVIRFTDAGRRVTSWTTGHYWGLRLYVSGQDPGLTFGIRLRYQNLGPRVPIGPNPVLADQQPLSKPKPVKSPSVTKPPSGTPLSPTQLPPAGTENRLLNLVDGAYQALNLTSPDKTQECWLCLVAGPPYYEGVAVLGTYSNHTSAPANCSVASQHKLTLSEVTGQGLCIGAVPKTHQALCNTTQTSSRGSYYLVAPTGTMWACSTGLTPCISTTILNLTTDYCVLVELWPRVTYHSPSYVYGLFERSNRHKREPVSLTLALLLGGLTMGGIAAGIGTGTTALMATQQFQQLQAAVQDDLREVEKSISNLEKSLTSLSEVVLQNRRGLDLLFLKEGGLCAALKEECCFYADHTGLVRDSMAKLRERLNQRQKLFESTQGWFEGLFNRSPWFTTLISTIMGPLIVLLMILLFGPCILNRLVQFVKDRISVVQALVLTQQYHQLKPIEYEP

SEQ ID NO: 122 - protein, 563 aa, Gammaretrovirus Baboon Endogenous virus
MGFTTKIIFLYNLVLVYAGFDDPRKAIELVQKRYGRPCDCSGGQVSEPPSDRVSQVTCSGKTAYLMPDQRWKCKSIPKDTSPSGPLQECPCNSYQSSVHSSCYTSYQQCRSGNKTYYTATLLKTQTGGTSDVQVLGSTNKLIQSPCNGIKGQSICWSTTAPIHVSDGGGPLDTTRIKSVQRKLEEIHKALYPELQYHPLAIPKVRDNLMVDAQTLNILNATYNLLLMSNTSLVDDCWLCLKLGPPTPLAIPNFLLSYVTRSSDNISCLIIPPLLVQPMQFSNSSCLFSPSYNSTEEIDLGHVAFSNCTSITNVTGPICAVNGSVFLCGNNMAYTYLPTNWTGLCVLATLLPDIDIIPGDEPVPIPAIDHFIYRPKRAIQFIPLLAGLGITAAFTTGATGLGVSVTQYTKLSNQLISDVQILSSTIQDLQDQVDSLAEVVLQNRRGLDLLTAEQGGICLALQEKCCFYVNKSGIVRDKIKTLQEELERRRKDLASNPLWTGLQGLLPYLLPFLGPLLTLLLLLTIGPCIFNRLTAFINDKLNIIHAMVLTQQYQVLRTDEEAQD

SEQ ID NO: 123 - protein, 985 aa, Spumavirus Human Foamy virus
MTLQQWIIWKKMNKAHEALQNTTTVTEQQKEQIILDIQNEEVQPTRRDKFRYLLYTCCATSSRVLAWMFLVCILLIIVLVSCFVTISRIQWNKDIQVLGPVIDWNVTQRAVYQPLQTRRIARSLRMQHPVPKYVEVNMTSIPQGVYYEPHPEPIVVKERVLGLSQILMINSENIANNANLTQEVKKLLTEMVNEEMQSLSDVMIDFEIPLGDPRDQEQYIHRKCYQEFANCYLVKYKEPKPWPKEGLIADQCPLPGYHAGLTYNRQSIWDYYIKVESIRPANWTTKSKYGQARLGSFYIPSSLRQINVSHVLFCSDQLYSKWYNIENTIEQNERFLLNKLNNLTSGTSVLKKRALPKDWSSQGKNALFREINVLDICSKPESVILLNTSYYSFSLWEGDCNFTKDMISQLVPECDGFYNNSKWMHMHPYACRFWRSKKNEKEETKCRDGETKRCLYYPLWDSPESTYDFGYLAYQKNFPSPICIEQQKIRDQDYEVYSLYQERKIASKAYGIDTVLFSLKNFLNYTGTPVNEMPNARAFVGLIDPKFPPSYPNVTREHYTSCNNRKRRSVDNNYAKLRSMGYALTGAVQTLSQISDINDENLQQGIYLLRDHVITLMEATLHDISVMEGMFAVQHLHTHLNHLKTMLLERRIDWTYMSSTWLQQQLQKSDDEMKVIKRIARSLVYYVKQTHSSPTATAWEIGLYYELVIPKHIYLNNWNVVNIGHLVKSAGQLTHVTIAHPYEIINKECVETIYLHLEDCTRQDYVICDVVKIVQPCGNSSDTSDCPVWAEAVKEPFVQVNPLKNGSYLVLASSTDCQIPPYVPSIVTVNETTSCFGLDFKRPLVAEERLSFEPRLPNLQLRLPHLVGIIAKIKGIKIEVTSSGESIKEQIERAKAELLRLDIHEGDTPAWIQQLAAATKDVWPAAASALQGIGNFLSGTAQGIFGTAFSLLGYLKPILIGVGVILLVILIFKIVSWIPTKKKNQ

SEQ ID NO: 124 - protein, 913 aa, Varicellovirus Pseudorabies virus
MPAGGGLWRGPRGHRPGHHGGAGLGRLWPAPHHAAAARGAVALALLLLALAAAPPCGAAAVTRAASASPTPGTGATPNDVSAEASLEEIEAFSPGPSEAPDGEYGDLDARTAVRAAATERDRFYVCPPPSGSTVVRLEPEQACPEYSQGRNFTEGIAVLFKENIAPHKFKAHIYYKNVIVTTVWSGSTYAAITNRFTDRVPVPVQEITDVIDRRGKCVSKAEYVRNNHKVTAFDRDENPVEVDLRPSRLNALGTRGWHTTNDTYTKIGAAGFYHTGTSVNCIVEEVEARSVYPYDSFALSTGDIVYMSPFYGLREGAHGEHIGYAPGRFQQVEHYYPIDLDSRLRASESVTRNFLRTPHFTVAWDWAPKTRRVCSLAKWREAEEMTRDETRDGSFRFTSRALGASFVSDVTQLDLQRVHLGDCVLREASEAIDAIYRRRYNSTHVLAGDRPEVYLARGGFVVAFRPLISNELAQLYARELERLGLAGVVGPAAPAAARRARRSPGPAGTPEPPAVNGTGHLRITTGSAEFARLQFTYDHIQAHVNDMLGRIAAAWCELQNKDRTLWSEMSRLNPSAVATAALGQRVSARMLGDVMAISRCVEVRGGVYVQNSMRVPGERGTCYSRPLVTFEHNGTGVIEGQLGDDNELLISRDLIEPCTGNHRRYFKLGSGYVYYEDYNYVRMVEVPETISTRVTLNLTLLEDREFLPLEVYTREELADTGLLDYSEIQRRNQLHALKFYDIDRVVKVDHNVVLLRGIANFFQGLGDVGAAVGKVVLGATGAVISAVGGMVSFLSNPFGALAIGLLVLAGLVAAFLAYRHISRLRRNPMKALYPVTTKTLKEDGVDEGDVDEAKLDQARDMIRYMSIVSALEQQEHKARKKNSGPALLASRVGAMATRRRHYQRLESEDPDAL

SEQ ID NO: 125 - protein, 400 aa, Varicellovirus Pseudorabies virus
MLLAALLAALVARTTLGADVDAVPAPTFPPPAYPYTESWQLTLTTVPSPFVGPADVYHTRPLEDPCGVVALISDPQVDRLLNEAVAHRRPTYRAHVAWYRIADGCAHLLYFIEYADCDPRQIFGRCRRRTTPMWWTPSADYMFPTEDELGLLMVAPGRFNEGQYRRLVSVDGVNILTDFMVALPEGQECPFARVDQHRTYKFGACWNDESFRRGVDVMRFLTPFYQQPPHREVVNYWYRKNGRTLPRAYAAATPYAIDPARPSAGSPRPRPRPRPRPKPEPAPVTPAPPGRLPEPATRDHAAGGHPTPRPPRPETPHRPFAPPAVVPSGWPQPAEPFQPRTPAAPGVSRHRSVIVGTGTAMGALLVGVCVYIFFRLRGAKGYRLLGGPADTDELKAQPGP

SEQ ID NO: 126 - protein, 686 aa, Varicellovirus Pseudorabies virus
MPASSVRLPLRLLTLAGLLALAGAAALARGAPQGGPPSPQGGPAPTAAPARGPTLFVLVGDGSAWFVFQLGGLGALNDTRIRGHLLGRYLVSYQVVPPPVSAWYFVQRPRERPRLSGPPSGAELVAFDAPGVRRTYTTAAVWPAEVAVLADAEARCPAAVFNVTLGEAFLGLRVALRSFLPLEVIISAERMRMIAPPALGSDLEPPGPPAGRFHVYTLGFLSDGAMHQTMRDVAAYVHESDDYLAQLSAAHAAALAAVVQPGPYYFYRAAVRLGVAAFVFSEAARRDRRASAPALLRVESDARLLSRLLMRAAGCPAGFAGLFDGRAERVPVAPADQLRAAWTFGEDPAPRLDLARATVAEAYRRSVRGKPFDQQALFFAVALLLRAGGPGDARETLLRTTAMCTAERAAAAAELTRAALSPTAAWNEPFSLLDVLSPCAVSLRRDLGGDATLANLGAAARLALAPAGAPGAAAATDEGAEEEEEDPVARAAPEIPAEALLALPLRGGASFVFTRRRPDCGPAYTLGGVDIANPLVLAIVSNDSAACDYTDRMPESQHLPATDNPSVCVYCDCVFVRYSSAGTILETVLIESKDMEEQLMAGANSTIPSFNPTLHGGDVKALMLFPNGTVVDLLSFTSTRLAPVSPAYVVASVVGAAITVGILYALFKMLCSFSSEGYSRLINARS

SEQ ID NO: 127 - protein, 156 aa, Varicellovirus Pseudorabies virus
MSPLVAVLVFFSAALGIPGPGVAGNPRGLDAIFEAPVTPAPPTRHPRREELEWDDEDHPLLDLEPPVGSRCHPYIAYSLPPDMNAVTSVVVKPYCSPPEVILWASGTAYLVNPFVAIQALAVGEPLNEAALKELGEVAVHKDSLPPLRYNGGPPAE

SEQ ID NO: 128 - protein, 904 aa, Simplexvirus Herpes simplex virus 1
MRQGAPARGRRWFVVWALLGLTLGVLVASAAPSSPGTPGVAAATQAANGGPATPAPPAPGAPPTGDPKPKKNKKPKPPKPPRPAGDNATVAAGHATLREHLRDIKAENTDANFYVCPPPTGATVVQFEQPRRCPTRPEGQNYTEGIAVVFKENIAPYKFKATMYYKDVTVSQVWFGHRYSQFMGIFEDRAPVPFEEVIDKINAKGVCRSTAKYVRNNLETTAFHRDDHETDMELKPANAATRTSRGWHTTDLKYNPSRVEAFHRYGTTVNCIVEEVDARSVYPYDEFVLATGDFVYMSPFYGYREGSHTEHTSYAADRFKQVDGFYARDLTTKARATAPTTRNLLTTPKFTVAWDWVPKRPSVCTMTKWQEVDEMLRSEYGGSFRFSSDAISTTFTTNLTEYPLSRVDLGDCIGKDARDAMDRIFARRYNATHIKVGQPQYYLANGGFLIAYQPLLSNTLAELYVREHLREQSRKPPNPTPPPPGASANASVERIKTTSSIEFARLQFTYNHIQRHVNDMLGRVAIAWCELQNHELTLWNEARKLNPNAIASATVGRRVSARMLGDVMAVSTCVPVAADNVIVQNSMRISSRPGACYSRPLVSFRYEDQGPLVEGQLGENNELRLTRDAIEPCTVGHRRYFTFGGGYVYFEEYAYSHQLSRADITTVSTFIDLNITMLEDHEFVPLEVYTRHEIKDSGLLDYTEVQRRNQLHDLRFADIDTVIHADANAAMFAGLGAFFEGMGDLGRAVGKVVMGIVGGVVSAVSGVSSFMSNPFGALAVGLLVLAGLAAAFFAFRYVMRLQSNPMKALYPLTTKELKNPTNPDASGEGEEGGDFDEAKLAEAREMIRYMALVSAMERTEHKAKKKGTSALLSAKVTDMVMRKRRNTNYTQVPNKDGDADEDDL

SEQ ID NO: 129 - protein, 394 aa, Simplexvirus Herpes simplex virus 1
MGGAAARLGAVILFVVIVGLHGVRSKYALVDASLKMADPNRFRGKDLPVLDQLTDPPGVRRVYHIQAGLPDPFQPPSLPITVYYAVLERACRSVLLNAPSEAPQIVRGASEDVRKQPYNLTIAWFRMGGNCAIPITVMEYTECSYNKSLGACPIRTQPRWNYYDSFSAVSEDNLGFLMHAPAFETAGTYLRLVKINDWTEITQFILEHRAKGSCKYALPLRIPPSACLSPQAYQQGVTVDSIGMLPRFIPENQRTVAVYSLKIAGWHGPKAPYTSTLLPPELSETPNATQPELAPEDPEDSALLEDPVGTVAPQIPPNWHIPSIQDAATPYHPPATPNNMGLIAGAVGGSLLAALVICGIVYWMRRHTQKAPKRIRLPHIREDDQPSSHQPLFY

SEQ ID NO: 130 - protein, 838 aa, Simplexvirus Herpes simplex virus 1
MGNGLWFVGVIILGVAWGQVHDWTEQTDPWFLDGLGMDRMYWRDTNTGRLWLPNTPDPQKPPRGFLAPPDELNLTTASLPLLRWYEERFCFVLVTTAEFPRDPGQLLYIPKTYLLGRPPNASLPAPTTVEPTAQPPPSVAPLKGLLHNPVASVLLRSRAWVTFSAVPDPEALTFPRGDNVATASHPSGPRDTPPPRPPVGARRHPTTELDITHLHNASTTWLATRGLLRSPGRYVYFSPSASTWPVGIWTTGELVLGCDAALVRARYGREFMGLVISMHDSPPVEVMVVPAGQTLDRVGDPADENPPGALPGPPGGPRYRVFVLGSLTRADNGSALDALRRVGGYPEEGTNYAQFLSRAYAEFFSGDAGAEQGPRPPLFWRLTGLLATSGFAFVNAAHANGAVCLSDLLGFLAHSRALAGLAARGAAGCAADSVFFNVSVLDPTARLQLEARLQHLVAEILEREQSLALHALGYQLAFVLDSPSAYDAVAPSAAHLIDALYAEFLGGRVLTTPVVHRALFYASAVLRQPFLAGVPSAVQRERARRSLLIASALCTSDVAAATNADLRTALARADHQKTLFWLPDHFSPCAASLRFDLDESVFILDALAQATRSETPVEVLAQQTHGLASTLTRWAHYNALIRAFVPEASHRCGGQSANVEPRILVPITHNASYVVTHSPLPRGIGYKLTGVDVRRPLFLTYLTATCEGSTRDIESKRLVRTQNQRDLGLVGAVFMRYTPAGEVMSVLLVDTDNTQQQIAAGPTEGAPSVFSSDVPSTALLLFPNGTVIHLLAFDTQPVAAIAPGFLAASALGVVMITAALAGILKVLRTSVPFFWRRE

SEQ ID NO: 131 - protein, 224 aa, Simplexvirus Herpes simplex virus 1
MGILGWVGLIAVGVLCVRGGLPSTEYVIRSRVAREVGDILKVPCVPLPSDDLDWRYETPSAINYALIDGIFLRYHCPGLDTVLWDRHAQKAYWVNPFLFVAGFLEDLSYPAFPANTQETETRLALYKEIRQALDSRKQAASHTPVKAGCVNFDYSRTRRCVGRQDLGPTNGTSGRTPVLPPDDEAGLQPKPLTTPPPIIATSDPTPRRDAATKSRRRRPHSRRL

SEQ ID NO: 132 - protein, 581 aa, Hepacivirus Hepatitis C virus
MGCSFSIFLLALLSCLTVPASAVEVRNVSSSYYATNDCSNSSITWQLNNAVLHLPGCVPCENDNGTLHCWIQVTPNVAVKHRGALTHNLRTHVDMIVMAATVCSALYVGDMCGAVMIVSQALIISPERHNFTQECNCSIYQGHITGHRMAWDMMLNWSPTLTMILAYAARVPELVLEVVFGGHWGVVFGLAYFSMQGAWAKVIAILLLVAGVDAETHTTGSAAGHAARGFANLLSPGSKQKISLINTNGSWHINRTALNCNDSLQTGFLASLFYVNNFNSSGCPERMSSCRGLDDFRIGWGTLEYETNVTNEEDMRPYCWHYPPKPCGIISARTVCGPVYCFTPSPVVVGTTDEQGLPTYSWGENETDVFLLNSTRPPQGAWFGCTWMNGTGFTKTCGAPPCRIRRDFNSTLDLLCPTDCFRKHPDTTYLKCGAGPWLTPRCLVDYPYRLWHYPCTVNFTIFKVRMYVGGVEHRLSAACNFTRGDRCRLEDRDRGQQSPLLHSTTEWAVLPCSFSDLPALSTGLLHLHQNIVDVQYLYGLTPAITKYIVKWEWVVLLFLLLADARVCACLWMLIILGQAEA

SEQ ID NO: 133 - protein, 524 aa, Lyssavirus Rabies virus
MVPQALLFVPLLVFPLCFGKFPIYTIPDKLGPWSPIDIHHLSCPNNLVVEDEGCTNLSGFSYMELKVGYILAIKVNGFTCTGVVTEAETYTNFVGYVTTTFKRKHFRPTPDACRAAYNWKMAGDPRYEESLHNPYPDYRWLRTVKTTKESLVIISPSVADLDPYDRSLHSRVFPSGKCSGVAVSSTYCSTNHDYTIWMPENPRLGMSCDIFTNSRGKRASKGSETCGFVDERGLYKSLKGACKLKLCGVLGLRLMDGTWVSMQTSNETKWCPPDKLVNLHDFRSDEIEHLVVEELVRKREECLDALESIMTTKSVSFRRLSHLRKLVPGFGKAYTIFNKTLMEADAHYKSVRTWNEILPSKGCLRVGGRCHPHVNGVFFNGIILGPDGNVLIPEMQSSLLQQHMELLESSVIPLVHPLADPSTVFKDGDEAEDFVEVHLPDVHNQVSGVDLGLPNWGKYVLLSAGALTALMLIIFLMTCCRRVNRSEPTQHNLRGTGREVSVTPQSGKIISSWESHKSGGETRL

SEQ ID NO: 134 - protein, 522 aa, Lyssavirus Mokola virus
MNIPCFVVILSLATTHSLGEFPLYTIPEKIEKWTPIDMIHLSCPNNLLSEEEGCNAESSFTYFELKSGYLAHQKVPGFTCTGVVNEAETYTNFVGYVTTTFKRKHFRPTVAACRDAYNWKVSGDPRYEESLHTPYPDSSWLRTVTTTKESLLIISPSIVEMDIYGRTLHSPMFPSGVCSNVYPSVPSCETNHDYTLWLPEDPSLSLVCDIFTSSNGKKAMNGSRICGFKDERGFYRSLKGACKLTLCGRPGIRLFDGTWVSFTKPDVHVWCTPNQLINIHNDRLDEIEHLIVEDIIKKREECLDTLETILMSQSVSFRRLSHFRKLVPGYGKAYTILNGSLMETNVYYKRVDKWADILPSKGCLKVGQQCMEPVKGVLFNGIIKGPDGQILIPEMQSEQLKQHMDLLKAAVFPLRHPLISREAVFKKDGDADDFVDLHMPDVHKSVSDVDLGLPHWGFWMLIGATIVAFVVLVCLLRVCCKRVRRRRSGRATQEIPLSFPSAPVPRAKVVSSWESYKGLPGT

SEQ ID NO: 135 - protein, 550 aa, Morbillivirus Measles virus
MGLKASVSAIFMTVLLTLQTPTGQIHWGNLSKIGVVGIGSASYKVMTRSSHQSLVIKLMPNITLLNNCTRVEIAEYRRLLRTVLEPIRDALNAMTQNIRPVQSVASSRRHKRFAGVVLAGAALGVATAAQITAGIALHQSMLNSQAIDNLRASLETTNQAIETIRQAGQEMILAVQGIQDYINNELIPSMNQLSCDLIGQKLGLKLLRYYTEILSLFGPSLRDPISAEISIQALSYALGGDINKVLEKLGYSGGDLLGILESRGIKARITHVDTESYFIVLSIAYPTLSEIKGVIVHRLEGVSYNIGSQEWYTTVPKYVATQGYLISNFDESSCTFMPEGTVCSQNALYPMSPLLQECLRGSTKSCARTLVSGSFGNRFILSQGNLIANCASILCKCYTTGTIINQDPDKILTYIAADYCPVVEVNGVTIQVGSRKYPDAVYLHRIDLGPPISLERLDVGTNLGNAVAKLEDAKELLESSDQILRSMKGLSSTNIVYILIAVCLGGLIGIPTLICCCRGRCNKKGGQVGMSRPGLKPDLTGTSKSYVRSL

SEQ ID NO: 136 - protein, 617 aa, Morbillivirus Measles virus
MSPQRDRINAFYKDNPHPKGSRIVINREHLMIDRPYVLLAVLFVMFLSLIGLLAIAGIRLHRAAIYTAEIHKSLSTNLDVTNSIEHQVKDVLTPLFKIIGDEVGLRTPQRFTDLVKFISDKIKFLNPDREYDFRDLTWCINPPERIKLDYDQYCADVAAEELMNALVNSTLLETRTTNQFLAVSKGNCSGPTTIRGQFSNMSLSLLDLYLSRGYNVSSIVTMTSQGMYGGTYLVEKPNLSSKGSELPQPSMHRVFEVGVIRNPGLGAPVFHMTNYFEQPVSNDFSNCMVALGELKLAALCHGEDSITIPYQGSGKGVSFQLVKLGVWKSPTDMQSWVPLSTDDPVIDRLYLSSHRGIIADNQAKWAVPTTRTDDKLRMETCFQQACKGKIQALCENPEWAPLKDNRIPSYGVLSVDLSLAVELKIKIASGFGPLITHGSGMDLYKSNHNNVYWLTIPPMKNLALGVINTLEWIPRFKVSPNLFTVPIKEAGEDCHAPTYLPAEVDGDVKLSSNLVILPGQDLQYVLATYDTSRVEHAVVYYVYSPSRSFSYFYPFRLPIKGVPIELQVECFTWDQKLWCRHFCVLADSESGGHITHSGMVGMGVSCTVTREDGTNRG

SEQ ID NO: 137 - protein, 676 aa, Ebolavirus Zaire ebolavirus
MGVTGILQLPRDRFKRTSFFLWVIILFQRTFSIPLGVIHNSTLQVSDVDKLVCRDKLSSTNQLRSVGLNLEGNGVATDVPSATKRWGFRSGVPPKVVNYEAGEWAENCYNLEIKKPDGSECLPAAPDGIRGFPRCRYVHKVSGTGPCAGDFAFHKEGAFFLYDRLASTVIYRGTTFAEGVVAFLILPQAKKDFFSSHPLREPVNATEDPSSGYYSTTIRYQATGFGTNETEYLFEVDNLTYVQLESRFTPQFLLQLNETIYTSGKRSNTTGKLIWKVNPEIDTTIGEWAFWETKKNLTRKIRSEELSFTVVSNGAKNISGQSPARTSSDPGTNTTTEDHKIMASENSSAMVQVHSQGREAAVSHLTTLATISTSPQSLTTKPGPDNSTHNTPVYKLDISEATQVEQHHRRTDNDSTASDTPSATTAAGPPKAENTNTSKSTDFLDPATTTSPQNHSETAGNNNTHHQDTGEESASSGKLGLITNTIAGVAGLITGGRRTRREAIVNAQPKCNPNLHYWTTQDEGAAIGLAWIPYFGPAAEGIYIEGLMHNQDGLICGLRQLANETTQALQLFLRATTELRTFSILNRKAIDFLLQRWGGTCHILGPDCCIEPHDWTKNITDKIDQIIHDFVDKTLPDQGDNDNWWTGWRQWIPAGIGVTGVIIAVIALFCICKFVF

SEQ ID NO: 138 - protein, 495 aa, Flavivirus Dengue virus
MRCVGIGNRDFVEGLSGATWVDVVLEHGSCVTTMAKDKPTLDIELLKTEVTNPAVLRKLCIEAKISNTTTDSRCPTQGEATLVEEQDTNFVCRRTFVDRGWGNGCGLFGKGSLITCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGISYVMCTGSFKLEKEVAETQHGTVLVQVKYEGTDAPCKIPFSSQDEKGVTQNGRLVTANPIVTDKEKPVNIEAEPPFGESYIVVGAGEKALKLSWFKKGSSIGKMFEATARGARRMAILGDTAWDFGSIGGVFTSVGKLVHQIFGTAYGVLFSGVSWTMKIGIGILLTWLGLNSRSTSLSMTCIAVGMVTLYLGVMVQA

SEQ ID NO: 139 - protein, 505 aa, Flavivirus Zika virus
MIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 140 - protein, 427 aa, Flavivirus West Nile virus
MFNCLGMSNRDFLEGVSGATWVDLVLEGDSCVTIMSKDKPTIDVKMMNMEAANLAEVRSYCYLATVSDLSTKAACPTMGEAHNDKRADPAFVCRQGVVDRGWGNGCGLFGKGSIDTCAKFACSTKAIGRTILKENIKYEVAIFVHGPTTVESHGNYSTQVGATQAGRFSITPAAPSYTLKLGEYGEVTVDCEPRSGIDTNAYYVMTVGTKTFLVHREWFMDLNLPWSSAGSTVWRNRETLMEFEEPHATKQSVIALGSQEGALHQALAGAIPVEFSSNTVKLTSGHLKCRVKMEKLQLKGTTYGVCSKAFKFLGTPADTGHGTVVLELQYTGTDGPCKVPISSVASLNDLTPVGRLVTVNPFVSVATANAKVLIELEPPFGDSYIVVGRGEQQINHHWHKSGSSIGKAFTTTLKGAQRLAALGDTAW

SEQ ID NO: 141 - protein, 501 aa, Flavivirus Japanese Encephalitis virus
MFNCLGMGNRDFIEGASGATWVDLVLEGDSCLTIMANDKPTLDVRMINIEASQLAEVRSYCYHASVTDISTVARCPTTGEAHNEKRADSSYVCKQGFTDRGWGNGCGLFGKGSIDTCAKFSCTSKAIGRTIQPENIKYEVGIFVHGTTTSENHGNYSAQVGASQAAKFTVTPNAPSITLKLGDYGEVTLDCEPRSGLNTEAFYVMTVGSKSFLVHREWFHDLALPWTSPSSTAWRNRELLMEFEEAHATKQSVVALGSQEGGLHQALAGAIVVEYSSSVKLTSGHLKCRLKMDKLALKGTTYGMCTGKFSFAKNPADTGHGTVVIELSYSGRDGPCKIPIVSVASLNDMTPVGRLVTVNPFVATSSANSKVLVEMEPPFGDSYIVVGRGDKQINHHWHKAGSTLGKAFSTTLKGAQRLAALGDTAWDFGSIGGVFNSIGKAVHQVFGGAFRTLFGGMSWITQGLMGALLLWMGVNARDRSIALAFLATGGVLVFLATNVHA

SEQ ID NO: 142 - protein, 717 aa, Pegivirus Hepatitis G virus
MSLLTNRFIRRVDKDQWGPGVMGKDPKPCPSRWAGKCMGPPSSAAACSRGSPRILRVRAGGISLFYTIMAVLLLLLVVEAGAILAPATHACRANGQYFLTNCCAPEDIGFCLEGGCLVALGCTVCTDRCWPLYQAGLAVRPGKSAAQLVGELGSLYGPLSVSAYVAGILGLGEVYSGVLTVGVALRRRVYLMPNLKCAVECDVKWGSEFWRWTEQLASNYWILEYLWKVPFEFWRGVMSLTPLLVWVAALLLLEQRIVMVFLLVTMAGMLQGAPASVLGSRPFDYGLKWQSCSCRANGSRIPTGERVWDRGNVTLLCDCPNGPWVWVPAFCQAVGWGDPITHWSHGQNQWPLSCPQYVYGSVSVTCVWGSVSWFASTGGRDSKIDVWSLVPVGSASCTIAALGSSDRDTVVELSEWGVPCVTCILDRRPASCGTCVRDCWPETGSVRFPFHRCGTGPRLTKDLEAVPFVNRTTPFTIRGPLGNQGRGNPVRSPLGFGSYTMTKIRDSLHLVKCPTPAIEPPTGTFGFFPGVPPINNCMPLGTEVSEALGGAGLTGGFYEPLVRRCSELMGRRNPVCPGYAWLSSGRPDGFIHVQGHLQEVDAGNFIPPPRWLLLDFVFVLLYLMKLAEARLVPLILLLLWWWVNQLAVLGLPAVDAAVAGEVFAGPALSWCLGLPTVSMILGLANLVLYFRWMGPQRLMFLVLWKLARGLDLNSPHQ

SEQ ID NO: 143 - protein, 539 aa, Orthorubulavirus Mumps Virus
MKVFLVTCLGFAVFSSSVCVNINILQQIGYIKQQVRQLSYYSQSSSSYIVVKLLPNIQPTDNSCEFKSVTQYNKTLSNLLLPIAENINNIASPSSGSRRHKRFAGIAIGIAALGVATAAQVTAAVSLVQAQTNARAIAAMKNSIQATNRAVFEVKEGTQRLAIAVQAIQDHINTIMNTQLNNMSCQILDNQLATSLGLYLTELTTVFQPQLINPALSPISIQALRSLLGSMTPAVVQATLSTSISAAEILSAGLMEGQIVSVLLDEMQMIVKINIPTIVTQSNALVIDFYSISSFINNQESIIQLPDRILEIGNEQWSYPAKNCKLTRHHIFCQYNEAERLSLESKLCLAGNISACVFSPIAGSYMRRFVALDGTIVANCRSLTCLCKSPSYPIYQPDHHAVTTIDLTACQTLSLDGLDFSIVSLSNITYAENLTISLSQTINTQPIDISTELSKVNASLQNAVKYIKESNHQLQSVNVNSKIGAIIVAALVLSILSIIISLLFCCWAYVATKEIRRINFKTNHINTISSSVDDLIRYL

SEQ ID NO: 144 - protein, 583 aa, Orthorubulavirus Mumps Virus
MEPSKLFTMSDNATFAPGPVINAADKKTFRTCFRILVLSVQAVTLILVIVTLGELVRMINDQGLSNQLSSIADKIRESATMIASAVGVMNQVIHGVTVSLPLQIEGNQNQLLSTLATICTGKKQVSNCSTNIPLVNDLRFINGINKFIIEDYATHDFSIGHPLNMPSFIPTATSPNGCTRIPSFSLGKTHWCYTHNVINANCKDHTSSNQYISMGILVQTASGYPMFKTLKIQYLSDGLNRKSCSIATVPDGCAMYCYVSTQLETDDYAGSSPPTQKLTLLFYNDTVTERTISPTGLEGNWATLVPGVGSGIYFENKLIFPAYGGVLPNSSLGVKSAREFFRPVNPYNPCSGPQQDLDQRALRSYFPSYFSNRRVQSAFLVCAWNQILVTNCELVVPSNNQTLMGAEGRVLLINNRLLYYQRSTSWWPYELLYEISFTFTNSGQSSVNMSWIPIYSFTRPGSGNCSGENVCPTACVSGVYLDPWPLTPYSHQSGINRNFYFTGALLNSSTTRVNPTLYVSALNNLKVLAPYGNQGLFASYTTTTCFQDTGDASVYCVYIMELASNIVGEFQILPVLTRLTITL

SEQ ID NO: 145 - protein, 566 aa, Respirovirus Sendai virus
MTAYIQRSQCISTSLLVVLTTLVSCQIPRDRLSNIGVIVDEGKSLKIAGSHESRYIVLSLVPGVDFENGCGTAQVIQYKSLLNRLLIPLRDALDLQEALITVTNDTTQNAGAPQSRFFGAVIGTIALGVATSAQITAGIALAEAREAKRDIALIKESMTKTHKSIELLQNAVGEQILALKTLQDFVNDEIKPAISELGCETAALRLGIKLTQHYSELLTAFGSNFGTIGEKSLTLQALSSLYSANITEIMTTIKTGQSNIYDVIYTEQIKGTVIDVDLERYMVTLSVKIPILSEVPGVLIHKASSISYNIDGEEWYVTVPSHILSRASFLGGADITDCVESRLTYICPRDPAQLIPDSQQKCILGDTTRCPVTKVVDSLIPKFAFVNGGVVANCIASTCTCGTGRRPISQDRSKGVVFLTHDNCGLIGVNGVELYANRRGHDATWGVQNLTVGPAIAIRPIDISLNLADATNFLQDSKAELEKARKILSEVGRWYNSRETVITIIVVMVVILVVIIVIIIVLYRLRRSMLMGNPDDRIPRDTYTLEPKIRHMYTNGGFDAMAEKRL

SEQ ID NO: 146 - protein, 576 aa, Respirovirus Sendai virus
MDGDRGKRDSYWSTSPSGSTTKPASGWERSSKADTWLLILSFTQWALSIATVIICIIISARQGYSMKEYSMTVEALNMSSREVKESLTSLIRQEVIARAVNIQSSVQTGIPVLLNKNSRDVIQMIDKSCSRQELTQHCESTIAVHHADGIAPLEPHSFWRCPVGEPYLSSDPEISLLPGPSLLSGSTTISGCVRLPSLSIGEAIYAYSSNLITQGCADIGKSYQVLQLGYISLNSDMFPDLNPVVSHTYDINDNRKSCSVVATGTRGYQLCSMPTVDERTDYSSDGIEDLVLDVLDLKGRTKSHRYRNSEVDLDHPFSALYPSVGNGIATEGSLIFLGYGGLTTPLQGDTKCRTQGCQQVSQDTCNEALKITWLGGKQVVSVIIQVNDYLSERPKIRVTTIPITQNYLGAEGRLLKLGDRVYIYTRSSGWHSQLQIGVLDVSHPLTINWTPHEALSRPGNKECNWYNKCPKECISGVYTDAYPLSPDAANVATVTLYANTSRVNPTIMYSNTTNIINMLRIKDVQLEAAYTTTSCITHFGKGYCFHIIEINQKSLNTLQPMLFKTSIPKLCKAESL

SEQ ID NO: 147 - protein, 530 aa, Autographa californica multiple nucleopolyhedrovirus
MLLVNQSHQGFNKEHTSKMVSAIVLYVLLAAAAHSAFAAEHCNAQMKTGPYKIKNLDITPPKETLQKDVEITIVETDYNENVIIGYKGYYQAYAYNGGSLDPNTRVEETMKTLNVGKEDLLMWSIRQQCEVGEELIDRWGSDSDDCFRDNEGRGQWVKGKELVKRQNNNHFAHHTCNKSWRCGISTSKMYSRLECQDDTDECQVYILDAEGNPINVTVDTVLHRDGVSMILKQKSTFTTRQIKAACLLIKDDKNNPESVTREHCLIDNDIYDLSKNTWNCKFNRCIKRKVEHRVKKRPPTWRHNVRAKYTEGDTATKGDLMHIQEELMYENDLLKMNIELMHAHINKLNNMLHDLIVSVAKVDERLIGNLMNNSVSSTFLSDDTFLLMPCTNPPAHTSNCYNNSIYKEGRWVANTDSSQCIDFSNYKELAIDDDVEFWIPTIGNTTYHDSWKDASGWSFIAQQKSNLITTMENTKFGGVGTSLSDITSMAEGELAAKLTSFMFGHVVNFVIILIVILFLYCMIRNRNRQY

SEQ ID NO: 148 - protein, 985 aa, Alphavirus Ross River virus
MSAALMMCILANTSFPCSSPPCYPCCYEKQPEQTLRMLEDNVNRPGYYELLEASMTCRNRSRHRRSVTEHFNVYKATRPYLAYCADCGDGYFCYSPVAIEKIRDEAPDGMLKIQVSAQIGLDKAGTHAHTKIRYMAGHDVQESKRDSLRVYTSAACSIHGTMGHFIVAHCPPGDYLKVSFEDADSHVKACKVQYKHDPLPVGREKFVVRPHFGVELPCTSYQLTTAPTDEEIDMHTPPDIPDRTLLSQTAGNVKITAGGRTIRYNCTCGRDNVGTTSTDKTINTCKIDQCHAAVTSHDKWQFTSPFVPRADQTARRGKVHVPFPLTNVTCRVPLARAPDVTYGKKEVTLRLHPDHPTLFSYRSLGAEPHPYEEWVDKFSERIIPVTEEGIEYQWGNNPPVRLWAQLTTEGKPHGWPHEIIQYYYGLYPAATIAAVSGASLMALLTLAATCCMLATARRKCLTPYALTPGAVVPLTLGLLCCAPRANAASFAETMAYLWDENKTLFWMEFAAPAAALALLACCIKSLICCCKPFSFLVLLSLGASAKAYEHTATIPNVVGFPYKAHIERNGFSPMTLQLEVVETSWEPTLNLEYITCEYKTVVPSPFIKCCGTSECSSKEQPDYQCKVYTGVYPFMWGGAYCFCDSENTQLSEAYVDRSDVCKHDHASAYKAHTASLKATIRISYGTINQTTEAFVNGEHAVNVGGSKFIFGPISTAWSPFDNKIVVYKDDVYNQDFPPYGSGQPGRFGDIQSRTVESKDLYANTALKLSRPSPGVVHVPYTPTPSGFKYWLKEKGSSLNTKAPFGCKIKTNPVRAMDCAVGSIPVSMDIPDSAFTRVVDAPAVTDLSCQVVVCTHSSDFGGVATLSYKTDKPGKCAVHSHSNVATLQEATVDVKEDGKVTVHFSTASASPAFKVSVCDAKTTCTAACEPPKDHIVPYGASHNNQVFPDMSGTAMTWVQRLASGLGGLALIAVVVLVLVTCITMRR

SEQ ID NO: 149 - protein, 524 aa, synthetic construct
MVPQALLFVPLLVFPLCFGKFPIYTIPDKLGPWSPIDIHHLSCPNNLVVEDEGCTNLSGFSYMELKVGYILAIKVNGFTCTGVVTEAETYTNFVGYVTTTFKRKHFRPTPDACRAAYNWKMAGDPRYEESLHNPYPDYRWLRTVKTTKESLVIISPSVADLDPYDRSLHSRVFPSGKCSGVAVSSTYCSTNHDYTIWMPENPRLGMSCDIFTSSRGKRASKGSETCGFVDERGLYKSLKGACKLKLCGVLGLRLMDGTWVSMQTSNETKWCPPDKLVNLHDFRSDEIEHLVVEELVRKREECLDALESIMTTKSVSFRRLSHLRKLVPGFGKAYTIFNKTLMEADAHYKSVETWNEILPSKGCLRVGGRCHPHVNGVFFNGIILGPDGNVLIPEMQSSLLQQHMELLESSVIPLVHPLADPSTVFKDGDEAEDFVEVHLPDVHNQVSGVDLGLPNWGKYVLLSAGALTALMLIIFLMTCCRRVNRSEPTQHNLRGTGREVSVTPQSGKIISSWESHKSGGETRL

SEQ ID NO: 150 - protein, 524 aa, Lyssavirus Rabies virus
MVPQALLLVPILGFSSCFGKFPIYTIPDTLGPWSPIDIHHLSCPNNLVVEDEGCTNLSGFSYMELKVGYISAIKVNGFTCTGVVTEAETYTNFVGYVTTTFKRKHFRPTPDACRAAYNWKMAGDPRYEESLHSPYPDYHWLRTVKTTKESLVIISPSVADLDPYDNSLHSRVFPSGKCSGITVSSVYCSTNHDYTVWMPESLRLGTSCDIFTNSRGKRASKGSKTCGFVDERGLYKSLKGACKLKLCGVLGLRLMDGTWVAMQTSNETKWCPPDQLVNLHDLRSDEIEHLVIEELVKKREECLDALESIITTKSVSFRRLSYLRKLVPGFGKAYTIFNKTLMEAEAHYKSVRTWNEIIPSKGCLRVGGRCHPHVNGVFFNGIILGPDGHVLIPEMQSSLLQQHIELLESSVIPLMHPLADPFTVFKDGDETEDFIEVHLPDVHEQVSGVDLGLPNWGEYVLLSAGTLIALMLIIFLMTCCRKVDRPESTQRSLRGTGRNVSVTSQSGKFIPSWESYKSGGETGL

SEQ ID NO: 151 - protein, 524 aa, Lyssavirus Rabies virus
MVPQVLLFVPLLVFSMCFGKFPIYTIPDKLGPWSPIDIHHLSCPNNLVVEDEGCTNLSGFSYMELKVGYISAIKVNGFTCTGVVTEAETYTNFVGYVTTTFKRKHFRPTPDACRAAYNWKMAGDPRYEESLHNPYPDYHWLRTVKTTKESLVIISPSVADLDPYDKSLHSRVFPSGKCSGITISSTYCSTNHDYTIWMPENPRLGTSCDIFTNSRGKRASKGGKTCGFVDERGLYKSLKGACKLKLCGVLGLRLMDGTWVAMQTSDETKWCPPDQLVNLHDFRSDEIEHLVVEELVKKREECLDALESIMATKSVSFRRLSHLRKLVPGFGKAYTIFNKTLMEADAHYKSVRTWNEIIPSKGCLRVGGRCHPHVNGVFFNGIILGPDGHVLIPEMQSSLLQQHMELLESSVIPLMHPLADPSTVFKDGDEAEDFVEVHLPDVHKQISGVDLGLPSWGKYVLVSAGVLVVLMLTIFIMTCCGRVHRPKSTQHGLGGTGRKVSVTSQSGKVISSWESYKSGGETRL

SEQ ID NO: 152 - protein, 524 aa, Lyssavirus Rabies virus
MVPQVLLFVPLLGFSLCFGKFPIYTIPDKLGPWSPIDIHHLSCPNNLVVEDEGCTNLSEFSYMELKVGYISAIKVNGFTCTGVVTEAETYTNFVGYVTTTFKRKHFRPTPDACRAAYNWKMAGDPRYEESLHNPYPDYHWLRTVRTTKESLIIISPSVTDLDPYDKSLHSRVFPGGKCSGITVSSTYCSTNHDYTIWMPENPRPRTPCDIFTNSRGKRASKGNKTCGFVDERGLYKSLKGACRLKLCGVLGLRLMDGTWVAMQTSDETKWCPPDQLVNLHDFRSDEIEHLVVEELVKKREECLDALESIMTTKSVSFRRLSHLRKLVPGFGKAYTIFNKTLMEADAHYKSVRTWNEIIPSKGCLKVGGRCHPHVNGVFFNGIILGPDGHVLIPEMQSSLLQQHMELLKSSVIPLMHPLADPSTVFKEGDEAEDFVEVHLPDVYKQISGVDLGLPNWGKYVLMTAGAMIGLVLIFSLMTWCRRANRPESKQRSFGGTGRNVSVTSQSGKVIPSWESYKSGGEIRL

SEQ ID NO: 153 - protein, 524 aa, Lyssavirus Rabies virus
MVPQALLFVPLLVFPLCFGKFPIYTILDKLGPWSPIDIHHLSCPNNLVVEDEGCTNLSGFSYMELKVGYILAIKMNGFTCTGVVTEAETYTNFVGYVTTTFKRKHFRPTPDACRAAYNWKMAGDPRYEESLHNPYPDYRWLRTVKTTKESLVIISPSVADLDPYDRSLHSRVFPSGKCSGVAVSSTYCSTNHDYTIWMPENPRLGMSCDIFTNSRGKRASKGSETCGFVDERGLYKSLKGACKLKLCGVLGLRLMDGTWVAMQTSNETKWCPPDQLVNLHDFRSDEIEHLVVEELVRKREECLDALESIMTTKSVSFRRLSHLRKLVPGFGKAYTIFNKTLMEADAHYKSVRTWNEILPSKGCLRVGGRCHPHVNGVFFNGIILGPDGNVLIPEMQSSLLQQHMELLESSVIPLVHPLADPSTVFKDGDEAEDFVEVHLPDVHNQVSGVDLGLPNWGKYVLLSAGALTALMLIIFLMTCCRRVNRSEPTQHNLRGTGREVSVTPQSGKIISSWESHKSGGETRL

SEQ ID NO: 154 - protein, 524 aa, Lyssavirus Rabies virus; identical to SEQ ID NO: 133

SEQ ID NO: 155 - protein, 524 aa, Lyssavirus Rabies virus
MVPQALLFVPLLVFPLCFGKFPIYTIPDKLGPWSPIDIHHLSCPNNLVVEDEGCTNLSGFSYMELKVGYILAIKMNGFTCTGVVTEAENYTNFVGYVTTTFKRKHLRPTPDACRAAYNWKMAGDPRYEESLHNPYPDYSWLRTVKTTKESLVIISPSVADLDPYDRSLHSRVFPSGKCSGVAVSSTYCSTNHDYTIWMPENPRLGKSCDIFTNSRGKRASKGSETCGFVDERGLYKSLKGACKLKLCGVLGLRLMDGTWVAMQTSNETKWCPPDQLVNLHDFRSDEIEHLVVEELVRKREECLDALESIMTTKSVSFRRLSHLRKLVPGFGKAYTIFNKTLMEADAHYKSVRTWNEILPSKGCLRVGGRCHPHVNGVFFNGIILGPDGNVLIPEMQSSLLQQHMELLESSVIPLVHPLADPSTVFKDGDEAEDFVEVHLPDVHNQVSGVDLGLPNWGKYVLLSAGALTALMLIIFLMTCCRRVNRSEPTQHNLRGTGREVSVTPQTWKIISSWESHKSGGETRL

SEQ ID NO: 156 - protein, 524 aa, Lyssavirus Rabies virus
MVPQALLFVPLLVFPLCFGKFPIYTIPDKLGPWSPIDIHHLSCPNNLVVEDEGCTNLSGFSYMELKVGYISAIKMNGFTCTGVVTEAETYTNFVGYVTTTFKRKHFRPTPDACRAAYNWKMAGDPRYEESLHNPYPDYHWLRTVKTTKESLVIISPSVADLDPYDRSLHSRVFPGGNCSGVAVSSTYCSTNHDYTIWMPENPRLGMSCDIFTNSRGKRASKGSETCGFVDERGLYKSLKGACKLKLCGVLGLRLMDGTWVAMQTSNETKWCPPGQLVNLHDFRSDEIEHLVVEELVKKREECLDALESIMTTKSVSFRRLSHLRKLVPGFGKAYTIFNKTLMEADAHYKSVRTWNEIIPSKGCLRVGGRCHPHVNGVFFNGIILGPDGNVLIPEMQSSLLQQHMELLVSSVIPLMHPLADPSTVFKNGDEAEDFVEVHLPDVHERISGVDLGLPNWGKYVLLSAGALTALMLIIFLMTCWRRVNRSEPTQHNLRGTGREVSVTPQSGKIISSWESYKSGGETGL

SEQ ID NO: 157 - protein, 524 aa, Lyssavirus Rabies virus
MVPQVLLFVPLLGFSLCFGKFPIYTIPDELGPWSPIDIHHLSCPNNLVVEDEGCTNLSEFSYMELKVGYISAIKVNGFTCTGVVTEAETYTNFVGYVTTTFKRKHFRPTPDACRAAYNWKMAGDPRYEESLHNPYPDYHWLRTVRTTKESLIIISPSVTDLDPYDKSLHSRGFPGGKCSGITVSSTYCSTNHDYTIWMPENPGPRTPCDIFTNSRGKRASKGNKTCGFVDERGLYKSLKGACRLKLCGVLGLRLMDGTWVAMQTSDETKWCPPDQLVNLHDFRSDEIEHLVVEELVKKREECLDALESIMTTKSVSFRRLSHLRKLVPGFGKAYTIFNKTLMEADAHYKSVRTWNEIIPSKGCLKVGGRCHPHVNGVFFNGIILGPDGHVLIPEMQSSLLQQHMELLKSSVIPLMHPLADPSTVFKEGDEAEDFVEVHLPDVYKQISGVDLGLPNWGKYVLMTAGAMIGLVLIFSLMTWCRRANRPESKQRSFGGTGRNVSVTSQSGKVIPSWESYRSGGEIRL

SEQ ID NO: 158 - protein, 524 aa, Lyssavirus Rabies virus
MVPQALLLVPLLGFSLCFGKFPIYTIPTKLGPWSPIDIHHLSCPNNLVVEDEGCTNLSGFSYMELKVGRISAIKVNGFTCTGVVTEAETYTNFVGYVTTTFKRKHFRPMPGCMYSRVQLEDGRSPQIEESLHNPYPDYHWLRTVRTTKESLIIISPSVTDLDPYDKSLHSRVFPGRKCSGITVSSTYCSTNHDYTVWMPEILRLGTSCDIFTNSRGKRASKGSKTCGFVDERGLYKSLKGACKLKLCGVPGLRLMDGTWVAMQTSNETKWCPPGQLVNLHDLHSDEIEHLVVEELVKKREECLDALESITTTKSVSFRRLSHLRKLVPGFGKAYTIFNKTLMEAEAHYKSVRTWNEIIPSKGCLRVGGGCHPHVNGVFFNGIILGPDGHVLIPEMQSSLLQQHIELLESSVIPLMHPLADPFTVFKDGDEIEDFVEVHLPDVHEQVSGVDLGLPNWGEYVLLSAGTLIALMLIIFLITCCKRVDRPESTQRSLRGTGRNVSVTSQSGKFIPSRESYKSGGETGL

SEQ ID NO: 159 - protein, 524 aa, Lyssavirus Rabies virus
MVPQVLLFVLLLGFSLCFGKFPIYTIPDELGPWSPIDIHHLSCPNNLVVEDEGCTNLSEFSYMELKVGYISAIKVNGFTCTGVVTEAETYTNFVGYVTTTFKRKHFRPTPDACRAAYNWKMAGDPRYEESLHNPYPDYHWLRTVRTTKESLIIISPSVTDLDPYDKSLHSRVFPGRKCSGITVSSTYCSTNHDYTIWMPENPRPRTPCDIFTNSRGKRASNGNKTCGFVDERGLYKSLKGACRLKLCGVLGLRLMDGTWVAMQTSGETKWCPPDQLVNLHDFRSDEIEHLVVEELVKKREECLDALESIMTTKSVSFRRLSHLRKLVPGFGKAYTIFNKTLMEADAHYKSVRTWNEIIPSKGCLKVGGRCHPHVNGVFFNGLILGPDDHVLIPEMQSSLLQQHMELLESSVIPLMHPLADPSTVFKEGDEAEDFVEVHLPDVYKQISGVDLGLPNWGKYVLMTAGAMIGLVLIFSLMTWCRRANRPESKQRSFGGTGGNVSVTSQSGKVIPSWESYKSGGEIRL

SEQ ID NO: 160 - protein, 524 aa, Lyssavirus Rabies virus
MVPQALLFVPLLVFPLCFGKFPIYTIPDKLGPWSPIDIHHLRCPNNLVVEDEGCTNLSGFSYMELKVGYISAIKVNGFTCTGVVTEAETYTNFVGYVTTTFKRKHFRPTPDACRAAYNWKMAGDPRYEESLHNPYPDYHWLRTVKTTKESLVIISPSVADLDPYDKSLHSRVFPSGNCSGITVSSTYCSTNHDYTIWMPENPRLETSCDIFTNSRGKRASKGSKTCGFVDERGLYKSLKGACKLKLCGVLGLRLMDGTWVAMQTSDETKWCPPDQLVNLHDFRSDEIEHLVVEELVKKREECLDALESIMTTKSVSLRRLSHLRKLVPGFGKAYTIFNKTLMEAEAHYKSVQTWNEIIPSKGCLRVGGRCHPHVNGVFFNGIILGPDGHVLIPEMQSSLLQQHMELLESSVIPLMHPLADPSTVFKDGDEAEDFVEVHLPDVHKQVSGVDLGLPNWGKYVLLSAGTLIALMLIIFLMTCCRRVNRPKSTERSLGETGRKVSVTSQSGKVISSWESYKSGGETRR

SEQ ID NO: 161 - protein, 524 aa, Lyssavirus Rabies virus
MVPQVLLFAPLLVFPLCFGKFPIYTIPDKLGPWSPIDLHHLSCPNNLVVEDEGCTNLSGFSYMELKVGYISAIKVNGFTCTGVVTEAETYTNFVGYVTTTFKRKHFRPTPDACRAAYNWKMAGDPRYEESLHNPYPDYHWLRTVKTTKESLVIISPSVTDLDPYDKSLHSRVFPGGNCSGITVSSTYCSTNHDYTIWMPENLRLGTSCDIFTHSRGKRASKGDKTCGFVDERGLYKSLKGACKLKLCGVLGLRLMDGTWVAMQTSDETKWCPPGQLVNLHDFRSDEIEHLVEEELVKKREECLDALESIMTTKSVSFRRLSHLRKLVPGFGKAYTIFNKTLMEADAHYKSVQTWNEIIPSKGCLRVGERCHPHVNGVFFNGIILGSDGHVLIPEMQSSLLQQHMELLESSVIPLMHPLADPSTVFKDGDEVEDFVEVHLPDVHKQVSGVDLGLPKWGKYVLMIAGALIALMLIIFLMTCCRRVNRPESTQSNLGGTGRNVSVPSQSGKVISSWESYKSGGETRL

SEQ ID NO: 162 - protein, 524 aa, Lyssavirus Rabies virus
MIPQALLFVPLLIPSLCLGKFPIYTIPDKLGPWSPIDIHHLSCPNNLVVEDEGCTSLSGFSYMELKVGYISAMKVNGFTCTGVVTEAETYTNFVGYVTTTFKRKHFRPMPDACRAAHDWKIAGDPRYEDSLQNPYPDYHWLRTVKTTKESLVIISPSVADLDPYDKSLHSRVFPSGKCLGITVSSTYCPTNHDYTIWMPVEARLGTSCDIFTNSRGKKASKGGRTCGFVDERGLYKSLKGACKLKLCGVPGLRLMNGTWVSIQTSDDIKWCPPDQLVNLHDFHSDEIEHLVVEELIKKREGCLDALESIMTTKSVSFRRLSHLRKLVPGFGKAYTIFNNTLMEADAHYKSVRTWNEVIPSKGCLKVGGRCHPPVNGVFFNGIILGPDGNVLIPEMQSSLLQQHMELLESSVIPLMHPLADPSTVFKDGDEAEDFVEVHLPDVHKQVSDVDLGLPSWGKYLLMSAGALATLILAIFLITCCRRANRTKSTQRGHRESGGKVSVAPQNGKIISSWELYKSESETGM

SEQ ID NO: 163 - protein, 904 aa, Simplexvirus Human herpesvirus 2
MRGGGLICALVVGALVAAVASAAPAAPAAPRASGGVAATVAANGGPASRPPPVPSPATTKARKRKTKKPPKRPEATPPPDANATVAAGHATLRAHLREIKVENADAQFYVCPPPTGATVVQFEQPRRCPTRPEGQNYTEGIAVVFKENIAPYKFKATMYYKDVTVSQVWFGHRYSQFMGIFEDRAPVPFEEVIDKINAKGVCRSTAKYVRNNMETTAFHRDDHETDMELKPAKVATRTSRGWHTTDLKYNPSRVEAFHRYGTTVNCIVEEVDARSVYPYDEFVLATGDFVYMSPFYGYREGSHTEHTSYAADRFKQVDGFYARDLTTKARATSPTTRNLLTTPKFTVAWDWVPKRPAVCTMTKWQEVDEMLRAEYGGSFRFSSDAISTTFTTNLTQYSLSRVDLGDCIGRDAREAIDRMFARKYNATHIKVGQPQYYLATGGFLIAYQPLLSNTLAELYVREYMREQDRKPRNATPAPLREAPSANASVERIKTTSSIEFARLQFTYNHIQRHVNDMLGRIAVAWCELQNHELTLWNEARKLNPNAIASATVGRRVSARMLGDVMAVSTCVPVAPDNVIVQNSMRVSSRPGTCYSRPLVSFRYEDQGPLIEGQLGENNELRLTRDALEPCTVGHRRYFIFGGGYVYFEEYAYSHQLSRADVTTVSTFIDLNITMLEDHEFVPLEVYTRHEIKDSGLLDYTEVQRRNQLHDLRFADIDTVIRADANAAMFAGLCAFFEGMGDLGRAVGKVVMGVVGGVVSAVSGVSSFMSNPFGALAVGLLVLAGLVAAFFAFRYVLQLQRNPMKALYPLTTKELKTSDPGGVGGEGEEGAEGGGFDEAKLAEAREMIRYMALVSAMERTEHKARKKGTSALLSSKVTNMVLRKRNKARYSPLHNEDEAGDEDEL

SEQ ID NO: 164 - protein, 393 aa, Simplexvirus Human herpesvirus 2
MGRLTSGVGTAALLVVAVGLRVVCAKYALADPSLKMADPNRFRGKNLPVLDQLTDPPGVKRVYHIQPSLEDPFQPPSIPITVYYAVLERACRSVLLHAPSEAPQIVRGASDEARKHTYNLTIAWYRMGDNCAIPITVMEYTECPYNKSLGVCPIRTQPRWSYYDSFSAVSEDNLGFLMHAPAFETAGTYLRLVKINDWTEITQFILEHRARASCKYALPLRIPPAACLTSKAYQQGVTVDSIGMLPRFTPENQRTVALYSLKIAGWHGPKPPYTSTLLPPELSDTTNATQPELVPEDPEDSALLEDPAGTVSSQIPPNWHIPSIQDVAPHHAPAAPANPGLIIGALAGSTLAALVIGGIAFWVRRRRSVAPKRLRLPHIRDDDAPPSHQPLFY

SEQ ID NO: 165 - protein, 838 aa, Simplexvirus Human herpesvirus 2
MGPGLWVVMGVLVGVAGGHDTYWTEQIDPWFLHGLGLARTYWRDTNTGRLWLPNTPDASDPQRGRLAPPGELNLTTASVPMLRWYAERFCFVLVTTAEFPRDPGQLLYIPKTYLLGRPRNASLPELPEAGPTSRPPAEVTQLKGLSHNPGASALLRSRAWVTFAAAPDREGLTFPRGDDGATERHPDGRRNAPPPGPPAGTPRHPTTNLSIAHLHNASVTWLAARGLLRTPGRYVYLSPSASTWPVGVWTTGGLAFGCDAALVRARYGKGFMGLVISMRDSPPAEIIVVPADKTLARVGNPTDENAPAVLPGPPAGPRYRVFVLGAPTPADNGSALDALRRVAGYPEESTNYAQYMSRAYAEFLGEDPGSGTDARPSLFWRLAGLLASSGFAFVNAAHAHDAIRLSDLLGFLAHSRVLAGLAARGAAGCAADSVFLNVSVLDPAARLRLEARLGHLVAAILEREQSLVAHALGYQLAFVLDSPAAYGAVAPSAARLIDALYAEFLGGRALTAPMVRRALFYATAVLRAPFLAGAPSAEQRERARRGLLITTALCTSDVAAATHADLRAALARTDHQKNLFWLPDHFSPCAASLRFDLAEGGFILDALAMATRSDIPADVMAQQTRGVASVLTRWAHYNALIRAFVPEATHQCSGPSHNAEPRILVPITHNASYVVTHTPLPRGIGYKLTGVDVRRPLFITYLTATCEGHAREIEPKRLVRTENRRDLGLVGAVFLRYTPAGEVMSVLLVDTDATQQQLAQGPVAGTPNVFSSDVPSVALLLFPNGTVIHLLAFDTLPIATIAPGFLAASALGVVMITAALAGILRVVRTCVPFLWRRE

SEQ ID NO: 166 - protein, 224 aa, Simplexvirus Human herpesvirus 2
MGFVCLFGLVVMGAWGAWGGSQATEYVLRSVIAKEVGDILRVPCMRTPADDVSWRYEAPSVIDYARIDGIFLRYHCPGLDTFLWDRHAQRAYLVNPFLFAAGFLEDLSHSVFPADTQETTTRRALYKEIRDALGSRKQAVSHAPVRAGCVNFDYSRTRRCVGRRDLRPANTTSTWEPPVSSDDEASSQSKPLATQPPVLALSNAPPRRVSPTRGRRRHTRLRRN

SEQ ID NO: 167 - protein, 868 aa, Varicellovirus Human alphaherpesvirus 3
MFVTAVVSVSPSSFYESLQVEPTQSEDITRSAHLGDGDEIREAIHKSQDAETKPTFYVCPPPTGSTIVRLEPTRTCPDYHLGKNFTEGIAVVYKENIAAYKFKATVYYKDVIVSTAWAGSSYTQITNRYADRVPIPVSEITDTIDKFGKCSSKATYVRNNHKVEAFNEDKNPQDMPLIASKYNSVGSKAWHTTNDTYMVAGTPGTYRTGTSVNCIIEEVEARSIFPYDSFGLSTGDIIYMSPFFGLRDGAYREHSNYAMDRFHQFEGYRQRDLDTRALLEPAARNFLVTPHLTVGWNWKPKRTEVCSLVKWREVEDVVRDEYAHNFRFTMKTLSTTFISETNEFNLNQIHLSQCVKEEARAIINRIYTTRYNSSHVRTGDIQTYLARGGFVVVFQPLLSNSLARLYLQELVRENTNHSPQKHPTRNTRSRRSVPVELRANRTITTTSSVEFAMLQFTYDHIQEHVNEMLARISSSWCQLQNRERALWSGLFPINPSALASTILDQRVKARILGDVISVSNCPELGSDTRIILQNSMRVSGSTTRCYSRPLISIVSLNGSGTVEGQLGTDNELIMSRDLLEPCVANHKRYFLFGHHYVYYEDYRYVREIAVHDVGMISTYVDLNLTLLKDREFMPLQVYTRDELRDTGLLDYSEIQRRNQMHSLRFYDIDKVVQYDSGTAIMQGMAQFFQGLGTAGQAVGHVVLGATGALLSTVHGFTTFLSNPFGALAVGLLVLAGLVAAFFAYRYVLKLKTSPMKALYPLTTKGLKQLPEGMDPFAEKPNATDTPIEEIGDSQNTEPSVNSGFDPDKFREAQEMIKYMTLVSAAERQESKARKKNKTSALLTSRLTGLALRNRRGYSRVRTENVTGV

SEQ ID NO: 168 - protein, 340 aa, Varicellovirus Human alphaherpesvirus 3
MQALGIKTEHFIIMCLLSGHAVFTLWYTARVKFEHECVYATTVINGGPVVWGSYNNSLIYVTFVNHSTFLDGLSGYDYSCRENLLSGDTMVKTAISTPLHDKIRIVLGTRNCHAYFWCVQLKMIFFAWFVYGMYLQFRRIRRMFGPFRSSCELISPTSYSLNYVTRVISNILLGYPYTKLARLLCDVSMRRDGMSKVFNADPISFLYMHKGVTLLMLLEVIAHISSGCIVLLTLGVAYTPCALLYPTYIRILAWVVVCTLAIVELISYVRPKPTKDNHLNHINTGGIRGICTTCCATVMSGLAIKCFYIVIFAIAVVIFMHYEQRVQVSLFGESENSQKH

SEQ ID NO: 169 - protein, 841 aa, Varicellovirus Human alphaherpesvirus 3
MFALVLAVVILPLWTTANKSYVTPTPATRSIGHMSALLREYSDRNMSLKLEAFYPTGFDEELIKSLHWGNDRKHVFLVIVKVNPTTHEGDVGLVIFPKYLLSPYHFKAEHRAPFPAGRFGFLSHPVTPDVSFFDSSFAPYLTTQHLVAFTTFPPNPLVWHLERAETAATAERPFGVSLLPARPTVPKNTILEHKAHFATWDALARHTFFSAEAIITNSTLRIHVPLFGSVWPIRYWATGSVLLTSDSGRVEVNIGVGFMSSLISLSSGPPIELIVVPHTVKLNAVTSDTTWFQLNPPGPDPGPSYRVYLLGRGLDMNFSKHATVDICAYPEESLDYRYHLSMAHTEALRMTTKADQHDINEESYYHIAARIATSIFALSEMGRTTEYFLLDEIVDVQYQLKFLNYILMRIGAGAHPNTISGTSDLIFADPSQLHDELSLLFGQVKPANVDYFISYDEARDQLKTAYALSRGQDHVNALSLARRVIMSIYKGLLVKQNLNATERQALFFASMILLNFREGLENSSRVLDGRTTLLLMTSMCTAAHATQAALNIQEGLAYLNPSKHMFTIPNVYSPCMGSLRTDLTEEIHVMNLLSAIPTRPGLNEVLHTQLDESEIFDAAFKTMMIFTTWTAKDLHILHTHVPEVFTCQDAAARNGEYVLILPAVQGHSYVITRNKPQRGLVYSLADVDVYNPISVVYLSRDTCVSEHGVIETVALPHPDNLKECLYCGSVFLRYLTTGAIMDIIIIDSKDTERQLAAMGNSTIPPFNPDMHGDDSKAVLLFPNGTVVTLLGFERRQAIRMSGQYLGASLGGAFLAVVGFGIIGWMLCGNSRLREYNKIPLT

SEQ ID NO: 170 - protein, 160 aa, Varicellovirus Human alphaherpesvirus 3
MASHKWLLQMIVFLKTITIAYCLHLQDDTPLFFGAKPLSDVSLIITEPCVSSVYEAWDYAAPPVSNLSEALSGIVVKTKCPVPEVILWFKDKQMAYWTNPYVTLKGLTQSVGEEHKSGDIRDALLDALSGVWVDSTPSSTNIPENGCVWGADRLFQRVCQ

SEQ ID NO: 171 - protein, 445 aa, Varicellovirus Human alphaherpesvirus 3
MQLIITSKLGIIYILCGRLAFYIREKLHAVPHFVGHHILGNKSYSMGGWSSKPRQGMGTNLSVPNPLGFFPDHQLDPAFGANSNNPDWDFNPNKDHWPEAKQVGAGAFGPGFTPPHGGLLGWSPQAQGTLTTVPAAPPPASTNRQSGRQPTPISPPLRDSHPQAMQWNSTTFHQALLDPRVRGLYFPAGGSSSGTVNPVPTTASPISSIFSRTGDPAPNMESTTSGFLGPLLVLQAGFFLLTRILTIPQSLDSWLTSLNFLGGTPKCPGQNSQSPTSNHSPTSCPPTCPGYRWMCLRRFIIFLFILLLCLIFLLVLLDYKGMLPVCPLLPGTSTTSTGPCKTCTIPAQNTSMFPSCCCTKPSDGNCTCIPIPSSWAFARFLWEWASVRFSWLSLLVPFVQWSAGLSPTVWLSVIWTMWYWGPSLYNILSPFLPLLPILCCLWAYI

SEQ ID NO: 172 - protein, 281 aa, Orthohepadnavirus Hepatitis B virus
MQWNSTTFHQALQDPRVRGLYFPAGGSSSGTVNPVPTTASLISSIFSRIGDPAPNMESITSGFLGPLLVLQAGFFLLTKILTIPQSLDSWWTSLNFLGGAPVCLGQNSQSPTSNHSPTSCPPICPGYRWMCLRRFIIFLFILLLCLIFLLVLLDYQGMLPVCPLIPGSSTTSTGPCRTCMTLAQGTSMFPSCCCSKPSDGNCTCIPIPSSWAFGKFLWEWASARFSWLSLLVPFVQWFAGLSPTVWLSVIWMMWYWGPSLYDILSPFIPLLPIFFCLWVYI

SEQ ID NO: 173 - protein, 226 aa, Orthohepadnavirus Hepatitis B virus
MESITSGFLGPLLVLQAGFFLLTKILTIPQSLDSWWTSLNFLGGAPVCLGQNSQSPTSNHSPTSCPPICPGYRWMCLRRFIIFLFILLLCLIFLLVLLDYQGMLPVCPLIPGSSTTSTGPCRTCMTLAQGTSMFPSCCCSKPSDGNCTCIPIPSSWAFGKFLWEWASARFSWLSLLVPFVQWFAGLSPTVWLSVIWMMWYWGPSLYDILSPFIPLLPIFFCLWVYI

SEQ ID NO: 174 - protein, 982 aa, Alphavirus Eastern equine encephalitis virus
MSLATVMCVLANITFPCDQPPCMPCCYEKNPHETLTMLEQNYDSRAYDQLLDAAVKCNARRTRRDLDTHFTQYKLARPYIADCPNCGHSRCDSPIAIEEVRGDAHAGVIRIQTSAMFGLKTDGVDLAYMSFMNGKTQKSIKIDNLHVRTSAPCSLVSHHGYYILAQCPPGDTVTVGFHDGPNRHTCTVAHKVEFRPVGREKYRHPPEHGVELPCNRYTHKRADQGHYVEMHQPGLVADHSLLSIHSAKVKITVPSGAQVKYYCKCPDVREGITSSDHTTTCTDVKQCRAYLIDNKKWVYNSGRLPRGEGDTFKGKLHVPFVPVKAKCIATLAPEPLVEHKHRTLILHLHPDHPTLLTTRSLGSDANPTRQWIERPTTVNFTVTGEGLEYTWGNHPPKRVWAQESGEGNPHGWPHEVVVYYYNRYPLTTIIGLCTCVAIIMVSCVTSVWLLCRTRNLCITPYKLAPNAQVPILLALLCCIKPTRADDTLQVLNYLWNNNQNFFWMQTLIPLAALIVCMRMLRCLFCCGPAFLLVCGALGAAAYEHTAVMPNKVGIPYKALVERPGYAPVHLQIQLVNTRIIPSTNLEYITCKYKTKVPSPVVKCCGATQCTSKPHPDYQCQVFTGVYPFMWGGAYCFCDTENTQMSEAYVERSEECSIDHAKAYKVHTGTVQAMVNITYGSVSWRSADVYVNGETPAKIGDAKLIIGPLSSAWSPFDNKVVVYGHEVYNYDFPEYSTGKAGSFGDLQSRTSTSNDLYANTNLKLQRPQAGIVHTPFTQAPSGFERWKRDKGAPLNDVAPFGCSIALEPLRAENCAVGSIPISIDIPDAAFTRISETPTVSDLECKITECTYASDFGGIATVAYKSSKAGNCPIHSPSGVAVIKENDVTLAESGSFTFHFSTANIHPAFKLQVCTSAVTCKGDCKPPKDHIVDYPAQHTESFTSAISATAWSWLKVLVGGTSAFIVLGLIATAVVALVLFFHRH

SEQ ID NO: 175 - protein, 981 aa, Alphavirus Venezuelan equine encephalitis virus
MSLVTTMCLLANVTFPCAEPPICYDRKPAETLAMLSVNVDNPGYDELLEAAVKCPGRKRRSTKELFKEYKLTRPYMARCIRCAVGSCHSPIAIEAVKSDGHDGYVRLQTSSQYGLDSSGNLKGRTMRYDMHGTIEEIPLHQVSLHTSRPCHIVDGHGYFLLARCPAGDSITMEFKKGSVTHSCSVPYEVKFNPVGRELYTHPPEHGAEQACQVYAHDAQNRGAYVEMHLPGSEVDSSLISLSGSSVTVTPPVGTSALVECKCGGTKISETINKAKQFSQCTKKEQCRAYRLQNDKWVYNSDKLPKAAGATLKGKLHVPFLLADGKCTVPLAPEPMITFGFRSVSLKLHPKNPTYLTTRQLADEPHYTHELISEPAVRNFTVTEKGWEFVWGNHPPKRFWAQETAPGNPHGLPHEVITHYYHRYPMSTILGLSICAAIVTVSVAASTWLFCKSRVSCLTPYRLTPNARMPLCLAVLCCARTARAETTWESLDHLWNNNQQMFWIQLLIPLAALIVVTRLLKCVCCVVPFLVVAGAAGAGAYEHATTMPSQAGISYNTIVNRAGYAPLPISITPTKIKLIPTVNLEYVTCHYKTGMDSPAIKCCGSQECTPTNRPDEQCKVFTGVYPFMWGGAYCFCDTENTQVSKAYVMKSDDCLADHAEAYKAHTASVQAFLNITVGEHSIVTTVYVNGETPVNFNGVKLTAGPLSTAWTPFDRKIVQYAGEIYNYDFPEYGAGQPGAFGDIQSRTVSSSDLYANTNLVLQRPKAGAIHVPYTQAPSGFEQWKKDKAPSLKFTAPFGCEIYTNPIRAENCAVGSIPLAFDIPDALFTRVSETPTLSAAECTLNECVYSSDFGGIATVKYSASKSGKCAVHVPSGTATLKEAAVELTEQGSATIHFSTANIHPEFRLQICTSYVTCKGDCHPPKDHIVTHPQYHAQTFTAAVSKTAWTWLTSLLGGSAVIIIIGLVLATIVAMYVLTNQKHN

SEQ ID NO: 176 - protein, 978 aa, Alphavirus Western equine encephalitis virus
MSLVTALCVLSNVTFPCDKPPVCYSLAPERTLDVLEENVNNPNYDTLLENVLKCPSRRPKRSITDDFTLTSPYLGFCPYCRHSAPCFSPIKIENVWDESDDGSIRIQVSAQFGYDQAGTADVTKFRYMSYDHDHDIKEDSVKKIAISTSGPCRRLGHKGYFLLAQCPPGDSVTVSITSGASENSCTVEKKIRRKFVGREEYLFPPVHGKLVKCHVYDHLKETSAGYITMHRPGPHAYKSYLEEASGEVYIKPPSGKNVTYECKCGDYSTGIVSTRTKMNGCTKAKQCIAYKSDQTKWVYNSPDLIRHTDHSVQGKLHIPFRLTPTFCPVPLAHTPTVTKWFKGITLHLTATRPTLLTTRKLGLRADATAEWITGTTSRNFSVGREGLEYVWGNHEPVRVWAQESAPGDPHGWPHEIIIHYYHRHPVYTVIVLCGVALAILVGIASSAACIAKARRDCLTPYALAPNATVPTALAVLCCIRPTNAETFGETLNHLWFNNQPFLWAQLCIPLAALIILFRCFSCCMPFLLVAGVCLGKVDAFEHATTVPNVPGIPYKALVERAGYAPLNLEITVVSSELTPSTNKEYVTCKFHTVIPSPQVKCCGSLECKASSKADYTCRVFGGVYPFMWGGAQCFCDSENTQLSEAYVEFAPDCTIDHAVALKVHTAALKVGLRIVYGNTTAHLDTFVNGVTPGSSRDLKVIAGPISAAFSPFDHKVVIRKGLVYNYDFPEYGAMKPGAFGDIQASSLDATDIVARTDIRLLKPSVKNIHVPYTQAVSGYEMWKNNSGRPLQETAPFGCKIEVEPLRASNCAYGHIPISIDIPDAAFVRSSESPTILEVSCTVADCIYSADFGGSLTLQYKADREGHCPVHSHSTTAVLKEATTHVTATGSITLHFSTSSPQANFIVSLCGKKTTCNAECKPPADHIIGEPHKVDQEFQAAVSKTSWNWLLALFGGASSLIAVGLIVLVCSSMLINTRR

SEQ ID NO: 177 - protein, 987 aa, Alphavirus Semliki Forest virus
MSAPLITAMCVLANATFPCFQPPCVPCCYENNAEATLRMLEDNVDRPGYYDLLQAALTCRNGTRHRRSVSQHFNVYKATRPYIAYCADCGAGHSCHSPVAIEAVRSEATDGMLKIQFSAQIGIDKSDNHDYTKIRYADGHAIENAVRSSLKVATSGDCFVHGTMGHFILAKCPPGEFLQVSIQDTRNAVRACRIQYHHDPQPVGREKFTIRPHYGKEIPCTTYQQTTAETVEEIDMHMPPDTPDRTLLSQQSGNVKITVGGKKVKYNCTCGTGNVGTTNSDMTINTCLIEQCHVSVTDHKKWQFNSPFVPRADEPARKGKVHIPFPLDNITCRVPMAREPTVIHGKREVTLHLHPDHPTLFSYRTLGEDPQYHEEWVTAAVERTIPVPVDGMEYHWGNNDPVRLWSQLTTEGKPHGWPHQIVQYYYGLYPAATVSAVVGMSLLALISIFASCYMLVAARSKCLTPYALTPGAAVPWTLGILCCAPRAHAASVAETMAYLWDQNQALFWLEFAAPVACILIITYCLRNVLCCCKSLSFLVLLSLGATARAYEHSTVMPNVVGFPYKAHIERPGYSPLTLQMQVVETSLEPTLNLEYITCEYKTVVPSPYVKCCGASECSTKEKPDYQCKVYTGVYPFMWGGAYCFCDSENTQLSEAYVDRSDVCRHDHASAYKAHTASLKAKVRVMYGNVNQTVDVYVNGDHAVTIGGTQFIFGPLSSAWTPFDNKIVVYKDEVFNQDFPPYGSGQPGRFGDIQSRTVESNDLYANTALKLARPSPGMVHVPYTQTPSGFKYWLKEKGTALNTKAPFGCQIKTNPVRAMNCAVGNIPVSMNLPDSAFTRIVEAPTIIDLTCTVATCTHSSDFGGVLTLTYKTNKNGDCSVHSHSNVATLQEATAKVKTAGKVTLHFSTASASPSFVVSLCSARATCSASCEPPKDHIVPYAASHSNVVFPDMSGTALSWVQKISGGLGAFAIGAILVLVVVTCIGLRR

SEQ ID NO: 178 - protein, 982 aa, Alphavirus Sindbis virus
MSAAPLVTAMCLLGNVSFPCDRPPTCYTREPSRALDILEENVNHEAYDTLLNAILRCGSSGRSKRSVIDDFTLTSPYLGTCSYCHHTVPCFSPVKIEQVWDEADDNTIRIQTSAQFGYDQSGAASANKYRYMSLKQDHTVKEGTMDDIKISTSGPCRRLSYKGYFLLAKCPPGDSVTVSIVSSNSATSCTLARKIKPKFVGREKYDLPPVHGKKIPCTVYDRLKETTAGYITMHRPRPHAYTSYLEESSGKVYAKPPSGKNITYECKCGDYKTGTVSTRTEITGCTAIKQCVAYKSDQTKWVFNSPDLIRHDDHTAQGKLHLPFKLIPSTCMVPVAHAPNVIHGFKHISLQLDTDHLTLLTTRRLGANPEPTTEWIVGKTVRNFTVDRDGLEYIWGNHEPVRVYAQESAPGDPHGWPHEIVQHYYHRHPVYTILAVASATVAMMIGVTVAVLCACKARRECLTPYALAPNAVIPTSLALLCCVRSANAETFTETMSYLWSNSQPFFWVQLCIPLAAFIVLMRCCSCCLPFLVVAGAYLAKVDAYEHATTVPNVPQIPYKALVERAGYAPLNLEITVMSSEVLPSTNQEYITCKFTTVVPSPKIKCCGSLECQPAAHADYTCKVFGGVYPFMWGGAQCFCDSENSQMSEAYVELSADCASDHAQAIKVHTAAMKVGLRIVYGNTTSFLDVYVNGVTPGTSKDLKVIAGPISASFTPFDHKVVIHRGLVYNYDFPEYGAMKPGAFGDIQATSLTSKDLIASTDIRLLKPSAKNVHVPYTQASSGFEMWKNNSGRPLQETAPFGCKIAVNPLRAVDCSYGNIPISIDIPNAAFIRTSDAPLVSTVKCEVSECTYSADFGGMATLQYVSDREGQCPVHSHSSTATLQESTVHVLEKGAVTVHFSTASPQANFIVSLCGKKTTCNAECKPPADHIVSTPHKNDQEFQAAISKTSWSWLFALFGGASSLLIIGLMIFACSMMLTSTRR

SEQ ID NO: 179 - protein, 981 aa, Alphavirus Chikungunya virus
MCLLANTTFPCSQPPCTPCCYEKEPEETLRMLEDNVMRPGYYQLLQASLTCSPHRQRRSTKDNFNVYKATRPYLAHCPDCGEGHSCHSPVALERIRNEATDGTLKIQVSLQIGIKTDDSHDWTKLRYMDNHMPADAERAGLFVRTSAPCTITGTMGHFILARCPKGETLTVGFTDSRKISHSCTHPFHHDPPVIGREKFHSRPQHGKELPCSTYVQSTAATTEEIEVHMPPDTPDRTLMSQQSGNVKITVNGQTVRYKCNCGGSNEGLTTTDKVINNCKVDQCHAAVTNHKKWQYNSPLVPRNAELGDRKGKIHIPFPLANVTCRVPKARNPTVTYGKNQVIMLLYPDHPTLLSYRNMGEEPNYQEEWVMHKKEVVLTVPTEGLEVTWGNNEPYKYWPQLSTNGTAHGHPHEIILYYYELYPTMTVVVVSVATFILLSMVGMAAGMCMCARRRCITPYELTPGATVPFLLSLICCIRTAKAATYQEAAIYLWNEQQPLFWLQALIPLAALIVLCNCLRLLPCCCKTLAFLAVMSVGAHTVSAYEHVTVIPNTVGVPYKTLVNRPGYSPMVLEMELLSVTLEPTLSLDYITCEYKTVIPSPYVKCCGTAECKDKNLPDYSCKVFTGVYPFMWGGAYCFCDAENTQLSEAHVEKSESCKTEFASAYRAHTASASAKLRVLYQGNNITVTAYANGDHAVTVKDAKFIVGPMSSAWTPFDNKIVVYKGDVYNMDYPPFGAGRPGQFGDIQSRTPESKDVYANTQLVLQRPAVGTVHVPYSQAPSGFKYWLKERGASLQHTAPFGCQIATNPVRAVNCAVGNMPISIDIPEAAFTRVVDAPSLTDMSCEVPACTHSSDFGGVAIIKYAASKKGKCAVHSMTNAVTIREAEIEVEGNSQLQISFSTALASAEFRVQVCSTQVHCAAECHPPKDHIVNYPASHTTLGVQDISATAMSWVQKITGGVGLVVAVAALILIVVLCVSFSRH

SEQ ID NO: 180 - protein, 503 aa, Orthobornavirus Bornavirus
MQLSMSSLIGFGTLVLALSAQTFDLQGLSCNTDSTPGLIDLEIRRLCHTPTENVISCEVSYLNHTTISLPAVHTSCLKYHCKTYWGFFGSYSADRIINRYTGTVKGCLNNSAPEDPFECNWFYCCSAITTEICRCSITNVTVAVQTFPPFMYCSFADCSTVSQQELESGKAMLSDGSTLTYTPYILQSEVVNKTLNGTILCNSSSKIVSFDEFRRSYSLANGSYQSSSINVTCVNYTSSCRSKLRRRRRDTQQIEYLVHKLRPTLKDAWEDCEILQSLLLGVFGTGIASASQFLRGWLNHPDIIGYIVNGVGVVWQCHRVNVTFMAWNESTYYPPVDYNGRKYFLNDEGRLQTNTPEARPGLKRVMWFGRYFLGTVGSGVKPRRIRYNKTSHDYHLEEFEASLNMTPQTSIASGHETDPINHAYGTQADLLPYTRSSNITSTDTGSGWVHIGLPSFAFLNPLGWLRDLLAWAAWLGGVLYLISLCVSLPASFARRRRLGRWQE

SEQ ID NO: 181 - protein, 496 aa, Flavivirus Tick-borne encephalitis virus
SRCTHLENRDFVTGTQGTTRVTLVLELGGCVTITAEGKPSMDVWLDAIYQENPAQTREYCLHAKLSDTKVAARCPTMGPATLAEEHQGGTVCKRDQSDRGWGNHCGLFGKGSIVACVKAACEAKKKATGHVYDANKIVYTVKVEPHTGDYVAANETHSGRKTASFTVSSEKTILTMGEYGDVSLLCRVASGVDLAQTVILELDKTVEHLPTAWQVHRDWFNDLALPWKHEGARNWNNAERLVEFGAPHAVKMDVYNLGDQTGVLLKALAGVPVAHIEGTKYHLKSGHVTCEVGLEKLKMKGLTYTMCDKTKFTWKRAPTDSGHDTVVMEVTFSGTKPCRIPVRAVAHGSPDVNVAMLITPNPTIENNGGGFIEMQLPPGDNIIYVGELSYQWFQKGSSIGRVFQKTKKGIERLTVIGEHAWDFGSAGGFLSSIGKALHTVLGGAFNSIFGGVGFLPKLLLGVALAWLGLNMRNPTMSMSFLLAGVLVLAMTLGVGA

SEQ ID NO: 182 - protein, 612 aa, Flavivirus Usutu virus
STVSNCPTTGEAHNPKRAEDTYVCKSGVTDRGWGNGCGLFGKGSIDTCANFTCSLKAMGRMIQPENVKYEVGIFIHGSTSSDTHGNYSSQLGASQAGRFTITPNSPAITVKMGDYGEISVECEPRNGLNTEAYYIMSVGTKHFLVHREWFNDLALPWTSPASSNWRNREILLEFEEPHATKQSVVALGSQEGALHQALAGAVPVSFSGSVKLTSGHLKCRVKMEKLTLKGTTYGMCTEKFSFAKNPADTGHGTVVLELQYTGSDGPCKIPISIVASLSDLTPIGRMVTANPYVASSEANAKVLVEMEPPFGDSYIVVGRGDKQINHHWHKAGSSIGKAFITTIKGAQRLAALGDTAWDFGSVGGIFNSVGKAVHQVFGGAFRTLFGGMSWITQGLMGALLLWMGVNARDRSIALVMLATGGVLLFLATNVHADSGCAIDVGRRELRCGQGIFIHNDVEAWVDRYKFMPETPKQLAKVIEQAHAKGICGLRSVSRLEHVMWENIRDELNTLLRENAVDLSVVVEKPKGMYKSAPQRLALTSEEFEIGWKAWGKSLVFAPELANHTFVVDGPETKECPDAKRAWNSLEIEDFGFGIMSTRVWLKVREHNTTDCD

SEQ ID NO: 183 - protein, 501 aa, Flavivirus St. Louis encephalitis virus
FNCLGTSNRDFVEGASGATWIDLVLEGGSCVTVMAPEKPTLDFKVMKMEATELATVREYCYEATLDTLSTVARCPTTGEAHNTKRSDPTFVCKRDVVDRGWGNGCGLFGKGSIDTCAKFTCKSKATGKTILRENIKYEVAIFVHGSTDSTTHGNYFEQIGKNQAARFTISPQAPSFTANMGEYGTVTIDCEARSGINTEDYYVFTVKEKSWLVNRDWFHDLNLPWTSPATTDWRNRETLVEFEEPHATKQTVVALGSQEGALHTALAGAIPATVSSSTLTLQSGHLKCRAKLDKVKIKGTTYGMCDSAFTFSKNPADTGHGTVIVELQYTGSNGPCRVPISVTANLMDLTPVGRLVTVNPFISTGGANNKVMVEVEPPFGDSYIVVGRGTTQINYHWHKEGSSIGKALATTWKGAQRLAVLGDTAWDFGSIGGVFNSIGKAVHQVFGGAFRTLFGGMSWITQGLLGALLLWMGLQARDRSISLTLLAVGGILIFLATSVQA

SEQ ID NO: 184 - protein, 472 aa, Flavivirus Yellow fever virus
VGPAYSAHCIGITDRDFIEGVHGGTWVSATLEQDKCVTVMAPDKPSLDISLETVAIDRPAEVRKVCYNAVLTHVKINDKCPSTGEAHLAEENEGDNACKRTYSDRGWGNGCGLFGKGSIVACAKFTCAKSMSLFEVDQTKIQYVIRAQLHVGAKQENWNTDIKTLKFDALSGSQEVEFIGYGKATLECQVQTAVDFGNSYIAEMETESWIVDRQWAQDLTLPWQSGSGGVWREMHHLVEFEPPHAATIRVLALGNQEGSLKTALTGAMRVTKDTNDNNLYKLHGGHVSCRVKLSALTLKGTSYKICTDKMFFVKNPTDTGHGTVVMQVKVSKGAPCRIPVIVADDLTAAINKGILVTVNPIASTNDDEVLIEVNPPFGDSYIIVGRGDSRLTYQWHKEGSSIGKLFTQTMKGVERLAVMGDTAWDFSSAGGFFTSVGKGIHTVFGSAFQGLFGGLNWITKVIMGAVLIWVGI

SEQ ID NO: 185 - protein, 495 aa, Flavivirus Dengue virus
MRCIGISNRDFVEGVSGGSWVDIVLEHGSCVTTMAKNKPTLDFELIKTEAKHPATLRKYCVEAKLTNTTTASRCPTQGEPSLNEEQDKRFVCKHSMVDRGWGNGCGLFGKGGIVTCAMFTCKKNMEGKVVQPENLEYTIVITPHSGEENAVGNDTGKHGKEIKVTPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLSWFKKGSSIGQMFETTMRGAKRMAILGDTAWDFGSLGGVFTSIGKALHQVFGAIYGAAFSGVSWTMKILIGVVITWIGMNSRSTSLSVSLVLVGVVTLYLGVMVQA

SEQ ID NO: 186 - protein, 493 aa, Flavivirus Dengue virus
MRCVGVGNRDFVEGLSGATWVDVVLEHGGCVTTMAKNKPTLDIELQKTEATQLATLRKLCIEGKITNITTDSRCPTQGEAILPEEQDQNYVCKHTYVDRGWGNGCGLFGKGSLVTCAKFQCLESIEGKVVQHENLKYTVIITVHTGDQHQVGNETQGVTAEITSQASTAEAILPEYGTLGLECSPRTGLDFNEMILLTMKNKAWMVHRQWFFDLPLPWTSGATTKTPTWNRKELLVTFKNAHAKKQEVVVLGSQEGAMHTALTGATEIQTSGGTSIFAGHLKCRLKMDKLKLKGMSYAMCLNTFVLKKEVSETQHGTILIKVEYKGEDAPCKIPFSTEDGQGKAHNGRLITANPVVTKKEEPVNIEAEPPFGESNIVIGIGDKALKINWYRKGSSIGKMFEATARGARRMAILGDTAWDFGSVGGVLNSLGKMVHQIFGSAYTALFSGVSWIMKIGIGVLLTWIGLNSKNTSMSFSCIAIGIITLYLGVVVQA

SEQ ID NO: 187 - protein, 72 aa, Flavivirus Dengue virus
FGSVGGLFTSLGKAVHQVFGSVYTTMFGGVSWMIRILIGFLVLWIGTNSRNTSMAMTCIAVGGITLFLGFTV

SEQ ID NO: 188 - protein, 501 aa, Flavivirus Murray Valley encephalitis virus
FNCLGMSSRDFIEGASGATWVDLVLEGDSCITIMAADKPTLDIRMMNIEATNLALVRNYCYAATVSDVSTVSNCPTTGESHNTKRADHNYLCKRGVTDRGWGNGCGLFGKGSIDTCAKFTCSNSAAGRLILPEDIKYEVGVFVHGSTDSTSHGNYSTQIGANQAVRFTISPNAPAITAKMGDYGEVTVECEPRSGLNTEAYYVMTIGTKHFLVHREWFNDLLLPWTSPASTEWRNREILVEFEEPHATKQSVVALGSQEGALHQALAGAIPVEFSSSTLKLTSGHLKCRVKMEKLKLKGTTYGMCTEKFTFSKNPADTGHGTVVLELQYTGSDGPCKIPISSVASLNDMTPVGRMVTANPYVASSTANAKVLVEIEPPFGDSYIVVGRGDKQINHHWHKEGSSIGKAFSTTLKGAQRLAALGDTAWDFGSVGGVFNSIGKAVHQVFGGAFRTLFGGMSWISPGLLGALLLWMGVNARDKSIALAFLATGGVLLFLATNVHA

SEQ ID NO: 189 - protein, 497 aa, Flavivirus Powassan virus
TRCTHLENRDFVTGTQGTTRVSLVLELGGCVTITAEGKPSIDVWLEDIFQESPAETREYCLHAKLTNTKVEARCPTTGPATLPEEHQANMVCKRDQSDRGWGNHCGFFGKGSIVACAKFECEEAKKAMGHVYDSTKITYVVKVEPHTGDYLAANETNSNRKSAQFTVASEKVILRLGDYGDVSLTCKVASGIDVAQTVVMSLDSSKDHLPSAWQVHRDWFEDLALPWKHKDNQDWNSVEKLVEFGPPHAVKMDVFNLGDQTAVLLKSLAGVPLASVEGQKYHLKSGHVTCDVGLEKLKLKGTTYSMCDKAKFKWKRVPVDSGHDTVVMEVSYTGSDKPCRIPVRAVAHGVPAVNVAMLITPNPTIETNGGGFIEMQLPPGDNIIYVGDLSQQWFQKGSTIGRMFEKTRRGLERLSVVGEHAWDFGSVGGVLSSVGKAIHTVLGGAFNTLFGGVGFIPKMLLGVALVWLGLNARNPTMSMTFLAVGALTLMMTMGVGA

SEQ ID NO: 190 - protein, 564 aa, Alphainfluenzavirus Influenza A virus
MERIVLLLAIVSLVKSDQICIGYHANKSTKQVDTIMEKNVTVTHAQDILERTHNGKLCSLNGVKPLILRDCSVAGWLLGNPMCDEFLNVPEWSYIVEKDNPINSLCYPGDFNDYEELKHLLSSTNHFEKIQIIPRSSWSNHDASSGVSSACPYIGRSSFFRNVVWLIKKDNAYPTIKRSYNNTNQEDLLILWGIHHPNDAAEQTKLYQNPTTYVSVGTSTLNQRSIPEIATRPKVNGQSGRMEFFWTILKPNDAINFESNGNFIAPEYAYKIVKKGDSAIMKSGLAYGNCDTKCQTPVGAINSSMPFHNIHPHTIGECPKYVKSDRLVLATGLRNVPQRKKRGLFGAIAGFIEGGWQGMVDGWYGYHHSNEQGSGYAADKESTQKAIDGITNKVNSIIDKMNTQFKAVGKEFNNLERRVENLNKKMEDGFLDVWTYNVELLVLMENERTLDFHDSNVKNLYDKVRLQLKDNARELGNGCFEFYHKCDNECMESVRNGTYDYPQYSEEARLNREEISGVKLESMGVYQILSIYSTVASSLALAIMIAGLSFWMCSNGSLQCRICI

SEQ ID NO: 191 - protein, 560 aa, Alphainfluenzavirus Influenza A virus
MNTQILVFALIAIIPTNADKICLGHHAVSNGTKVNTLTERGVEVVNATETVERTNIPRICSKGKRTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGISGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 192 - protein, 469 aa, Alphainfluenzavirus Influenza A virus
MNPNQKIITIGSICMIVGIISLILQIGNIISIWVSHSIQTGNQNQPEICNQSIITYENNTWVNQTYVNISNTNFVTEQALAPVALAGNSSLCPISGWAIYSKDNGIRIGSKGDVFVIREPFISCSHLECRTFFLTQGALLNDKHSNGTVKDRSPYRTLMSCPIGESPSPYNSRFESVAWSASACHDGIGWLTIGISGPDNGAVAVLKYNGIITDTIKSWRNNILRTQESECACMNGSCFTIMTDGPSNGQASYKIFKIEKGKVVKSVELNAPNYHYEECSCYPDAGEIMCVCRDNWHGSNRPWVSFNQNLEYQIGYICSGVFGDNPRPNDGAGSCGPVSSNGAYGVKGFSFKYGKGVWIGRTKSTSSRSGFEMIWDPNGWTETDSSFSVKQDIVAITDWSGYSGSFVQHPELTGLDCMRPCFWVELIRGRPKENTIWTSGSSISFCGVNSDTVGWSWPDGAELPFTIDK

SEQ ID NO: 193 - protein, 607 aa, Morbillivirus Canine Distemper Virus
MLSYQDKVGAFYKDNARANSSKLSLVTEEQGGRRPPYLLFVLLILLVGIMALLAITGVRFHQVSTSNMEFSRLLKEDMEKSEAVHHQVIDVLTPLFKIIGDEVGLRLPQKLNEIKQFILQKTNFFNPNREFDFRDLHWCINPPSKIKVNFTNYCDTIGIRKSIASAANPILLSAHTGGRGDIFPPYRCSGATTSVGRVFPLSVSLSMSLISRTSEIINMLTAISDGVYGKTYLLVPDYIEGEFDTQKIRVFEIGFIKRWLNDMPLLQTTNYMVLPENSKAKVCTIAVGELTLASLCVDESTILLYHDSNGSQDGILVVTLGIFGATPMDQVEEVIPVAHPSVEKIHITNHRGFIKDSIATWMVPALVSEKQEEQKSCLESACQRKSYPMCNQTSWEPFGGGQLPSYGRLTLPLDPSIDLQLNISFTYGPVILNGNGMDYYESPLLGSGWLTIPPKNGTVLGLINKAGRGDQFTVIPHVLTFAPRESSGNCYLPIQTSQIMDKDVLTESNLVVLPTQNFRYVIATYDISRGDHAIVYYVYDPIRTISYTHPFRLTTKGRPDFLRIECFVWDDDLWCHQFYRFETDSTNSTTSVENLVRIRFSCSRSKP

SEQ ID NO: 194 - protein, 511 aa, Vesiculovirus Alagoas vesiculovirus
MTPAFILCMLLAGSSWAKFTIVFPQSQKGDWKDVPPNYRYCPSSADQNWHGDLLGVNIRAKMPKVHKAIKADGWMCHAAKWVTTCDYRWYGPQYITHSIHSFIPTKAQCEESIKQTKEGVWINPGFPPKNCGYASVSDAESIIVQATAHSVMIDEYSGDWLDSQFPTGRCTGSTCETIHNSTLWYADYQVTGLCDSALVSTEVTFYSEDGLMTSIGRQNTGYRSNYFPYEKGAAACRMKYCTHEGIRLPSGVWFEMVDKELLESVQMPECPAGLTISAPTQTSVDVSLILDVERMLDYSLCQETWSKVHSGLPISPVDLGYIAPKNPGAGPAFTIVNGTLKYFDTRYLRIDIEGPVLKKMTGKVSGTPTKRELWTEWFPYDDVEIGPNGVLKTPEGYKFPLYMIGHGLLDSDLQKTSQAEVFHHPQIAEAVQKLPDDETLFFGDTGISKNPVEVIEGWFSNWRSSVMAIVFAILLLVITVLMVRLCVAFRHFCCQKRHKIYNDLEMNQLRR

SEQ ID NO: 195 - protein, 505 aa, Vesiculovirus Eptesicus vesiculovirus
MVRIICWLGLVLSVQAAKVILPVKLESDWVPVYSGERICQSHREKIPPGIYESLKVEGQVPVRQQSQGADGYYCHKTIYSVLCDFKWYGVKRVRHSVKRDTPSYSECLKAVDDEISGMSEYVGFPPPSCNYLVETRSQNIEIILSKHSVKIDDYKQSWMDSTFLDGGCSHAPCLTTVPGTLWIPTDNLTSACDITFRKQEFTIYYPKQKPAHLSSDQIFITSPYHPVSSLSKSCLITLCGKTGIRLPGGSWSSLDNHKSFHDIKIETLLSNCKSSTEIYSSPPDLRNIRMVWDLERVIENSLCQGTWDKIETRQKITPLDLNYLSPSEPGPGWGFIPKNGSIHKAQILYIRADVDDDTIALGQKYNKGKDEFYFNWNDWELLNGIKIGPNGIITNTHVRIPYYSVGIGKLDEDMITPDEVGVIHHIDHLKQRVLVQTNLDRVWIHEGENGDLITSVSHWWHDVIKHSWEIFALIGGLFSLSCICSLCSCRKKRRESRHQETMSFV

SEQ ID NO: 196 - protein, 523 aa, Vesiculovirus Carajas virus
MKMKMVIAGLILCIGILPAIGKITISFPQSLKGDWRPVPKGYNYCPTSADKNLHGDLIDIGLRLRAPKSFKGISADGWMCHAARWITTCDFRWYGPKYITHSIHSFRPSNDQCKEAIRLTNEGNWINPGFPPQSCGYASVTDSESVVVTVTKHQVLVDEYSGSWIDSQFPGGSCTSPICDTVHNSTLWHADHTLDSICDQEFVAMDAVLFTESGKFEEFGKPNSGIRSNYFPYESLKDVCQMDFCKRKGFKLPSGVWFEIEDAEKSHKAQVELKIKRCPHGAVISAPNQNAADINLIMDVERILDYSLCQATWSKIQNKEALTPIDISYLGPKNPGPGPAFTIINGTLHYFNTRYIRVDIAGPVTKEITGFVSGTSTSRVLWDQWFPYGENSIGPNGLLKTASGYKYPLFMVGTGVLDADIHKLGEATVIEHPHAKEAQKVVDDSEVIFFGDTGVSKNPVEVVEGWFSGWRSSLMSIFGIILLIVCLVLIVRILIALKYCCVRHKKRTIYKEDLEMGRIPRRA

SEQ ID NO: 197 - protein, 530 aa, Erythroparvovirus Rodent erythroparvovirus 1
MTSSVTISVILLISFIAPSYSSLSIAFPENTKLDWKPVTKNTRYCPMGGEWFLEPGLQEESFLSSTPIGATPSKSDGFLCHAAKWVTTCDFRWYGPKYITHSIHNIKPTRSDCDTALASYKSGTLVSPGFPPESCGYASVTDSEFLVIMITPHHVGVDDYRGHWVDPLFVGGECDQSYCDTIHNSSVWIPADQTKKNICGQSFTPLTVTVAYDKTKEIAAGAIVFKSKYHSHMEGARTCRLSYCGRNGIKFPNGEWVSLDVKTKIQEKPLLPLFKECPAGTEVRSTLQSDGAQVLTSEIQRILDYSLCQNTWDKVERKEPLSPLDLSYLASKSPGKGLAYTVINGTLSFAHTRYVRMWIDGPVLKEMKGKRESPSGISSDIWTQWFKYGDMEIGPNGLLKTAGGYKFPWHLIGMGIVDNELHELSEANPLDHPQLPHAQSIADDSEEIFFGDTGVSKNPVELVTGWFTSWKESLAAGVVLILVVVLIYGVLRCFPVLCTTCRKPKWKKGVERSDSFEMRIFKPNNMRARV

SEQ ID NO: 198 - protein, 512 aa, Vesiculovirus Cocal vesiculovirus
MNFLLLTFIVLPLCSHAKFSIVFPQSQKGNWKNVPSSYHYCPSSSDQNWHNDLLGITMKVKMPKTHKAIQADGWMCHAAKWITTCDFRWYGPKYITHSIHSIQPTSEQCKESIKQTKQGTWMSPGFPPQNCGYATVTDSVAVVVQATPHHVLVDEYTGEWIDSQFPNGKCETEECETVHNSTVWYSDYKVTGLCDATLVDTEITFFSEDGKKESIGKPNTGYRSNYFAYEKGDKVCKMNYCKHAGVRLPSGVWFEFVDQDVYAAAKLPECPVGATISAPTQTSVDVSLILDVERILDYSLCQETWSKIRSKQPVSPVDLSYLAPKNPGTGPAFTIINGTLKYFETRYIRIDIDNPIISKMVGKISGSQTERELWTEWFPYEGVEIGPNGILKTPTGYKFPLFMIGHGMLDSDLHKTSQAEVFEHPHLAEAPKQLPEEETLFFGDTGISKNPVELIEGWFSSWKSTVVTFFFAIGVFILLYVVARIVIAVRYRYQGSNNKRIYNDIEMSRFRK

SEQ ID NO: 199 - protein, 511 aa, Vesiculovirus Indiana vesiculovirus
MKCLLYLAFLSIGVNCKFTIVFPHNQKGTWKNVPSNYHYCPSSSDLNWHNDLIGTALQVKMPKSHKAIQADGWMCHASKWVTTCDFRWYGPKYITHSIRSFTPSVEQCRESIEQTKQGTWLNPGFPPQSCGYATVTDAEAVIVQVTPHHVLVDEYTGEWVDSQFINGKCSNDICPTVHNSTTWHSDYKVKGLCDSNLISMDITFFSEDGELSSLGKEGTGFRSNHFAYETGDKACKMQYCKHWGVRLPSGVWFEMADQDLFAAARFPECPEGSSISAPSQTSVDVSLIQDVERILDYSLCQETWSKIGAGLPISPVDLSYLAPKNPGTGPAFTIINGTLKYFETRYIRVDIAAPILSRMVGMISGTTTERELWDDWAPYEDVEIGPNGVLRTSSGYKFPLYMIGHGMLDSDLHLSSKAQVFEHPHIQDAASQLPDDETLFFGDTGLSKNPIELVEGWFSGWKSSIASFFFIIGLIIGLFLVLRVGIYLCIKLKHTKKRQIYTDIEMNRLGK

SEQ ID NO: 200 - protein, 523 aa, Vesiculovirus Isfahan vesiculovirus
MTSVLFMVGVLLGAFGSTHCSIQIVFPSETKLVWKPVLKGTRYCPQSAELNLEPDLKTMAFDSKVPIGITPSNSDGYLCHAAKWVTTCDFRWYGPKYITHSVHSLRPTVSDCKAAVEAYNAGTLMYPGFPPESCGYASITDSEFYVMLVTPHPVGVDDYRGHWVDPLFPTSECNSNFCETVHNATMWIPKDLKTHDVCSQDFQTIRVSVMYPQTKPTKGADLTLKSKFHAHMKGDRVCKMKFCNKNGLRLGNGEWIEVGDEVMLDNSKLLSLFPDCLVGSVVKSTLLSEGVQTALWETDRLLDYSLCQNTWEKIDRKEPLSAVDLSYLAPRSPGKGMAYIVANGSLMSAPARYIRVWIDSPILKEIKGKKESASGIDTVLWEQWLPFNGMELGPNGLIKTKSGYKFPLYLLGMGIVDQDLQELSSVNPVDHPHVPIAQAFVSEGEEVFFGDTGVSKNPIELISGWFSDWKETAAALGFAAISVILIIGLMRLLPLLCRRRKQKKVIYKDVELNSFDPRQAFHR

SEQ ID NO: 201 - protein, 524 aa, Vesiculovirus Jurona vesiculovirus
MESLPFSALLAVLSITLCDSAIPIFFPSEPQLEWKPVLPGSRYCPQSNEMSLDPDLKKSTISVKVPIGVTPSKSDGYLCHGAKWVSTCDFRWYGPKYITHSIHNLRPTTNDCEDAIKKYEAGTLINPGFPPDSCAYATVTDSEHLVILITPHHVGVDDYRGAWVDDSFPSGVCETNQCDTTHNSSIWIPKTKTRHNICSQTFANLSVTISYREGGAMKGADMVFHSKYHPHMVGGHICKMNFCNKQGLRLQNEEWIEIPSGTKVGNQDLMNLFSDCKSGLEVRSTLRSEGANTLTWETQRLLDYALCQNTWDKFDNQGAVSALDLSYLAARAPGKGVAYTMINGTLHSAPTRYVRMWIESPSMEELKAKKESSSGVETSIWNQWFPFKGGEIGPNGLIKAGNKYKFPLYLVGMGMLDDEINALELGGPIDHPQRAHAQAVLGDEETLFFGDTGVGKNPVELITGWFSGWKETIMAVVAIFLLVIVLYGVLRCCPTICVLCKRKSRHRTKDMEMQYIPNNQRHWR

SEQ ID NO: 202 - protein, 521 aa, Vesiculovirus Malpais Spring vesiculovirus
MESLLKAICVLLLIHCSRCDLPIVFPDQKELLWNPVLKTNRYCPQTREIAPLDKPKTLKITTGVPVRSPKEKIEGYLCHSGKWVTTCDYRWYGAKYVTHSIHHLKPTDQMCRDAISQYNGGTLLNPGFPPEVCGYASVTDSELIITLITPHTVGVDDYRGLWIDPSFPNGECNSIVCETIHNSTKWVSKGEMPTDICQQTFTTIKMDVSYPSDTTSQGSLLSFHSPYHPHISGKDICKMSYCGSNGLRLPNGEWFSIINTSKIGNKNLIDFFSPCKAGVEVRSTLQSEGSQTIAWETQRMLDYALCQNTWDKFERGEPLSPLDLNYLAPRVPGKGMAYTIINNTLHSSHAVYRRVWIEGPIIGEMKGKIESATGVAKEIWAQWFEFGQNKIGPNGVIKTNDGIKFPLYAIGTGLIDQDIHELSEVSPMDHPHLVHAKKYVSEDDEIYFGDTGVSHNPVEIFSGWFTNWKEGLMKFSILVLSILIFYVVIRLVMCIPLKCKKERKPRLEFELQPREWEYSRA

SEQ ID NO: 203 - protein, 512 aa, Vesiculovirus Maraba vesiculovirus
MLRLFLFCFLALGAHSKFTIVFPHHQKGNWKNVPSTYHYCPSSSDQNWHNDLTGVSLHVKIPKSHKAIQADGWMCHAAKWVTTCDFRWYGPKYITHSIHSMSPTLEQCKTSIEQTKQGVWINPGFPPQSCGYATVTDAEVVVVQATPHHVLVDEYTGEWIDSQLVGGKCSKEVCQTVHNSTVWHADYKITGLCESNLASVDITFFSEDGQKTSLGKPNTGFRSNHFAYESGEKACRMQYCTQWGIRLPSGVWFELVDKDLFQAAKLPECPRGSSISAPSQTSVDVSLIQDVERILDYSLCQETWSKIRAKLPVSPVDLSYLAPKNPGSGPAFTIINGTLKYFETRYIRVDISNPIIPHMVGTMSGTTTERELWNDWYPYEDVEIGPNGVLKTPTGFKFPLYMIGHGMLDSDLHKSSQAQVFEHPHAKDAASQLPDDETLFFGDTGLSKNPVELVEGWFSSWKSTLASFFLIIGLGVALIFIIRIIVAIRYKYKGRKTQKIYNDVEMSRLGNK

SEQ ID NO: 204 - protein, 513 aa, Vesiculovirus Morreton vesiculovirus
MLVLYLLLSLLALGAQCKFTIVFPHNQKGNWKNVPANYQYCPSSSDLNWHNGLIGTSLQVKMPKSHKAIQADGWMCHAAKWVTTCDFRWYGPKYVTHSIKSMIPTVDQCKESIAQTKQGTWLNPGFPPQSCGYASVTDAEAVIVKATPHQVLVDEYTGEWVDSQFPTGKCNKDICPTVHNSTTWHSDYKVTGLCDANLISMDITFFSEDGKLTSLGKEGTGFRSNYFAYENGDKACRMQYCKHWGVRLPSGVWFEMADKDIYNDAKFPDCPEGSSIAAPSQTSVDVSLIQDVERILDYSLCQETWSKIRAHLPISPVDLSYLSPKNPGTGPAFTIINGTLKYFETRYIRVDIAGPIIPQMRGVISGTTTERELWTDWYPYEDVEIGPNGVLKTATGYKFPLYMIGHGMLDSDLHISSKAQVFEHPHIQDAASQLPDDETLFFGDTGLSKNPIELVEGWFSGWKSTIASFFFIIGLVIGLYLVLRIGIALCIKCRVQEKRPKIYTDVEMNRLDR

SEQ ID NO: 205 - protein, 517 aa, Vesiculovirus New Jersey vesiculovirus
MLSYLIFALVVSPILGKIEIVFPQHTTGDWKRVPHEYNYCPTSADKNSHGTQTGIPVELTMPKGLTTHQVDGFMCHSALWMTTCDFRWYGPKYITHSIHNEEPTDYQCLEAIKAYKDGVSFNPGFPPQSCGYGTVTDAEAHIVTVTPHSVKVDEYTGEWIDPHFIGGRCKGQICETVHNSTKWFTSSDGESVCSQLFTLVGGTFFSDSEEITSMGLPETGIRSNYFPYVSTEGICKMPFCRKPGYKLKNDLWFQITDPDLDKTVRDLPHIKDCDLSSSIVTPGEHATDISLISDVERILDYALCQNTWSKIEAGEPITPVDLSYLGPKNPGAGPVFTIINGSLHYFMSKYLRVELESPVIPRMEGKVAGTRIVRQLWDQWFPFGEVEIGPNGVLKTKQGYKFPLHIIGTGEVDNDIKMERIVKHWEHPHIEAAQTFLKKDDTEEVLYYGDTGVSKNPVELVEGWFSGWRSSIMGVLAVIIGFVILIFLIRLIGVLSSLFRQKRRPIYKSDVEMAHFR

SEQ ID NO: 206 - protein, 525 aa, Vesiculovirus Perinet vesiculovirus
MSSKIVLAAICLCSVQYVACSFQIVFPEFNNAAWLPYLKTSRYCPQSAEMEFERRVSTTLLSADVPIGVTPTKSDGYLCHAAKWVTTCDFRWYGPKYVTHSIHDLTPAQVDCHEALARYKAGTLFNPGFPPASCGYATITDSEQKVVMITPHHVGIDDYRGKWIDPIFPGGECTTNYCETLHNSSVWLPADEKIVDICAQTFRKIKVTATYPSEGAVTKETISLHSAYHPHVPGTGICRMTYCSKEGLRLPNGEWLGIFYDNRIKTTDVRTVFPACPDGLEVKSTLNSDGANTIAWETQRMLDYALCQSTWDKVQNKEPLSAVDLSYLSARSPGKGLAYTVINGTLHFAHVRYVRTWIDGPVLKDLKGSRFDPTAAQKTLWDQWFPFGSNEIGPNGLLKTPKDFKFPLYIIGTGLVDEDLQELSEAGPIDHPQIPDASGILPNSEQVYYGDTGVSKNPIELIEGWFANWKETVMSIVGLVLLITIVFTVLKCIGTCRSLRRKRKIEKDIELQEIGPYQPTTYRPR

SEQ ID NO: 207 - protein, 529 aa, Vesiculovirus Piry vesiculovirus
MDLFPILVVVLMTDTVLGKFQIVFPDQNELEWRPVVGDSRHCPQSSEMQFDGSRSQTILTGKAPVGITPSKSDGFICHAAKWVTTCDFRWYGPKYITHSIHHLRPTTSDCETALQRYKDGSLINLGFPPESCGYATVTDSEAMLVQVTPHHVGVDDYRGHWIDPLFPGGECSTNFCDTVHNSSVWIPKSQKTDICAQSFKNIKMTASYPSEGALVSDRFAFHSAYHPNMPGSTVCIMDFCEQKGLRFTNGEWMGLNVEQSIREKKISAIFPNCVAGTEIRATLESEGARTLTWETQRMLDYSLCQNTWDKVSRKEPLSPLDLSYLSPRAPGKGMAYTVINGTLHSAHAKYIRTWIDYGEMKEIKGGRGEYSKAPELLWSQWFDFGPFKIGPNGLLHTGKTFKFPLYLIGAGIIDEDLHELDEAAPIDHPQMPDAKSVLPEDEEIFFGDTGVSKNPIELIQGWFSNWRESVMAIVGIVLLIVVTFLAIKTVRVLNCLWRPRKKRIVRQEVDVESRLNHFEMRGFPEYVKR

SEQ ID NO: 208 - protein, 556 aa, Vesiculovirus Radi vesiculovirus
MISITFVYLIIILSLSWGEMMIPFPDVTTTTWKPVLKGEHHCPSSSDVDILSRMSTLKLQVRIPTGSVASKSDGLLCHGAKWVTTCDFRWYGSKYITHSLHSIRPTLSQCTEAAKAYKEGRLMAPGFPPESCGWNSVTDSELLSILVTPHHTGVDDYRGIWIDSMFPGGECKEMVCDTVQGHTIWMSTSNLTTACGVAFKQIQGQFYYLNSGHQPNKEGTFFHSPNHPNSPLSTACRKKYCNQEGIVIHTGEWIGVPWNTRIRDVQLDSYTDLCAESTEIKSTIGSAPIRVIAWEMERVMDFALCQTVWDKVNRGDPLSPLDLSYLSSRAPGKGLAYTIINETLHVAHVRYIRTYIKAPIMEEIKGSRGDRSAAESVLWTQWFPYGDGEIGPNGLLKTNGSFKFPFYLVGMGAIDDDLIELSNADPIDHPQKAIASVHLNTDEELFFGNTGSDSNPVEAVEGWFASWKSAGINMALIVLCVLLVLIFLRSLPALIKLIHRYRVSRSRQTDVELNSINETARTGSVGPDIIPGAWRVHDSGVRQSQFFRNNPRRLGP

SEQ ID NO: 209 - protein, 559 aa, Vesiculovirus Yug Bogdanovac vesiculovirus
MISSTLILVIISAHAFCDMIIPFPDVTTTSWKPVLRGEHHCPASNDLDMAGGLSTLKMNVKIPSGVVGSKSDGYLCHGAKWVTTCDYRWYGAKYITHSLHPLRPSTSQCFDAIKAYREGTLLSPGFPPESCGWNSVTDSELLSIQITPHHSGVDDYRGVWIDSMFPKGECDQRICDTVQEHSIWIAANNVSSACSIAFKQLEGYFYYRNSGIQPNKDGTFFHSSHHPNSPMSSCCRIKYCNQEGLRLHTGEWIGVAWNTKIRDVTLDSYTDTCPGGTEVKSTIGSSPTRVVAWEMERIMDFALCQNVWDKVNRGEQLSPLDLSYLSSRAPGKGLAYTIINETLHVAHVRYIRTWIKGPVLKEIKGRRGSSSAAEDTLWIQWFPFGDNQIGPNGLLKSNGTFKFPFYLVGVGALDEDLIEMANADPVDHLQRVDAETHMRGDEELFFGDTGVSKNPIESVEGWFSNWISGLFNISIIVLCVLSVLIVFKSVITLIRVVRRRRRPRAEEDVELNNMNPRPQTRQPVGAPNIIPGAWGIQPSHGRGVRQSQFVKRSALNIVT

SEQ ID NO: 210 - protein, 511 aa, Vesiculovirus Indiana vesiculovirus
MKCLLYLALLFIGVYCKFTTVFPHNKKGDWKNVPSNYHYCPSSSDLNWHNDLIGTALQVKMPKSHKAIQADGWMCHASKWVTTCDFRWYGPKYITHSIRSFTPSVEQCKESIEQTKQGTWLNPGFPPQSCGYATVTDAEAVIVQVTPHHVLVDEYTGEWVDSQFINGKCSDDICPTVHNSTTWHSDYKVKGLCDSNLISMDITFFSEDGELSSLGKEGTGFRSNYFAYETGDKACKMQYCKHWGVRLPSGVWFEMADKNLFAAAKFPECPEGSSISAPSQTSVDVSLIQDVERILDYSLCQETWSKIRAGLPISPVDLSYLAPKNPGTGPAFTIINGTLKYFETRYIRVDIAAPILSRMVGMISGTTTERELWEDWAPYEDVEIGPNGVLRTSSGYKFPLYMIGHGMLDSDLHLSSKAQVFEHPHIPDATSQLPDDETLFFGDTGLSKDPIELVEGWFSGWKSSIASFFFIIGLIIGLFFVLRIGVYLCIKLKHTNKRQIYTDIEMNRLGK

SEQ ID NO: 211 - protein, 511 aa, Vesiculovirus Indiana vesiculovirus
MKCLLCLAFLFIGVNCKFTIVFPHNQKGNWKNVPSNYHYCPSSSDLNWHNDLIGTALQVKMPKSHKAIQADGWMCHASKWITTCDFRWYGPKYITHSIQSFTPSVEQCKESIEQTKQGTWLNPGFPPQSCGYATVTDAEAVIVQVTPHHVLVDEYTGEWVDSQFINGKCSNDICLTVHNSTTWHSDYKVKGLCDSNLISMDITFFSEDGELSSLGKAGTGFRSNYFAYETGDKACKMQYCKHWGVRLPSGVWFEMADKDLFAAAKFPECPEGSSISAPSQTSVDVSLIQDVERILDYSLCQETWSKIRAGLPISPVDLSYLAPKNPGTGPAFTIINGTLKYFETRYIRVDIAAPILSRMVGMISGTNTERELWEDWAPYEDVEIGPNGVLRTSSGYKFPLYMIGHGMLDSDLHLSSKVQVFEHPHIQDAASQLPDDETLFFGDTGLSKNPIELVEGWFSGWKSSIASFFFIIGLIIGLFLVLRVGIYLCIKLKHTRKRKIYADIEMNRLGK

SEQ ID NO: 212 - protein, 546 aa, Henipavirus Nipah henipavirus
MVVILDKRCYCNLLILILMISECSVGILHYEKLSKIGLVKGVTRKYKIKSNPLTKDIVIKMIPNVSNMSQCTGSVMENYKTRLNGILTPIKGALEIYKNNTHDLVGDVRLAGVIMAGVAIGIATAAQITAGVALYEAMKNADNINKLKSSIESTNEAVVKLQETAEKTVYVLTALQDYINTNLVPTIDKISCKQTELSLDLALSKYLSDLLFVFGPNLQDPVSNSMTIQAISQAFGGNYETLLRTLGYATEDFDDLLESDSITGQIIYVDLSSYYIIVRVYFPILTEIQQAYIQELLPVSFNNDNSEWISIVPNFILVRNTLISNIEIGFCLITKRSVICNQDYATPMTNNMRECLTGSTEKCPRELVVSSHVPRFALSNGVLFANCISVTCQCQTTGRAISQSGEQTLLMIDNTTCPTAVLGNVIISLGKYLGSVNYNSEGIAIGPPVFTDKVDISSQISSMNQSLQQSKDYIKEAQRLLDTVNPSLISMLSMIILYVLSIASLCIGLITFISFIIVEKKRNTYSRLEDRRVRPTSSGDLYYIGT

SEQ ID NO: 213 - protein, 602 aa, Henipavirus Nipah henipavirus
MPAENKKVRFENTTSDKGKIPSKVIKSYYGTMDIKKINEGLLDSKILSAFNTVIALLGSIVIIVMNIMIIQNYTRSTDNQAVIKDALQGIQQQIKGLADKIGTEIGPKVSLIDTSSTITIPANIGLLGSKISQSTASINENVNEKCKFTLPPLKIHECNISCPNPLPFREYRPQTEGVSNLVGLPNNICLQKTSNQILKPKLISYTLPVVGQSGTCITDPLLAMDEGYFAYSHLERIGSCSRGVSKQRIIGVGEVLDRGDEVPSLFMTNVWTPPNPNTVYHCSAVYNNEFYYVLCAVSTVGDPILNSTYWSGSLMMTRLAVKPKSNGGGYNQHQLALRSIEKGRYDKVMPYGPSGIKQGDTLYFPAVGFLVRTEFKYNDSNCPITKCQYSKPENCRLSMGIRPNSHYILRSGLLKYNLSDGENPKVVFIEISDQRLSIGSPSKIYDSLGQPVFYQASFSWDTMIKFGDVLTVNPLVVNWRNNTVISRPGQSQCPRFNTCPEICWEGVYNDAFLIDRINWISAGVFLDSNQTAENPVFTVFKDNEILYRAQLASEDTNAQKTITNCFLLKNKIWCISLVEIYDTGDNVIRPKLFAVKIPEQCT

SEQ ID NO: 214 - protein, 546 aa, Henipavirus Hendra henipavirus
MATQEVRLKCLLCGIIVLVLSLEGLGILHYEKLSKIGLVKGITRKYKIKSNPLTKDIVIKMIPNVSNVSKCTGTVMENYKSRLTGILSPIKGAIELYNNNTHDLVGDVKLAGVVMAGIAIGIATAAQITAGVALYEAMKNADNINKLKSSIESTNEAVVKLQETAEKTVYVLTALQDYINTNLVPTIDQISCKQTELALDLALSKYLSDLLFVFGPNLQDPVSNSMTIQAISQAFGGNYETLLRTLGYATEDFDDLLESDSIAGQIVYVDLSSYYIIVRVYFPILTEIQQAYVQELLPVSFNNDNSEWISIVPNFVLIRNTLISNIEVKYCLITKKSVICNQDYATPMTASVRECLTGSTDKCPRELVVSSHVPRFALSGGVLFANCISVTCQCQTTGRAISQSGEQTLLMIDNTTCTTVVLGNIIISLGKYLGSINYNSESIAVGPPVYTDKVDISSQISSMNQSLQQSKDYIKEAQKILDTVNPSLISMLSMIILYVLSIAALCIGLITFISFVIVEKKRGNYSRLDDRQVRPVSNGDLYYIGT

SEQ ID NO: 215 - protein, 603 aa, Henipavirus Hendra henipavirus
MADSKLVSLNNNLSGKIKDQGKVIKNYYGTMDIKKINDGLLDSKILGAFNTVIALLGSIIIIVMNIMIIQNYTRTTDNQALIKESLQSVQQQIKALTDKIGTEIGPKVSLIDTSSTITIPANIGLLGSKISQSTSSINENVNDKCKFTLPPLKIHECNISCPNPLPFREYRPISQGVSDLVGLPNQICLQKTTSTILKPRLISYTLPINTREGVCITDPLLAVDNGFFAYSHLEKIGSCTRGIAKQRIIGVGEVLDRGDKVPSMFMTNVWTPPNPSTIHHCSSTYHEDFYYTLCAVSHVGDPILNSTSWTESLSLIRLAVRPKSDSGDYNQKYIAITKVERGKYDKVMPYGPSGIKQGDTLYFPAVGFLPRTEFQYNDSNCPIIHCKYSKAENCRLSMGVNSKSHYILRSGLLKYNLSLGGDIILQFIEIADNRLTIGSPSKIYNSLGQPVFYQASYSWDTMIKLGDVDTVDPLRVQWRNNSVISRPGQSQCPRFNVCPEVCWEGTYNDAFLIDRLNWVSAGVYLNSNQTAENPVFAVFKDNEILYQVPLAEDDTNAQKTITDCFLLENVIWCISLVEIYDTGDSVIRPKLFAVKIPAQCSES

SEQ ID NO: 216 - protein, 552 aa, Orthoavulavirus Newcastle disease virus
MGSRPSTKNPAPMMLTIRVALVLSCICPANSIDGRPLAAAGIVVTGDKAVNIYTSSQTGSIIVKLLPNLPKDKEACAKAPLDAYNRTLTTLLTPLGDSIRRIQESVTTSGGGRQGRLIGAIIGGVALGVATAAQITAAAALIQAKQNAANILRLKESIAATNEAVHEVTDGLSQLAVAVGKMQQFVNDQFNKTAQELDCIKIAQQVGVELNLYLTELTTVFGPQITSPALNKLTIQALYNLAGGNMDYLLTKLGVGNNQLSSLIGSGLITGNPILYDSQTQLLGIQVTAPSVGNLNNMRATYLETLSVSTTRGFASALVPKVVTQVGSVIEELDTSYCIETDLDLYCTRIVTFPMSPGIYSCLSGNTSACMYSKTEGALTTPYMTIKGSVIANCKMTTCRCVNPPGIISQNYGEAVSLIDKQSCNVLSLGGITLRLSGEFDVTYQKNISIQDSQVIITGNLDISTELGNVNNSISNALNKLEESNRKLDKVNVKLTSTSALITYIVLTIISLVFGILSLILACYLMYKQKAQQKTLLWLGNNTLDQMRATTK

SEQ ID NO: 217 - protein, 577 aa, Orthoavulavirus Newcastle disease virus
MDRAVSQVALENDEREAKNTWRLIFRIAILFLTVVTLAISVASLLYSMGASTPSDLVGIPTRISRAEEKITSTLGSNQDVVDRIYKQVALESPLALLNTETTIMNAITSLSYQINGAANNSGWGAPIHDPDYIGGIGKELIVDDASDVTSFYPSAFQEHLNFIPAPTTGSGCTRIPSFDMSATHYCYTHNVILSGCRDHSHSYQYLALGVLRTSATGRVFFSTLRSINLDDTQNRKSCSVSATPLGCDMLCSKVTETEEEDYNSAVPTRMVHGRLGFDGQYHEKDLDVTTLFGDWVANYPGVGGGSFIDSRVWFSVYGGLKPNSPSDTVQEGKYVIYKRYNDTCPDEQDYQIRMAKSSYKPGRFGGKRIQQAILSIKVSTSLGEDPVLTVPPNTVTLMGAEGRILTVGTSHFLYQRGSSYFSPALLYPMTVSNKTATLHSPYTFNAFTRPGSIPCQASARCPNSCVTGVYTDPYPLIFYRNHTLRGVFGTMLDGVQARLNPASAVFDSTSRSRITRVSSSSTKAAYTTSTCFKVVKTNKTYCLSIAEISNTLFGEFRIVPLLVEILKDDGVREARSG

SEQ ID NO: 218 - protein, 574 aa, Orthopneumovirus Human respiratory syncytial virus
MELLILKANAITTILTAVTFCFASGQNITEEFYQSTCSAVSKGYLSALRTGWYTSVITIELSNIKENKCNGTDAKVKLIKQELDKYKNAVTELQLLMQSTPPTNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEINLCNVDIFNPKYDCKIMTSKTDVSSSVITSLGAIVSCYGKTKCTASNKNRGIIKTFSNGCDYVSNKGMDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 219 - protein, 263 aa, Orthopneumovirus Human respiratory syncytial virus
MSNHTHHPKFKTLKRAWKASKYFIVGLSCLYKFNLKSLVQTALTSLAMITLTSLVITAIIYISVGNAKAKPTSKPTTQQTQQPQNHTPLLPTEHNHKSTHTSTQSTTLSQPPNIDTTSGTTYGHPINRTQNRKIKSQSTPLATRKLPINPLESNPPENHQDHNNSQTLPHVPCSTCEGNPACSPLCQIGLERAPSRAPTITLKKAPKPKTTKKPTKTTIYHRTSPEAKLQTKKNTATPQQGILSSPEHQTNQSTTQISQHTSI

SEQ ID NO: 220 - protein, 574 aa, Orthopneumovirus Bovine respiratory syncytial virus
MATTAMRMIISIIFISTYVTHITLCQNITEEFYQSTCSAVSRGYLSALRTGWYTSVVTIELSKIQKNVCNSTDSNVKLIKQELERYNNAVVELQSLMQNEPASSSRAKRGIPELIHYKRNSTKKFYGLMGKKRKRRFLGFLLGIGSAIASGVAVSKVLHLEGEVNKIKNALLSTNKAVVSLSNGVSVLTSKVLDLKNYIDKELLPKVNNHDCKISNIATVIEFQQKNNRLLEIAREFSVNAGITTPLSTYMLTNSELLSLINDMPITNDQKKLMSSNVQIVRQQSYSIMSVVKEEVMAYVVQLPIYGVIDTPCWKLHTSPLCTTDNKEGSNICLTRTDRGWYCDNAGSVSFFPQAETCKVQSNRVFCDTMNSLTLPTDVNLCNTDIFNAKYDCKIMTSKTDISSSVITSIGAIVSCYGKTKCTASNKNRGIIKTFSNGCDYVSNRGVDTVSVGNTLYYVNKLEGKALYIKGEPIINYYDPLVFPSDEFDASIAQVNAKINQSLAFIRRSDELLHSVDVGKSTTNVVITTIIIVIVVVILMLIAVGLLFYSKTRSTPIMLGKDQLSGINNLSFSK

SEQ ID NO: 221 - protein, 537 aa, Orthopneumovirus Murine pneumonia virus
MIPGRIFLVLLVIFNTKPIHPNTLTEKYYESTCSVETAGYKSALRTGWHMTVMSIKLSQINIESCKSSNSLLAHELAIYSSAVDELRTLSSNALKSKRKKRFLGLILGLGAAVTAGVALAKTVQLESEIALIRDAVRNTNEAVVSLTNGMSVLAKVVDDLKNFISKELLPKINRVSCDVHDITAVIRFQQLNKRLLEVSREFSSNAGLTHTVSSFMLTDRELTSIVGGMAVSAGQKEIMLSSKAIMRRNGLAILSSVNADTLVYVIQLPLFGVMDTDCWVIRSSIDCHNIADKYACLARADNGWYCHNAGSLSYFPSPTDCEIHNGYAFCDTLKSLTVPVTSRECNSNMYTTNYDCKISTSKTYVSTAVLTTMGCLVSCYGHNSCTVINNDKGIIRTLPDGCHYISNKGVDRVQVGNTVYYLSKEVGKSIVVRGEPLVLKYDPLSFPDDKFDVAIRDVEHSINQTRTFFKASDQLLDLSENRENKNLNKSYILTTLLFVVMLIIIMAVIGFILYKVLKMIRDNKLKSKSTPGLTVLS

SEQ ID NO: 222 - protein, 550 aa, Morbillivirus Measles virus
MGLKVNVSAIFMAVLLTLQTPTGQIHWGNLSKIGVVGIGSASYKVMTRSSHQSLVIKLMPNITLLNNCTRVEIAEYRRLLRTVLEPIRDALNAMTQNIRPVQSVASSRRHKRFAGVVLAGAALGVATAAQITAGIALHQSMLNSQAIDNLRASLETTNQAIEAIRQAGQEMILAVQGVQDYINNELIPSMNQLSCDLIGQKLGLKLLRYYTEILSLFGPSLRDPISAEISIQALSYALGGDINKVLEKLGYSGGDLLGILESRGIKARITHVDTESYFIVLSIAYPTLSEIKGVIVHRLEGVSYNIGSQEWYTTVPKYVATQGYLISNFDESSCTFMPEGTVCSQNALYPMSPLLQECLRGSTKSCARTLVSGSFGNRFILSQGNLIANCASILCKCYTTGTIINQDPDKILTYIAADHCPVVEVNGVTIQVGSRRYPDAVYLHRIDLGPPISLERLDVGTNLGNAIAKLEDAKELLESSDQILRSMKGLSSTSIVYILIAVCLGGLIGIPALICCCRGRCNKKGEQVGMSRPGLKPDLTGTSKSYVRSL

SEQ ID NO: 223 - protein, 550 aa, Morbillivirus Measles virus; identical to SEQ ID NO: 222

SEQ ID NO: 224 - protein, 574 aa, Orthopneumovirus Human respiratory syncytial virus
MELLIHRLSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEINREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITTIIIVIIVVLLSLIAIGLLLYCKAKNTPVTLSKDQLSGINNIAFSK

SEQ ID NO: 225 - protein, 546 aa, Morbillivirus Rinderpest virus
MKILFATLLVVTTPHLVTGQIHWGNLSKIGVVGTGSASYKVMTQSSHQTLVIKLMPNITAIDNCTKTEIEEYKRLLGTVLQPIKVALNAITKNIKPIKSSTTSRRHRRFAGVALAGAALGVATAAQITAGIALHQSMMNTQAIESLKASLETTNQAIEEIRQAGQEMILAVQGVQDYINNELVPAMGQLSCDIVGQKLGLKLLRYYTEILSLFGPSLRDPISAEISIQALSYALGGDINKILEKLGYSGSDLLAILESKGIKAKITYVDIESYFIVLSIAYPSLSEIKGVIIHRLEGVSYNIGSQEWYTTVPRYVATQGYLISNFDDTPCAFSPEGTICSQNALYPMSPLLQECFRGSTRSCARTLVSGSIGNRFILSKGNLIANCASILCKCYTTGSIISQDPDKILTYIAADQCPIVEVDGVTIQVGSREYPDAVYLHKIDLGPPISLEKLDVGTNLGNAVTKLEKAKDLLDSSDLILETIKGASVTNTGHILVGAGLIAVVGILIVTCCCRKRSNDSKVSTVILNPGLKPDLTGTSKSYVRSL

SEQ ID NO: 226 - protein, 561 aa, Simian virus glycoprotein 41 (SV41)
MRLTPYPIALTTLMIALTTLPETGLGIARDALSQVGVIQSKARSLMYYSDGSSSFIVVKLLPTLPTPSGNCNLTSITAYNTTLFKLLTPLMENLDTIVSANQAGSRRKRFAGVVVGLAALGVATAAQVTAAVAVVKANANAAAINKLAASIQSTNAAISDVISSTRTLATAIQAVQDHVNGVLASGLTEANCRSQDALIGSILNLYLTELTTIFHNQIVNPALTPLSIQALRIILGSTLPLIVESRWNTNLNTAELLSSGLLTGQIISISPSYMQMVIQITVPTFVMQPGAKIIDLVTITANRMEEEVLIQVPPRILEYANEIQAYTADDCVVTPHAVFCKYNDGSPISDSLYQCLKGNLTSCVFTPVVGNYLKRFAFANGVMYVNCKALLCRCADPPMVITQDDLAGITVIDITVCREVMLDTLAFKITSLNNVTYGANFSMLAAAIKDLSPLDLSAQLAQVNKSLASAEEKIAQSSSLAAQAVSQEATITVGSVAMLIAVLALIAGCTGIMIAVQMSRRLEVLRHLTDQSIISNHHYAELNPPPYNHSYESLHPIPQSH

SEQ ID NO: 227 - protein, 538 aa, Orthorubulavirus Mumps Virus
MKVFLVTCLGFAVFSSSVCVNINILQQIGYIKQQVRQLSYYSQSSSSYIVVKLLPNIQPTDNSCEFKSVTQYNKTLSNLLLPIAENINNIASPSSGSRRHKRFAGIAIGIAALGVATAAQVTAAVSLVQAQTNARAIAAMKNSIQATNRAVFEVKEGTQRLAIAVQAIQDHINTIMNTQLNNMSCQILDNQLATSLGLYLTELTTVFQPQLINPALSPISIQALRSLLGSMTPAVVQATLSTSISAAEILSAGLMEGQIVSVLLDEMQMIVKINIPTIVTQSNALVIDFYSISSFINNQESIIQLPDRILEIGNEQWSYPAKNCKLTRHHIFCQYNEAERLSLESKLCLAGNISACVFSPIAGSYMRRFVALDGTIVANCRSLTCLCKSPSYPIYQPDHHAVTTIDLTACQTLSLDGLDFSIVSLSNITYAENLTISLSQTINTQPIDISTELSKVNASLQNAVKYIKESNHQLQSVNVNSKIGAIIVAALVLSILSIIISLLFCCWAYVATKEIRRINFKTNHINTISSSVDDLIRY

SEQ ID NO: 228 - protein, 662 aa, Morbillivirus Canine distemper virus
MHRGIPKSSKTQTHTQQDRPPQPSTELEETRTSRARHSTTSAQRSTHYDPRTSDRPVSYTMNRTRSRKQTSHRLKNIPVHGNHEATIQHIPESVSKGARSQIERRQPNAINSGSHCTWLVLWCLGMASLFLCSKAQIHWDNLSTIGIIGTDNVHYKIMTRPSHQYLVIKLIPNASLIENCTKAELGEYEKLLNSVLEPINQALTLMTKNVKPLQSLGSGRRQRRFAGVVLAGVALGVATAAQITAGIALHQSNLNAQAIQSLRTSLEQSNKAIEEIREATQETVIAVQGVQDYVNNELVPAMQHMSCELVGQRLGLRLLRYYTELLSIFGPSLRDPISAEISIQALIYALGGEIHKILEKLGYSGSDMIAILESRGIKTKITHVDLPGKFIILSISYPTLSEVKGVIVHRLEAVSYNIGSQEWYTTVPRYIATNGYLISNFDESSCVFVSESAICSQNSLYPMSPLLQQCIRGDTSSCARTLVSGTMGNKFILSKGNIVANCASILCKCYSTSTIINQSPDKLLTFIASDTCPLVEIDGATIQVGGRQYPDMVYEGKVALGPAISLDRLDVGTNLGNALKKLDDAKVLIDSSNQILETVRRSSFNFGSLLSVPILSCTALALLLLIYCCKRRYQQTLKQHTKVDPAFKPDLTGTSKSYVRSL

SEQ ID NO: 229 - protein, 574 aa, Orthopneumovirus Human respiratory syncytial virus
MELPILKANAITTILAAVTFCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKKTNVTLSKKRKRRFLGFLLGVGSAIASGTAVSKVLHLEGEVNKIKSALLSTNKAVVSLSNGVSVLTSKVLDLKNYIDKQLLPIVNKQSCRISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYASNKGVDTVSVGNTLYYVNKQEGKSLYVKGEPIINFYDPLVFPSDEFDASISQVNEKINQSLAFIRKSDELLHHVNAGKSTTNIMITTIIIVIIVILLSLIAVGLLLYCKARSTPVTLSKDQLSGINNIAFSN

SEQ ID NO: 230 - protein, 565 aa, Respirovirus Sendai virus
MTAYIQRSQCISTSLLVVLTTLVSCQIPRDRLSNIGVIVDEGKSLKIAGSHESRYIVLSLVPGVDLENGCGTAQVIQYKSLLNRLLIPLRDALDLQEALITVTNDTTQNAGVPQSRFFGAVIGTIALGVATSAQITAGIALAEAREAKRDIALIKESMTKTHKSIELLQNAVGEQILALKTLQDFVNDEIKPAISELGCETAALRLGIKLTQHYSGLLTAFGSNFGTIGEKSLTLQALSSLYSANITEIMTTIRTGQSNIYDVIYTEQIKGTVIDVDLERYMVTLSVKIPILSEVPGVLIHKASSISYNIDGEEWYVTVPSHILSRASFLGGADITDCVESRLTYICPRDPAQLIPDSQQKCILGDTTRCPVTKVVDSLIPKFAFVNGGVVANCIASTCTCGTGRRPISQDRSKGVVFLTHDNCGLIGVNGVELYANRRGHDATWGVQNLTVGPAIAIRPIDISLNLADATNFLQDSKAELEKARKILSEVGRWYNSRETVITIIVVMVVILVVIIVIVIVLYRLKRSMLMGNPDDRIPRDTYTLEPKIRHMYTNGGFDAMAEKR

SEQ ID NO: 231 - protein, 574 aa, Orthopneumovirus Human respiratory syncytial virus
MELPILKTNAITAILAAVTLCFASSQNITEEFYQSTCSAVSKGYLSALRTGWYTSVITIELSNIKENKCNGTDAKVKLIKQELDKYKSAVTELQLLMQSTPATNNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPLAETCKVQSNRVFCDTMNSLTLPSEVNLCNIDIFNPKYDCKIMTSKTDVSSSVITSLGAIVSCYGKTKCTASNKDRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 232 - protein, 546 aa, Morbillivirus Rinderpest virus
MRIPLAALIAMTIPCLATGQIHWGNLSKIGVVGTSSASYKVVTQSSHQSLVIKLMPNITAIDNCTKTEIGEYKRLLGTVLKPIGEALNAITKNIKPIQSSTTSRRHKRFAGVVLAGAALGVATAAQITAGIALHQSMMNSQAIESLKASLVTTNQAIEEIRQAGQEMILAVQGVQDYINNELVPAMGQLSCDMVGQKLGLKLLRYYTEILSLFGPSLRDPVSAEISIQALSYALGGDINKILNRLGYSGSDLLAILESKGIKAKITYVDIESYFIVLSIAYPSLSEIKGVIVHRLEGVSYNIGSQEWYTTVPRYVATQGYLISNFDDTPCAFTPEGTISSQNALYPMSPLLQECFRGSTRSCARTLVSGSIGNRFILSKGNLIANCASILCKCYTTGSIISQDPDKILTYIAADQCPVVEVNGVTIQVGSREYPDAVYLHNIDLGPPISLEKLDVGTDLGNAVTKLERAKDLLDSSDLILKNIKGVSVTNTGYILIGVGLIAVVGIIIVTCCCKKSSSDSRASTVVLNPGLKPDLTGTSKSYIRSL

SEQ ID NO: 233 - protein, 550 aa, Morbillivirus Measles virus; identical to SEQ ID NO: 222

SEQ ID NO: 234 - protein, 551 aa, Orthorubulavirus Human parainfluenza 2 virus
MHHLHPMIVCIFVMYTGIVGSDAIAGDQLLNIGVIQSKIRSLMYYTDGGASFIVVKLLPNLPPSNGTCNITSLDAYNVTLFKLLTPLIENLSKISTVTDTKTRQKRFAGVVVGLAALGVATAAQITAAVAIVKANANAAAINNLASSIQSTNKAVSDVIDASRTIATAVQAIQDHINGAIVNGITSASCRAHDALIGSILNLYLTELTTIFHNQITNPALTPLSIQALRILLGSTLPIVIESKLNTNLNTAELLSSGLLTGQIISISPMYMQMLIQINVPTFIMQPGAKVIDLIAISANHKLQEVVVQVPNRILEYANELQNYPANDCVVTPNSVFCRYNEGSPIPESQYQCLRGNLNSCTFTPIIGNFLKRFAFANGVLYANCKSLLCRCADPPHVVSQDDTQGISIIDIKRCSEMMLDTFSFRITSTFNATYVTDFSMINANIVHLSPLDLSNQINSINKSLKSAEDWIADSNFFANQARTAKTLYSLSAIALILSVITLVVVGLLIAYIIKLVSQIHQFRSLAATTMFHRENPAFFSKNNHGNIYGIS

SEQ ID NO: 235 - protein, 537 aa, Metapneumovirus Avian metapneumovirus
MSWKVVLLLVLLATPTGGLEESYLEESCSTVTRGYLSVLRTGWYTNVFTLEVGDVENLTCTDGPSLIRTELELTKNALEELKTVSADQLAKEARIMSPRKARFVLGAIALGVATAAAVTAGVAIAKTIRLEGEVAAIKGALRKTNEAVSTLGNGVRVLATAVNDLKDFISKKLTPAINKNKCDISDLKMAVSFGQYNRRFLNVVRQFSDNAGITPAISLDLMTDAELVRAVSNMPTSSGQINLMLENRAMVRRKGFGILIGVYGSSVVYMVQLPIFGVIDTPCWKVKAAPLCSGKDGSYACLLREDQGWYCQNAGSTVYYPNEEDCEVRSDHVFCDTAAGINVAKESEECNRNISTTKYPCKVSTGRHPISMVALSPLGALVACYDGVSCSIGSNKVGIIRPLGKGCSYISNQDADTVTIDNPVYQLSKVEGEQHTIKGKPVSSNFDPIEFPEDQFNIALDQVFESVEKSKNLIDQSNKILDSTEKGNAGFVMVIVLIVLLMLAAVGVGIFFVVKKRKAAPKFPMEMNGVNNKGFIP

SEQ ID NO: 236 - protein, 537 aa, Morbillivirus Phocine distemper virus
MVILVHCVMGQIHWTNLSTIGIIGTDSSHYKIMTRSSHQYLVLKLMPNVSIIDNCTKAELDEYEKLLNSVLEPINQALTLMTKNVKSLQSLGSGRRQRRFAGVVIAGAALGVATAAQITAGVALYQSNLNAQAIQSLRASLEQSNKAIDEVRQASQNIIIAVQGVQDYVNNEIVPALQHMSCELIGQRLGLKLLRYYTELLSVFGPSLRDPISAEISIQALSYALGGEIHKILEKLGYSGNDMVAILETKGIRAKITHVDLSGKFIVLSISYPTLSEVKGVVVHRLEAVSYNIGSQEWYTTVPRYVATNGYLISNFDESSCVFVSESAICSQNSLYPMSPILQQCLRGETASCARTLVSGTLGNKFILSKGNIIANCASILCKCHSTSKIINQSPDKLLTFIASDTCSLVEIDGVTIQVGSRQYPDVVYASKVILGPAISLERLDVGTNLGSALKKLDDAKVLIESSDQILDTVKNSYLSLGTLIALPVSIGLGLILLLLICCCKKRYQHLFSQSTKVAPVFKPDLTGTSKSYVRSL

SEQ ID NO: 237 - protein, 565 aa, Respirovirus Sendai virus
MTAYIQRSQCISTSLLVVLTTLVSCQIPRDRLSNIGVIVDEGKSLKIAGSHESRYIVLSLVPGVDLENGCGTAQVIQYKSLLNRLLIPLRDALDLQEALITVTNDTTQNAGVPQSRFFGAVIGTIALGVATSAQITAGIALAEAREAKRDIALIKESMTKTHKSVELLQNAVGEQILALKTLQDFVNDEIKPAISELGCETAALRLGIKLTQHYFGLLTAFGSNFGTIGEKSRTLQALSSLYSANITEIMTTIRTGQSNIYDVIYTEQIKGTVIDVDLERYMVTLSVKIPILSEVPGVLIHKASSISYNIDGEEWYVTVPSHILSRASFLGGADITDCVESRLTYICPRDPAQLIPDSQQKCILGDTTRCPVTKVVDSLIPKFAFVNGGVVANRIASTCTCGTGRRPISQDRSKGVAFLTHDNCGLIGVNGVELYANRRGHDATWGVQNLTVGPAIAIRPVDISLNLADATNFLQDSKAELEKARKILSEVGRWYNSRETVITIIVVMVVILVVIIVIVIVLYRLKRSMLMGNPDERIPRDTYTLEPKIRHMYTNGGFDAMAEKR

SEQ ID NO: 238 - protein, 540 aa, Respirovirus Bovine respirovirus 3
MIITNTIIIILIISPSFCQIDITKLQRVGVLVNNPKGMKISQNFETRYLILSLIPKIENSHSCGDQQINQYKKLLDRLIIPLYDGLKLQKDVIVVSHETNNNTNSRTKRFFGEIIGTIAIGIATSAQITAAVALVEAKQAKSDIEKLKEAIRDTNKAVQSIQSSVGNLIVAVKSVQDYVNNEIVPSITRLGCEAAGLKLGIALTQHYSELTNIFGDNIGTLKEKGIKLQGIASLYHTNITEIFTTSTVDQYDIYDLLFTESIKMRVIDVDLSDYSITLQVRLPLLTKISNTQIYKVDSISYNIQGKEWYIPLPNHIMTKGAFLGGADIKECIEAFSSYICPSDPGFTLNHEIENCLSGNITQCPKTIVTSDVVPRYAFVNGGLIANCITTTCTCNGVDNRINQSPDQGIKIITHKECQVIGINGMLFSTNREGTLATYTFDDIILNNSVALNPIDISMELNKAKLELEESKEWIKKSNQKLDSVGSWYQSSATITIIIVMIVVLFIINITIIVVIIRHHRIQGKNQNDKNSEPYVLTSRQ

SEQ ID NO: 239 - protein, 550 aa, Morbillivirus Measles virus; identical to SEQ ID NO: 222

SEQ ID NO: 240 - protein, 553 aa, Orthorubulavirus Human parainfluenza 2 virus
MGSRPSTKIPAPMMLTIRVALVLSCICPANSIDGRPLAAAGIVVTGDKAVNIYTSSQTGSIIVKLLPNLPKDKEACAKAPLDAYNRTLTTLLTPLGDSIRRIQESVTTSGGGRQGRLIGAIIGGVALGVATAAQITAAAALIQAKQNAANILRLKESIAATNEAVHEVTDGLSQLAVAVGKMQQFVNDQFNKTAQELDCIKIAQQVGVELNLYLTELTTVFGPQITSPALNKLTIQALYNLAGGNMDYLLTKLGIGNNQLSSLIGSGLITGNPILYDSQTQLLGIQVTLPSVGNLNNMRATYLETLSVSTTRGFASALVPKVVTQVGSVIEELDTSYCIETDLDLYCTRIVTFPMSPGIYSCLSGNTSACMYSKTEGALTTPYMTIKGSVIANCKMTTCRCVNPPGIISQNYGEAVSLIDKQSCNVLSLGGITLRLSGEFDVTYQKNISIQDSQVIITGNLDISTELGNVNNSISNALNKLEESNRKLDKVNVKLTSTSALITYIVLTIISLVFGILSLILACYLMYKQKAQQKTLLWLGNNTLDQMRATTKM

SEQ ID NO: 241 - protein, 553 aa, Orthoavulavirus Newcastle disease virus; identical to SEQ ID NO: 240

SEQ ID NO: 242 - protein, 534 aa, Morbillivirus Measles virus
MGLRVNVSAIFMAVLLTLQTPTGQIHWGNLSKIGVVGIGSASYKVMTRSSHQSLVIKLMPNTTLLNNCTRVEIAEYRRLLRTVLEPIRDALNAMTQNIRPVQIVASSRRHKRFAGVVLAGAALGVATAAQITAGIALHQSMLNSQAIDNLRASLETTNQAIEAIRQTGQEMILAVQGVQDYINNELIPSMNQLSCDLIGQKLGLKLLRYYTEILSLFGPSLRDPISAEISIQALSYVLGGDINKVLEKLGYSGGDLLGILESRGIKARITHVDTESYFIVLSIAYPTLSEIKGVIVHRLEGVSYNIGSQEWYTTVPKYVATQGYLISNFDESSCTFMPEGTVCSQNALYPMSPLLQECLRGSTKSCARTLVSGSFGNRFILSQGNLIANCASILCKCYTTGTIINQDPDKILTHIAADHCPVVEVNGVTIQVGSRRYPDAVYLHRIDLGPPISLERLDVGTSLGSAIAKLEDAKELLESSDQILRSMKGLSSTSIVYILIAVCLGGLIGIPALICCCRGRCNKRENKLVCQDQA

SEQ ID NO: 243 - protein, 529 aa, Morbillivirus Measles virus
MSIMGLKVNVSAIFMAVLLTLQTPTGQIHWGNLSKIGVVGIGSASYKVMTRSSHQSLVIKLMPNITLLNNCTRVEIAEYRRLLRTVLEPIRDALNAMTQNIRLVQSVASSRRHKRFAGVVLAGAALGVATAAQITAGIALHQSMLSSQAIDNLRASLETTNQAIEAIRQAGQEMILAVQGVQDYINNELIPSMNQLSCDLIGQKLGLKLLRYYTEILSLFGPSLRDPISAEISIQALSYALGGDINKVLEKLGYSGGDLLGILESRGIKARITHVDTESYFIVLSIAYPTLSEIKEVIVHRLEGVSYNIGSQEWYTTVPKYVATQGYLISNFDESSCTFMPEGTVCSQNALYPMSPLLQECLRGSTKSCARTLVSGSFGNRFILSQGNLIANCASILCKCYTTGTIIRQDPDKILTYIAADHCPVVEVNGVTIQVGSRRYPDAVDLHRIDLGPPISLERLDVGTNLGSAIAKLEDAKELLESSDQILRSMKGLSSTSIVYILIAVCLGGLIGIPALICCCRGRCNKKGE

SEQ ID NO: 244 - protein, 550 aa, Morbillivirus Measles virus
MGLKVNVSAIFMAVLLTLQTPTGQIHWGNLSKIGVVGIGSASYKVMTRSSHQSLVIKLMPNITLLNNCTRVEIAEYRRLLRTVLEPIRDALNAMTQNIRPVQSVASSRRHKRFAGVVLAGAALGVATAAQITAGIALHQSMLNSQAIDNLRASLETTNQAIEAIRQAGQEMILAVQGVQDYINNELIPSMNQLSCDLIGQKLGLKLLRYYTEILSLFGPSLRDPISAEISIQALSYALGGDINKVLEKLGYSGGDLLGILESRGIKARITHVDTESYLIVLSIAYPTLSEIKGVIVHRLEGVSYNIGSQEWYTTVPKYVATQGYLISNFDESSCTFMPEGTVCSQNALYPMSPLLQECLRGSTKSCARTLVSGSFGNRFILSQGNLIANCASILCKCYTTGTIINQDPDKILTYIAADHCPVVEVNGVTIQVGSRRYPDAVYLHRIDLGPPILLERLDVGTNLGNAIAKLEDAKELLESSDQILRSMKGLSSTCIVYILIAVCLGGLIGIPALICCCRGRCNKKGEQVGMSRPGLKPDLTGTSKSYVRSL

SEQ ID NO: 245 - protein, 538 aa, Metapneumovirus Turkey rhinotracheitis virus
MDVRICLLLFLISNPSSCIQETYNEESCSTVTRGYKSVLRTGWYTNVFNLEIGNVENITCNDGPSLIDTELVLTKNALRELKTVSADQVAKESRLSSPRRRRFVLGAIALGVATAAAVTAGVALAKTIRLEGEVKAIKNALRNTNEAVSTLGNGVRVLATAVNDLKEFISKKLTPAINQNKCNIADIKMAISFGQNNRRFLNVVRQFSDSAGITSAVSLDLMTDDELVRAINRMPTSSGQISLMLNNRAMVRRKGFGILIGVYDGTVVYMVQLPIFGVIETPCWRVVAAPLCRKEKGNYACILREDQGWYCTNAGSTAYYPNKDDCEVRDDYVFCDTAAGINVALEVEQCNYNISTSKYPCKVSTGRHPVSMVALTPLGGLVSCYESVSCSIGSNKVGIIKQLGKGCTHIPNNEADTITIDNTVYQLSKVVGEQRTIKGAPVVNNFNPILFPEDQFNVALDQVFESIDRSQDLIDKSNDLLGADAKSKAGIAIAIVVLVILGIFFLLAVIYYCSRVRKTKPKHDYPATTGHSSMAYVS

SEQ ID NO: 246 - protein, 551 aa, Orthorubulavirus Human parainfluenza 2 virus
MHHLHPMIVCIFVMYTGIVGSDAIAGDQLLNIGVIQSKIRSLMYYTDGGASFIVVKLLPNLPPSNGTCNITSLDAYNVTLFKLLTPLIENLSKISTVTDTKTRQKRFAGVVVGLAALGVATAAQITAAVAIVKANANAAAINNLASSIQSTNKAVSDVIDASRTIATAVQAIQDHINGAIVNGITSASCRAHDALIGSILNLYLTELTTIFHNQITNPALTPLSIQALRILLGSTLPIVIESKLNTNLNTAELLSSGLLTGQIISISPMYMQMLIQINVPTFIMQPGAKVIDLIAISANHKLQEVVVQVPNRILEYANELQNYPANDCVVTPNSVCCRYNEGSPIPESQYQCLRGNLNSCTFTPIIGNFLKRFAFANGVLYANCKSLLCRCADPPHVVSQDDTQGISIIDIKRCSEMMLDTFSFRITSTFNATYVTDFSMINANIVHLSPLDLSNQINSINKSLKSAEDWIADSNFFANQARTAKTLYSLSAIALILSVITLVVVGLLIAYIIKLVSQIHQFRSLAATTMFHRENPAFFSKNNHGNIYGIS

SEQ ID NO: 247 - protein, 546 aa, Henipavirus Hendra henipavirus; identical to SEQ ID NO: 214

SEQ ID NO: 248 - protein, 539 aa, Metapneumovirus Human metapneumovirus
MSWKVVIIFSLLITPQHGLKESYLEESCSTITEGYLSVLRTGWYTNVFTLEVGDVENLTCSDGPSLIKTELDLTKSALRELKTVSADQLAREEQIENPRQSRFVLGAIALGVATAAAVTAGVAIAKTIRLESEVTAIKNALKTTNEAVSTLGNGVRVLATAVRELKDFVSKNLTRAINKNKCDIDDLKMAVSFSQFNRRFLNVVRQFSDNAGITPAISLDLMTDAELARAVSNMPTSAGQIKLMLENRAMVRRKGFGILIGVYGSSVIYMVQLPIFGVIDTPCWIVKAAPSCSGKKGNYACLLREDQGWYCQNAGSTVYYPNEKDCETRGDHVFCDTAAGINVAEQSKECNINISTTNYPCKVSTGRHPISMVALSPLGALVACYKGVSCSIGSNRVGIIKQLNKGCSYITNQDADTVTIDNTVYQLSKVEGEQHVIKGRPVSSSFDPIKFPEDQFNVALDQVFENIENSQALVDQSNRILSSAEKGNTGFIIVIILIAVLGSSMILVSIFIIIKKTKKPTGAPPELSGVTNNGFIPHS

SEQ ID NO: 249 - protein, 574 aa, Orthopneumovirus Bovine respiratory syncytial virus
MAATAMRMIISIIFISTYMTHITLCQNITEEFYQSTCSAVSRGYLSALRTGWYTSVVTIELSKIQKNVCKSTDSKVKLIKQELERYNNAVIELQSLMQNEPASFSRAKRGIPELIHYTRNSTKRFYGLMGKKRKRRFLGFLLGIGSAIASGVAVSKVLHLEGEVNKIKNALLSTNKAVVSLSNGVSVLTSKVLDLKNYIDKELLPKVNNHDCRISNIETVIEFQQKNNRLLEIAREFSVNAGITTPLSTYMLTNSELLSLINDMPITNDQKKLMSSNVQIVRQQSYSIMSVVKEEVIAYVVQLPIYGVIDTPCWKLHTSPLCTTDNKEGSNICLTRTDRGWYCDNAGSVSFFPQAETCKVQSNRVFCDTMNSLTLPTDVNLCNTDIFNTKYDCKIMTSKTDISSSVITSIGAIVSCYGKTKCTASNKNRGIIKTFSNGCDYVSNKGVDTVSVGNTLYYVNKLEGKALYIKGEPIINYYDPLVFPSDEFDASIAQVNAKINQSLAFIRRSDELLHSVDVGKSTTNVVITTIIIVIVVVILMLIAVGLLFYCKTRSTPIMLGKDQLSGINNLSFSK

SEQ ID NO: 250 - protein, 565 aa, Respirovirus Sendai virus
MTAYIQRSQCISTSLLVVLTTLVSCQIPRDRLSNIGVIVDEGKSLKIAGSHESRYIVLSLVPGVDFENGCGTAQVIQYKSLLNRLLIPLRDALDLQEALITVTNDTTQNAGAPQSRFFGAVIGTIALGVATSAQITAGIALAEAREAKRDIALIKESMTKTHKSIELLQNAVGEQILALKTLQDFVNDEIKPAISELGCETAALRLGIKLTQHYSELLTAFGSNFGTIGEKSLTLQALSSLYSANITEIMTTIKTGQSNIYDVIYTEQIKGTVIDVDLERYMVTLSVKIPILSEVPGVLIHKASSISYNIDGEEWYVTVPSHILSRASFLGGADITDCVESRLTYICPRDPAQLIPDSQQKCILGDTTRCPVTKVVDSLIPKFAFVNGGVVANCIASTCTCGTGRRPISQDRSKGVVFLTHDNCGLIGVNGVELYANRRGHDATWGVQNLTVGPAIAIRPIDISLNLADATNFLQDSKAELEKARKILSEVGRWYNSRETVITIIVVMVVILVVIIVIIIVLYRLRRSMLMGNPDDRIPRDTYTLEPKIRHMYTNGGFDAMAEKR

SEQ ID NO: 251 - protein, 539 aa, Respirovirus Human parainfluenza 3 virus
MPTSILLIITTMIMASFCQIDITKLQHVGVLVNSPKGMKISQNFETRYLILSLIPKIEDSNSCGDQQIKQYKRLLDRLIIPLYDGLRLQKDVIVSNQESNENTDPRTKRFFGGVIGTIALGVATSAQITAAVALVEAKQARSDIEKLKEAIRDTNKAVQSVQSSIGNLIVAIKSVQDYVNKEIVPSIARLGCEAAGLQLGIALTQHYSELTNIFGDNIGSLQEKGIKLQGIASLYRTNITEIFTTSTVDKYDIYDLLFTESIKVRVIDVDLNDYSITLQVRLPLLTRLLNTQIYRVDSISYNIQNREWYIPLPSHIMTKGAFLGGADVKECIEAFSSYICPSDPGFVLNHEMESCLSGNISQCPRTVVKSDIVPRYAFVNGGVVANCITTTCTCNGIGNRINQPPDQGVKIITHKECNTIGINGMLFNTNKEGTLAFYTPNDITLNNSVALDPIDISIELNKAKSDLEESKEWIRRSNQKLDSIGNWHQSSTTIIIVLIMIIILFIINVTIIIIAVKYYRIQKRNRVDQNDKPYVLTNK

SEQ ID NO: 252 - protein, 538 aa, Orthorubulavirus Mumps Virus
MKAFPVICLGFAIFSSSICVNINILQQIGYIKQQVRQLSYYSQSSSSYVVVKLLPNIQPTDNSCEFKSVTQYNKTLSNLLLPIAENINNITSPSPGSRRHKRFAGIAIGIAALGVATAAQVTAAVSLVQAQTNARAIAAMKNSIQATNRAVFEVKEGTQQLAIAVQAIQDHINTIMNTQLNNMSCQILDNQLATSLGLYLTELTTVFQPQLINPALSPISIQALRSLLGSMTPAVVQATLSTSISAAEILSAGLMEGQIVSVLLDEMQMIVKINVPTIVTQSNALVIDFYSISSFINNQESIIQLPDRILEIGNEQWRYPAKNCKLTRHHIFCQYNEAERLSLETKLCLAGNISACVFSSIAGSYMRRFVALDGTIVANCRSLTCLCKSPSYPIYQPDHHAVTTIDLTSCQTLSLDGLDFSIVSLSNITYAENLTISLSQTINTQPIDISTELSKVNASLQNAVKYIKESNHQLQSVSVSSKIGAIIVAALVLSILSIIISLLFCFWAYIATKEIRRINFKTNHINTISSSVDDLIRY

SEQ ID NO: 253 - protein, 550 aa, Morbillivirus Measles virus; identical to SEQ ID NO: 222

SEQ ID NO: 254 - protein, 555 aa, Respirovirus Human parainfluenza 1
MQKSEILFLIYSSLLLSSSLCQIPVDKLSNVGVIINEGKLLKIAGSYESRYIVLSLVPSIDLEDGCGTTQIIQYKNLLNRLLIPLKDALDLQESLITITNDTTVTNDNPQSRFFGAVIGTIALGVATAAQITAGIALAEAREARKDIALIKDSIIKTHNSVELIQRGIGEQIIALKTLQDFVNNEIRPAIGELRCETTALKLGIKLTQHYSELATAFSSNLGTIGEKSLTLQALSSLYSANITEILSTIKKDKSDIYDIIYTEQVKGTVIDVDLEKYMVTLLVKIPILSEIPGVLIYRASSISYNIEGEEWHVAIPNYIINKASSLGGADVTNCIESRLAYICPRDPTQLIPDNQQKCILGDVSKCPVTKVINNLVPKFAFINGGVVANCIASTCTCGTNRIPVNQDRSRGVTFLTYTNCGLIGINGIELYANKRGRDTTWGNQIIKVGPAVSIRPVDISLNLASATNFLEESKIELMKAKAIISAVGGWHNTESTQIIIIIIVCILIIIICGILYYLYRVRRLLVMINSTHNSPVNTYTLESRMRNPYIGNNSN

SEQ ID NO: 255 - protein, 565 aa, Respirovirus Sendai virus
MATYIQRVQCISALLSVVLTTLVSCQIPRDRLSNIGVIVDEGKSLKIAGSHESRYIVLSLVPGVDLENGCGTAQVIQYKSLLNRLLIPLRDALDLQEALITVTNDTMTSADVPQSRFFGAVIGTIALGVATSAQITAGIALAEAREAKRDIALIKESMTKTHKSIELLQNAVGEQILALKTLQDFVNDEIKPAISELGCETAALRLGIKLTQHYSELLTAFGSNFGTIGEKSLTLQALSSLYSANITEIMTTIRTGQSNIYDVIYTEQIKGTVIDVDLERYMVTLSVKIPILSEVPGVLIHKASSISYNIDGEEWYVTVPSHILSRASFLGGANIADCVESRLTYICPRDPAQLIPDSQQKCILGDTTRCPVTKVVDNLIPKFAFVNGGVVANCIASTCTCGTGRRPISQDRSKGVVFLTHDNCGLIGVNGIELYANRKGHDATWGVQNLTVGPAIAIRPVDISLNLAAATDFLQDSRAELEKARKILSEVGRWYNSGATLITIIVVMIVVLVVIIVIVIVLYRLRRSMLMSNPAGRISRDTYTLEPKIRHMYTNGGFDAMTEKR

SEQ ID NO: 256 - protein, 538 aa, Orthorubulavirus Mumps Virus
MKAFSVTCLGFAVFSSSICVNINILQQIGYIKQQVRQLSYYSQSSSSYIVVKLLPNIQPTDNSCEFKSVTQYNKTLSNLLLPIAENINNIASPSPGSRRHKRFAGIAIGIAALGVATAAQVTAAVSLVQAQTNARAIAAMKNSIQATNRAIFEVKEGTQQLAIAVQAIQDHINTIMNTQLNNMSCQILDNQLATYLGLYLTELTTVFQPQLINPALSPISIQALRSLLGSMTPAVVQATLSTSISAAEILSAGLMEGQIVSVLLDEMQMIVKINIPTIVTQSNALVIDFYSISSFINNQESIIQLPDRILEIGNEQWSYPAKNCKLTRHHIFCQYNEAERLSLESKLCLAGNISACVFSPIAGSYMRRFVALDGTIVANCRSLTCLCKSPSYPIYQPDHHAVTTIDLTTCQTLSLDGLDFSIVSLSNITYAENLTISLSQTINTQPIDISTELSKVNASLQNAVKYIKESNHQLQSVSVNSKIGAIIVAALVLSILSIIISLLFCCWAYIATKEIRRINFKTNHINTISSSVDDLIRY

SEQ ID NO: 257 - protein, 508 aa, Novirhabdovirus Infectious hematopoietic necrosis virus
MDTTITTPLILILITCGANSQTVKPDTASESDQPTWSNPLFTYPEGCTLDKLSKVNASQLRCPRIFDDENRGLIAYPTSIRSLSVGNDLGDIHTQGNHIHKVLYRTICSTGFFGGQTIEKALVEMKLSTKEAGAYDTTTAAALYFPAPRCQWYTDNVQNDLIFYYTTQKSVLRDPYTRDFLDSDFIGGKCTKSPCQTHWSNVVWMGDAGIPACDSSQEIKGHLFVDKISNRVVKATSYGHHPWGLHQACMIEFCGKQWIRTDLGDLISVEYNSGAEILSFPKCEDKTVGMRGNLDDFAYLDDLVKASESREECLEAHAEIISTNSVTPYLLSKFRSPHPGINDVYAMHKGSIYHGMCMTVAVDEVSKDRTTYRAHRATSFTKWERPFGDEWEGFHGLHGNNTTIIPDLEKYVAQYKTSMMEPMSIKSVPHPSILALYNETDVSGISIRKLDSFDLQSLHWSFWPTISALGGIPFALLLAVAACCCWSGRPPTPSASQSIPMYHLANRS

SEQ ID NO: 258 - protein, 561 aa, Sigmavirus Drosophila melanogaster sigmavirus
MAHYELHVLFVHSWMLALILITTLVWLAASQKAFTPDLVFPEMNRNSSWSVANYGEILCPTSFQSYDPKKHQILTRVLVERPSLNTDTKVEGYTCHKVKYETICDMPWYFSPTISHSISPLRVKESECKDAIAEHQLGTHVPLSFPPEDCSWNSVNTKEYEDIIVKEHPVMLDPYTNNYVDAIFPGGISSPGMGGTIHDDMMWVSKDLAVSPECSGWQRSMGLIYSSRLYGEREPMLEVGSIHIEGHRDKNLTLACRISFCGEIGVRFHDGEWMKVSVNLDHPNSVTFQVTDFPPCPPGTTIQTAVVENINPEIQELTVNMMYRLKCQETISKMVSGLPTSALDLSYLIQVQEGPGIVYKREKGILYQSVGMYQYIDTVTLNKEENQLGENSRGQKVFWTEWSDSPTRPGLQEGINGIVKYEGQVRVPLGMSLRLEAATELMWGHPVHTVSHPILHVISNHTEQSVTTWNRGVNSTNLIGLATRSISGFYDNLKLYLILALIFVSLIALVVLDVIPFKYILFVLCPPLLLCRFIKCSRRKPETRDRYHVEYNRPGQVSSAF

SEQ ID NO: 259 - protein, 508 aa, Novirhabdovirus Hirame rhabdovirus
MDPRIMYYTVLLTTAARVYGQTIKPGVDSVSDQPTWANPLFTYPVDCPAAKLSKVSPSQLRCPRIFDDENRGLVAYPAVIRSLSVGNNLGDIHTQGEYVHKVLYRTTCSTGFFGGQTIEKALVEMKLAPREVGVYDTTTASALYFPAPRCQWYTDNVHNDLTFYYTTAKSVLRDPYTLGFLDSDFIEGKCSKSPCQTHWSNVVWKGDSGVAACDTGSEIKGHIFVDKTSHHVVKATSYGHHPWGLHRACMITFCGKPWIRTDLGDLIAIEYNGGATLLAFPACKDTTVGMRGSLDDFAYLDDLVKSSESREECLEAHAEIIATNSVTPYLLSKFRSPHPGINDVYAMHDGSIYHGKCMTVAIDEVSKDRRTYRAHQTSAFVAWGHPFGDEWGGFHGLHGNDTPVIPDLEKYVAQYKVSMMDKMDIRPVPHPSVQILYNDTDTADITIRKIDSFDLQSLNWSFWPSLSALGGVPILLALVFFLYCCMNRRPSMPAAPQEIPMYHLASRG

SEQ ID NO: 260 - protein, 632 aa, Nucleorhabdovirus Sonchus yellow net virus
MSHIMNLLVISFVLAGSSWSLLGYQDDFSSKRSGALASNPTYNLPQDKGYGRDMYQPYYICEPDNDGSALTLPSWHYSCKESCMGNHLKRVVNITGARWNYVGISIPVFKIVTNEVCYTSHENVWGYCSQYQISRPVATQKSDVSCITSSMWDNDKSPIGSLYNIVNSNEAECDYFSDITDCNRDYQIFKREGKLIKRSDDSPLELSIVTDGIRTDPASEYLSLDDVSWFWKLPNNDMSPPCGWEKTQKLSCSYTDTTDVIKCNSIGYTYNIQGISKKSTCAGNIYDTDGPFPFFYDAEEALMSTDDACGKAKQGKPDADIAFIEGVNRAFEDLELTYCSATCDLFARQGTPNEDHVLDTPIGTWRYVMRDNLDPALVPCLPTSNWTISDPTTICHGKDHILVVDTATGHSGSWDTKKDYIITGEVCNTNNDEMGDDYDGMRDKILRGETIEIKFWTGDIIRMAPPYDNPEWIKGSVLFRQNPGWFSSVELNKDMIHTRDNITDLLTVMVQNATAEVMYKRLDPKTMKHILFAEIVDGVGNVSGKISGFLTGLFGGFTKAVIIVASLAICYIVLSVLWKVRLVASIFNSAKKKRVRISDILDEEPHRIQQSRPTLSRKKKTRESIQMLLNDI

SEQ ID NO: 261 - protein, 524 aa, Lyssavirus European bat lyssavirus
MLLSTAIFAFFLNCAPCLAKFPIYTIPDKIGPWSPIDINHLSCPNNLIVEDEGCTTLTPFSYMELKVGYITTIKIEGFTCTGVITEAETYTNFVGYVTTTFKRKHFRPTVSACRDAYNWKITGDPRYEESLHNPYPDSHWLRTVKTTKESLLIISPSVVDMDAYDKNLYSKMFPNGKCLASPPSAICCPTNHDYTIWIPENPKPGLSCDIFTTSKGKKATKDGRLCGFVDERGLYKSLKGACKQRLCGVPGMRLMDGSWVSLQKTEAPEWCSPDQLVNVHDFHTDEIEHLVVEELVKKREECLDALETIITTKSISFRRLSHFRKLVPGFGKAYTLINKTLMEADAHYKSVREWKEVIPSKGCLMAGGRCHPHYSGIFFNGIILSPGGDVLIPEMQSALLQQHIELLESSMIPLRHPLADPSTVFKRDDEAEDFVEVHLPDTQKLISGIDLGFPEWKRYFLIGISVLALLALAIITAACCKRFKRRRRPKPNPIELIRKVSVTSQSGRAIPSWESYKVGATGES

SEQ ID NO: 262 - protein, 522 aa, Lagos bat virus glycoprotein (LBV)
MSQLNLIPFFCVIIVLSVEDFPLYTIPEKIGPWTPIDLIHLSCPNNLQSEDEGCGTSSVFSYVELKTGYLTHQKVSGFTCTGVVNEAVTYTNFVGYVTTTFKRKHFKPTALACRDAYHWKISGDPRYEESLHTPYPDNSWLRTVTTTKESLVIISPSIVEMDVYSRTLHSPMFPTGTCSRFYPSSPSCATNHDYTLWLPDDPNLSLACDIFVTSTGKKSMNGSRMCGFTDERGYYRTIKGACKLTLCGKPGLRLFDGTWISFPRPEVTTRCLPNQLVNIHNNRIDEVEHLIVEDLIRKREECLDTLETVLMSKSISFRRLSHFRKLVPGYGKAYTILNGSLMETNVHYLKVDNWSEILPSKGCLKINNQCVAHYKGVFFNGIIKGPDGHILIPEMQSSLLKQHMDLLKAAVFPLKHPLIEPGSLFNKDGDADEFVDVHMPDVHKLVSDVDLGLPDWSLYALIGATIIAFFILICLIRICCKKGGRRNSPTNRPDLPIGLSTTPQPKSKVISSWESYKGTSNV

SEQ ID NO: 263 - protein, 533 aa, Duvenhage virus glycoprotein (DUVV)
MPLNAVIFTLLLRCSICLGKFPFYTIPDKLGPWSPIDIHHLSCPNNLVVEDEGCTTLTPFSYMELKVGYITSIKVSGFTCTGVVTEAETYTNFVGYVTTTFRRRHFRPSVNSCRDAYNWKIAGDPRYEESLHNPYPDSHWLRTVKTTKESLLIISPSVADMDAYDKKLYSKIVSNGRCSEISPGSPFCPTNHEYTIWMPESSNPGISCDIFTRSMGKKATKDGQLCGFVDERGLYKSLKGACRLRLCGISGLRLMDGSWVSLPQVNNSEWCSPDQLVNIHDFHSDEIEHLVADELVKKREDCLDALETILFTKSISFRRLSHLRKLVPGFGKAYTIINRTLMEAEAHYKSVREWKEIIPSKGCLKAGGRCYPHHNGIFFNGIILGPGGEILIPEMQSALLQQHIELLESSVVPLKHPLADPSTVFKNDDEAESFVDVHLPDTNQKISGIDLGLPEWKRYFLIGVSAVALLALSIIIAVCCKRFRKRKKSKPGPVELTRKVSVISKGNGPVPSWESYKEGTTGDVRNTTPSTRE

SEQ ID NO: 264 - protein, 525 aa, Lyssavirus West Caucasian bat virus
MASYFALVLNGISMVFSQGLFPLYTIPDHLGPWTPIDLSHLHCPNNLYTDASYCTTEQSITYTELKVGSSVSQKIPGFTCTGVRTESVTYTNFVGYVTTTFKKKHFPPKSRDCREAYERKKAGDPRYEESLAHPYPDNSWLRTVTTTKDSWVIIEPSVVELDIYTSALYSPLFKDGTCSKSRTYSPYCPTNHDFTIWMPESENIRSACNLFSTSRGKLVRNRTSTCGIIDERGLFRSVKGACKISICGRQGIRLVDGTWMSFRYSEYLPVCSPSQLINTHDIKVDELENAIVLDLIRRREECLDTLETILMSGSVSHRRLSHFRKLVPGSGKAYSYINGTLMESDAHYIKVENWSEVIPHKGCLMVGGKCYEPVNDVYFNGIIRDSNNQILIPEMQSSLLREHVDLLKANIVPFRHPMLLRSFTSDTEEDIVEFVNPHLQDTQKLVSDMDLGLSDWKRYLLIGSLAVGGVVAILFIGTCCLRCRAGRNRRTIRSNHRSLSHDVVFHKDKDKVITSWESYKGQTAQ

SEQ ID NO: 265 - protein, 524 aa, Lyssavirus European bat lyssavirus
MPFQAVLSALLSALTLCVGKFPIYTIPDKLGPWSPIDIHHLSCPNNIVVEDEGCTTLTVFSYMELKVGYITTIKVNGFTCTGVVTEAETYTNFVGYVTTTFKRKHFRPSPSACRDAYSWKTAGDPRYEESLHNPYPDSHWLRTVTTTKESVLIISPSVADMDAYDKTLYSKIFLNGKCSGVSQVSPFCSTNHDYTIWMPENPNPGVSCDIFTTSKGKKATKDGKLCGFVDERGLYKSLKGACKLKLCGISGMRLMDGSWVSIQNHDEAKWCSPDQLVNIHDFHSDEVEHLIAEELVKKREECLDALESIMTTKSISFRRLSHLRKLVPGFGKAYTIINKTLMEADAHYKSIREWTDVIPSKGCLMAGGRCYPHHNGVFFNGIILSPDGHVLIPEMQSAMLQQHIELLESSVIPLMHPLADPSTIFKKDDGAEDFVEVHLPDVQKQISGIDLGLPEWKRYFLIGVSALAFLALMIFIAACCRRVKRKKRAKPNPVELIRKVSVTSQSGRPIPSWESYKVETGGQS

SEQ ID NO: 266 - protein, 524 aa, Lyssavirus Irkut lyssavirus
MSLLTAVIAFLFISTFCSGKFPIYTIPDKIGPWSPIDINHLSCPNNLEVEDEGCTTLTAFNYMELKVGYITSIKVDGFTCTGVVTEAETYTNFVGYVTTTFKRKHFRPNVSACRAAFSWKTAGDPRYEESLHNPYPDSHWLRTVTTTKESLLIISPSVVDMDAYDKTLYSKMFPNGKCFPPISDSPFCSTNHDYTLWLPEKEKLSMSCNIFVSSKGKKATKDGRLCGFVDERGLYKSLKGACKLKLCGMAGMRLMDGSWVSLQRADAPEWCPPGALVNVHDFHSDEIAHFVVEELIKKREECLDTLETILTTKSISFRRLSHFRKLVPGLGKAYTLINNTLMEAEAHYKSIREWKEIIPSKGCLKAGGRCHPHYDGIFFNGIILGPNGDVLIPEMQSSLLQQHIELLESSMIPLRHPLADSSAIFRSDNEAEDFVDVHLPDTQKQVSDIDLGFPEWKRYFLIGVSAIALFSLAIIIAVCCRKFKRRKRPKPGPIELVRKVSVTSQSGKVVPSWESYKEGATSQP

SEQ ID NO: 267 - protein, 531 aa, Tupavirus Tupaia tupavirus
MAPQTISLLWAMVCVSVYTRANRVVAPIHEPQNWKPATVDDFTCRTGFNLDFDSKFIKTKALVLKRVGQAKVKGYLCMKNRWTTTCETNWLYSKSVSHHITHVAVSAEECYNKIRDDASGNLKIESYPNPQCAWSSTVSREEDFIHISTSDVGYDMYTDTVLSPSFPGGTCKLKTCCKTIYPNIVWVPETPAQTQVRDALFDETMVTVTVEAKKVVKDSWVTGATITPSVMEGSCKKTLGSKSGILLPNGQWFSIVETGQITIQPKGSVEEKETWVNLINDLNLSDCAETQEAKVPTAEFTVYKTESMVFNILNYHLCLETVAKARSGKNLTRLDLARLAPEIPGVAHVYQLTSDGVRVGSTRYEIIAWKPTMGLDKTLGLTIVPSGNRNSETIKWIEWTRTDDGLLNGPNGIFIADGKEIVHPNLKMVSFELETYLISEHSTQLVPHPVIHSISDEIYPENYTIGGKNSYIKIHTPTAYFWSGIHWIEGAVQKLFIVVVATALIGLFILVVWLCCGCCSKSRPVRNQKWE

SEQ ID NO: 268 - protein, 524 aa, Lyssavirus Rabies virus; identical to SEQ ID NO: 153

SEQ ID NO: 269 - protein, 263 aa, Ovine respiratory syncytial virus
MSNHTHHFEFKTLKKAWKASKYFIVGLSCLYKLNLKSLVQMALSALAMITLVSLTITAIIYISTGNTKAKPMPTPTIQITQQFQNHTSLPPTEHNHNSTHSPTQGTTSPHTFAVDVTEGTRYYHLTLKTQGGKTKGPPTPHATRKPPISSQKSNPSEIQQDYSDFQILPYVPCNICEGDSACLSLCQDRSESILDKALTTTPKKTPKPMTTKKPTKTSTHHRTSLRNKLYIKTNMTTPPHGLISTAKHNKNQSTVQNPRHTLA

SEQ ID NO: 270 - protein, 297 aa, Orthopneumovirus Human respiratory syncytial virus
MSKTKDQRTAKTLERTWDTLNHLLFISSCLYKLNLKSIAQITLSILAMIISTSLIIAAIIFIASANHKVTLTTAIIQDATSQIKNTTQTYLTQNTQLGISFSNLSETTSQPTTTPALTTPSAKSTPQSTTVKTKNTTTTQIQPSKPTTKQRQKKPPNKPNNDFHFEVFNFVPCSICSNNPTCWAICKRIPNKKPGKKTTTKPTKKPTIKTTKKDLKPQTTKPKEVLTTKPTEKPTINTTRTNIRTTLLTTNTTGNPEYTSQKETLHSTSPEGNPSPSQVYTTSEYPSQPPSPSNTTN

SEQ ID NO: 271 - protein, 529 aa, Piry virus glycoprotein (PIRYV); identical to SEQ ID NO: 207

SEQ ID NO: 272 - protein, 298 aa, Orthopneumovirus Human respiratory syncytial virus
MSKTKDQRTAKTLEKTWDTLNHLLFISSCLYKLNLKSIAQITLSILAMIISTSLIIAAIIFIASANNKVTLTTAIIQDATSQIKNTTPTYLTQNPQLGISFFNLSGTTSQTTAILALTTPSVESILQSTTVKTKNTTTTQIQPSKPTTKQRQNKPPNKPNNDFHFEVFNFVPCSICSNNPTCWAICKRIPSKKPGKKTTTKPTKKPTIKTTKKDHKPQTTKPKEAPSTKPTEKPTINITKPNIRTTLLTNSTTGNLEHTSQEETLHSTSSEGNTSPSQVYTTSEYLSQPTSPSNITNQ

SEQ ID NO: 273 - protein, 524 aa, Lyssavirus Rabies virus; identical to SEQ ID NO: 133

SEQ ID NO: 274 - protein, 526 aa, Lyssavirus Australian bat lyssavirus
MLLQIVLLMSLMVFSPCPGKFPLYTIPDKLGPWSPIDIHHLSCPNNLIVEDEGCTSLSGFSYMELKVGFITTIKVSGFTCTGVVTESETYTNFFGYVTTTFKRKHFRPTPEFCRNAYNWKVAGDPRYEESLHNPYPDYHWLRTVTTTKESLLIISPSVVDMDPYDKSLHSKMFPKGTCSGASVPSIFCSTNHDYTLWMPENPKPGMSCDIFTTSKGKKASKGGKVCGFVDERGLYKSLKGACKLKLCGISGLRLMDGSWVSIQNHEEAKWCSPDQLVNIHDFHSDEIEHLIVEELVRKREECLDALESIMTTKSVSFRRLSHLRKLVPGFGKAYTIVNKTLMEADAHYKSVRTWNEIIPSKGCLKVRERCHPPYNGVFFNGIILSPDGHVLIPEMQSSLLQQHVELLESSVIPLIHPLADPSTVFKRDDEAEDFIEVHLPDVQKQVSGIDLGLSEWERYLIIGASAVVLFALAIIFAVCCRRCKRRKKARTDRIELDRKVSVTSQSGKVIPSWESYKIEAGGHFRS

SEQ ID NO: 275 - protein, 524 aa, Lyssavirus Rabies virus; identical to SEQ ID NO: 155

SEQ ID NO: 276 - protein, 526 aa, Lyssavirus Aravan lyssavirus
MPLQAIPLFSLILPVLVAGKFPIYTIPDKIGPWSPIDINHLSCPNNLVVEDEGCTTLTAFSYMELKVGYITTIKVSGFTCTGVVTEAETYTNFVGYVTTTFRRKHFRPTASACREAYNWKATGDPRYEESLHNPYPDSHWLRTVKTTKESLLIISPSVADMDAYDKALYSKIFPNGKCLGVSLSSPFCSTNHDYTLWMPENPKPGVSCDIFTTSKGKKATKDGKLCGFVDERGLYKSLKGACKLKLCGVMGLRLMDGSWVSLQKTEESEWCSPNQLINIHDFHSDEIEHMVVEELVKKREECLDALESIMTTKSISFRRLSHLRKLVPGFGKAYTLINKTLMEADAHYKSVREWTEVIPSKGCLKAGGGCYPHYNRVFFNGIILSPDGHVLIPEMQSALLQQHIELLESSVIPLRHPLADPSTVFKGDDEAEEFVEVHLPDTQKQISGIDLGLPEWKRYFLMGMSAIGFLALTIILAVCCRRIKRRKQSKPNPVELIRKVSVTSQSGRAIPSWESYKVKTGDQPQV

SEQ ID NO: 277 - protein, 526 aa, Sigma virus
MLALIFITTSVWLAASQKTFTPDLVFPEMNRNSSWSVANYGEILCPTSFQSYEPKKHQILTRVLVERPSLNTDTKVEGYTCHKVKYETICDMPWYFSPTISHSISPLRVKESECKDAIAEHQLGTHVSLSFPPEDCSWNSVNTKAYEDIIVKDHPVMLDPYTNNYVDAIFPGGISSPGMGGTIHDDMMWVSKDLAVSPECSGGNKVWGLFIHLGCMGGGSRCWKSAPPHRGPQGQEPHFSLPVSFYNKIGVRFHDGEWMKVSVNLDHPNSVTFQVTDFPPCPPGTTIQTAVVENINPEIQELTVNMMYRLKCQETISKMVSGLPTSVFDLSYLIQVQEGPSIVYKREKGVLYQSVGMYQYIDTVTLNTEENQLGENARGQKVFWTEWSDSPTRPDPQEGSNGFFKYEGQIRVPLGMSLRLEAATELMWGHPVHTVSHPILHVISNHTEQSVTTWNRGVNSTNLIGQATRSISGFYNDLKLYLILALIVVSIVALVVLDVIPFKYILFILCPPLLLCRFIKCSTKEA

SEQ ID NO: 278 - protein, 507 aa, NovirhabdovirusViral hemorrhagic septicemia virus
MEWNTFFLVILIIIIKSTTPQITQRPPVENISTYHADWDTPLYTHPSNCRDDSFVPIRPAQLRCPHEFEDINKGLVSVPTRIIHLPLSVTSVSAVASGHYLHRVTYRVTCSTSFFGGQTIEKTILEAKLSRQEATDEASKDHEYPFFPEPSCIWMKNNVHKDITHYYKTPKTVSVDLYSRKFLNPDFIEGVCTTSPCQTHWQGVYWVGATPKAHCPTSETLEGHLFTRTHDHRVVKAIVAGHHPWGLTMACTVTFCGTEWIKTDLGDLIQVTGPGGTRKLTPNKCVNTDIQMRGATDDFSYLNHLITNMAQRTECLDAHSDITASGKVSSFLLSKFRPSHPGPGKAHYLLDGQIMRGDCDYEAVVSINYNRAQYKTMNNTWKSWKRVDNNTDGYDGMIFGDKLIIPDIEKYQSVYDSGMLVQRNLVEVPHLSIVFVSNTSDLSTNHIHTNLIPSDWSFNWSLWPSLSGMGVVGGAFLLLVLCCCCKASPPIPNYGIPMQQFSRSQTV

SEQ ID NO: 279 - protein, 524 aa, Lyssavirus Rabies virus; identical to SEQ ID NO: 156

SEQ ID NO: 280 - protein, 257 aa, Orthopneumovirus Bovine respiratory syncytial virus
MSNHTHHLKFKTLKRAWKASKYFIVGLSCLYKFNLKSLVQTALTTLAMITLTSLVITALIYISVGNAKAKPTSKPTIQQTQRPQNHTSPLFTEHNYKSTHTSIQSTTLSQLLNIDTTRGTTYSHPTDETQNRKIKSQSTLPATRQPPINPSGSNPPENHQDHNNSQTLPYVPCSTCEGNLACSSLCQIGLERAPSRAPTITLKKAPKPKTTKKPTKTTIHHRTSPEAKLQPKNNTAAPQQGILSSPEHHTNQSTTQI

SEQ ID NO: 281 - protein, 662 aa, Tibrovirus Tibrogargan virus
MEAITIEIIIIILTISYPILVAPQLLYNYPFNCKKGPKMTLDGLTCPLDFNTFNLDSKDNMEAGTMCRPNPLSKDIEDGFLCYKDTWVTTCEETWYFSKTVKNHIIHEHITKDECFEALATYKLGKHVEPFFPAPSCYWSATNEERATFVNIQPHGVLLDPYSGKIKDPLIDSDNCDNDFCVTRSHQTHWLRNRKPDIMERCNNETWECHPIKIYYGWVSKKKNQETSTTFNYVQTGLVIESQYIGHVLMADLCIMTFCNRDGYLFPDGSWWEIKYSLYHAFTKDHTVLNNAHKCGDRTHGDHLTEFQRDKKVGYEDLEINLEGLEMRQKSRSINMMCLNRLAEIRNTHHINVLDMSYLTPKHPGRGLAYYFSQDQKNSSKYHVKVLDCDYKLIHIHDADIKGFVNITKYPEPNVTILGLKDNLTFADLGISRCQDLTPLNGSRNISCEESSGPLHSDDSRLSNGKRFWTRHSFQGANFHEHPGVRIGVNGITYDIRKQILRFPSTSNLLWDLPSYYSTKHRVHFFQHPTKHEIRKNFTGSDSRDIDVLDDLINRHINRTDFPTRIRNWIGNIEDKVEHFFSNVGGTIKTIISLVLFVIGTLISIKVWKKCKRHPQKTKKVAQLKLNDYEKTYNQRDTSNNNNDDLYETIENGGTVYSPFHV

SEQ ID NO: 282 - protein, 508 aa, Novirhabdovirus Infectious hematopoietic necrosis virus
MDTMITTPLILILITCGANSQTVKPDTASESDQPTWSNPLFTYPEGCTLDKLSKVNASQLRCPRIFDDENRGLIAYPTSIRSLSVGNDLGEIHTQGNHIHKVLYRTICSTGFFGGQTIEKALVEMKLSTKEAGAYDTTTAAALYFPAPRCQWYTDNVQNDLIFYYTTQKSVLRDPYTRDFLDSDFIGGKCTKSPCQTHWSNVVWMGDAGIPACDSSQEIKAHLFVDKISNRVVKATSYGHHPWGLHRACMIEFCGKQWIRTDLGDLISVEYNSGAEILSFPKCEDKTMGMRGNLDDFAYLDDLVKASESREECLEAHAEIISTNSVTPYLLSKFRSPHPGINDVYAMHKGSIYHGMCMTVAVDEVSKDRTTYRAHRATSFTKWERPFGDEWEGFHGLHGNNTTIIPDLEKYVAQYKTSMMEPMSIKSVPHPSILAFYNETDLSGISIRKLDSFDLQSLHWSFWPTISALGGIPLVLLLAVAACCCWSGRPPTPSAPQSIPMYHLANRS

SEQ ID NO: 283 - protein, 292 aa, Orthopneumovirus Human respiratory syncytial virus
MSKHKNQRTARTLEKTWDTLNHLIVISSCLYRLNLKSIAQIALSVLAMIISTSLIIAAIIFIISANHKVTLTTVTVQTIKNHTEKNISTYLTQVPPERVNSSKQPTTTSPIHTNSATISPNTKSETHHTTAQTKGRITTSTQTNKPSTKSRSKNPPKKPKDDYHFEVFNFVPCSICGNNQLCKSICKTIPSNKPKKKPTIKPTNKPTTKTTNKRDPKTPAKMPKKEIITNPAKKPTLKTTERDTSISQSTVLDTITPKYTIQQQSLHSTTSENTPSSTQIPTASEPSTLNPN

SEQ ID NO: 284 - protein, 660 aa, Ephemerovirus Adelaide River virus
MATFKVLVLMILWITSIFNVRCEKFVTIPVNCSGEVDIDKMDVMCPNRYNLLSTNHLMEGEEVETFCRPSLRENDLLDGYLCRKQKWEVTCTETWYFVTDVKYQIIEVIPTENECMEERERKLKGEYIPPYYPPTNCVWNAIDTQERTFITLIEHPVIEDPVTMTLMDSKFTKPCNPKHNEVTICDTYNPLIKWISKETSGLNLHCQIKSWECIPVKLHHSHRNMMEALYLESPDFGIVDASKICNLTFCGYNGILLDNGEWWSIYRSGFTHGFLDNHILKNRRIEECKEKKPGYKLAKLDTTYIDLEFEIELEHEKCLGTLEKLQNGEYVTPLDLSYLSPSNPGKHYAYRLEYINTTEHKCVQLGFTYEGGDCRKMLDERDDHGAYYNWTTIKLQRVIRAVCYYHTFSMNLDESKHKYYDQDNRSIQIDEKFISEVLKSTPLIDRHEKYEGNLSWNGIIIESKNGHEKNVIVPSASQYNHVMINKILKRLDTVMYDSYKFDSESGSISYNKIVPIVREDNLQNAHRVDVIQYIKDKGSYIINGFTGWFSSLGKLMRWTIWGVGLFFSIFTLYKIIMILRKHSNDNVRKEFKETAGKVMIGQPIDTKSMSRTSIKANNKGKFDKVKDLFTPRSKTISHLTTDTLKEHTDGTYEELHFFNV

SEQ ID NO: 285 - protein, 525 aa, Lyssavirus Australian bat lyssavirus
MLLQVILLVSLTAILPCTGQFPLYAIPDKLGPWSPIDIHHLSCPNNLIVEDEGCTSLSGFSYMELKVGFITTIKVSGFTCTGVVTESETYTNFFGYVTTTFKRKHFRPTPESCRKAYNWKIAGDPRYEESLHNPYPDYHWLRTVTTTKESLLIISPSVVDMDPYDKSLHSRMFPKGSCSGASIPSVFCSTNHDYTLWMPEDSNSGMSCDIFTMSKGKKASKGGKVCGFVDERGLYKSLKGACKLKLCGISGLRLLDGSWVSIQNHEEVKWCSPNQLVNIHDFNADEIEHLIVEELIKEREECLDALESIITTKSVSFRRLSHLRKLVPGFGKAYTIINKTLMEADAHYKSVRTWDEIIPSKGCLKVREKCHPPYNGVFFNGIILGPDGQVLIPEMQSSLLHQHTELLESSVIPLIHPLADPSTIFRGDDEAEGFIEVHLPDIQKQVSGIDLGLSEWERYLIIGISAIILFILAIIFTICCRRCKRRKKIRTDHIELDRKVSVTSQSGKSIPSWESYKSRQGHSRS

SEQ ID NO: 286 - protein, 623 aa, Ephemerovirus Bovine ephemeral fever virus
MFKVLIITLLVNKIHLEKIYNVPVNCGELHPVKAHEIKCPQRLNELSLQAHHNLAKDEHYNKICRPQLKDDAHLEGFICRKQRWITKCSETWYFSTSIEYQILEVIPEYSGCTDAVKKLDQGALIPPYYPPAGCFWNTEMNQEIEFYVLIQHKPFLNPYDNLIYDSRFLTPCTINDSKTKGCPLKDITGTWIPDVRVEEISEHCNNKHWECITVKSFRSELNDKERLWEAPDIGLVHVNKGCLSTFCGKNGIIFEDGEWWSIENQTESDFQNFKIEKCKGKKPGFRMHTDRTEFEELDIKAELEHERCLNTISKILNKENINTLDMSYLAPTRPGRDYAYLFEQTSWQEKLCLSLPDSGRVSKDCNIDWRTSTRGGMVKKNHYGIGSYKRAWCEYRPFVDKNEDGYIDIQELNGHNMSGNHAILETAPAGGSSGNRLNVTLNGMIFVEPTKLYLHTKSLYEGIEDYQKLIKFEVMEYDNVEENLIRYEEDEKFKPVNLNPHEKSQINRTDIVREIQKGGKKVLSAVVGWFTSTAKAVRWTIWAVGAIVTTYAIYKLYKMVKSNSSHSKHREADLEGLQSTTKENMRVEKNDKNYQDLELGLYEEIRSIKGGSKQTGDDRFFDH

SEQ ID NO: 287 - protein, 523 aa, Vesiculovirus Isfahan vesiculovirus; identical to SEQ ID NO: 200

SEQ ID NO: 288 - protein, 524 aa, Lyssavirus Rabies virus; identical to SEQ ID NO: 162

SEQ ID NO: 289 - protein, 512 aa, Novirhabdovirus Snakehead rhabdovirus
MTLPNMKPKRIVLFLVFLNAWVSNAQVTHKPRPDSIVEYSEEWENPIYTTPSHCFEDTFAPVKPEKLRCPHIFDDQNLGLTASKAKILHMDLKPEDTHFEAKGRLLHKVTYQVLCSTGFFGGRTVTRKVLETPMGDNEAQAYKAVDREFPYFPEPLCFWLRDNVAAERVFHFSTPKTVTVDLYSRKYISPDFVGGQCAKSPCPTHWPNVYWVGETQSPECPSIDTEGGHIFTKKDTHRITKAVVHGHHPWGLTKACQIQFCNEQWIRTDLGDLIRIEPNDGTSSLTLPKCQDNVVQMRGNLDDFSYLNHAIVNMAQRSECLEAHSSIVAQQKVSPYLLSKFRPPHPGLGKAHYLQNNTIMRGDCIYEGVAEISENRTTYRNLKGEWKKWSLSRGGEGYDGMTVGTKIVIPDLEKYQSIYDNGMFIPKLLGEVPHPSIVITYNQTDSIETGIFTDGKLLNMGVNWTLWPSLSGISLFTVASLILIWYCCCRVTPQALNYSIPMHTITSRGVEI

SEQ ID NO: 290 - protein, 508 aa, Novirhabdovirus Infectious hematopoietic necrosis virus
MDTMITTPLILILITCGANSQTVKPDTASESDQPTWSNPLFTYPEGCTLDKLSKVNASQLRCPRIFDDENRGLIAYPTSIRSLSVGNDLGDIHTQGNHIHKVLYRTICSTGFFGGQTIEKALVKMKLSTKEAGAYDTTTAAALYFPAPRCQWYTDNVQNDLIFYYTTQKSVLRDPYTRDFLDSDFIGGKCTKSPCQTHWSNVVWMGDAGIPACDSSQEIKAHLFVDKISNRVVKATSYGHHPWGLHQACMIEFCGQQWIRTDLGDLISVVYNSGSEILSFPKCEDKTVGMRGNLDDFAYLDDLVKASESREECLEAHAEIISTNSVTPYLLSKFRSPHPGINDVYAMHKGSIYHGMCMTVAVDEVSKDRTTYRAHRATSFTKWERPFGDEWEGFHGLHGNNTTIIPDLEKYVAQYKMSMMEPMSIKSVPHPSILALYNETDVSGISIRKLDSFDLQSLHWSFWPTISALGGIPFVLLLAVAACCCWSGRPPTPSVPQSIPMYHLANRS

SEQ ID NO: 291 - protein, 676 aa, Ebolavirus Zaire ebolavirus
MGVTGILQLPRDRFKRTSFFLWVIILFQRTFSIPLGVIHNSTLQVSDVDKLVCRDKLSSTNQLRSVGLNLEGNGVATDVPSATKRWGFRSGVPPKVVNYEAGEWAENCYNLEIKKPDGSECLPAAPDGIRGFPRCRYVHKVSGTGPCAGDFAFHKEGAFFLYDRLASTVIYRGTTFAEGVVAFLILPQAKKDFFSSHPLREPVNATEDPSSGYYSTTIRYQATGFGTNETEYLFEVDNLTYVQLESRFTPQFLLQLNETIYTSGKRSNTTGKLIWKVNPEIDTTIGEWAFWETKKNLTRKIRSEELSFTAVSNRAKNISGQSPARTSSDPGTNTTTEDHKIMASENSSAMVQVHSQGREAAVSHLTTLATISTSPQPPTTKPGPDNSTHNTPVYKLDISEATQVEQHHRRTDNDSTASDTPPATTAAGPLKAENTNTSKGTDLLDPATTTSPQNHSETAGNNNTHHQDTGEESASSGKLGLITNTIAGVAGLITGGRRARREAIVNAQPKCNPNLHYWTTQDEGAAIGLAWIPYFGPAAEGIYTEGLMHNQDGLICGLRQLANETTQALQLFLRATTELRTFSILNRKAIDFLLQRWGGTCHILGPDCCIEPHDWTKNITDKIDQIIHDFVDKTLPDQGDNDNWWTGWRQWIPAGIGVTGVIIAVIALFCICKFVF

SEQ ID NO: 292 - protein, 372 aa, Ebolavirus Sudan ebolavirus
MEGLSLLQLPRDKFRKSSFFVWVIILFQKAFSMPLGVVTNSTLEVTEIDQLVCKDHLASTDQLKSVGLNLEGSGVSTDIPSATKRWGFRSGVPPQVVSYEAGEWAENCYNLEIKKPDGSECLPPPPDGVRGFPRCRYVHKAQGTGPCPGDYAFHKDGAFFLYDRLASTVIYRGVNFAEGVIAFLILAKPKETFLQSPPIREAANYTENTSSYYATSYLEYEIENFGAQHSTTLFKINNNTFVLLDRPHTPQFLFQLNDTIQLHQQLSNTTGKLIWTLDANINADIGEWAFWENKKISPNNYVEKSCLSKLYRSTRQKTMMRHRRELQREESPTGPPGSIRTWFQRIPLGWFHCTYQKGKQHCRLRIRQKVEE

SEQ ID NO: 293 - protein, 365 aa, Ebolavirus Tai Forest ebolavirus
MGASGILQLPRERFRKTSFFVWVIILFHKVFSIPLGVVHNNTLQVSDIDKFVCRDKLSSTSQLKSVGLNLEGNGVATDVPTATKRWGFRAGVPPKVVNYEAGEWAENCYNLAIKKVDGSECLPEAPEGVRDFPRCRYVHKVSGTGPCPGGLAFHKEGAFFLYDRLASTIIYRGTTFAEGVIAFLILPKARKDFFQSPPLHEPANMTTDPSSYYHTTTINYVVDNFGTNTTEFLFQVDHLTYVQLEARFTPQFLVLLNETIYSDNRRSNTTGKLIWKINPTVDTSMGEWAFWENKKTSQKPFQVKSCLSYLYQKPRTRSLTRQRRSLLPSPPTTTQAKTTKNWFQRIPLQWFRCKTSRERTQCQPQ

SEQ ID NO: 294 - protein, 677 aa, Ebolavirus Reston ebolavirus
MGSGYQLLQLPRERFRKTSFLVWVIILFQRAISMPLGIVTNSTLKATEIDQLVCRDKLSSTSQLKSVGLNLEGNGIATDVPSATKRWGFRSGVPPKVVSYEAGEWAENCYNLEIKKSDGSECLPLPPDGVRGFPRCRYVHKVQGTGPCPGDLAFHKNGAFFLYDRLASTVIYRGTTFAEGVIAFLILSEPKKHFWKATPAHEPVNTTDDSTSYYMTLTLSYEMSNFGGEESNTLFKVDNHTYVQLDRPHTPQFLVQLNETLRRNNRLSNSTGRLTWTVDPKIEPDVGEWAFWETKKNFSQQLHGENLHFQILSTHTNNSSDQSPAGTVQGKISYHPPTNNSELVPTDSPPVVSVLTAGRTEEMSTQGLTNGETITGFTANPMTTTIAPSPTMTSEVDNNVPSEQPNNTASIEDSPPSASNETIDHSEMNSIQGSNNSAQSPQTKATPAPTASPMTLDPQETANISKPGTSPGSAAGPSQPGLTINTISKVADSLSPTRKQKRSVRQNTANKCNPDLHYWTAVDEGAAAGLAWIPYFGPAAEGIYIEGVMHNQNGLICGLRQLANETTQALQLFLRATTELRTYSLLNRKAIDFLLQRWGGTCRILGPSCCIEPHDWTKNITDEINQIKHDFIDNPLPDHGDDLNLWTGWRQWIPAGIGIIGVIIAIIALLCICKILC

SEQ ID NO: 295 - protein, 681 aa, Marburgvirus Lake Victoria marburgvirus
MKTTCLLISLILIQGVKTLPILEIASNIQPQNVDSVCSGTLQKTEDVHLMGFTLSGQKVADSPLEASKRWAFRAGVPPKNVEYTEGEEAKTCYNISVTDPSGKSLLLDPPTNIRDYPKCKTIHHIQGQNPHAQGIALHLWGAFFLYDRIASTTMYRGKVFTEGNIAAMIVNKTVHKMIFSRQGQGYRHMNLTSTNKYWTSSNGTQTNDTGCFGTLQEYNSTKNQTCAPSKKPLPLPTAHPEVKLTSTSTDATKLNTTDPNSDDEDLTTSGSGSGEQEPYTTSDAATKQGLSSTMPPTPSPQPSTPQQGGNNTNHSQGVVTEPGKTNTTAQPSMPPHNTTTISTNNTSKHNLSTPSVPIQNATNYNTQSTAPENEQTSAPSKTTLLPTENPTTAKSTNSTKSPTTTVPNTTNKYSTSPSPTPNSTAQHLVYFRRKRNILWREGDMFPFLDGLINAPIDFDPVPNTKTIFDESSSSGASAEEDQHASPNISLTLSYFPKVNENTAHSGENENDCDAELRIWSVQEDDLAAGLSWIPFFGPGIEGLYTAGLIKNQNNLVCRLRRLANQTAKSLELLLRVTTEERTFSLINRHAIDFLLARWGGTCKVLGPDCCIGIEDLSRNISEQIDQIKKDEQKEGTGWGLGGKWWTSDWGVLTNLGILLLLSIAVLIALSCICRIFTKYIG

SEQ ID NO: 296 - protein, 676 aa, Ebolavirus Zaire ebolavirus
MGVTGILQLPRDRFKRTSFFLWVIILFQRTFSIPLGVIHNSTLQVNDVDKLVCRDKLSSTNQLRSVGLNLEGNGVATDVPSATKRWGFRSGVPPKVVNYEAGEWAENCYNLEIKKPDGSECLPAAPDGIRGFPRCRYVHKVSGTGPCAGDFAFHKEGAFFLYDRLASTVIYRGTTFAEGVVAFLILPQAKKDFFSSHPLREPVNATEDPSSGYYSTTIRYQATGFGTNETEYLFEVDNLTYVQLESRFTPQFLLQLNETIYTSGKRSNTTGKLIWKVNPEIDTTIGEWAFWETKKNLTRKIRSEELSFTVVSNGAKNISGQSPARTSSDPGTNTTTEDHKIMASENSSAMVQVHSQGREAAVSHLTTLATISTSPQSLTTKPGPDNSTHNTPVYKLDISEATQVEQHHRRTDNDSTASDTPSATTAAGPPKAENTNTSKSTDFLDPATTTSPQNHSETAGNNNTHHQDTGEESASSGKLGLITNTIAGVAGLITGGRRTRREAIVNAQPKCNPNLHYWTTQDEGAAIGLAWIPYFGPAAEGIYTEGLMHNQNGLICGLRQLANETTQALQLFLRATTELRTFSILNRKAIDFLLQRWGGTCHILGPDCCIEPHDWTKNITDKIDQIIHDFVDKTLPDQGDNDNWWTGWRQWIPAGIGVTGVIIAVIALFCICKFVF

SEQ ID NO: 297 - protein, 677 aa, Ebolavirus Reston ebolavirus
MGSGYQLLQLPRERFRKTSFLVWVIILFQRAISMPLGIVTNSTLKATEIDQLVCRDKLSSTSQLKSVGLNLEGNGIATDVPSATKRWGFRSGVPPKVVSYEAGEWAENCYNLEIKKSDGSECLPLPPDGVRGFPRCRYVHKVQGTGPCPGDLAFHKNGAFFLYDRLASTVIYRGTTFAEGVVAFLILSEPKKHFWKATPAHEPVNTTDDSTSYYMTLTLSYEMSNFGGNESNTLFKVDNHTYVQLDRPHTPQFLVQLNETLRRNNRLSNSTGRLTWTLDPKIEPDVGEWAFWETKKNFSQQLHGENLHFQILSTHTNNSSDQSPAGTVQGKISYHPPANNSELVPTDSPPVVSVLTAGRTEEMSTQGLTNGETITGFTANPMTTTIAPSPTMTSEVDNNVPSEQPNNTASIEDSPPSASNETIYHSEMDPIQGSNNSAQSPQTKTTPAPTTSPMTQDPQETANSSKPGTSPGSAAGPSQPGLTINTVSKVADSLSPTRKQKRSVRQNTANKCNPDLYYWTAVDEGAAVGLAWIPYFGPAAEGIYIEGVMHNQNGLICGLRQLANETTQALQLFLRATTELRTYSLLNRKAIDFLLQRWGGTCRILGPSCCIEPHDWTKNITDEINQIKHDFIDNPLPDHGDDLNLWTGWRQWIPAGIGIIGVIIAIIALLCICKILC

SEQ ID NO: 298 - protein, 676 aa, Ebolavirus Tai Forest ebolavirus
MGASGILQLPRERFRKTSFFVWVIILFHKVFSIPLGVVHNNTLQVSDIDKFVCRDKLSSTSQLKSVGLNLEGNGVATDVPTATKRWGFRAGVPPKVVNYEAGEWAENCYNLAIKKVDGSECLPEAPEGVRDFPRCRYVHKVSGTGPCPGGLAFHKEGAFFLYDRLASTIIYRGTTFAEGVIAFLILPKARKDFFQSPPLHEPANMTTDPSSYYHTTTINYVVDNFGTNTTEFLFQVDHLTYVQLEARFTPQFLVLLNETIYSDNRRSNTTGKLIWKINPTVDTSMGEWAFWENKKNFTKTLSSEELSFVPVPETQNQVLDTTATVSPPISAHNHAGEDHKELVSEDSTPVVQMQNIKGKDTMPTTVTGVPTTTPSPFPINARNTDHTKSFIGLEGPQEDHSTTQPAKTTSQPTNSTESTTLNPTSEPSSRGTGPSSPTVPNTTESHAELGKTTPTTLPEQHTAASAIPRAVHPDELSGPGFLTNTIRGVTNLLTGSRRKRRDVTPNTQPKCNPNLHYWTALDEGAAIGLAWIPYFGPAAEGIYTEGIMENQNGLICGLRQLANETTQALQLFLRATTELRTFSILNRKAIDFLLQRWGGTCHILGPDCCIEPQDWTKNITDKIDQIIHDFVDNNLPNQNDGSNWWTGWKQWVPAGIGITGVIIAIIALLCICKFML

SEQ ID NO: 299 - protein, 681 aa, Marburgvirus Lake Victoria marburgvirus
MRTTCLFISLILIQGIKTLPILEIASNDQPQNVDSVCSGTLQKTEDVHLMGFTLSGQKVADSPLEASKRWAFRTGVPPKNVEYTEGEEAKTCYNISVTDPSGKSLLLDPPTNVRDYPKCKTIHHIQGQNPHAQGIALHLWGAFFLYDRIASTTMYRGKVFTEGNIAAMIVNKTVHKMIFSRQGQGYRHMNLTSTNKYWTSSNGTQTNDTGCFGTLHEYNSTKNQTCAPSKTPPPPPTARPEIKPTSTPTDATRLNTTNPNSDDEDLTTSGSGSGEQELYTTSDAVTKQGLSSTMPPTPSPQPGTPQQGGNNTNHSQDATTELDNTNTTAQPPTPSHNTTTISTNNTSKHNLSTLSAPPQNTTNPNTQSMATENEKTSAPPKATLPPTENPTTEKSTNNTKSPTTMEPNTTNGHFTSPSSTPNSTTQHLIYFRRKRSILWREGDMFPFLDGLINAPIDFDPVPNTKTIFDESSSSGASTEEDQHASSNISLTLSYLPHTSGNTAYSGENENDCDAELRIWSVQEDDLAAGLSWIPFFGPGIEGLYTAGLIKNQNNLVCRLRRLANQTAKSLELLLRVTTEERTFSLINRHAIDFLLTRWGGTCKVLGPDCCIGIEDLSRNISEQIDQIKKDEQKEGTGWGLGGKWWTSDWGVLTNLGILLLLSIAVLIALSCICRIFTKYIG

SEQ ID NO: 300 - protein, 364 aa, Ebolavirus Zaire ebolavirus
MGVTGILQLPRDRFKRTSFFLWVIILFQRTFSIPLGVIHNSTLQVSDVDKLVCRDKLSSTNQLRSVGLNLEGNGVATDVPSATKRWGFRSGVPPKVVNYEAGEWAENCYNLEIKKPDGSECLPAAPDGIRGFPRCRYVHKVSGTGPCAGDFAFHKEGAFFLYDRLASTVIYRGTTFAEGVVAFLILPQAKKDFFSSHPLREPVNATEDPSSGYYSTTIRYQATGFGTNETEYLFEVDNLTYVQLESRFTPQFLLQLNETIYTSGKRSNTTGKLIWKVNPEIDTTIGEWAFWETKKTSLEKFAVKSCLSQLYQTEPKTSVVRVRRELLPTQGPTQQLKTTKSWLQKIPLQWFKCTVKEGKLQCRI

SEQ ID NO: 301 - protein, 681 aa, Marburgvirus Lake Victoria marburgvirus
MKTTCLFISLILIQGIKTLPILEIASNNQPQNVDSVCSGTLQKTEDVHLMGFTLSGQKVADSPLEASKRWAFRTGVPPKNVEYTEGEEAKTCYNISVTDPSGKSLLLDPPTNIRDYPKCKTIHHIQGQNPHAQGIALHLWGAFFLYDRIASTTMYRGRVFTEGNIAAMIVNKTVHKMIFSRQGQGYRHMNLTSTNKYWTSNNGTQTNDTGCFGALQEYNSTKNQTCAPSKIPSPLPTARPEIKPTSTPTDATTLNTTDPNNDDEDLITSGSGSGEQEPYTTSDAVTKQGLSSTMPPTPSPQPSTPQQEGNNTDHSQGTVTEPNKTNTTAQPSMPPHNTTAISTNNTSKNNFSTLSVSLQNTTNYDTQSTATENEQTSAPSKTTLPPTGNLTTAKSTNNTKGPTTTAPNMTNGHLTSPSPTPNPTTQHLVYFRKKRSILWREGDMFPFLDGLINAPIDFDPVPNTKTIFDESSSSGASAEEDQHASPNISLTLSYFPNINENTAYSGENENDCDAELRIWSVQEDDLAAGLSWIPFFGPGIEGLYTAGLIKNQNNLVCRLRRLANQTAKSLELLLRVTTEERTFSLINRHAIDFLLTRWGGTCKVLGPDCCIGIEDLSRNISEQIDQIKKDEQKEGTGWGLGGKWWTSDWGVLTNLGILLLLSIAVLIALSCICRIFTKYIG

SEQ ID NO: 302 - protein, 676 aa, Ebolavirus Sudan ebolavirus
MEGLSLLQLPRDKFRKSSFFVWVIILFQKAFSMPLGVVTNSTLEVTEIDQLVCKDHLASTDQLKSVGLNLEGSGVSTDIPSATKRWGFRSGVPPQVVSYEAGEWAENCYNLEIKKPDGSECLPPPPDGVRGFPRCRYVHKAQGTGPCPGDYAFHKDGAFFLYDRLASTVIYRGVNFAEGVIAFLILAKPKETFLQSPPIREAANYTENTSSYYATSYLEYEIENFGAQHSTTLFKINNNTFVLLDRPHTPQFLFQLNDTIQLHQQLSNTTGKLIWTLDANINADIGEWAFWENKKNLSEQLRGEELSFETLSLNETEDDDATSSRTTKGRISDRATRKYSDLVPKDSPGMVSLHVPEGETTLPSQNSTEGRRVDVNTQETITETTATIIGTNGNNMQISTIGTGLSSSQILSSSPTMAPSPETQTSTTYTPKLPVMTTEESTTPPRNSPGSTTEAPTLTTPENITTAVKTVWPQESTSNGLITSTVTGILGSLGLRKRSRRQVNTRATGKCNPNLHYWTAQEQHNAAGIAWIPYFGPGAEGIYTEGLMHNQNALVCGLRQLANETTQALQLFLRATTELRTYTILNRKAIDFLLRRWGGTCRILGPDCCIEPHDWTKNITDKINQIIHDFIDNPLPNQDNDDNWWTGWRQWIPAGIGITGIIIAIIALLCVCKLLC

SEQ ID NO: 303 - protein, 367 aa, Ebolavirus Reston ebolavirus
MGSGYQLLQLPRERFRKTSFLVWVIILFQRAISMPLGIVTNSTLKATEIDQLVCRDKLSSTSQLKSVGLNLEGNGIATDVPSATKRWGFRSGVPPKVVSYEAGEWAENCYNLEIKKSDGSECLPLPPDGVRGFPRCRYVHKVQGTGPCPGDLAFHKNGAFFLYDRLASTVIYRGTTFAEGVVAFLILSEPKKHFWKATPAHEPVNTTDDSTSYYMTLTLSYEMSNFGGNESNTLFKVDNHTYVQLDRPHTPQFLVQLNETLRRNNRLSNSTGRLTWTLDPKIEPDVGEWAFWETKKTFPNNFMEKTCISKFYQPTPTTPQIRARRELSKEKLATTHPPTTPSWFQRIPLQWFQCSLQDGQRKCRPKV

SEQ ID NO: 304 - protein, 319 aa, Ebolavirus Sudan ebolavirus
MGGLSLLQLPRDKFRKSSFFVWVIILFQKAFSMPLGVVTNSTLEVTEIDQLVCKDHLASTDQLKSVGLNLEGSGVSTDIPSATKRWGFRSGVPPKVVSYEAGEWAENCYNLEIKKPDGSECLPPPPDGVRGFPRCRYVHKAQGTGPCPGDYAFHKDGAFFLYDRLASTVIYRGVNFAEGVIAFLILAKPKETFLQSPPIREAVNYTENTSSYYATSYLEYEIENFGAQHSTTLFKIDNNTFVRLDRPHTPQFLFQLNDTIHLHQQLSNTTGRLIWTLDANINADIGEWAFWENKKKSLRTTTWRRAVFRSFIAQRDRRR

SEQ ID NO: 305 - protein, 676 aa, Ebolavirus Zaire ebolavirus
MGVTGILQLPRDRFKRTSFFLWVIILFQRTFSIPLGVIHNSTLQVSDVDKLVCRDKLSSTNQLRSVGLNLEGNGVATDVPSATKRWGFRSGVPPKVVNYEAGEWAENCYNLEIKKPDGSECLPAAPDGIRGFPRCRYVHKVSGTGPCAGDFAFHKEGAFFLYDRLASTVIYRGTTFAEGVVAFLILPQAKKDFFSSHPLREPVNATEDPSSGYYSTTIRYQATGFGTNETEYLFEVDNLTYVQLESRFTPQFLLQLNETRYTSGKRSNTTGKLIWKVNPEIDTTIGEWAFWETKKNLTRKIRSEELSFTAVSNRAKNISGQSPARTSSDPGTNTTTEDHKIMASENSSAMVQVHSQGREAAVSHLTTLATISTSLRPPITKPGPDNSTHNTPVYKLDISEATQVEQHHRRTDNASTTSDTPPATTAAGPLKAENTNTSKGTDLLDPATTTSPQNHSETAGNNNTHHQDTGEESASSGKLGLITNTIAGVAGLITGGRRTRREAIVNAQPKCNPNLHYWTTQDEGAAIGLAWIPYFGPAAEGIYIEGLMHNQDGLICGLRQLANETTQALQLFLRATTELRTFSILNRKAIDFLLQRWGGTCHILGPDCCIEPHDWTKNITDKIDQIIHDFVDKTLPDQGDNDNWWTGWRQWIPAGIGVTGVIIAVIALFCICKFVF

SEQ ID NO: 306 - protein, 332 aa, Ebolavirus Reston ebolavirus
MGSGYQLLQLPRERFRKTSFLVWVIILFQRAISMPLGIVTNSTLKATEIDQLVCRDKLSSTSQLKSVGLNLEGNGIATDVPSATKRWGFRSGVPPKVVSYEAGEWAENCYNLEIKKSDGSECLPLPPDGVRGFPRCRYVHKVQGTGPCPGDLAFHKNGAFFLYDRLASTVIYRGTTFAEGVVAFLILSEPKKHFWKATPAHEPVNTTDDSTSYYMTLTLSYEMSNFGGNESNTLFKVDNHTYVQLDRPHTPQFLVQLNETLRRNNRLSNSTGRLTWTLDPKIEPDVGEWAFWETKKKLFPTTSWRKLAFPNSINPHQQLLRSEPGGNCPRKN

SEQ ID NO: 307 - protein, 568 aa, Orthorubulavirus Simian orthorubulavirus
MSGAEGNTNKRTFRAVFRTLIILITLTILALSAAILYEVTHTSNGSESNNQVFDPTDTLNAITGNIKSMIALLNQILYNAAIALPLKIDSTESVLLAAIKDLQFSNPASQNCSSGGNLLNDALYINGINQYLLSNSFAGTVGLGPLLNIPSFIPSATAPGGCTRIPSFSLTKTHWCYSHNVILAGCADSKASNQYLAMGIVEQSSADFPFFRTMRTLYLSDGINRKSCSIVAIPGGCALYCYVATKTEQEDYAATTPSELRLTFYYYNETLVERTLTIPNVTGNWATLNPAVGSGVYHLGYLAFPVYGGLIQNSAAWNSQFGSYFLPQNPAVQCSGSAEQQINTAKGSYVVNWFSGRLIQSAVLVCPLSDQLTDQCRVVLFNNSETMMGAEGRLYTIGGDLYYYQRSSSWWTASLLYKINTDFSQGLPPLIEAQWVPTYLVPRPGAQPCSAGNFCPANCITGVYADVWPMNNPFPAGSSGVNPNYLFGGAFLWADVARVNPTFYMASATQYKNTTGFPNSNQKAAYTSTTCFQNTGSKKIYCLFIIEMGSSLMGEFQIVPFLREVIIT

SEQ ID NO: 308 - protein, 616 aa, Orthoavulavirus Newcastle disease virus
MDRAVSQVALENDEREAKNTWRLVFRIAILLLTVVTLAISAAALAYSMEASTPSDLVGIPTAISRTEEKITSALGSNQDVVDRIYKQVALESPLALLNTESTIMNAITSLSYQINGAANSSGCGAPIHDPDYIGGIGKELIVDDASDVTSFYPSAFQEHLNFIPAPTTGSGCTRIPSFDMSATHYCYTHNVILSGCRDRSHSHQYLALGVLRTSATGRVFFSTLRSINLDDTQNRKSCSVSATPLGCDMLCSKVTETEEEDYNSAIPTSMVHGRLGFDGQYHEKDLDVTTLFEDWVANYPGVGGGSFIDNRVWFPVYGGLKPNSPSDTAQEGKYVIYKRYNDTCPDEQDYQIRMAKSSYKPGRFGGKRVQQAILSIKVSTSLGEDPVLTVPPNTVTLMGAEGRVLTVGTSHFFYQRGSSYFSPALLYPMTVSNKTATLHSPYTFNAFTRPGSVPCQASARCPNSCVTGVYTDPYPLVFYRNHTLRGVFGTMLDDEQARLNPVSAVFDSISRSRITRVSSSSTKAAYTTSTCFKVVKTNKTYCLSIAEISNTLFGEFRIVPLLVEILKDDGVREARSGRLSQLQEGWKDDIVSPIFCDAKNQTEYRRELESYAASWP

SEQ ID NO: 309 - protein, 645 aa, Gammaretrovirus Xenotropic MuLV-related virus
MESPAFSKPLKDKINPWGPLIIMGILVRAGASVQRDSPHQVFNVTWKITNLMTGQTANATSLLGTMTDTFPKLYFDLCDLVGDNWDDPEPDIGDGCRSPGGRKRTRLYDFYVCPGHTVLTGCGGPREGYCGKWGCETTGQAYWKPSSSWDLISLKRGNTPKGQGPCFDSSVGSGSIQGATPGGRCNPLVLEFTDAGKRASWDAPKTWGLRLYRSTGADPVTLFSLTRQVLNVGPRVPIGPNPVITEQLPPSQPVQIMLPRPPRPPPSGAASMVPGAPPPSQQPGTGDRLLNLVEGAYQALNLTSPDKTQECWLCLVSGPPYYEGVAVLGTYSNHTSAPANCSVTSQHKLTLSEVTGQGLCIGAVPKTHQALCNTTQKTSDGSYYLASPAGTIWACSTGLTPCLSTTVLNLTTDYCVLVELWPKVTYHSPNYVYGQFEKKTKYKREPVSLTLALLLGGLTMGGIAAGVGTGTTALVATKQFEQLQAAIHTDLGALEKSVSALEKSLTSLSEVVLQNRRGLDLLFLKEGGLCAALKEECCFYADHTGVVRDSMAKLRERLNQRQKLFESGQGWFEGLFNRSPWFTTLISTIMGPLIVLLLILLFGPCILNRLVQFVKDRISVVQALVLTQQYHQLKSIDPEEVESRE

SEQ ID NO: 310 - protein, 645 aa, Gammaretrovirus Xenotropic MuLV-related virus
MESPAFSKPLKDKINPWGPLIIMGILVRAGASVQRDSPHQVFNVTWKITNLMTGQTANATSLLGTMTDTFPKLYFDLCDLVGDNWDDPEPDIGDGCRSPGGRKRTRLYDFYVCPGHTVLTGCGGPREGYCGKWGCETTGQAYWKPSSSWDLISLKRGNTPKGQGPCFDSSVGSGSIQGATPGGRCNPLVLEFTDAGKRASWDAPKTWGLRLYRSTGADPVTLFSLTRQVLNVGPRVPIGPNPVITEQLPPSQPVQIMLPRTPRPPPSGAASMVPGAPPPSQQPGTGDRLLNLVEGAYLALNLTSPDKTQECWLCLVSGPPYYEGVAVLGTYSNHTSAPANCSVTSQHKLTLSEVTGQGLCIGAVPKTHQALCNTTQKTSDGSYYLASPAGTIWACSTGLTPCLSTTVLNLTTDYCVLVELWPKVTYHSPNYVYGQFEKKTKYKREPVSLTLALLLGGLTMGGIAAGVGTGTTALVATKQFEQLQAAIHTDLGALEKSVSALEKSLTSLSEVVLQNRRGLDLLFLKEGGLCAALKEECCFYADHTGVVRDSMAKLRERLNQRQKLFESGQGWFEGLFNRSPWFTTLISTIMGPLIVLLLILLFGPCILNRLVQFVKDRISVVQALVLTQQYHQLKSIDPEEVESRE

SEQ ID NO: 311 - protein, 885 aa, Lentivirus Simian immunodeficiency virus
MGCLGNQLLIALLLVSVLEICCVQYVTVFYGVPAWKNATIPLFCATKNRDTWGTTQCLPDNDDYSELAINVTEAFDAWDNTVTEQAIEDVWNLFETSIKPCVKLTPLCIAMRCNKTETDRWGLTGNAGTTTTAITTTATPSVAENVINESNPCIKNNSCAGLEQEPMIGCKFNMTGLNRDKKKEYNETWYSRDLICEQSANESESKCYMHHCNTSVIQESCDKHYWDAIRFRYCAPPGYALLRCNDSNYLGFAPNCSKVVVSSCTRMMETQTSTWFGFNGTRAENRTYIYWHGKSNRTIISLNKYYNLTMRCRRPENKTVLPVTIMSGLVFHSQPINERPKQAWCWFEGSWKKAIQEVKETLVKHPRYTGTNDTRKINLTAPAGGDPEVTFMWTNCRGEFLYCKMNWFLNWVEDRDQKGGRWKQQNRKEQQKKNYVPCHIRQIINTWHKVGKNVYLPPREGDLTCNSTVTSLIAEIDWINSNETNITMSAEVAELYRLELGDYKLIEITPIGLAPTSVRRYTTTGASRNKRGVFVLGFLGFLATAGSAMGAASVTLSAQSRTLLAGIVQQQQQLLDVVKRQQELLRLTVWGTKNLQTRVTAIEKYLKDQAQLNSWGCAFRQVCHTTVPWPNETLVPNWNNMTWQEWERQVDFLEANITQLLEEAQIQQEKNMYELQKLNSWDIFGNWFDLTSWIRYIQYGVLIVLGVIGLRIVIYVVQMLARLRQGYRPVFSSPPAYVQQIPIHKGQEPPTKEGEEGDGGDRGGSRSWPWQIEYIHFLIRQLIRLLTWLFSSCRDWLLRSYQILQPVLQSLSTTLQRVREVIRIEIAYLQYGWRYFQEAVQAWWKLARETLASAWGDIWETLGRVGRGILAIPRRIRQGLELTLL

SEQ ID NO: 312 - protein, 881 aa, Lentivirus Simian immunodeficiency virus
MGCLGNQLLIAILLLSVYGIYCTQYVTVFYGVPAWRNATIPLFCATKNRDTWGTTQCLPDNGDYSELALNVTESFDAWENTVTEQAIEDVWQLFETSIKPCVKLSPLCITMRCNKSETDRWGLTKSSTTITTAAPTSAPVSEKIDMVNETSSCIAQNNCTGLEQEQMISCKFTMTGLKRDKTKEYNETWYSTDLVCEQGNSTDNESRCYMNHCNTSVIQESCDKHYWDTIRFRYCAPPGYALLRCNDTNYSGFMPKCSKVVVSSCTRMMETQTSTWFGFNGTRAENRTYIYWHGRDNRTIISLNKYYNLTMKCRRPGNKTVLPVTIMSGLVFHSQPINDRPKQAWCWFGGKWKDAIKEVKQTIVKHPRYTGTNNTDKINLTAPGGGDPEVTFMWTNCRGEFLYCKMNWFLNWVEDRDVTTQRPKERHRRNYVPCHIRQIINTWHKVGKNVYLPPREGDLTCNSTVTSLIANIDWTDGNQTSITMSAEVAELYRLELGDYKLVEITPIGLAPTDVKRYTTGGTSRNKRGVFVLGFLGFLATAGSAMGAASLTLTAQSRTLLAGIVQQQQQLLDVVKRQQELLRLTVWGTKNLQTRVTAIEKYLKDQAQLNAWGCAFRQVCHTTVPWPNASLTPDWNNDTWQEWERKVDFLEENITALLEEAQIQQEKNMYELQKLNSWDVFGNWFDLASWIKYIQYGIYVVVGVILLRIVIYIVQMLAKLRQGYRPVFSSPPSYFQXTHTQQDPALPTREGKEGDGGEGGGNSSWPWQIEYIHFLIRQLIRLLTWLFSNCRTLLSRAYQILQPILQRLSATLRRVREVLRTELTYLQYGWSYFHEAVQAGWRSATETLAGAWRDLWETLRRGGRWILAIPRRIRQGLELTLL

SEQ ID NO: 313 - protein, 821 aa, Lentivirus Simian immunodeficiency virus
MSTGNVYQELIRRYLVVVKKLYEGKYEVSRSFSYTMFSLLVGIIGKQYVTVFYGVPVWKEAKTHLICATDNSSLWVTTNCIPSLPDYDEVEIPDIKENFTGLIRENQIVYQAWHAMGSMLDTILKPCVKINPYCVKMQCQETENVSATTAKPITTPTTTSTVASSTEIYLDVDKNNTEEKVERNHVCRYNITGLCRDSKEEIVTNFRGDDVKCENNTCYMNHCNESVNTEDCQKGLLIRCILGCVPPGYVMLRYNEKLNNNKLCSNISAVQCTQHLVATVSSFFGFNGTMHKEGELIPIDDKYRGPEEFHQRKFVYKVPGKYGLKIECHRKGNRSVVSTPSATGLLFYHGLEPGKNLKKGMCTFKGRWGLALWSLAKELNKLNDSIKVNQTCKNFTSTGEENKQNTDKQKEFAKCIKTLKIDNYTTSGDRAAEMMMMTCQGEMFFCNVTRIMRAWNDPNEKKWYPYASCQIRQIVDDWMQVGRKIYLPPTSGFNNHIRCTHRVTEMYFEMQKIDSNETKMQIKFLPPSETSNQFVAYGAHYKLVKIMPIGIAPTDVKRHTLPEHHKEKRGAVILGILGLLSLAGSAMGSVSVALTVQSQSLVTGIVEQQKQLLKLIEQQSELLKLTIWGVKNLQTRLTSLENYIKDQALLSQWGCSWAQVCHTSVEWTNTSITPNWTSETWKEWETRTDYLQQNITEMLKQAYDREQRNTYELQKLGDLTSWASWFDFTWWVQYLKWGVFLVLGIIGLRILLALWNTISRFRQGYRPVFSQDCQQNLYRKRPDNGEEESNSLELGEHNSENLKEESLNRSLIEDLTSFARE

SEQ ID NO: 314 - protein, 882 aa, Lentivirus Simian immunodeficiency virus
MGCLGNQLLIAILLLSVYGIYCIQYVTVFYGVPAWRNATIPLFCATKNRDTWGTTQCLPDNDDYSELALNVTESFDAWENTVTEQAIEDVWQLFETSIKPCVKLSPLCITMRCNKSETDKWGLTKSSTTTASTTTTTTAKSVETRDIVNETSPCVVHDNCTGLEQEPMISCKFNMTGLKRDKKKEYNETWYSADLVCEQGNSTGNESRCYMNHCNTSVIQECCDKDYWDAIRCRYCAPPGYALLRCNDTNYSGFMPNCSKVVVSSCTRMMETQTSTWFRFNGTRAENRTYIYWHGRDNRTIISLNKHYNLTMKCRRPGNKTVLPVTIMSALVFHSQPVNERPKQAWCRFGGNWKEAIKEVKQTIVKHPRYTGTNNTDKINLTAPRGGDPEVTFMWTNCRGEFLYCKMNWFLNWVEDRSLTTQKPKERHKRNYVPCHIRQIINTWHKVGKNVYLPPREGDLTCNSTVTSLIANINWTDGNQTSITMSAEVAELYRLELGDYKLVEITPIGLAPTNVKRYTTGGTSRNKRGVFVLGFLGFLATAGSAMGAASLTVTAQSRTLLAGIVQQQQQLLDVVKRQQELLRLTVWGTKNLQTRVSAIEKYLKDQAQLNAWGCAFRQVCHTTVPWPNASLTPDWNNETWQEWERKVDFLEANITALLEEAQIQQEKNMYELQKLNSWDVFGNWFDLTSWIKYIQYGIYIIVGVILLRIVIYIVQMLARLRQGYRPVFSSPPSYFQXTHTQQDPALPTKEGKKGDGGGSGGNSSWPWQIEYIHFLIRQLIRLLTWLFSNCRTLLSRAYQILQPIFQRLSATLRRIREVLRLELTYLQYGWSYFQEAVQAAQRSATETLAGAWGELWEALQRGGRWILAIPRRIRQGLELTLL

SEQ ID NO: 315 - protein, 880 aa, Lentivirus Simian immunodeficiency virus
MKAMETQRNCRTLSLKEIILCTLVLGIIGIIKCEDNMWVTVYYGVPVWREADTTLFCASDAKAQNPEVHNVWASQACVSTNPNPEEIELTNVTEYFNAWENNMVEQMHEDIVNLWDQSVKPCVKLIPLCVTLNCSLFKCIKENGNTTNCTVQISTGNDSTANNITVGTIDMYNCSFNATTELRDRKKQVYSLFYRQDLEPLEGNKPPEGDKNALYRLYNCNTTAMTQACSKVSLEPIPIHYCAPAGFALLKCNDKNFTGIGQCKNVSTVHCTHGIRPVVSTQFLLNGTLEEKVTVLDRNVSNDMDTIIVKLNETVRLNCTRTGNNTIKGIPIGPSQIFYGIETVIGDTRQAFCQLNKTVWTNTFKKVRHALNETYKGYLGNETITFGPSTGGDLEVTNLHLICGGEFFYCNTSILFNTSIIFNETKDDNITIPCRIRQIVRLWQRVGRGIFLPPIRGTINCISNITGILFAQQKTDRMNKSAMFTPVGGEMRNNWRSELYKYKVVRIEPLGVAPTKAKRRTVHREKRAAVGLGALFLGFLGAAGSTMGAASLTLTVQARQLLSGIVQQQSNLLRAIEAQQHLLQLSVWGIKQLQARVLAVERYLKDQQLLGLWGCSGKLICTTSVPWNTTWTNKSYDDIWYNMTWMQWDKEVSNYTDVIYNLLEKAQTQQENNEKELLELDKWASLWNWFDITSWLWYIKIFIIIVGGLIGLRIVFALLSIVNRVRQGYSPLSFQTLIPARRDRDRPEEIEEGGGEPDNVRSIRLVSGFLALAWNDLRDLCLFLYHRLRDLLLIVLRTLELVGQTLLKGLRRGREALIHLRGILQYWGQELKTSAISLLDTTAIAVAEGTDRIIEIAQRFGRGILNIPRRIRQGLERALL

SEQ ID NO: 316 - protein, 835 aa, Lentivirus Simian immunodeficiency virus
MKVTEMQKNWLICCLLIGLIKIIGSELWVTVYYGVPVWRDAETVLFCASDAKAHSTEAHNIWATQACVPTDPNPQEVLIPNVTERFDMWKNNMVDQMQEDIISLWEQSLKPCVKLTPLCVTLSCSSWRSVNNSVNQTNHVQMQNCSFNVTTELRDKKKQVYSLFYMGDIIPLDTNNSSGNNSQYRLINCNTTAVTQACPKISFEPIPIYYCAPPGFAIIKCNDQDFNGTGECNNVSTVQCTHGIKPVISTQLILNGSLATSNIVIRNNSKDTLLVQLNESIPINCTRPGNKTRGQVQIGPGMTFYNIENIIGDTRQAYCEVNRTWEQIWNTTKQIIINNRKNITFIPNPGGDLEVTNLMINCGGEFFYCNTSQLFTNQNGNTTGNITLQCRIRQIVNLWTRVGKGIYAPPIKGPINCLSNITGIILDYTKSGTEKYTIYPTGGDMTNLWRQELYKYKVVSIEPIGVAPGKAKRHTVTRQKRAAFGLGALFLGFLGAAGSTMGAASITLTVQARKLLSGIVQQQNNLLRAIEAQQHLLQLSVWGIKQLQARVLAIERYLRDQQILGLWGCSGKSVCYTNVPWNTTWSNNNSYDTIWGNMTWQNWDEQVRNYSGVIFGLLEQAQEQQSINEKSLLELDQWSSLWNWFDITKWLWYIKIFIMVVAGIVGIRIISIIMSMVARVRQGYSPLSLQTLIPTTRGPDRPERTEEDAGELDNGRSVRLVSGFLALAWEDFRNLLLFLYHRLTDCLSILRRTLELLRQNIHKGLQLLNELRIYLWGIIAYWGRELKISAINLLDTTAVAVAEGTDRIIELVQRIGRGILHIPRRIRQGLERALL

SEQ ID NO: 317 - protein, 855 aa, Lentivirus Feline immunodeficiency virus
MAEGFAVNRQWIGPEEAEELLDFDIATQMNEEGPLNPGINLFRVPGITETEKQEYCNILQPKLQDLRNEIQEVKLEEGNAGKFRRARFLRYSDETILSLIHLFIGYCTYLCKRNKLGTLVHNIDIEAPQEECYSNRERGTTVNIKYSRRCCIGTTALYLLLLTGIIIYTQTTQAQVVWRLPPLVVPVEESEIIFWDCWAPEEPACQDFLGAMIYLKASTNISIQEGPTLGNWAREIWGTLFKKATRQCRRGRIWRRWNETITGPSGCANNTCYNISVIVPDYQCYLDRVDTWLQGKVNISLCLTGGKMLYNKDTKQLSYCTDPLQIPLINYTFGPNQTCMWNTSQIQDSDIPKCGWWNQIAYYNSCRWEQTDVKFHCQRTQSQPGTWLRTISSWKQKNRWEWRPDFESEKVRVSLQCNTTKNLTFAMRSSGDYGEVTGAWIEFGCHRNKSKLHSDARFRIRCRWNVGDNTSLIDTCGNDPNVSGANPVDCTMYANRMYNCSLQNGFTMKVDDLIMHFNMTKAVEMYNIAGNWSCTSDLPSTWGYMNCNCTNSSSTDSNKMACPKRQGILRNWYNPVAGLRQSLEKYQVVKQPDYLVVPREVMEYKPRRKRAAIHVMLALATVLSMAGAGTGATAIGMVTQYHQVLATHQETIEKITEALKVNNLRLVTLEHQVLVIGLKVEAIEKFLYTAFAMQELGCNQNQFFCKVPPELWQRYNMTINQTIWNHGNITLGEWYNQTKDLQQKFYEIIMDMEQNNVQGRKGLQQLQEWEDWVGWLGNIPRYLKGLLGGILGIGLGVLLLILCLPTLVDCIRNCISKVLGYTVIAMPEVEEEEIQPPMELRRNGRQCDMSEKEEE

SEQ ID NO: 318 - protein, 854 aa, Lentivirus Feline immunodeficiency virus
MAEGFAANRQWIGPEEAEELLDFDKATQMNEEGPLNPGVNPFRVPAVTEADKQEYCKILQPRLQEIRNEIQEVKLEEGNAGKFRRARFLRYSDESILSLIHLFIGYCTYLVNRRRLGSLRHDINIEAPQEEQYSSREQGTTENIKYGRRCLIGTASLYLLLFIGVAIYLGTTNAQIVWRLPPLVVPVEESEIIFWDCWAPEEPACQDFLGAMIHLKASTNISIQEGPTLGNWAREIWGTLFKKATRHCRRNKIWKRWNETITGPVGCANNTCYNISVIIPDYQCYLDRVDTWLQGKVNISLCLTGGKMLYNRDTKQLSYCTDPLQIPLINYTFGPNQTCMWNTSQIQDPEIPKCGWWNQIAYYNSCRWESTNVKFYCQRTQSQPGTWIRTISSWRQKNRWEWRPDFESEKVKISLQCNSTHNLTFAMRSSGDYGEVMGAWIEFGCHRNKSRFHTEARFRIRCRWNVGDNTSLIDTCGKNLNVSGANPVDCTMYANKMYNCSLQNGFTMKVDDLIMHFNMTKAVEMYNIAGNWSCKSDLPQNWGYMNCNCTNGTSNDNKMACPEDKGILRNWYNPVAGLRQALEKYQVVKQPEYIVVPTEVMTYKYKQKRAAIHIMLALATVLSIAGAGTGATAIGMVTQYQQVLATHQEALDKITEALKINNLRLVTLEHQMLVIGLKVEAIEKFLYTAFAMQELGCNQNQFFCEIPKELWLRYNMTLNQTIWNHGNITLGEWYNQTKYLQQKFYEIIMDIEQNNVQGKQGLQKLQNWQDWMGWIGKIPQYLKGLLGGILGIGLGILLLILCLPTLVDCIRNCISKVLGYTVIAMPEIDDEEETVQMELRKNGRQCGMSEKEEE

SEQ ID NO: 319 - protein, 854 aa, Lentivirus Feline immunodeficiency virus
MAEGFAANRQWIGPEEAEELLDFDIAIQMNEEGPLNPGVNPFRVPGITEAEKQEYCNILQPKLQDLKGKIQEVKLEEGNAGKFRRARFLRYSDETVLSLIHLFIGYCPHLCRRHELGSLRHDIDIEALQEERYNDREKGITDNIKYGKRCLIGTAVLYLLLSLGIIIHTCKAQVVWRLPPLVVPVEESEIIFWDCWAPEEPACQDFLGAMIHLKASTNISIQEGPTLGNWAREIWGTLFKKATRQCRRGRIWRRWNETITGPLGCANNTCYNISVIVPDYQCYLDRVDTWLQGKVNISLCLTGGKMLYNKETKQLSYCTDPLQIPLINYTFGPNQTCMWNTSQIQDPEIPKCGWWNQNAYYNSCRWEHTDVQFQCQRTQSQPGSWIRAISSWKQRNRWEWRPDFESEKVKVSLQCNSTKNLTFAMRSSGDYGEVTGAWIEFGCHRTKSKYHTEARFRIRCRWNVGDNTSLIDTCGETQNVSRANPVDCTMYANRMYNCSLQNGFTMKVDDLIMHFNKTKAVEMYNIAGNWSCKSDLPPTWGYMNCNCTNSTNSGTGIRMACPRNQGILRNWYNPVAGLRQSLEKYQVVKQPDYLVVPGEVMEYKPRRKRAAIHVMLALATVLSMAGAGTGATAIGMVTQYQQVLATHQEAIEKVTEALKINNLRLVTLEHQVLVIGLKVEAMEKFLYTAFAMQELGCNQNQFFCKVPSALWERYNMTINQTIWNHGNITLGEWYNQTKDLQQRFYEIIMDIEQNNVQGKKGLQQLQEWEDWVGWIGNIPQYLKGLLGGILGIGLGMLLLILCLPTLVDCIRNCIHKILGYTVIAMPEVEEEEIQPQMELRRNGRQCGMSEKEEE

SEQ ID NO: 320 - protein, 856 aa, Lentivirus Feline immunodeficiency virus
MAEGFAANRQWIGPEEAEELLDFDIATQMSEEGPLNPGVNPFRVPGITEKEKQNYCNILQPKLQDLRNEIQEVKLEEGNAGKFRRARFLRYSDERVLSLVHAFIGYCIYLGNRNKLGSLRHDIDIEAPQEECYNNREKGTTDNIKYGRRCCLGTVTLYLILFTGVIVYSQTAGAQVVWRLPPLVVPVEESEIIFWDCWAPEEPACQDFLGAMIHLKAKTNISIREGPTLGNWAREIWATLFKKATRQCRRGRIWKRWNETITGPSGCANNTCYNVSVIVPDYQCYLDRVDTWLQGKINISLCLTGGKMLYNKVTKQLSYCTDPLQIPLINYTFGPNQTCMWNTSQIQDPEIPKCGWWNQMAYYNSCKWEEAKVKFHCQRTQSQPGSWFRAISSWKQRNRWEWRPDFKSKKVKISLPCNSTKNLTFAMRSSGDYGEVTGAWIEFGCHRNKSNLHTEARFRIRCRWNVGSDTSLIDTCGNTPNVSGANPVDCTMYSNKMYNCSLQNGFTMKVDDLIVHFNMTKAVEMYNIAGNWSCTSDLPSSWGYMNCNCTNSSSSYSGTKMACPSNRGILRNWYNPVAGLRQSLEQYQVVKQPDYLLVPEEVMEYKPRRKRAAIHVMLALATVLSIAGAGTGATAIGMVTQYHQVLATHQEAIEKVTGALKINNLRLVTLEHQVLVIGLKVEAMEKFLYTAFAMQELGCNQNQFFCKIPLELWTRYNMTINQTIWNHGNITLGEWYNQTKDLQQKFYEIIMDIEQNNVQGKTGIQQLQKWEDWVRWIGNIPQYLKGLLGGILGIGLGVLLLILCLPTLVDCIRNCIHKILGYTVIAMPEVEGEEIQPQMELRRNGRQCGMSEKEEE

SEQ ID NO: 321 - protein, 855 aa, Lentivirus Feline immunodeficiency virus
MAEGFAANRQWIGPEEAEELLDFDIATQMNEEGPLNPGINPFRVPGITETEKQDYCNMLQPKLQALRNEIQEVKLEEGNAGKFRRARFLRYSDETILSLIHLFIGYCTYLLNRKELGSLRHDIDIEAPQEECYSSREQSITDNIKYGKRCFIGTAGLYLLLFIGVGIYLGTAKAQVVWRLPPLVVPVEESEIIFWDCWAPEEPACQDFLGAMIHLKASTNISIQEGPTLGNWAKEIWGTLFKKATRQCRRGRIWKRWNETITGPLGCANNTCYNISVIVPDYQCYLDRVDTWLQGKVNVSLCLTGGKILYNKYTKQLSYCTDPLQIPLISYTFGPNQTCMWDTSQIQDPEIPKCGWWNQIAYYNSCRWESTDVKFHCQRTQSQPGLWLRAISSWKQRNRWEWRPDFESEKAKVSLQCNSTKNLTFAMRSSGDYGEVTGAWIEFGCHRNKSKLHTEARFRIRCRWNVGDNTSLIDTCGETQNVSGANPVDCTMYANRMYNCSLQNGFTMKVDDLIMHFNMTKAVEMYDIAGNWSCTSDLPPTWGYMNCNCTNSSSTNSVKMACPKNQGILRNWYNPVAGLRQSLEKYQVVKQPDYLVVPGEVMEYKPRRKRAAIHVMLALATVLSMAGAGTGATAIGMVTQYHQVLATHQETIEKVTEALKINNLRLVTLEHQVLVIGLKVEAMEKFLYTAFAMQELGCNQNQFFCKVPPELWKRYNMTINQTIWNHGNITLGEWYNQTKELQQKFYEIIMNIEQNNVQVKKGLQQLQEWEDWVGWIGNIPQYLKGLLGGILGIGIGVLLLILCLPTLVDCIRNCISKVLGYTVIAMPEIGDEEETVQMELRKNGRQCGMSEKEEE

SEQ ID NO: 322 - protein, 856 aa, Lentivirus Feline immunodeficiency virus
MAEGFVANGQWIGPEEAEELVDFEIATQMNEEGPLNPGINPFRVPGITKQEKQEYCSTMQPKLQALRNEIQEVKLEEGNAGKFRRARFLRYSDETILSLIYLFIGYFRYLVDRKRFGSLRHDIDIEAPQEECYNNKEKGMTENIKYGKRCLVGTAALYLILAIGIIIIIRTTDAQVVWRLPPLVVPVEESEIIFWDCWAPEEPACQDFLGAMIHLKASTNISNTEGPTLGNWAREIWATLFKKATRQCRRGRIWKRWNETITGPIGCANNTCYNISVIVPDYQCYIDRVDTWLQGKVNISLCLTGGKMLYNKETKQLSYCTDPLQIPLINYTFGPNQTCMWNISQIQDPEIPKCGWWNQQAYYNNCKWERTDVKFQCQRTQSQPGSWIRAISSWKQGNRWEWRPDFESERVKVSLQCNSTRNLTFAMRSSGDYGEITGAWIEFGCHRNKSIRHNAARFRIRCRWNEGDNNSLIDTCGETQNVSGANPVDCTMYANKMYNCSLQDGFTMKVDDLIMHFNMTKAVEMYNIAGNWSCMSDLPTEWGYMNCNCTNDTSNNNTRKMKCPKENGILRNWYNPVAGLRQSLEKYQVVKQPDYLLVPEEVMEYKPRRKRAAIHVMLALATVLSMAGAGTGATAIGMVTQYHQVLATQQEAIEKVTEALKITNLRLVTLEHQVLVIGLKVEAMEKFLYTAFAMQELGCNQNQFFCKVPPELWRRYNMTINQTIWNHGNITLGEWYNQTKDLQKKFYGIIMDIEQNNVQGKKGLQQLQKWEDWVGWIGNIPQYLKGLLGSIVGIGLGILLLILCLPTLVDCIRNCIHKILGYTVIAMPEVDGEEIQPQMELRRNGRQCGMSEKEEE

SEQ ID NO: 323 - protein, 575 aa, Alphavirus Mayaro virus
EGRAHGWPHEIIEYYYGLHPTTTIVVVVAVSVVVLLSVAASVYMCVVARNKCLTPYALTPGAVVPVTIGVLCCAPKAHAASFAEGMAYLWDNNQSMFWMELTGPLALLILTTCCARSLLSCCKGSFLVAVSVGSAVASAYEHTAVIPNQVGFPYKAHVAREGYSPLTLQMQVVETSLEPTLNLEYITCDYKTKVPSPYVKCCGTAECRTQDKPEYKCAVFTGVYPFMWGGAYCFCDSENTQMSEAYVERADVCKHDYAAAYRAHTASLRAKIKVTYGTVNQTVEAYVNGDHAVTLAGTKFIFGPVSTAWTPFDTKIVVYKGEVYNQDFPPYGAGQPGRFGDIQSRTLDSKDLYANTGLKLARPAAGNIHVPYTQTPSGFKTWQKDRDSPLNAKAPFGCTIQTNPVRAMNCAVGNIPVSMDIADSAFTRLTDAPIISELLCTVSTCTHSSDFGGVAVLSYKVEKAGRCDVHSHSNVAVLQEVSIEAEGRSVIHFSTASAAPSFIVSVCSSRATCTAKCEPPKDHVVTYPANHNGITLPDLSSTAMTWAQHLAGGVGLLIALAVLILVIVTCITLRR

SEQ ID NO: 324 - protein, 1239 aa, Alphavirus Barmah Forest virus
MDFIPTQTFYGRRWRPAPVQRYIPQPQPPAPPRRRRGPSQLQQLVAALGALALQPKQKQKRAQKKPKKTPPPKPKKTQKPKKPTQKKKSKPGKRMRNCMKIENDCIFPVMLDGKVNGYACLVGDKVMKPAHVKGTIDNPELAKLTFKKSSKYDLECAQVPVCMKSDASKFTHEKPEGHYNWHHGAVQFSNGRFTIPTGSGKPGDSGRPIFDNTGKVVAIVLGGANEGARTALSVVTWNKDMVTRITPEESVEWSAAALNITALCVLQNLSFPCDAPPCAPCCYEKDPAGTLRLLSDHYYHPKYYELLDSTMHCPQGRRPKRSVAHFEAYKATRPYIGWCADCGLAGSCPSPVSIEHVWSDADDGVLKIQVSMQIGIAKSNTINHAKIRYMGANGVQEAERSTLSVSTTAPCDILATMGHFILARCRPGSQVEVSLSTDPKLLCRTPFSHKPRFIGNEKSPAPTGHKTRIPCKTYSHQTDLTREEITMHVPPDVPIQGLVSNTGKSYSLDPKTKTIKYKCTCGETVKEGTATNKITLFNCDTAPKCITYAVDNTVWQYNSQYVPRSEVTEVKGKIHVPFPLTDSTCAVSVAPEPQVTYRLGEVEFHFHPMYPTLFSIRSLGKDPSHSQEWIDTPMSKTIQVGAEGVEYVWGNNNPVRLWAQKSSSSSAHGNPISIVSHYYDLYPYWTITVLASLGLLIVISSGFSCFLCSVARTKCLTPYQLAPGAQLPTFIALLCCAKSARADTLDDFSYLWTNNQAMFWLQLASPVAAFLCLSYCCRNLACCMKIFLGISGLCVIATQAYEHSTTMPNQVGIPFKALIERPGYAGLPLSLVVIKSELVPSLVQDYITCNYKTVVPSPYIKCCGGAECSHKNEADYKCSVFTGVYPFMWGGAYCFCDTENSQMSEVYVTRGESCEADHAIAYQVHTASLKAQVMISIGELNQTVDVFVNGDSPARIQQSKFILGPISSAWSPFDHKVIVYRDEVYNEDYAPYGSGQAGRFGDIQSRTVNSTDVYANTNLKLKRPASGNVHVPYTQTPSGFSYWKKEKGVPLNRNAPFGCIIKVNPVRAENCVYGNIPISMDIADAHFTRIDESPSVSLKACEVQSCTYSSDFGGVASISYTSNKVGKCAIHSHSNSATMKDSVQDVQESGALSLFFATSSVEPNFVVQVCNARITCHGKCEPPKDHIVPYAAKHNDAEFPSISTTAWQWLAHTTSGPLTILVVAIIVVVVVSIVVCARH

SEQ ID NO: 325 - protein, 675 aa, Alphavirus Aura virus
SRATAMCNVTCDRTCYNRNDTTMTNVNHSYDVDAARCTRRHVRSTTDDTTAYGCHRCKTMCYSKKVWDDADDGVRVSAGYNRAGTAASARRMGGGVGAADKVTSKCHSHKGYVVKCGDSTTSKVHGSDTCTMRVGYKVGRKYTMHGTCTYRTRKSAGYVTMHRGSTMMSGGVYVTSGRNVTYCKCGDKTGTVTARTKDGCTRKCASADHVKWVNSDRHTDHTAGKHACTVAHGVKHAYRSMSTHAHTTTRHGNTAWVGSVTRNSTGYTWGNKVRVYASAGNHGWHVRHYYHYYTVTVSGMGACAGVSCCCKARRDCTYANATVVTCCCRTSADTDTMGYWHSTMWVAAVTVRCCSCCVASNKADAYHTTVNANSYKAVRGYANVMVMNTSVKRYTCRYHTVVSKCCGTVCKGKADYTCKVTGVYWGGACCDSNSSDKYVSTDCATDHAAVRVHTASVKSRTYGNSTAVDVVNGVTARSKDMKAGSTTSDNKVYHGKVYNYDGAGTGAGDVASSTTGSDANTAHRARNHVYTASGWKNNSGSDTAGCKVNVNRADKCAVGSSVDDAATRVSSKCTVTSCTYSTDYGGVVTYSDRAGCAVHSHSSTAVRDSVYVKGTTKSTRSADVSMCGTRTTCHACTHVMNRKSTDSSASKTSWNWTAMGGSSAAAAVVAVTAHR

SEQ ID NO: 326 - protein, 252 aa, Alphavirus Bebaru virus
GAYCCDANSSAYVVRSMCKDHAVAYRAHTASKAKVRVSGSVNTVTVNGSKAKVSGSMGVSTAWTDNKVVYKDVNDYGSGGRGDSRTTTSKDYANTAKARSAGTHVYTTSGRYWKKGSANSKAGCKTGVRAMNCAVGNVSDDAVTRTDSATTCTVASCTHSSDGGVASAKTDKAGKCAVHSHSNVATVADVDVTTGKVAHSTASASSTVSCAARANCRASCKDHVYAAKHNNVVDVSGTAGWVKVAGGTGAVA

SEQ ID NO: 327 - protein, 712 aa, Alphavirus Middleburg virus
TAVTTACSNTDCSCACCYKDAGTRMDNVDNGYYDAASTHCDARRRRRGTDYKAYKTKYAYCSDCGNGCYSARVRAASDGMKSAGVDGAHSWTKRYMKGHDVDTDRNSVTTGCTVHGTMGHVATCGDSTVAVDKHKVRHACRAYKHRVVGRHTVRHHGVCTTYAMRTSVTTMHVAHDVDNTSKTGNKVKTKGKSRYNCTCGSKSGVTKDKDNCVSCHTMVTAHDKWNSYVRAGSGKKGKHVSNSTCRVANTAKNGTHVATTYRTGKHHTWSSCRTVGYTWGNHAVRWATTKGSAHGMHSYYYGYATTVAVCVGACVASASCCCVSARNKCTYATGAVVCTSCCARAKAATATAAYWANTVWMAVACMVTYCRHMCCRTASVAVSGMGATAYHSVTNAVGYRAHVDRGSTHMVVSTSTADYVTCYKTVVSKVTCCGMSCAHKADCKVYTGVYWGGAYCCDSNTSAYVRSVCKHDHAAAYRAHTAAKAKSVTYGSTNGTAAVNGSTARGDKMGSTAWSDKVVYKDVYNDYYGSGGRGDSRTTSNDVYANTAKARSAGTVHVYTTSGKYWKKGDANHKAGCKTNVRANCAVGNVSDDAATRVDASTGKCVATCTHSSDGGTVVYKTDKVGTCAVHSSNTAVMTSSVTMDGRGTHSTASASSVKVCSSKTTCTAKCVKDHVVANHNNVVDSSTAVSWTHTMGGATVVAGTVTCASRH

SEQ ID NO: 328 - protein, 271 aa, Alphavirus Mucambo virus
LVTTMCLLANVTFPCSTPPICYDRAPAETLMMLSKNIDNPGYDELLEAVLKCPGRQKRSTEELFKEYKLTRPYMAKCVRCAVGSCHSPIAIEAVRSDGHDGYIRIQTSSQYGLDPSGNVKSRVMRYNLYGKIVEVPLHQVSLHTSRPCHIIDGHGYFLLARCPEGDSITMEFKKDSVTHSCSVPYEVKFTPVGRELYSHPPEHGTEHPCRVYAHDAQQKDAYVEMHLPGSEVDSSLLSMSGSAVRVTPPSGQSVLVECNCGSAVSETINTA

SEQ ID NO: 329 - protein, 343 aa, Alphavirus Ndumu virus
GAYCFCSSENTQMSEAYVERAEVCKHEHALAYKTQTASLTATLKVTLGNITQGAKAYVNGETPFQIGQAKFVLGPISAAWSPFNPKIVVYKDDVYNYDFPAYGAGQPGRFGDIQSRTVDSKDLYARTHLRLDRPASGNIHVPYTQIPSEFKYWMQEKGEPLNRQAAFGCVVKTNPVRADNCAYGNIPISVDIPDAMFTRVVDIPAVSHLQCIDVSCAHSAGFGGVAKLRFMADRTGKCAIHTASKIVAIQEATVDLPEIAVGAGGGTAEITFHYSTALASPSFDVQLCSAHVTCDTKCEPPKDHIVPFAAQHMSNDMPNLSATAMNWVTGLGTSIGTFVFLFL

SEQ ID NO: 330 - protein, 987 aa, Alphavirus O'nyong-nyong virus
SLALPVMCLLANTTFPCSQPPCAPCCYEKKPEETLRMLEDNVMQPGYYQLLDSALACSQHRQRRNARENFNVYKVTRPYLAHCPDCGEGHSCHSPIALERIRSEATDGTLKIQVSLQIGIKTADSHDWTKLRYMDSHTPVDADRSGLFVRTSAPCTITGTMGHFILARCPKGETLTVGFVDSRRISHTCMHPFHHEPPLIGREKFHSRPQHGKELPCSTYVHTTAATTEEIEVHMPPDTPDYTLMTQQAGNVKITVDGQTVRYKCKCDGSNEGLITTDKVINNCKVDQCHTAVTNHKKWQYNSPLTPRNSEQGDRKGKIHIPFPLVNTTCRVPKARNPTVTYGKNRVTLLLYPDHPTLLSYRAMGRIPDYHEEWITSKKEISITVPAEGLEVTWGNNDPYKYWPQLSTNGTAHGHPHEIILYYYELYPTTTIAVLAAASIVVASLVGLSLGMCICARRRCITPYELTPGATIPFLLGILCCVKTAKAASYYEAATYLWNEQQPLFWLQLLIPLSAAIVVCNCLKLLPCCCKTLTFLAVMSIGARTVSAYEHATVIPNTVGVPYKTLVSRPGYSPMVLEMELQSVTLEPTLFLDYITCEYKTITPSPYVKCCGTAECKAKNLPDYNCKVFTGVYPFMWGGAYCFCDAENTQLSEAHVEKSESCKTEFASAYRAHTASVSAKLRVFYQGNNITVSAYANGDHAVTVKDAKFVIGPLSSAWSPFDNKIVVYKGEVYNMDYPPFGAGRPGQFGDIQSRTPDSKDVYANTQLILQRPAAGAIHVPYSQAPSGFKYWLKEKGASLQHTAPFGCQIATNPVRAVNCAVGNIPVSIDIPDAAFTRVTDAPSVTDMSCEVASCTHSSDFGGAAVIKYTASKKGKCAVHSLTNAVTIREPNVDVEGTAQLQIAFSTALASAEFKVQICSTQVHCSATCHPPKDHIVNYPSPHTTLGVQDISTTAMSWVQKITGGVGLVVAIAALILIIVLCVSFSRH

SEQ ID NO: 331 - protein, 265 aa, Alphavirus Pixuna virus
LVTTMCLLANVSFPCSQPPMCYDHKPAATLALLSANVDRPGYDDLLEAVLKCPGRARRSTDELFKEYKLTRPYMAKCIRCAVGSCHSPIAIEAVRSDGHDGYVRIQTSSQYGLDPSGSVKRRTMRYNMHGKIEEVPLHEVSLHTSRPCHIVDGHGYFLLARCPPGDSITMEFKKEHVTHLCSVPYEVRFTPVGRELYTHPPEHGAEHPCRVYAHDAQHHGAYVEMHLPGLEVDSTMLSLSGGAVQITPPTGKTAFVECKCGAQIS

SEQ ID NO: 332 - protein, 335 aa, Alphavirus Tonate virus
GAYCFCDSENTQLSRAYVTKSDDCSADHALAYKAHTASVQAFLNITVGEQSTTAVVYVNGETPISFNGIRLVAGPLSTAWTPFDRKVVQYAGEIYNYDFPEYGAGHAGAFGDLQARTTTSNDLYANTNLVLQRPTAGTIHVPYTQAPSGFEQWKKDKPPSLKYTAPFGCEIYVNPVRAENCAVGSIPLAFDIPDALFTRVSETPTLSNAECSLNECVYSSDFGGIATVKYTASKSGKCAVHIPSGTATLKESLVDVVEQGSLTLHFSTANIHPEFKLQICTTHLTCKGDCHPPKDHIVTHPQLHAQTFTAAVSKTAWTWLTSLLGGSAVIIIIGL

SEQ ID NO: 333 - protein, 335 aa, Alphavirus Trocara virus
GAQCFCESENTQMSEAYVDRSPDCKTLNAKAYRAHTANFKAKLNITFGDKYEVVEAFANGVTKVNAGQLTAVLGPMASPWSPFDNKIVLYKDKVYNYDFPEYGAGLPGAFGDIQMMSPTSADLYARTNLKLLRPNSGQIHVPYTQAPSGFVHWTNNSGKSLQDTAPFGCNIKTNPIRAENCAVGSIPVSLDIPDAEFTRVSEAPHITSASCTVTSCTSSTEAGGVMHIEYKAAKPGKCAVQALSSVVTITESNADIQTEGTLELHFSTAAIQADFRVXVCASGVQCTGPCRPPKEHIVAKPQLTTKEFKNAISSTSWNWVYALLGSTSSLLLVGV

SEQ ID NO: 334 - protein, 334 aa, Alphavirus Whataroa virus
GAQCFCDTENTQMSEAYVERSSDCAVDHAQALKVHTSSMKVGLKITYGNTTGMLDVFVNGVTPGTSKDLKVIAGPISAAFSPFDSKVVVYKGMVYNYDFPEFGAMKPGVFGDIQASSPTSNDLVANTDIRLLRPIARNVHVPYTQAASGFEMWKNNSGRPLQETAPFGCKVQTNPLRASDCAYGNIPISLDIPNAAFMRISDAPLISAATCTVSECIYSADYGGMASIQYTSDREGQCPVHSHSSTASLQESTVHVVQSGTVTVHFSTASPQANFVISLCGKKTICHAECKPPADHIVKTPHKNDQEFRSAVSTTSWSWLFALFGGASSLIFIG

SEQ ID NO: 335 - protein, 668 aa, Flavivirus Bussuquara virus glycoprotein
FKVVTGPEGPIMDVTKKDVGKALEIPFQNFNNTCWVMAMDVGHPCEDTIEYECPSLDIGAEPNDIDCWCDTMPMRVRYGRCTKGSIPKRSRRNAVFPQHTENVLATRQETWMNTDVIMKHLIKVETWALRNPGFALVAITLGWMLGSNRSQKIIFTILLLLVAPAYNMRCIGVENRDFVEGLSGGTWVDVVLEHGGCVTVRVEGKPTLDFELVQTKATGLAAVRAYCYQAKVSDIQISAACPAVQLTENSKATDSNYLCRRGVTNRGWNNGCGLFGKGDIHTCVKFKCEKKAAGFSIGKENLEYEVRASVHNSIGADKFSNELADGEPHTQKMKFSPLSPSAEKSFGDYGTLGMDCEPQSGLDFGQLYLMTIESKSWLVNRDWYHDLHLPYTVGSGSQWNNREALVEFQEPHATKQEVLALGSQEGALHSALAGAIMANRETSSPHALLLTAGHLKCRIKMDKMVIKGITYGQCSGTFKMEKHPADTGHGTVVLDVSYQGDDAPCKIPIVITSNLAEVEPVGRLVSAHPVITAKNVRTMLEVEPPYGDSYIVIGVGDGRLKQHWFKKGSVIGGAFSTTMKGAKRLAVLGDAAWDFGSVGGVFNSLGKAVHQLFGGIFRTLFGGMSWLSRLMIGALCLWIGINARDHSIAVTMLSVGGILIFLSINVSA

SEQ ID NO: 336 - protein, 271 aa, Flavivirus Jugra virus
FTSTGHMDVYEMDMTKVEYTIKTQVHSGAKSGDATLVKSIKFTPVSGTQTVEFSGYGTLGLECHVQSAIDFTTHYLVVIGSDAWLVHKQWVADVTLPWSHGDANVWRDKNYLVEFGEPHAATVKVLAMGPQEGALRTALAGAMVVSYDSGSKTFKLHGGHVTCKAMVNNLVLKGTTYQNCRGGLSFTKTPADTGHGTVVMQVKVTKNTPCRLTAIASDDASGRVNRGTLVTSNPVANSANDEVLIEINPPYGESYLIAGVGDDKLVYQWFQ

SEQ ID NO: 337 - protein, 100 aa, synthetic construct
MNNSQGRVTFEDVTVNFTQGEWQRLNPEQRNLYRDVMLENYSNLVSVGQGETTKPDVILRLEQGKEPWLEEEEVLGSGRAEKNGDIGGQIWKPKDVKESL

SEQ ID NO: 338 - protein, 72 aa, synthetic construct
MDAKSLTAWSRTLVTFKDVFVDFTREEWKLLDTAQQIVYRNVMLENYKNLVSLGYQLTKPDVILRLEKGEEP

SEQ ID NO: 339 - protein, 326 aa, synthetic construct
MDAKSLTAWSRTLVTFKDVFVDFTREEWKLLDTAQQIVYRNVMLENYKNLVSLGYQLTKPDVILRLEKGEEPWLVSGGGSGGSGSSPKKKRKVEASVQVKRVLEKSPGKLLVKMPFQASPGGKGEGGGATTSAQVMVIKRPGRKRKAEADPQAIPKKRGRKPGSVVAAAAAEAKKKAVKESSIRSVQETVLPIKKRKTRETVSIEVKEVVKPLLVSTLGEKSGKGLKTCKSPGRKSKESSPKGRSSSASSPPKKEHHHHHHHAESPKAPMPLLPPPPPPEPQSSEDPISPPEPQDLSSSICKEEKMPRAGSLESDGCPKEPAKTQP

SEQ ID NO: 340 - protein, 80 aa, synthetic construct
KMKKFQIPVSFQDLTVNFTQEEWQQLDPAQRLLYRDVMLENYSNLVSVGYHVSKPDVIFKLEQGEEPWIVEEFSNQNYPD

SEQ ID NO: 341 - DNA, 20 bp, synthetic construct
  source 1..20: mol_type = other DNA
ggccgagatgtctcgctccg

SEQ ID NO: 342 - DNA, 20 bp, synthetic construct
  source 1..20: mol_type = other DNA
cgcgagcacagctaaggcca

SEQ ID NO: 343 - DNA, 20 bp, synthetic construct
  source 1..20: mol_type = other DNA
cgagacgtaattacgtctcg

SEQ ID NO: 344 - DNA, 20 bp, synthetic construct
  source 1..20: mol_type = other DNA
actgggaggctcagcccatg

SEQ ID NO: 345 - DNA, 20 bp, synthetic construct
  source 1..20: mol_type = other DNA
tgttctgtcttgaactagct

SEQ ID NO: 346 - DNA, 20 bp, synthetic construct
  source 1..20: mol_type = other DNA
tgagtgtcttgtcttgctca

SEQ ID NO: 347 - DNA, 20 bp, synthetic construct
  source 1..20: mol_type = other DNA
cgtaacctacggtgtcccgc

SEQ ID NO: 348 - DNA, 20 bp, synthetic construct
  source 1..20: mol_type = other DNA
tagcgggacaccgtaggtta

SEQ ID NO: 349 - DNA, 20 bp, synthetic construct
  source 1..20: mol_type = other DNA
cttttgggggcggggtctag

SEQ ID NO: 350 - DNA, 20 bp, synthetic construct
  source 1..20: mol_type = other DNA
cgctgcggtctgtgggcgtg

SEQ ID NO: 351 - DNA, 20 bp, synthetic construct
  source 1..20: mol_type = other DNA
gtgtgccatggacgggtaag

SEQ ID NO: 352 - DNA, 20 bp, synthetic construct
  source 1..20: mol_type = other DNA
cagcggggatccgacgagct

SEQ ID NO: 353 - DNA, 20 bp, synthetic construct
  source 1..20: mol_type = other DNA
ccacgtgtgtcagcaacggc

SEQ ID NO: 354 - DNA, 20 bp, synthetic construct
  source 1..20: mol_type = other DNA
acagcatcgtcccagacata

SEQ ID NO: 355 - protein, 81 aa, Homo sapiens
GPLEHLCCDLEEEPQSLQEKAQSAPWVPAIPQEGNTGDWEMAAALLAAGSQGLVTIKDVSLCFSQEEWRSLDPSQTDFYGE

SEQ ID NO: 356 - protein, 81 aa, Homo sapiens
MLENYGHLVSLGLSISKPDVVSLLEQGKEPWLGKREVKRDLFSVSESSGEIKDFSPKNVIYDDSSQYLIMERILSQGPVYS

SEQ ID NO: 357 - protein, 81 aa, Homo sapiens
MDVFVDFTWEEWQLLDPAQKCLYRSVMLENYSNLVSLGYQHTKPDIIFKLEQGEELCMVQAQVPNQTCPNTVWKIDDLMDW

SEQ ID NO: 358 - protein, 81 aa, Homo sapiens
MLENYRNLVSLGLVVSKPDLITFLEQRKEPWNVKSEETVAIQPDVFSHYNKDLLTEHCTEASFQKVISRRHGSCDLENLHL

SEQ ID NO: 359 - protein, 81 aa, Homo sapiens
MGLLTFRDVAIEFSREEWEHLDSDQKLLYGDVMLENYGNLVSLGLAVSKPDLITFLEQRKEPWNVKSAETVAIQPDIFSHD

SEQ ID NO: 360 - protein, 81 aa, Homo sapiens
MDTVVFEDVVVDFTLEEWALLNPAQRKLYRDVMLETFKHLASVDNEAQLKASGSISQQDTSGEKLSLKQKIEKFTRKNIWA

SEQ ID NO: 361 - protein, 81 aa, Homo sapiens
MDSVVFEDVAVDFTLEEWALLDSAQRDLYRDVMLETFRNLASVDDGTQFKANGSVSLQDMYGQEKSKEQTIPNFTGNNSCA

SEQ ID NO: 362 - protein, 80 aa, Homo sapiens
MDSVVFEDVAVNFTQEEWALLGPSQKKLYRDVMQETFVNLASIGENWEEKNIEDHKNQGRKLRDGVLPCCPDWSQTPELK

SEQ ID NO: 363 - protein, 81 aa, Homo sapiens
MDSVVFEDVAVNFTQEEWALLGPSQKKLYRDVMQETFVNLASIGENWEEKNIEDHKNQGRKLRSHMVERLCERKEGSQFGE

SEQ ID NO: 364 - protein, 81 aa, Homo sapiens
MGPLQFRDVAIEFSLEEWHCLDTAQRNLYRDVMLENYRNLVFLGIVVSKPDLVTCLEQGKKPLTMERHEMIAKPPVMSSHF

SEQ ID NO: 365 - protein, 81 aa, Homo sapiens
MGPLQFRDVAIEFSLEEWHCLDTAQRNLYRNVMLENYSNLVFLGIVVSKPDLIAHLEQGKKPLTMKRHEMVANPSVICSHF

SEQ ID NO: 366 - protein, 81 aa, Homo sapiens
MGPLTFTDVAIEFSLEEWQCLDTAQQNLYRNVMLENYRNLVFLGIAVSKPDLITCLEKEKEPCKMKRHEMVDEPPVVCSHF

SEQ ID NO: 367 - protein, 81 aa, Homo sapiens
MGPLTIRDVTVEFSLEEWHCLDTAQQNLYRDVMLENYRNLVFLGIAVSKPDLITCLEQGKEPCNMKRHEMVAKPPVMCSHI

SEQ ID NO: 368 - protein, 81 aa, Homo sapiens
MGPLTFMDVAIEFSVEEWQCLDTAQQNLYRNVMLENYRNLVFLGIAVSKPDLITCLEQGKEPWNMERHEMVAKPPGMCCYF

SEQ ID NO: 369 - protein, 81 aa, Homo sapiens
MGLLTFRDVAIEFSLEEWQCLDTAQRNLYKNVILENYRNLVFLGIAVSKQDLITCLEQEKEPLTVKRHEMVNEPPVMCSHF

SEQ ID NO: 370 - protein, 81 aa, Homo sapiens
MEPLKFRDVAIEFSLEEWQCLDTIQQNLYRNVMLENYRNLVFLGIVVSKPDLITCLEQEKEPWTRKRHRMVAEPPVICSHF

SEQ ID NO: 371 - protein, 81 aa, Homo sapiens
MGLLTFRDVAIEFSLEEWQCLDTAQKNLYRNVMLENYRNLAFLGIAVSKPDLIICLEKEKEPWNMKRDEMVDEPPGICPHF

SEQ ID NO: 372 - protein, 81 aa, Homo sapiens
MLENYRNLAFLGIAVSKPDLITCLEQGKEPWNMKRHEMVDEPPGMCPHFAQDLWPEQGMEDSFQKAILRRYGKYGHENLQL

SEQ ID NO: 373 - protein, 81 aa, Homo sapiens
MSQVTFSDVAIDFSHEEWACLDSAQRDLYKDVMVQNYENLVSVAGLSVTKPYVIMLLEDGKEPWMMEKKLSKDWESRWENK

SEQ ID NO: 374 - protein, 81 aa, Homo sapiens
MSQVTFSDVAIDFSHEEWACLDSAQRDLYKDVMVQNYENLVSVAGLSVTKPYVIMLLEDGKEPWMMEKKLSKAYPFPLSHS

SEQ ID NO: 375 - protein, 81 aa, Homo sapiens
MSQVTFSDVAIDFSHEEWACLDSAQRDLYKDVMVQNYENLVSVGLSVTKPYVIMLLEDGKEPWMMEKKLSKAYPFPLSHSV

SEQ ID NO: 376 - protein, 81 aa, Homo sapiens
PSQNYDLPQKKQEKMTKFQEAVTFKDVAVVFSREELRLLDLTQRKLYRDVMVENFKNLVAVGHLPFQPDMVSQLEAEEKLW

SEQ ID NO: 377 - protein, 81 aa, Homo sapiens
MLENYSNLVSVGYQASKPDALFKLEQGEPWTVENEIHSQICPEIKKVDNHLQMHSQKQRCLKRVEQCHKHNAFGNIIHQRK

SEQ ID NO: 378 - protein, 81 aa, Homo sapiens
RDPAQVPVAADLLTDHEEGYVTFEDVAVYFSQEEWRLLDDAQRLLYRNVMLENFTLLASLGKVLTPHPSILSWARLFLLFL

SEQ ID NO: 379 - protein, 81 aa, Homo sapiens
MAAAALRAPTQDEWGLLDEAQRLLYLEVMLENFALVASLGCGHGTEDEETPSDQNVSVGVSQSKAGSSTQKTQSCEMCVPV

SEQ ID NO: 380 - protein, 81 aa, Homo sapiens
MLENYRNLVSVEHQLSKPDVVSQLEEAEDFWPVERGIPQDTIPEYPELQLDPKLDPLPAESPLMNIEVVEVLTLNQEVAGP

SEQ ID NO: 381 - protein, 81 aa, Homo sapiens
MAFEDVAVYFSQEEWGLLDTAQRALYRRVMLDNFALVASLGLSTSRPRVVIQLERGEEPWVPSGTDTTLSRTTYRRRNPGS

SEQ ID NO: 382 - protein, 81 aa, Homo sapiens
TQNHKAKGLPSNDTDCPQKKEGKAQIVVPVTFRDVTVIFTEAEWKRLSPEQRNLYKEVMLENYRNLLSLDGGQEQQDAAAY

SEQ ID NO: 383 - protein, 81 aa, Homo sapiens
KNGENVETMKKLTQNHKAKGLPSNDTDCPQKKEGKAQIVVPVTFRDVTVIFTEAEWKRLSPEQRNLYKEVMLENYRNLLSL

SEQ ID NO: 384 - protein, 81 aa, Homo sapiens
MAFRDVAVDFTQDEWRLLSPAQRTLYREVMLENYSNLVSLGISFSKPELITQLEQGKETWREEKKCSPATCPADPEPELYL

SEQ ID NO: 385 - protein, 81 aa, Homo sapiens
LAGQSDTPAAQMPALFPREGCPGDQVTPTRSLTAQLQETMTFKDVEVTFSQDEWGWLDSAQRNLYRDVMLENYRNMASLGK

SEQ ID NO: 386 - protein, 81 aa, Homo sapiens
MGPLTFRDVKIEFSLEEWQCLDTAQRNLYRDVMLENYRNLVFLGIAVSKPDLITWLEQGKEPWNLKRHEMVDKTPVMCSHF

SEQ ID NO: 387 - protein, 81 aa, Homo sapiens
MGVLTFRDVAVEFSPEEWECLDSAQQRLYRDVMLENYGNLVSLGLAIFKPDLMTCLEQRKEPWKVKRQEAVAKHPAGSFHF

SEQ ID NO: 388 - protein, 81 aa, Homo sapiens
MRVLTFRDVAVEFSPEEWECLDSAQQRLYRDVMLENYGNLFSLGLAIFKPDLITYLEQRKEPWNARRQKTVAKHPAGSLHF

SEQ ID NO: 389 - protein, 81 aa, Homo sapiens
MEVVTFGDVAVHFSREEWQCLDPGQRALYREVMLENHSSVAGLGFLVFKPELISRLEQGEEPWVLDLQGAEGTEAPRTSKT

SEQ ID NO: 390 - protein, 81 aa, Homo sapiens
MGLLTFRDVAVEFSLEEWEHLEPAQKNLYQDVMLENYRNLVSLGLVVSKPDLITFLEQRKEPWNVKSEETVAIQPDVFSHY

SEQ ID NO: 391 - protein, 81 aa, Homo sapiens
MGPLQFRDVAIEFSLEEWHCLDTAQRNLYRNVMLENYRNLVFLGIVVSKPDLITCLEQGKKPLTMKKHEMVANPSVTCSHF

SEQ ID NO: 392 - protein, 81 aa, Homo sapiens
MASPSPPPESKEEWDYLDPAQRSLYKDVMMENYGNLVSLDVLNRDKDEKPTVKQEIEEIEEEVEPQGVIVTRIKSEIDQDP

SEQ ID NO: 393 - protein, 81 aa, Homo sapiens
MDSVVFEDVAVDFTLEEWALLDSAQRDLYRDVMLETFRNLASVGCEMWERTNGSVSLQDMYGQEKSKEQTIPNFTGNNSCA

SEQ ID NO: 394 - protein, 81 aa, Homo sapiens
MLENYRNLVFLGIALTKPDLITCLEQGKEPWNIKRHEMVAKPPVICSHFPQDLWAEQDIKDSFQEAILKKYGKYGHDNLQL

SEQ ID NO: 395 - protein, 81 aa, Homo sapiens
MGALTFRDVAIEFSLEEWQCLDSTQQNLYRNVMLENYRNLVFLGIAAFKPDLIIFLEQGKEPWNMKRHEMVEEPPVICSHF

SEQ ID NO: 396 - protein, 81 aa, Homo sapiens
MGPLTFTDVAIKFSLEEWQFLDTAQQNLYRDVMLENYRNLVFLGVGVSKPDLITCLEQGKEPWNMKRHKMVAKPPVVCSHF

SEQ ID NO: 397 - protein, 81 aa, Homo sapiens
MGSLTFRDVAIQFSLEEWQCLDTAQQNLYRNVMLENYRNLVFLGIAAPKPDLIIFLEQGKEPWNMKRHELVKEPPVICSHF

SEQ ID NO: 398 - protein, 81 aa, Homo sapiens
MGALTFRDVAIEFSLEEWQCLDTEQQNLYRNVMLDNYRNLVFLGIAVSKPDLITCLEQEKEPWNLKTHDMVAKPPVICSHI

SEQ ID NO: 399 - protein, 81 aa, Homo sapiens
MTFEDVAVYFSQEEWGLLDTAQRALYRHVMLENFTLVTSLGLSTSRPRVVIQLERGEEPWVPSGKDMTLARNTYGRLNSGS

SEQ ID NO: 400 - protein, 81 aa, Homo sapiens
MYFSQEEWELLDPTQKALYNDVMQENYETVISLALFVLPKPKVISCLEQGEEPWVQVSPEFKDSAGKSPTGLKLKNDTENH

SEQ ID NO: 401 - protein, 81 aa, Homo sapiens
MDSVVFEDVAVDFTLEEWALLDSAQRDLYRDVMLETFQNLASVDDETQFKASGSVSQQDIYGEKIPKESKIATFTRNVSWA

SEQ ID NO: 402 - protein, 81 aa, Homo sapiens
MELLTFKDVAIEFSPEEWKCLDTSQQNLYRDVMLENYRNLVSLGVSISNPDLVTSLEQRKEPYNLKIHETAARPPAVCSHF

SEQ ID NO: 403 - protein, 81 aa, Homo sapiens
KEALMAFRDVAVAFTQKEWKLLSSAQRTLYREVMLENYSHLVSLGIAFSKPKLIEQLEQGDEPWREENEHLLDLCPEPRTE

SEQ ID NO: 404 - protein, 81 aa, Homo sapiens
EQGLVTFEDVAVDFTQEEWQYLNPPQRTLYRDVMLETYSNLVFVGQQVTKPNLILKLEVEECPAEGKIPFWNFPEVCQVDE

SEQ ID NO: 405 - protein, 81 aa, Homo sapiens
SGSVTFEDVAVYFSWEEWDLLDEAQKHLYFDVMLENFALTSSLGCWCGVEHEETPSEQRISGERVPQFRTSKEGSSSQNAD

SEQ ID NO: 406 - protein, 81 aa, Homo sapiens
MLENYKNLATVGYQLFKPSLISWLEQEESRTVQRGDFQASEWKVQLKTKELALQQDVLGEPTSSGIQMIGSHNGGEVSDVK

SEQ ID NO: 407 - protein, 81 aa, Homo sapiens
AQVSVTFEDVAVTFTQEEWGQLDAAQRTLYQEVMLETCGLLMSLGCPLFKPELIYQLDHRQELWMATKDLSQSSYPGDNTK

SEQ ID NO: 408 - protein, 81 aa, Homo sapiens
PQGRLTFMDVAIEFSQEEWKSLDPGQRALYRDVMLENYRNLVFLGICLPDLSIISMLKQRREPLILQSQVKIVKNTDGREC

SEQ ID NO: 409 - protein, 81 aa, Homo sapiens
DSVTFEDVAVDFTQEEWTLLDQTQRNLYRDVMLENYKNLVAVDWESHINTKWSAPQQNFLQGKTSSVVEMERNHFGEELFD

SEQ ID NO: 410 - protein, 81 aa, Homo sapiens
YQDSVTFDDVAVDFTPEEWALLDTTEKYLYRDVMLENYMNLASVEWEIQPRTKRSSLQQGFLKNQIFSGIQMTRGYSGWKL

SEQ ID NO: 411 - protein, 81 aa, Homo sapiens
ARGCVVFEDVFVYFSREEWELLDDAQRLLYHDVMLENFALLASLGIAFSRSRAVMKLERGEEPWVYDQVDMTSATEREAQR

SEQ ID NO: 412 - protein, 81 aa, Homo sapiens
LQESFSFDDLSVDFTQKEWQLLDPSQKNLYKDVMLENYSSLVSLGYEVMKPDVIFKLEQGEEPWVGDGEIPSSDSPEVWKV

SEQ ID NO: 413 - protein, 81 aa, Homo sapiens
MGSLTFRDVAIEFSLEEWQCLDTAQQNLYRNVMLENYRNLVFLGIAAFKPDLIIFLEEGKESWNMKRHEMVEESPVICSHF

SEQ ID NO: 414 - protein, 81 aa, Homo sapiens
FQEAVTFKDVIVDFTQEEWKQLDPGQRDLFRDVTLENYTHLVSIGLQVSKPDVISQLEQGTEPWIMEPSIPVGTCADWETR

SEQ ID NO: 415 - protein, 81 aa, Homo sapiens
FQEAVTFKDVAVAFTEEELGLLDSAQRKLYRDVMLENFRNLVSVGHQSFKPDMISQLEREEKLWMKELQTQRGKHSGDRNQ

SEQ ID NO: 416 - protein, 81 aa, Homo sapiens
QGTVTFEDVAVNFSQEEWCLLSEAQRCLYRDVMLENLALISSLGCWCGSKDEEAPCKQRISVQRESQSRTPRAGVSPKKAH

SEQ ID NO: 417 - protein, 81 aa, Homo sapiens
SQGLVTIKDVSLCFSQEEWRSLDPSQTDFYGEYVMQENCGIVVSLRFPIPKLDMLSQLEGGEEQWVPDPQDLEERDILRVT

SEQ ID NO: 418 - protein, 81 aa, Homo sapiens
SQESVSFKDVTVGFTQEEWQHLDPSQRALYRDVMLENYSNLVSVGYCVHKPEVIFRLQQGEEPWKQEEEFPSQSFPVWTAD

SEQ ID NO: 419 - protein, 81 aa, Homo sapiens
AQGCVTFEDVTIYFSQEEWVLLDEAQRLLYCDVMLENFALIASLGLISFRSHIVSQLEMGKEPWVPDSVDMTSAMARGAYG

SEQ ID NO: 420 - protein, 81 aa, Homo sapiens
CQELVTFEDVAVYFSLEEWERLEADQRGLYQEVMQENYGILVSLGYPIPKPDLIFRLEQGEEPWVPDSPRPEEGDIVTGVY

SEQ ID NO: 421 - protein, 81 aa, Homo sapiens
FQIPVSFQDLTVNFTQEEWQQLDPAQRLLYRDVMLENYSNLVSVGYHVSKPDVIFKLEQGEEPWIVEEFSNQNYPDIDDAL

SEQ ID NO: 422 - protein, 81 aa, Homo sapiens
SLKKLTFEDVAIDFTQEEWAMMDTSKRKLYRDVMLENISHLVSLGYQISKSYIILQLEQGKELWREGRVFLQDQNPNRESA

SEQ ID NO: 423 - protein, 81 aa, Homo sapiens
FQASVSFQDVTVEFSQEEWQHMGPVERTLYRDVMLENYSHLVSVGYCFTKPELIFTLEQGEDPWLLEKEKGFLSRNSPEDS

SEQ ID NO: 424 - protein, 81 aa, Homo sapiens
EMGLLTFRDIAIEFSLAEWQCLDHAQQNLYRDVMLENYRNLFSLGMTVSKPDLIACLEQNKEPQNIKRNEMAAKHPVTCSH

SEQ ID NO: 425 - protein, 81 aa, Homo sapiens
MDSVSFEDVAVNFTLEEWALLDSSQKKLYEDVMQETFKNLVCLGKKWEDQDIEDDHRNQGKNRRCHMVERLCESRRGSKCG

SEQ ID NO: 426 - protein, 81 aa, Homo sapiens
ITAFVAFRDVAVYFTQEEWRLLSPAQRTLHREVMLETYNHLVSLEIPSSKPKLIAQLERGEAPWREERKCPLDLCPESKPE

SEQ ID NO: 427 - protein, 81 aa, Homo sapiens
MAEEFVTLKDVGMDFTLGDWEQLGLEQGDTFWDTALDNCQDLFLLDPPRPNLTSHPDGSEDLEPLAGGSPEATSPDVTETK

SEQ ID NO: 428 - protein, 81 aa, Homo sapiens
SLGSVTFTDVAIDFSQDEWEWLNLAQRSLYKKVMLENYRNLVSVGLCISKPDVISLLEQEKDPWVIKGGMNRGLCPDLECV

SEQ ID NO: 429 - protein, 81 aa, Homo sapiens
EMESLQFRDVAVEFSLEEWHCLDTAQQNLYRDVMLENYRHLVFLGIIVSKPDLITCLEQGIKPLTMKRHEMIAKPPVVCSH

SEQ ID NO: 430 - protein, 81 aa, Homo sapiens
QEMPLTFQDVAVYFSQAEGRQLGPQQRALYRDVMLENYGNVASLGFPVPKPELISQLEQGKELWVLNLLGAEEPDILKSCQ

SEQ ID NO: 431 - protein, 81 aa, Homo sapiens
AQESITLEDVAVDFTWEEWQLLGAAQKDLYRDVMLENYSNLVAVGYQASKPDALFKLEQGEQLWTIEDGIHSGACSDIWKV

SEQ ID NO: 432 - protein, 81 aa, Homo sapiens
DSVAFEDVAVNFTLEEWALLDPSQKNLYRDVMRETFRNLASVGKQWEDQNIEDPFKIPRRNISHIPERLCESKEGGQGEET

SEQ ID NO: 433 - protein, 81 aa, Homo sapiens
QGRLTFRDVAIEFSLEEWKCLNPAQRALYRAVMLENYRNLEFVDSSLKSMMEFSSTRHSITGEVIHTGTLQRHKSHHIGDF

SEQ ID NO: 434 - protein, 81 aa, Homo sapiens
VAFEDVAIYFSQEEWELLDEMQRLLYRDVMLENFAVMASLGCWCGAVDEGTPSAESVSVEELSQGRTPKADTSTDKSHPCE

SEQ ID NO: 435 - protein, 81 aa, Homo sapiens
LKGLVTFEDVAVEFTQEEWALLDPAQRTLYRDVMLENCRNLASLGNQVDKPRLISQLEQEDKVMTEERGILSGTCPDVENP

SEQ ID NO: 436 - protein, 81 aa, Homo sapiens
SQAPVTFEDMAMYLTREEWRPLDAAQRDLYRDVMQENYGNVVSLDFEIRSENEVNPKQEISEDVQFGTTSERPAENAEENP

SEQ ID NO: 437 - protein, 81 aa, Homo sapiens
YQEMVTFEDVAVHFTKTEWTGLSPAQRALYRSVMLENFGNLTALGYPVPKPALISLLERGDMAWGLEAQDDPPAERTKNVC

SEQ ID NO: 438 - protein, 81 aa, Homo sapiens
CQESVTFEDVAVVFTDEEWSRLVPIQRDLYKEVMLENYNSIVSLGLPVPQPDVIFQLKRGDKPWMVDLHGSEEREWPESVS

SEQ ID NO: 439 - protein, 81 aa, Homo sapiens
LQASVSFEDVTVDFSKEEWQHLDPAQRRLYWDVTLENYSHLLSVGYQIPKSEAAFKLEQGEGPWMLEGEAPHQSCSGEAIG

SEQ ID NO: 440 - protein, 81 aa, Homo sapiens
MGSLTFWDVTIEFALEEWQCLDMAQQNLYRNVMLENYRNLVFLGIAVSKLDLITCLKQGKEPWNMKRHEMVTKPPVISSHF

SEQ ID NO: 441 - protein, 81 aa, Homo sapiens
PLETVTFKDVAVDLTQEEWEQMKPAQRNLYRDVMLENYSNLVTVGCQVTKPDVIFKLEQEEEPWVMEEEMFGRHCPEVWEV

SEQ ID NO: 442 - protein, 81 aa, Homo sapiens
SQASVSFQDVTVEFTREEWQHLGPVERTLYRDVMLENYSHLISVGYCITKPKVISKLEKGEEPWSLEDEFLNQRYPGYFKV

SEQ ID NO: 443 - protein, 81 aa, Homo sapiens
TARSQETVTFKDVAMDFTPEEWGKLDPAQRDVMLENYRNLVSLWLPVSKPESYNLENGKEPLKLERKAPKSSYSDMETRPQ

SEQ ID NO: 444 - protein, 81 aa, Homo sapiens
YQIPVSFKDVVVGFTQEEWHRLSPAQRALYRDVMLETYSNLVSVGYEGTKPDVILRLEQEEAPWIGEAACPGCHCWEDIWR

SEQ ID NO: 445 - protein, 81 aa, Homo sapiens
YQYSVTFEDTAVDFTQEEWILLDPVQRNLYRDVMLENYENVAKVGFQLFKPSVISWLEEEELRTLQQGVLQDWAIKHQTSV

SEQ ID NO: 446 - protein, 81 aa, Homo sapiens
AQEPVTFRDVAVFFSQDEWLHLDSAQRALYREVMLENYSSLVSLGIPFSMPKLIHQLQQGEDPCMVEREVPSDTRLGFKTW

SEQ ID NO: 447 - protein, 81 aa, Homo sapiens
PQVSLTFEDVAVLFTRDEWRKLAPSQRNLYRDVMLENYRNLVSLGLPFTKPKVISLLQQGEDPWEVEKDGSGVSSLGSKSS

SEQ ID NO: 448 - protein, 81 aa, Homo sapiens
SYEGSVSFRDVAIDFSREEWRHLDLSQRNLYRDVMLETYSHLLSVGYQVPKPEVVMLEQGKEPWALQGERPRHSCPGEKLW

SEQ ID NO: 449 - protein, 81 aa, Homo sapiens
LQELVSFEEVAVHFTWEEWQDLDDAQRTLYRDVMLETYSSLVSLGHCITKPEMIFKLEQGAEPWIVEETPNLRLSAVQIID

SEQ ID NO: 450 - protein, 81 aa, Homo sapiens
EPGAVSFADVAVYFCREEWGCLRPAQRALYRDVMRETYGHLSALGIGGNKPALISWVEEEAELWGPAAQDPEVAKCQTQTD

SEQ ID NO: 451 - protein, 81 aa, Homo sapiens
EMGLLTFRDIAIEFSLEEWQCLDCAQRNLYRDVMLENYRNLVSLGIAVSKPDLITCLEQNKESQNIKRNEMVAKHPVTRSH

SEQ ID NO: 452 - protein, 81 aa, Homo sapiens
VFEELVTFEDVLVDFSPEELSSLSAAQRNLYREVMLENYRNLVSLGHQFSKPDIISRLEEEESYAMETDSRHTVICQGESH

SEQ ID NO: 453 - protein, 81 aa, Homo sapiens
VTLRDVVINFSQEEWEYLDSAQRNLYWDVMMENYSNLLSLDLESRNETKHLSVGKDIIQNTGSQWEVMESSKLCGLEGSIF

SEQ ID NO: 454 - protein, 81 aa, Homo sapiens
PQGLLTFRDVAIEFSQEEWKCLDPAQRTLYRDVMLENYRNLVSLDISSKCMMEFSSIGKGNTEVIHTGTLQRLASHHIGEC

SEQ ID NO: 455 - protein, 81 aa, Homo sapiens
WSQMPVTFEDVALYLSREEWGRLDHTQQNFYRDVLQKKNGLSLGFPFSRPFWAPQAHGKGEASGSSRQAGDEKEWRGACTG

SEQ ID NO: 456 - protein, 81 aa, Homo sapiens
AQMLVTFKDVAVTFTREEWRQLDLAQRTLYREVMLETCGLLVSLGHRVPKPELVHLLEHGQELWIVKRGLSHATCAGDRAQ

SEQ ID NO: 457 - protein, 81 aa, Homo sapiens
LRGLVTFEDVAVEFTQEEWALLDPAQRTLYRDVMLENCRNLASLGCRVNKPSLISQLEQDKKVVTEERGILPSTCPDLETL

SEQ ID NO: 458 - protein, 81 aa, Homo sapiens
EEGYVTFEDVAVYFSQEEWRLLDDAQRLLYRNVMLENFTLLASLGLASSKTHEITQLESWEEPFMPAWEVVTSAIPRGCWH

SEQ ID NO: 459 - protein, 81 aa, Homo sapiens
RPGAVSFADVAVYFSPEEWECLRPAQRALYRDVMRETFGHLGALGFSVPKPAFISWVEGEVEAWSPEAQDPDGESSAAFSR

SEQ ID NO: 460 - protein, 81 aa, Homo sapiens
SLEKVTFEDVAIDFTQEEWDMMDTSKRKLYRDVMLENISHLVSLGYQISKSYIILQLEQGKELWWEGRVFLQDQNPDRESA

SEQ ID NO: 461 - protein, 81 aa, Homo sapiens
VHGSVTFRDVAIDFSQEEWECLQPDQRTLYRDVMLENYSHLISLGSSISKPDVITLLEQEKEPWIVVSKETSRWYPDLESK

SEQ ID NO: 462 - protein, 81 aa, Homo sapiens
QGLLTFRDVAIEFSQEEWKCLDPAQRTLYRDVMLENYRNLVSLDISSKCMMKEFSSTAQGNREVFHAGTSQRHESHHNGDF

SEQ ID NO: 463 - protein, 81 aa, Homo sapiens
SQGSVTFRDVAIDFSQEEWKWLQPAQRDLYRCVMLENYGHLVSLGLSISKPDVVSLLEQGKEPWLGKREVKRDLFSVSESS

SEQ ID NO: 464 - protein, 81 aa, Homo sapiens
DSISLEDVAVNFTLEEWALLDPGQRNIYRDVMRATFKNLACIGEKWKDQDIEDEHKNQGRNLRSPMVEALCENKEDCPCGK

SEQ ID NO: 465 - protein, 81 aa, Homo sapiens
EMGLLTFRDVAIEFSLEEWQHLDIAQQNLYRNVMLENYRNLAFLGIAVSKPDLITCLEQGKEPWNMKRHEMVDEPPGMCPH

SEQ ID NO: 466 - protein, 81 aa, Homo sapiens
SQGTVTFKDVAIDFTQEEWKRLDPAQRKLYRNVMLENYNNLITVGYPFTKPDVIFKLEQEEEPWVMEEEVLRRHWQGEIWG

SEQ ID NO: 467 - protein, 81 aa, Homo sapiens
LQGSVSFKDVTVDFTQEEWQQLDPAQKALYRDVMLENYCHFVSVGFHMAKPDMIRKLEQGEELWTQRIFPSYSYLEEDGKT

SEQ ID NO: 468 - protein, 81 aa, Homo sapiens
NCYQDAVTFDDVAVDFTQEEWTLLDPSQRDLYRDVMLENYENLASVEWRLKTKGPALRQDRSWFRASNETQTARSHNGGQL

SEQ ID NO: 469 - protein, 81 aa, Homo sapiens
MTLLTFRDVAIEFSLEEWKCLDLAQQNLYRDVMLENYRNLFSVGLTVCKPGLITCLEQRKEPWNVKRQEAADGHPEMGFHH

SEQ ID NO: 470 - protein, 81 aa, Homo sapiens
TLKEAVTFKDVAVVFTEEELRLLDLAQRKLYREVMLENFRNLLSVGHQSLHRDTFHFLKEEKFWMMETATQREGNLGGKIQ

SEQ ID NO: 471 - protein, 81 aa, Homo sapiens
IQGPLTFGDVAVAFTRIEWRHLDAAQRALYRDVMLENYGNLVSVGLLSSKPKLITQLEQGAEPWTEVREAPSGTHAVEDYW

SEQ ID NO: 472 - protein, 81 aa, Homo sapiens
FQEAVTFKDVAVVFSREELRLLDLTQRKLYRDVMVENFKNLVAVGHLPFQPDMVSQLEAEEKLWMMETETQRSSKHQNKME

SEQ ID NO: 473 - protein, 81 aa, Homo sapiens
VTFRDVAIDFSQEEWECLDPAQRDLYVDVMLENYSNLVSLDLESKTYETKKIFSENDIFEINFSQWEMKDKSKTLGLEASI

SEQ ID NO: 474 - protein, 81 aa, Homo sapiens
AQESVTFEDVAVNFTNREWQCLTYAQRHLYKDVMLENYGNMVSLGFPFPKPPLISHLEREVDPCVQDPQDRESLSCSYPVS

SEQ ID NO: 475 - protein, 81 aa, Homo sapiens
CYQDSVTFDDVAVDFTQEEWTLLDSTQRSLYSDVMLENYKNLATVGGQIIKPSLISWLEQEESRTVQGGVLQGWEMRLETQ

SEQ ID NO: 476 - protein, 81 aa, Homo sapiens
AQSSVTFEDVAVNFSLEEWSLLNEAQRCLYRDVMLETLTLISSLGCWHGGEDEAAPSKQSTCIHIYKDQGGHSGERPYECG

SEQ ID NO: 477 - protein, 81 aa, Homo sapiens
IQGQVNFEDVFVYFSQEEWVLLDEAQRLLYRDVMLENFALMASLGHTSFMSHIVASLVMGSEPWVPDWVDMTLAVATETPG

SEQ ID NO: 478 - protein, 81 aa, Homo sapiens
SQEQVSFKDVCVDFTQEEWYLLDPAQKILYRDVILENYSNLVSVGYCITKPEVIFKIEQGEEPWILEKGFPSQCHPERKWK

SEQ ID NO: 479 - protein, 81 aa, Homo sapiens
EKETLTFRDVAIEFSLEEWECLNPAQQNLYMNVMLENYKNLVFLGVAVSKQDPVTCLEQEKEPWNMKRHEMVDEPPAMCSY

SEQ ID NO: 480 - protein, 81 aa, Homo sapiens
SQEPVTFEDVAVDFTQEEWQQLNPAQKTLHRDVMLETYNHLVSVGCSGIKPDVIFKLEHGKDPWIIESELSRWIYPDRVKG

SEQ ID NO: 481 - protein, 81 aa, Homo sapiens
ARDLVMFRDVAVDFSQEEWECLNSYQRNLYRDVILENYSNLVSLAGCSISKPDVITLLEQGKEPWMVVRDEKRRWTLDLES

SEQ ID NO: 482 - protein, 81 aa, Homo sapiens
PKVPVSFEDVSVYFTKTEWKLLDLRQKVLYKRVMLENYSHLVSLGFSFSKPHLISQLERGEGPWVADIPRTWATAGLHIGD

SEQ ID NO: 483 - protein, 81 aa, Homo sapiens
EMGLLTFRDVAIEFSPEEWQCLDTAQQNLYRNVMLENYRNLAFLGIALSKPDLITYLEQGKEPWNMKQHEMVDEPTGICPH

SEQ ID NO: 484 - protein, 81 aa, Homo sapiens
FEGSVSFEDVAVDFTRQEWHRLDPAQRTMHKDVMLETYSNLASVGLCVAKPEMIFKLERGEELWILEEESSGHGYSGSLSL

SEQ ID NO: 485 - protein, 81 aa, Homo sapiens
MGPLQFRDVAIEFSLEEWHCLDAAQRNLYRDVMLENYRNLIFLGIVVSKPNLITCLEQGKKPLTMKRHEMIAKPPVMYSHF

SEQ ID NO: 486 - protein, 81 aa, Homo sapiens
PQASVCFEDVAMAFTQEEWEQLDLAQRTLYREVTLETWEHIVSLGLFLSKSDVISQLEQEEDLCRAEQEAPRDWKATLEEN

SEQ ID NO: 487 - protein, 81 aa, Homo sapiens
FQAKLTFEDVAVLLSQDEWDRLCPAQRGLYRNVMMETYGNVVSLGLPGSKPDIISQLERGEDPWVLDRKGAKKSQGLWSDY

SEQ ID NO: 488 - protein, 81 aa, Homo sapiens
VQEPVTFKDVAVDFTQEEWGQLDLVQRTLYRDVMLETYGHLLSVGNQIAKPEVISLLEQGEEPWSVEQACPQRTCPEWVRN

SEQ ID NO: 489 - protein, 81 aa, Homo sapiens
FQESVTFQDVAVDFTAEEWQLLDCAERTLYWDVMLENYRNLISVGCPITKTKVILKVEQGQEPWMVEGANPHESSPESDYP

SEQ ID NO: 490 - protein, 81 aa, Homo sapiens
MELLTFRDVAIEFSPEEWKCLDPAQQNLYRDVMLENYRNLISLGVAISNPDLVIYLEQRKEPYKVKIHETVAKHPAVCSHF

SEQ ID NO: 491 - protein, 81 aa, Homo sapiens
RPRALKFVDVAVYFSPEEWGCLRPAQRALYRDVMRETYGHLGALGCAGPKPALISWLERNTDDWEPAALDPQEYPRGLTVQ

SEQ ID NO: 492 - protein, 81 aa, Homo sapiens
QGLLTFRDVAIEFSQEEWKCLDPAQRTLYRDVMLENYRNLVSLDISSKCTMKEFLSTAQGNREVFHAGTLQIHESHHNGDF

SEQ ID NO: 493 - protein, 81 aa, Homo sapiens
MELLTFRDVAIEFSPEEWKCLDPDQQNLYRDVMLENYRNLVSLGVAISNPDLVTCLEQRKEPYNVKIHKIVARPPAMCSHF

SEQ ID NO: 494 - protein, 81 aa, Homo sapiens
GPLTFRDVAIEFSQEEWKSLDPVQKALYWDVMLENYRNLVFLGILPKCMTKELPPIGNSNTGEKCQTVTLERHECYDVENF

SEQ ID NO: 495 - protein, 81 aa, Homo sapiens
MLENYGNVASLGFPLLKPAVISQLEGGSELGGSSPLAAGTGLQGLQTDIQTDNDLTKEMYEGKENVSFELQRDFSQETDFS

SEQ ID NO: 496 - protein, 81 aa, Homo sapiens
SKDLVTFGDVAVNFSQEEWEWLNPAQRNLYRKVMLENYRSLVSLGVSVSKPDVISLLEQGKEPWMVKKEGTRGPCPDWEYV

SEQ ID NO: 497 - protein, 81 aa, Homo sapiens
ARVPLTFSDVAIDFSQEEWEYLNSDQRDLYRDVMLENYTNLVSLDFNFTTESNKLSSEKRNYEVNAYHQETWKRNKTFNLM

SEQ ID NO: 498 - protein, 81 aa, Homo sapiens
SQESVTFQDVAVDFTEKEWPLLDSSQRKLYKDVMLENYSNLTSLGYQVGKPSLISHLEQEEEPRTEERGAHQGACADWETP

SEQ ID NO: 499 - protein, 81 aa, Homo sapiens
GEGSLSFEDVAVGFTREEWQFLDQSQKVLYKEVMLENYINLVSIGYRGTKPDSLFKLEQGEPPGIAEGAAHSQICPGFVIQ

SEQ ID NO: 500 - protein, 81 aa, Homo sapiens
MGPLQFRDVAIEFSLEEWHCLDTAQRNLYRNVMLENYSNLVFLGITVSKPDLITCLEQGRKPLTMKRNEMIAKPSVMCSHF

SEQ ID NO: 501 - protein, 81 aa, Homo sapiens
AQESLTLEDVAVDFTWEEWQFLSPAQKDLYRDVMLENYSNLVSVGYQAGKPDALTKLEQGEPLWTLEDEIHSPAHPEIEKA

SEQ ID NO: 502 - protein, 81 aa, Homo sapiens
VKESVTFKDVAIDFTLEEWRLMDPTQRNLHKDVMLENYRNLVSLGLAVSKPDMISHLENGKGPWVTVREISRIPYPDMEPK

SEQ ID NO: 503 - protein, 81 aa, Homo sapiens
MLENYGAVASLAAFPFPKPALISQLERGETPWCSVPRGALDGEAPRGISSGYPFLKPAGISHPEQVEEPLNLKLQGEGPSL

SEQ ID NO: 504 - protein, 81 aa, Homo sapiens
AQVSVTFDDVAVTFTQEEWGQLDLAQRTLYQEVMLENCGLLVSLGCPVPRPELIYHLEHGQEPWTRKEDLSQGTCPGDKGK

SEQ ID NO: 505 - protein, 81 aa, Homo sapiens
EKGPLTFRDVVIEFSQEEWQCLDTAQQDLYRKVMLENFRNLVFLGIDVSKPDLITCLEQGKDPWNMKRHSMVATPPESGVL

SEQ ID NO: 506 - protein, 81 aa, Homo sapiens
CWGLLSFKDISMEFTWDEWQLLDSTQKYLYRDVILENYHNLISVGYHGTKPDLIFKLEQGEDPWIINAKISRQSCPDGWEE

SEQ ID NO: 507 - protein, 81 aa, Homo sapiens
AHGSVTFRDVAIDFSQEEWEFLDPAQRDLYRDVMWENYSNFISLGPSISKPDVITLLDEERKEPGMVVREGTRRYCPDLES

SEQ ID NO: 508 - protein, 81 aa, Homo sapiens
SQASVSFKDVTIEFTQEEWQQMAPVQKNLYRDVMLENYSNLVSVGYCCFKPEVIFKLEQGEEPWFSEEEFSNQSHPKDYRG

SEQ ID NO: 509 - protein, 81 aa, Homo sapiens
MTFEDVAVEFSQWEWGQLNPAQKDLYREVMLENFRNLAILGLLVSKPYVICQLEEGGEPFMVEREISTGAHSDWKRRSKSK

SEQ ID NO: 510 - protein, 81 aa, Homo sapiens
GLLTFEDVAVFFTQEEWDYLDPAQRSLYKDVMMENYGNLVSLDVLNRDKDEEPTVKQEIEEIEEEVEPQGVIVTRIKSEID

SEQ ID NO: 511 - protein, 81 aa, Homo sapiens
PQGLLTFRDVAIEFSQEEWKCLDPAQRTLYRDVMLENYRNLVSLDISSKCMLKTLSSTGQGNTEVIHTGTLHRQASHHIGE

SEQ ID NO: 512 - protein, 81 aa, Homo sapiens
PQESVTFEDVAVYFTQNQWASLDPAQRALYGEVMLENYANVASLVAFPFPKPALISHLERGEAPWGPDPWDTEILRGISQG

SEQ ID NO: 513 - protein, 81 aa, Homo sapiens
SCEPVTFEDVTLGFTPEEWGLLDLKQKSLYREVMLENYRNLVSVEHQLSKPDVVSQLEEAEDFWPVERGIPQDTIPEYPEL

SEQ ID NO: 514 - protein, 81 aa, Homo sapiens
MELVTFRDVAIEFSPEEWKCLDPAQQNLYRDVMLENYRNLVSLGFVISNPDLVTCLEQIKEPCNLKIHETAAKPPAICSPF

SEQ ID NO: 515 - protein, 81 aa, Homo sapiens
SQGLLTFRDVAIEFSQEEWKCLDPAQRTLYRDVMLENYRNLVSLDISSKCMMNTLSSTGQGNTEVIHTGTLQRQASYHIGA

SEQ ID NO: 516 - protein, 81 aa, Homo sapiens
PQESVAFEDVAVYFTTKEWAIMVPAERALYRDVMLENYEAVAFVVPPTSKPALVSHLEQGKESCFTQPQGVLSRNDWRAGW

SEQ ID NO: 517 - protein, 81 aa, Homo sapiens
LQGPVSFKDVAVDFTQEEWQQLDPDEKITYRDVMLENYSHLVSVGYDTTKPNVIIKLEQGEEPWIMGGEFPCQHSPEAWRV

SEQ ID NO: 518 - protein, 81 aa, Homo sapiens
GWVPALFDEVAIYFSDEEWEVLTEQQKALYREVMRMNYETVLSLEFPFPKPDMITRLEGEEESQNSDEWQLQGGTSAENEE

SEQ ID NO: 519 - protein, 81 aa, Homo sapiens
GPVSFKDVAVDFTQEEWRQLDPDEKIAYGDVMLENYSHLVSVGYDYHQAKHHHGVEVKEVEQGEEPWIMEGEFPCQHSPEP

SEQ ID NO: 520 - protein, 81 aa, Homo sapiens
SQELLTFKDVSVDFTQEEWGQLAPAHRNLYREVMLENYGNLVSVGCQLSKPGVISQLEKGEEPWLMERDISGVPSSDLKSK

SEQ ID NO: 521 - protein, 81 aa, Homo sapiens
PRLPLTFEDVAIYFSEQEWQDLEAWQKELYKHVMRSNYETLVSLDDGLPKPELISWIEHGGEPFRKWRESQKSGNIICSSV

SEQ ID NO: 522 - protein, 81 aa, Homo sapiens
NFWILRLPPGSKGESPKEWGKLEDWQKELYKHVMRGNYETLVSLDYAISKPEVLSQIEQGKEPCNWRRPGPKIPDVPVDPS

SEQ ID NO: 523 - protein, 81 aa, Homo sapiens
PQGHLTFRDVAIEFSQAEWKCLDPAQRALYKDVMLENYRNLVSLGISLPDLNINSMLEQRREPWSGESEVKIAKNSDGREC

SEQ ID NO: 524 - protein, 81 aa, Homo sapiens
VTFEDVTIIFTWEEWKFLDSSQKRLYREVMWENYTNVMSVENWNESYKSQEEKFRYLEYENFSYWQGWWNAGAQMYENQNY

SEQ ID NO: 525 - protein, 81 aa, Homo sapiens
MFKEAVTFKDVAVAFTEEELGLLGPAQRKLYRDVMVENFRNLLSVGHPPFKQDVSPIERNEQLWIMTTATRRQGNLGEKNQ

SEQ ID NO: 526 - protein, 81 aa, Homo sapiens
SAQGMTFEDVAIYFSQEEWELLDESQRFLYCDVMLENFAHVTSLGYCHGMENEAIASEQSVSIQVRTSKGNTPTQKTHLSE

SEQ ID NO: 527 - protein, 81 aa, Homo sapiens
MELLTFRDVAIEFSPEEWKCLDPAQQNLYRDVMLENYRNLVSLAVYSYYNQGILPEQGIQDSFKKATLGRYGSCGLENICL

SEQ ID NO: 528 - protein, 81 aa, Homo sapiens
MFKEAVTFKDVAVVFTEEELGLLDVSQRKLYRDVMLENFRNLLSVGHQLSHRDTFHFQREEKFWIMETATQREGNSGGKIQ

SEQ ID NO: 529 - protein, 81 aa, Homo sapiens
QGLLTFRDVAIEFSQEEWKCLDPAQRTLYRDVMLENYRNLVSLDISSKCMMKEFSSTAQGNTEVIHTGTLQRHERHHIGDF

SEQ ID NO: 530 - protein, 81 aa, Homo sapiens
MESVTFEDVAVEFIQEWALLDSARRSLCKYRMLDQCRTLASRGTPPCKPSCVSQLGQRAEPKATERGILRATGVAWESQLK

SEQ ID NO: 531 - protein, 81 aa, Homo sapiens
QGRLTFRDVAIEFSLAEWKFLNPAQRALYREVMLENYRNLEAVDISSKRMMKEVLSTGQGNTEVIHTGMLQRHESYHTGDF

SEQ ID NO: 532 - protein, 81 aa, Homo sapiens
AQESLTLEDVAVDFTWEEWQFLSPAQKDLYRDVMLENYSNLVAVGYQASKPDALSKLERGEETCTTEDEIYSRICSEIRKI

SEQ ID NO: 533 - protein, 81 aa, Homo sapiens
SKAPITFGDLAIYFSQEEWEWLSPIQKDLYEDVMLENYRNLVSLGLSFRRPNVITLLEKGKAPWMVEPVRRRRAPDSGSKC

SEQ ID NO: 534 - protein, 81 aa, Homo sapiens
GTVTFEDVAVNFTWEEWNLLSEAQRCLYRDVTLENLALISSLGCWCGVEDEAAPSKQSIYIQRETQVRTPMAGVSPKKAHP

SEQ ID NO: 535 - protein, 81 aa, Homo sapiens
RSQESLTFQDVAVDFTREEWDQLYPAQKNLYRDVMLENYRNLVALGYQLCKPEVIAQLELEEEWVIERDSLLDTHPDGENR

SEQ ID NO: 536 - protein, 81 aa, Homo sapiens
KSLESVSFKDVTVDFSRDEWQQLDLAQKSLYREVMLENYFNLISVGCQVPKPEVIFSLEQEEPCMLDGEIPSQSRPDGDIG

SEQ ID NO: 537 - protein, 81 aa, Homo sapiens
AVTFKDVAVIFTEEELGLLDPAQRKLYRDVMLENFRNLLSVGGKIQTEMETVPEAGTHEEFSCKQIWEQIASDLTRSQDTT

SEQ ID NO: 538 - protein, 81 aa, Homo sapiens
KSQESLTLEDVAVEFTWEEWQLLGPAQKDLYRDVMLENYSNLVSVGYQASKPDALFKLEQGEPWTVENEIHSQICPEIKKV

SEQ ID NO: 539 - protein, 81 aa, Homo sapiens
EMGLLTFRDVVIEFSLEEWQCLDHAQQNLYRDVMLENYRNLVSLGIAVSKPDLITCLEQNKEPWNIKRNEMVTKHPVMCSH

SEQ ID NO: 540 - protein, 81 aa, Homo sapiens
EMGPLTFRDVAIEFSLEEWQCLDTAQRNLYRKVMFENYRNLVFLGIAVSKPHLITCLEQGKEPWNRKRQEMVAKPPVIYSH

SEQ ID NO: 541 - protein, 81 aa, Homo sapiens
GTVTFEDVAVNFSQEEWSLLSEAQRCLYHDVMLENLTLISSLGCWYGAKDETPSKQTLSIQQESPLRTHWTGVCTKKVHLW

SEQ ID NO: 542 - protein, 81 aa, Homo sapiens
GKELLSFEDVAMYFTREEWGHLNWGQKDLYRDVMLENYRNMVLLGFQFPKPEMICQLENWDEQWILDLPRTGNRKASGSAC

SEQ ID NO: 543 - protein, 81 aa, Homo sapiens
GHLTFRDVAIEFSLEEWKCLDPTQRALYRAMMLENYRNLHSVDISSKCMMKKFSSTAQGNTEVDTGTLERHESHHIGDFCF

SEQ ID NO: 544 - protein, 81 aa, Homo sapiens
ALRSVMFSDVSIDFSPEEWEYLDLEQKDLYRDVMLENYSNLVSLGCFISKPDVISSLEQGKEPWKVVRKGRRQYPDLETKY

SEQ ID NO: 545 - protein, 81 aa, Homo sapiens
LQGLVMFEDVTVYFSREEWGLLNVTQKGLYRDVMLENFALVSSLGLAPSRSPVFTQLEDDEQSWVPSWVDVTPVSRAEARR

SEQ ID NO: 546 - protein, 81 aa, Homo sapiens
AGRPLEMAVSEPEASAAEWKQLDPAQSNLYNDVMLENYCNQASMGCQAPKPDMISKLEKGEAPWLGKGKRPSQGCPSKIAR

SEQ ID NO: 547 - protein, 81 aa, Homo sapiens
SQGLVTFGDVAVDFSQEEWEWLNPIQRNLYRKVMLENYRNLASLGLCVSKPDVISSLEQGKEPWTVKRKMTRAWCPDLKAV

SEQ ID NO: 548 - protein, 81 aa, Homo sapiens
MGPLQFRDVAIEFSLEEWHCLDMAQRNLYRDVMLENYRNLVFLGIVVSKPDLITHLEQGKKPSTMQRHEMVANPSVLCSHF

SEQ ID NO: 549 - protein, 81 aa, Homo sapiens
TFKEAVTFKDVAVVFTEEELGLLDPAQRKLYRDVMLENFRNLLSVGHQPFHQDTCHFLREEKFWMMGTATQREGNSGGKIQ

SEQ ID NO: 550 - protein, 81 aa, Homo sapiens
SWGPLSFMDVFVDFTWEEWQLLDPAQKCLYRSVMLENYSNLVSLGYQHTKPDIIFKLEQGEELCMVQAQVPNQTCPNTVWK

SEQ ID NO: 551 - protein, 81 aa, Homo sapiens
SVAFEDVAVNFTQEEWALLSPSQKNLYRDVTLETFRNLASVGIQWKDQDIENLYQNLGIKLRSLVERLCGRKEGNEHRETF

SEQ ID NO: 552 - protein, 81 aa, Homo sapiens
LGPVTFEDVAVLFTEAEWKRLSLEQRNLYKEVMLENLRNLVSLAESKPEVHTCPSCPLAFGSQQFLSQDELHNHPIPGFHA

SEQ ID NO: 553 - protein, 81 aa, Homo sapiens
GTVTFEDVAVKFTQEEWNLLSEAQRCLYRDVTLENLALMSSLGCWCGVEDEAAPSKQSIYIQRETQVRTPMAGVSPKKAHP

SEQ ID NO: 554 - protein, 81 aa, Homo sapiens
SLEKVTFEDVAIDFTQEEWDMMDTSKRKLYRDVMLENISHLVSLGYQISKSYIILQLEQGKELWREGRVFLQDQNPDRESA

SEQ ID NO: 555 - protein, 81 aa, Homo sapiens
QGRLTFRDVAIEFSLAEWKFLNPAQRALYREVMLENYRNLEAVDISSKHMMKEVLSTGQGNREVIHTGTLQRHQSYHIGDF

SEQ ID NO: 556 - protein, 81 aa, Homo sapiens
SKESVSFKDVAVDFTQEEWGQLDSPQRALYRDVMLENYQNLLALGPPLHKPDVISHLERGEEPWSMQREVPRGPCPEWELK

SEQ ID NO: 557 - protein, 81 aa, Homo sapiens
LQEPVTFRDVAVDFTQEEWGQLDPTQRILYRDVMLETFGHLLSIGPELPKPEVISQLEQGTELWVAERGTTQGCHPAWEPR

SEQ ID NO: 558 - protein, 81 aa, Homo sapiens
TFKEAVTFKDVAVVFTEEELGLLDPAQRKLYRDVMLENFRNLLSVGNQPFHQDTFHFLGKEKFWKMKTTSQREGNSGGKIQ

SEQ ID NO: 559 - protein, 81 aa, Homo sapiens
CEASVSFEDVTVDFSREEWQQLDPAQRCLYRDVMLELYSHLFAVGYHIPNPEVIFRMLKEKEPRVEEAEVSHQRCQEREFG

SEQ ID NO: 560 - protein, 81 aa, Homo sapiens
AQGHVVFEDVAIYFSQEEWGHLDEAQRLLYRDVMLENLALLSSLGCCHGAEDEEAPLEPGVSVGVSQVMAPKPCLSTQNTQ

SEQ ID NO: 561 - protein, 81 aa, Homo sapiens
PVTFRDVTVIFTEAEWKRLSPEQRNLYKEVMLENYRNLLSLAEPKPEIYTCSSCLLAFSCQQFLSQHVLQIFLGLCAENHF

SEQ ID NO: 562 - protein, 81 aa, Homo sapiens
PKVPVAFDDVSIYFSTPEWEKLEEWQKELYKNIMKGNYESLISMDYAINQPDVLSQIQPEGEHNTEDQAGPEESEIPTDPS

SEQ ID NO: 563 - protein, 81 aa, Homo sapiens
SLKKVTFEDVAIDFTQEEWAMMDTSKRKLYRDVMLENISHLVSLGYQISKSYIILQLEQGKELWREGREFLQDQNPDRESA

SEQ ID NO: 564 - protein, 81 aa, Homo sapiens
QGTVTFEDVAVHFSWEEWGLLDEAQRCLYRDVMLENLALLTSLDVHHQKQHLGEKHFRSNVGRALFVKTCTFHVSGEPSTC

SEQ ID NO: 565 - protein, 81 aa, Homo sapiens
LVTFRDVAIDFSQEEWECLDPAQRDLYRDVMLENYSNLISLDLESSCVTKKLSPEKEIYEMESLQWENMGKRINHHLQYNG

SEQ ID NO: 566 - protein, 81 aa, Homo sapiens
RQAFLAFGDVTVDFTQKEWRLLSPAQRALYREVTLENYSHLVSLGILHSKPELIRRLEQGEVPWGEERRRRPGPCAGIYAE

SEQ ID NO: 567 - protein, 81 aa, Homo sapiens
QGRLTFRDVAIEFSLAEWKCLNPSQRALYREVMLENYRNLEAVDISSKCMMKEVLSTGQGNTEVIHTGTLQRHESHHIGDF

SEQ ID NO: 568 - protein, 81 aa, Homo sapiens
RESGKAPVTFDDITVYLLQEEWVLLSQQQKELCGSNKLVAPLGPTVANPELFRKFGRGPEPWLGSVQGQRSLLEHHPGKKQ

SEQ ID NO: 569 - protein, 81 aa, Homo sapiens
VQESVTFRDVAVFFSQDEWLHLDSAQRALYREVMLENYSILVSLGILFSKPKVISQLEQGEDPWMVESGVPQGAHLGWESL

SEQ ID NO: 570 - protein, 81 aa, Homo sapiens
DPEQVTFEDVVVGFSQEEWGQLKPAQRTLYRDVMLDTFRLLVSVGHWLPKPNVISLLEQEAELWAVESRLPQGVYPDLETR

SEQ ID NO: 571 - protein, 81 aa, Homo sapiens
MEGLVMFQDLSIDFSQEEWECLDAAQKDLYRDVMMENYSSLVSLGLSIPKPDVISLLEQGKEPWMVSRDVLGGWCRDSEFR

SEQ ID NO: 572 - protein, 81 aa, Homo sapiens
SQELVTFEDVAVYFIRKEWKRLEPAQRDLYRDVMLENYGNVFSLDRETRTENDQEISEDTRSHGVLLGRFQKDISQGLKFK

SEQ ID NO: 573 - protein, 81 aa, Homo sapiens
MLENYQNLVWLGLSISKSVISLLEKRKLPWIMAKEEIRGPLPGYFKVSEMTISQEPKAKTRTLFGKDVPGAEIKELSAKRA

SEQ ID NO: 574 - protein, 81 aa, Homo sapiens
AEGSVMFSDVSIDFSQEEWDCLDPVQRDLYRDVMLENYGNLVSMGLYTPKPQVISLLEQGKEPWMVGRELTRGLCSDLESM

SEQ ID NO: 575 - protein, 81 aa, Homo sapiens
MVQESVTFKDVAILFTQEEWGQLSPAQRALYRDVMLENYSNLVSLGLLGPKPDTFSQLEKREVWMPEDTPGGFCLDWMTMP

SEQ ID NO: 576 - protein, 81 aa, Homo sapiens
SYGSITFGDVAIDFSHQEWEYLSLVQKTLYQEVMMENYDNLVSLAGHSVSKPDLITLLEQGKEPWMIVREETRGECTDLDS

SEQ ID NO: 577 - protein, 81 aa, Homo sapiens
DSVAFEDVAINFTCEEWALLGPSQKSLYRDVMQETIRNLDCIGMIWQNHDIEEDQYKDLRRNLRCHMVERACEIKDNSQCG

SEQ ID NO: 578 - protein, 81 aa, Homo sapiens
PQESVTFKDVSVDFTQEEWYHVDPAQRSLYRDVMLENYSHLVSLGYQVSKPEVIFKLEQGEEPWISEGEIQRPFYPDWKTR

SEQ ID NO: 579 - protein, 81 aa, Homo sapiens
QGLLTFRDVAIEFSQEEWKCLDPAQRTLYRDVMLENYRNLVSLDISSKCMMKTFFSTGQGNTEAFHTGTLQRQASHHIGDF

SEQ ID NO: 580 - protein, 81 aa, Homo sapiens
SRSLENDGVCFTEQEWENLEDWQKELYRNVMESNYETLVSLKVLGQTEGEAELGTEMLGDLEEEGPGGAHPAGGVMIKQEL

SEQ ID NO: 581 - protein, 81 aa, Homo sapiens
VMFRDVAIDFSQEEWECLDSAQRDLYRDVMLENYSNLVSLDLPSRCASKDLSPEKNTYETELSQWEMSDRLENCDLEESNS

SEQ ID NO: 582 - protein, 81 aa, Homo sapiens
MGPLEFRDVAIEFSLEEWHCLDTAQQNLYRDVMLENYRHLVFLGIVVTKPDLITCLEQGKKPFTVKRHEMIAKSPVMCFHF

SEQ ID NO: 583 - protein, 81 aa, Homo sapiens
MNVMLENYKNLVFLAGIAVSKQDPITSLEQEKEPWNMKICEMVDESPAMCSSFTRDLWPEQDIKDSFQQVILRRHGKCEHE

SEQ ID NO: 584 - protein, 81 aa, Homo sapiens
EMGLLTFRDIAIEFSLAEWQCLDHAQQNLYRDVMLENYRNLVSLGIAVSKPDLITCLEQNKEPQNIKRNEMVAKHPVTCSH

SEQ ID NO: 585 - protein, 81 aa, Homo sapiens
MGPLTFMDVAIEFCLEEWQCLDIAQQNLYRNVMLENYRNLVFLGIAVSKPDLITCLEQEKEPWEPMRRHEMVAKPPVMCSH

SEQ ID NO: 586 - protein, 81 aa, Homo sapiens
MLENYRNLVFVGIAASKPDLITCLEQGKEPWNVKRHEMVAEPPVVCSYFARDLWPKQGKKNYFQKVILRRYKKCGCENLQL

SEQ ID NO: 587 - protein, 81 aa, Homo sapiens
QEPLSFKDVAVVFTEEELELLDSTQRQLYQDVMQENFRNLLSVGERNPLGDKNGKDTEYIQDEELRFFSHKELSSCKIWEE

SEQ ID NO: 588 - protein, 81 aa, Homo sapiens
ANVSLAFRDVSIDLSQEEWECLDAVQRDLYKDVMLENYSNLVSLGYTIPKPDVITLLEQEKEPWIVMREGTRNWFTDLEYK

SEQ ID NO: 589 - protein, 81 aa, Homo sapiens
QQGYVTFEDVAVYFSQEEWRLLDDAQRLLYRNVMLENFTLLASLGLASSKTHEITQLESWEEPFMPAWEVVTSAILRGSWQ

SEQ ID NO: 590 - protein, 81 aa, Homo sapiens
FQDSVAFEDVAVSFTQEEWALLDPSQKNLYRDVMQETFKNLTSVGKTWKVQNIEDEYKNPRRNLSLMREKLCESKESHHCG

SEQ ID NO: 591 - protein, 81 aa, Homo sapiens
YHGSVTFEDVAIAFSQQEWESLDSSQRGLYRDVMLENYRNLVSMGHSRSKPHVIALLEQWKEPEVTVRKDGRRWCTDLQLE

SEQ ID NO: 592 - protein, 81 aa, Homo sapiens
KSKEAVTFKDVAVVFSEEELQLLDLAQRKLYRDVMLENFRNVVSVGHQSTPDGLPQLEREEKLWMMKMATQRDNSSGAKNL

SEQ ID NO: 593 - protein, 81 aa, Homo sapiens
CEVSVSFEDVTVDFSREEWQQLDSTQRRLYQDVMLENYSHLLSVGFEVPKPEVIFKLEQGEGPWTLEGEAPHQSCSDGKFG

SEQ ID NO: 594 - protein, 81 aa, Homo sapiens
EMGVLTFRDVALEFSLEEWQCLDTAQQNLYRNVMLENYRNLVFVGIAASKPDLITCLEQGKEPWNVKRHEMVTEPPVVYSY

SEQ ID NO: 595 - protein, 81 aa, Homo sapiens
SQGRVTFEDVTVNFTQGEWQRLNPEQRNLYRDVMLENYSNLVSVGQGETTKPDVILRLEQGKEPWLEEEEVLGSGRAEKNG

SEQ ID NO: 596 - protein, 81 aa, Homo sapiens
FQEMVTFKDVAVVFTREELGLLDLAQRKLYQDVMLENFRNLLSVGYQPFKLDVILQLGKEDKLRMMETEIQGDGCSGHKNQ

SEQ ID NO: 597 - protein, 81 aa, Homo sapiens
TQGQVTFRDVAIEFSQEEWTCLDPAQRTLYRDVMLENYRNLASLGISCFDLSIISMLEQGKEPFTLESQVQIAGNPDGWEW

SEQ ID NO: 598 - protein, 81 aa, Homo sapiens
WSQNSVTFQEVAVDFSQEEWALLDPAQKNLYKDVMLENFRNLASVGYQLCRHSLISKVDQEQLKTDERGILQGDCADWETQ

SEQ ID NO: 599 - protein, 81 aa, Homo sapiens
VAFEDVAVNFTQEEWTLLDISQKNLFREVMLETFRNLTSIGKKWSDQNIEYEYQNPRRSFRSLIEEKVNEIKEDSHCGETF

SEQ ID NO: 600 - protein, 81 aa, Homo sapiens
RVTFKDVAVVFTKEELALLDKAQINLYQDVMLENFRNLMLVRDGIKNNILNLQAKGLSYLSQEVLHCWQIWKQRIRDLTVS

SEQ ID NO: 601 - protein, 81 aa, Homo sapiens
SPDSMTFEDIIVDFTQEEWALLDTSQRKLFQDVMLENISHLVSIGKQLCKSVVLSQLEQVEKLSTQRISLLQGREVGIKHQ

SEQ ID NO: 602 - protein, 81 aa, Homo sapiens
GTVTFEDVAVKFTQEEWNLLSEAQRCLYRDVTLENLALMSSLGCWCGVEDEAAPSKQSIYIQRETQVRTPVTGVSPKKAHP

SEQ ID NO: 603 - protein, 81 aa, Homo sapiens
EKGPLTFRDVAIEFSLEEWQCLDSAQQGLYRKVMLENYRNLVFLAGIALTKPDLITCLEQGKEPWNIKRHEMVAKPPVICS

SEQ ID NO: 604 - protein, 81 aa, Homo sapiens
EMGPLTFRDVTIEFSLEEWQCLDTVQQNLYRDVMLENYRNLVFLGMAVFKPDLITCLKQGKEPWNMKRHEMVTKPPVMRSH

SEQ ID NO: 605 - protein, 81 aa, Homo sapiens
QGLLTFRDVAIEFSQEEWKCLDPAQRTLYRDVMLENYRNLVSLDISSKCMMKEFSSTAQGNREVIHTGTLQRHESHHTGDF

SEQ ID NO: 606 - protein, 81 aa, Homo sapiens
PQEAVVFEDVAVYFTRIEWSCLAPDQQALYRDVMLENYGNLASLGFLVAKPALISLLEQGEEPGALILQVAEQSVAKASLC

SEQ ID NO: 607 - protein, 81 aa, Homo sapiens
QSCVTFEDVFVYFSREEWELLEEAQRFLYRDVMLENFALVATLGFWCEAEHEAPSEQSVSVEGVSQVRTAESGLFQKAHPC

SEQ ID NO: 608 - protein, 81 aa, Homo sapiens
FQELVTFRDVAIDFSRQEWEYLDPNQRDLYRDVMLENYRNLVSLGGHSISKPVVVDLLERGKEPWMILREETQFTDLDLQC

SEQ ID NO: 609 - protein, 81 aa, Homo sapiens
AQESVMFSDVSVDFSQEEWECLNDDQRDLYRDVMLENYSNLVSMGHSISKPNVISYLEQGKEPWLADRELTRGQWPVLESR

SEQ ID NO: 610 - protein, 81 aa, Homo sapiens
PKVPVTFDDVAVYFSELEWGKLEDWQKELYKHVMRGNYETLVSLDYAISKPDILTRIERGEEPCLDRWGQEKGNEVEVGRP

SEQ ID NO: 611 - protein, 81 aa, Homo sapiens
SQGLVSFKDVAVDFTQEEWQQLDPSQRTLYRDVMLENYSHLVSMGYPVSKPDVISKLEQGEEPWIIKGDISNWIYPDEYQA

SEQ ID NO: 612 - protein, 81 aa, Homo sapiens
GQLTFKDVAIEFSQEEWTCLDPAQKTLYRDVMLENYRNLVSLDISCKCVNTDLPPKGKNNMGEAFYTVKLERLESCDTVGL

SEQ ID NO: 613 - protein, 81 aa, Homo sapiens
KVPVTFVDIAVYFSEDEWKNLDEWQKELYNNLVKENYKTLMSLDAEGSVPKPDAPVQAEPREEPCVWEQRHPEEREIPMDP

SEQ ID NO: 614 - protein, 81 aa, Homo sapiens
FQGSVSFKDVTVGFTQEEWQHLDPSQRALYRDVMLENYSNLVSVGYCAHKPEVIFRLEQGEEPWRLEEEFPSQSFPEVWTA

SEQ ID NO: 615 - protein, 81 aa, Homo sapiens
RRGHLTFRDVAIEFSQEEWKCLDPVQKALYRDVMLENYRNLVSLGICLPDLSIISMMKQRTEPWTVENEMKVAKNPDRWEG

SEQ ID NO: 616 - protein, 81 aa, Homo sapiens
SKGPVMFRDVSIDFSQEEWECLDADQMNLYKEVMLENFSNLVSVGLSNSKPAVISLLEQGKEPWMVDRELTRGLCSDLESM

SEQ ID NO: 617 - protein, 81 aa, Homo sapiens
SQHLVTFEDVAVDFTQEEWTLLDQAQRDLYRDVMLENYKNLIILAGSELFKRSLMSGLEQMEELRTGVTGVLQELDLQLKT

SEQ ID NO: 618 - protein, 81 aa, Homo sapiens
MSKEAVTFKDVAVVFTEEELGLLDLAQRKLYRDVMLENFRNLLSVGHQPFHRDTFHFLREEKFWMMDIATQREGNSGGKIQ

SEQ ID NO: 619 - protein, 81 aa, Homo sapiens
MPQVTFNDVAIDFTHEEWGWLSSAQRDLYKDVMVQNYENLVSVAGLSVTKPYVITLLEDGKEPWMMEKKLSKGMIPDWESR

SEQ ID NO: 620 - protein, 81 aa, Homo sapiens
AGGSVSFSDVAVGFTQEEWQHLDSAQRTPYRDMMLENYSLLLSVGYCITKPEVVCKLEHGQVLWILEEESPSQSHLDCCID

SEQ ID NO: 621 - protein, 81 aa, Homo sapiens
AQELLTLEDVTVEFTWEEWQLLGPFQKDLYRDVMLEIYSNLLSMGYQVSKPDALSKLERGEEPWTMEDERHSRICPENNEV

SEQ ID NO: 622 - protein, 81 aa, Homo sapiens
VTFDDVAVEFTPEEWALLDTTQKYLYRDVMLENYMNLASVDFFFCLTSEWEIQPRTKRSSLQQGFLKNQIFTGIQMQTRSY

SEQ ID NO: 623 - protein, 81 aa, Homo sapiens
EKGPLTFRDVAIEFSLEEWQCLDTAQQDLYRKVMLENYRNLVFLAGIAVSKPDLITCLEQGKEPWNMKRHAMVDQPPVTYS

SEQ ID NO: 624 - protein, 81 aa, Homo sapiens
VHGSVTFRDVAIDFSQEEWECLQPDQRTLYRDVMLENYSHLISLGSSISKPDVITLLEQEKEPWMVVRKETSRRYPDLELK

SEQ ID NO: 625 - protein, 81 aa, Homo sapiens
MELLTFRDVTIEFSLEEWEFLNPAQQSLYRKVMLENYRNLVSLGLTVSKPELISRLEQRQEPWNVKRHETIAKPPAMSSHY

SEQ ID NO: 626 - protein, 81 aa, Homo sapiens
ALALVSFEDVVVTFTGEEWGHLDLAQRTLYQEVMLETCRLLVSLGHPVPKPELIYLLEHGQELWTVKRGLSQSTCAGEKAK

SEQ ID NO: 627 - protein, 81 aa, Homo sapiens
SVAFEDVAVTFTQEEWALLDPSQKNLCRDVMQETFRNLASIGKKWKPQNIYVEYENLRRNLRIVGERLFESKEGHQHGEIL

SEQ ID NO: 628 - protein, 81 aa, Homo sapiens
PQVSLTFEDVAVLFTWDEWRKLAPSQRNLYRDVMLENYRNLVSLGLSFTKPKVISLLQQGEDPWEVEKDSSGVSSLGCKST

SEQ ID NO: 629 - protein, 81 aa, Homo sapiens
MRDEVAEKEKADINVTLVFQGYENTPIMVCVDGIVFSKPDLVTCLEQRKKPWSMKHPGLTQHNIVHTGDKPYKCKDCGKIF

SEQ ID NO: 630 - protein, 81 aa, Homo sapiens
SLKKVTFEDVAIDFTQEEWAMMDTSKRKLYRDVMLENISHLVSLGYQISKSYIILQLEQGKELWQEGREFLQDQNPDRESA

SEQ ID NO: 631 - protein, 81 aa, Homo sapiens
LQGLLTFRDVAIEFSQEEWKCLDPAQRTLYRDVMLENYRNLVSLDTSSKCMMKMFSSTGQGNTEVVHTGTLQIHASHHIGD

SEQ ID NO: 632 - protein, 81 aa, Homo sapiens
FQEMVTFKDVAVVFTEEELGLLDSVQRKLYRDVMLENFRNLLLVAHQPFKPDLISQLEREEKLLMVETETPRDGCSGRKNQ

SEQ ID NO: 633 - protein, 81 aa, Homo sapiens
FQGPVTLKDVIVEFTKEEWKLLTPAQRTLYKDVMLENYSHLVSVGYHVNKPNAVFKLKQGKEPWILEVEFPHRGFPEDLWS

SEQ ID NO: 634 - protein, 81 aa, Homo sapiens
TTFKEAVTFKDVAVFFTEEELGLLDPAQRKLYQDVMLENFTNLLSVGHQPFHPFHFLREEKFWMMETATQREGNSGGKTIA

SEQ ID NO: 635 - protein, 81 aa, Homo sapiens
SLGSELFRDVAIVFSQEEWQWLAPAQRDLYRDVMLETYSNLVSLGLAVSKPDVISFLEQGKEPWMVERVVSGGLCPVLESR

SEQ ID NO: 636 - protein, 81 aa, Homo sapiens
AHALVTFRDVAIDFSQKEWECLDTTQRKLYRDVMLENYNNLVSLGYSGSKPDVITLLEQGKEPCVVARDVTGRQCPGLLSR

SEQ ID NO: 637 - protein, 81 aa, Homo sapiens
IQDSVVFEDVAVDFTQEEWALLDLAQRNLYRDVMLENFQNLASLGYPLHTPHLISQWEQEEDLQTVKRELIQGIFMGEHRE

SEQ ID NO: 638 - protein, 81 aa, Homo sapiens
AQEPVTFRDVAIYFSREEWACLEPSQRALYRDVMLDNFSSVAALGFCSPRPDLVSRLEQWEEPWVEDRERPEFQAVQRGPR

SEQ ID NO: 639 - protein, 81 aa, Homo sapiens
QDTVAYEDLSEDYTQKKWKGLALSQRALHWNMMLENDRSMASLGRNMMESSELTPKQEIFKGSESSNSTSGGLFGVVPGGT

SEQ ID NO: 640 - protein, 81 aa, Homo sapiens
SRTLVTFKDVFVDFTREEWKLLDTAQQIVYRNVMLENYKNLVSLGYQLTKPDVILRLEKGEEPWLVEREIHQETHPDSETA

SEQ ID NO: 641 - protein, 81 aa, Homo sapiens
RRGHLAFRDVAIEFPQEEWKCLDPAQRTLYREVMVENYRNLVFLGICLPDLSVISMLEQRRDPRNLQSEVKIANNPGGREC

SEQ ID NO: 642 - protein, 81 aa, Homo sapiens
PRGSTFFSSVTVAFAQERWRCLVSTPRDRFKEGIPGKSRSLVLLGLPVSQPGMNSQLEQREGAWMLEGEDLRSPSPGWKII

SEQ ID NO: 643 - protein, 81 aa, Homo sapiens
AHELVMFRDVAIDVSQEEWECLNPAQRNLYKEVMLENYSNLVSLGLSVSKPAVISSLEQGKEPWMVVREETGRWCPGTWKT

SEQ ID NO: 644 - protein, 81 aa, Homo sapiens
AQVSVTFDDVAVTFTKEEWGQLDLAQRTLYQEVMLENCGLLVSLGCPVPKAELICHLEHGQEPWTRKEDLSQDTCPGDKGK

SEQ ID NO: 645 - protein, 81 aa, Homo sapiens
TQGPLKFMDVAIEFSQEEWKCLDPAQRTLYRDVMLENYRNLVSLGICLPDLSVTSMLEQKRDPWTLQSEEKIANDPDGREC

SEQ ID NO: 646 - protein, 81 aa, Homo sapiens
SYEGSVSFRDVAIDFSREEWRHLDPSQRNLYRDVMLETYSHLLSVGYQVPEAEVVMLEQGKEPWALQGERPRQSCPGEKLW

SEQ ID NO: 647 - protein, 81 aa, Homo sapiens
WLQEPMTFKDVAVEFTQEEWMMLDSAQRSLYRDVMLENYRNLTSVEYQLYRLTVISPLDQEEIRNMKKRIPQAICPDQKIQ

SEQ ID NO: 648 - protein, 81 aa, Homo sapiens
VASEDVAVNFTLEEWALLDPSQKKLYRDVMRETFRNLACVGKKWEDQSIEDWYKNQGRILRNHMEEGLSESKEYDQCGEAF

SEQ ID NO: 649 - protein, 81 aa, Homo sapiens
TQESLTLEDVAVEFSWEEWQLLDTAQKNLYRDVMVENYNHLVSLGYQTSKPDVLSKLAHGQEPWTTDAKIQNKNCPGIGKV

SEQ ID NO: 650 - protein, 81 aa, Homo sapiens
SLEEWQCLDTSQQNLYRNVMLDNYRNLVFLGIAVSKPDLITCLEQGKEPCNMKRHAMVAKPPVVCSHFAQDLWPKQGLKDS

SEQ ID NO: 651 - protein, 81 aa, Homo sapiens
HLTFKDVAIEFSQEEWKCLEPVQKALYKDVMLENYRNLVFLGISPKCVIKELPPTENSNTGERFQTVALERHQSYDIENLY

SEQ ID NO: 652 - protein, 81 aa, Homo sapiens
AQGLVTFRDVAIEFSLEEWKCLEPAQRDLYREVTLENFGHLASLGLSISKPDVVSLLEQGKEPWMIANDVTGPWCPDLESR

SEQ ID NO: 653 - protein, 81 aa, Homo sapiens
SQESLTFKDVFVDFTLEEWQQLDSAQKNLYRDVMLENYSHLVSVGHLVGKPDVIFRLGPGDESWMADGGTPVRTCAGEDRP

SEQ ID NO: 654 - protein, 81 aa, Homo sapiens
SQGSVSFRDVTVGFTQEEWQHLDPAQRTLYRDVMLENYSHLVSVGYCIPKPEVILKLEKGEEPWILEEKFPSQSHLELINT

SEQ ID NO: 655 - protein, 81 aa, Homo sapiens
KPGTVSFADVAVYFSPEEWGCLRPAQRALYRDVMQETYGHLGALGFPGPKPALISWMEQESEAWSPAAQDPEKGERLGGAR

SEQ ID NO: 656 - protein, 81 aa, Homo sapiens
VTFADVAVNFTKEEWTLLDPAQRNLYRDVMLENSRNLAFIDWATPCKTKDATPQPDILPKRTFPEANRVCLTSISSQHSTL

SEQ ID NO: 657 - protein, 81 aa, Homo sapiens
SLGPVSFKDVAVDFTQEEWQQLDPEQKITYRDVMLENYSNLVSVGYHIIKPDVISKLEQGEEPWIVEGEFLLQSYPDEVWQ

SEQ ID NO: 658 - protein, 81 aa, Homo sapiens
MGPLQFRDVAIEFSLEEWHCLDTAQWNLYRDVMLENYRHLVFLVCGKAFNSSSNLTTHKKIHTGEKPYRCEECGKAFKRSS

SEQ ID NO: 659 - protein, 81 aa, Homo sapiens
MGPLTFRDVAIEFSLKEWQCLDTAQRNLYRNVMLENYRNLVFLGITVSKPDLITCLEQGKEAWSMKRHEIMVAKPTVMCSH

SEQ ID NO: 660 - protein, 81 aa, Homo sapiens
PKVPVTFDDVAVHFSEQEWGNLSEWQKELYKNVMRGNYESLVSMDYAISKPDLMSQMERGERPTMQEQEDSEEGETPTDPS

SEQ ID NO: 661 - protein, 81 aa, Homo sapiens
RVTFKDIAVIFTKEELAVLDKAQINLYQDVMLENFRNFISVDGIKNNILNLQGKGLIYLSQEELHCWKIWKQRIRDLSVSQ

SEQ ID NO: 662 - protein, 81 aa, Homo sapiens
RNMIPQDNENPPQQGEANQNDSVAFEDVAVNFTPDEWALLDPSQKNLYREVMQETLRNLASIEVLWKRDSLKVKVISMEKF

SEQ ID NO: 663 - protein, 81 aa, Homo sapiens
MAHLMMFRDVAVDFSQEEWECLDLEQRDLYRDVMLENYSNMVSLGFCIYQPEAFSLLEKGKEPWKILRDETRGPCPDMQSR

SEQ ID NO: 664 - protein, 81 aa, Homo sapiens
FQKPVTFEDVAVNFTQEEWDCLDASQRVLYQDVMSETFKNLTSVARIFLHKPELITKLEQEEEQWRETRVLQASQAGPPFF

SEQ ID NO: 665 - protein, 81 aa, Homo sapiens
QAEVTFEDVAVYLSREEWGRLGPAQRGLYRDVMLETYGNLVSLGVGPAGPKPGVISQLERGDEPWVLDVQGTSGKEHLRVN

SEQ ID NO: 666 - protein, 81 aa, Homo sapiens
HQELVRFRDVAVVFSPEEWDHLTPEQRNLYKDVMLDNCKYLASLGNWTYKAHVMSSLKQGKEPWMMEREVTGDPCPACQPA

SEQ ID NO: 667 - protein, 81 aa, Homo sapiens
QEGVNFKIVTVDFTREEQGTWNPAQRTLDRDVILENHRDLVSWDLATAVGKKDSTSKQRIFDEEPANGVKIERFTRDDPWL

SEQ ID NO: 668 - protein, 81 aa, Homo sapiens
TQVRLTFRDVAIEFSQEEWKCLDPAQRILYRDVMLENYWNLVSLGLCHFDMNIISMLEEGKEPWTVKSCVKIARKPRTPEC

SEQ ID NO: 669 - protein, 81 aa, Homo sapiens
TEGRVVFEDVAIYFSQEEWGHLDEAQRLLYRDVMLENLALLSSLGSWHGAEDEEAPSQQGFSVGVSEVTASKPCLSSQKVH

SEQ ID NO: 670 - protein, 81 aa, Homo sapiens
PQDLVTFKDVAIDFSQEEWQWMNPAQKRLYRSMMLENYQSLVSLGLCISKPYVISLLEQGREPWEMTSEMTRSPFSDWESI

SEQ ID NO: 671 - protein, 81 aa, Homo sapiens
YQELVTFRDVAVDFSQEEWDCLDSSQRHLYSNVMLENYRILVSLGLCFSKPSVILLLEQGKAPWMVKRELTKGLCSGWEPI

SEQ ID NO: 672 - protein, 81 aa, Homo sapiens
AQGSVSFNDVTVDFTQEEWQHLDHAQKTLYMDVMLENYCHLISVGCHMTKPDVILKLERGEEPWTSFAGHTCLEENWKAED

SEQ ID NO: 673 - protein, 81 aa, Homo sapiens
IQSQISFEDVAVDFTLEEWQLLNPTQKNLYRDVMLENYSNLVFLEVWLDNPKMWLRDNQDNLKSMERGHKYDVFGKIFNSS

SEQ ID NO: 674 - protein, 81 aa, Homo sapiens
MLENYRNLVFLGIAAFKPDLIIFLEQGKEPWNMKRHEMVEEPPVICSHFSQEFWPEQGIEDSFQKMILRRYDKCGHENLHL

SEQ ID NO: 675 - protein, 81 aa, Homo sapiens
ASVTVTFDDVALYFSEQEWEILEKWQKQMYKQEMKTNYETLDSLGYAFSKPDLITWMEQGRMLLISEQGCLDKTRRTTSPP

SEQ ID NO: 676 - protein, 81 aa, Homo sapiens
SQESLTFKDVFVDFTLEEWQQLDSAQKNLYRDVMLENYSHLVSVGYLVAKPDVIFRLGPGEESWMADGGTPVRTCAGEDRP

SEQ ID NO: 677 - protein, 81 aa, Homo sapiens
MLENYWNLVSLGLCHFDMNIISMLEEGKEPWTVKSCVKIARKPRTPECVKGVVTDIPPKCTIKDLLPKEKSSTEAVFHTVV

SEQ ID NO: 678 - protein, 81 aa, Homo sapiens
MGPLTFRDVAIEFSLKEWQCLDTAQRNLYRNVMLENYRNLVFLDLITCLEQGKEAWSMKRHEIMVAKPTVMCSHFAQDLWP

SEQ ID NO: 679 - protein, 81 aa, Homo sapiens
MASPSPPPESKEWDYLDPAQRSLYKDVMMENYGNLVSLDVLNRDKDEEPTVKQEIEEIEEEVEPQGVIVTRIKSEIDQDPM

SEQ ID NO: 680 - protein, 81 aa, Homo sapiens
PQASVCFEDVAMAFTQEEWEQLDLAQRTLYREVTLETWEHIVSLGLFLSKSDVISQLEQEEDLCRAEQEAPRDGVSLLLPR

SEQ ID NO: 681 - protein, 81 aa, Homo sapiens
PQASVCFEDVAMAFTQEEWEQLDLAQRTLYREVTLETWEHIVSLGLFLSKSDVISQLEQEEDLCRAEQEAPRGTRPSKKQR

SEQ ID NO: 682 - protein, 81 aa, Homo sapiens
QGRLTFRDVAIEFSLAEWKCLNPSQRALYREVMLENYRNLEAVDISSKRMMKEVLSTGQGNTEVIHTGTLQRYQSYHIGDF

SEQ ID NO: 683 - protein, 81 aa, Homo sapiens
MGLLAFRDVALEFSPEEWECLDPAQRSLYRDVMLENYRNLISLGLAMSKPELIICLEARKEPWNVNTEKTARHSVETRFRH

SEQ ID NO: 684 - protein, 81 aa, Homo sapiens
SQGLVTFRDVALDFSQEEWEWLKPSQKDLYRDVMLENYRNLVWLGLSISKPNMISLLEQGKEPWMVERKMSQGHCAGSHSV

SEQ ID NO: 685 - protein, 81 aa, Homo sapiens
KDHSCPQNLDLFVCSGLEPHTPSVGSQESVTFQDVAVDFTEKEWPLLDSSQRKLYKDVMLENYSNLTSLGKASAISPLIHP

SEQ ID NO: 686 - protein, 81 aa, Homo sapiens
RKRKAKESGMALLQGLLTFRDVAIEFSQEEWKCLDPAQRTLYRDVMLENYRNLVSLDTSSKCMMKMFSSTGQGNTEVVHTG

SEQ ID NO: 687 - protein, 81 aa, Homo sapiens
LQEPVKDVHVARGFSYRKSVHQIPAQRDLYRDFRKENVGNVVSLGSAVSTSNKITRLEQRKEPWTLGLHSSNKRSILRSNY

SEQ ID NO: 688 - protein, 81 aa, Homo sapiens
KKKPVTFEDVAVNFTQEEWDCLDASQRVLYQDVMSETFKNLTSVARIFLHKPELITKLEQEEEQWREFVHLPNTEGLSEGK

SEQ ID NO: 689 - protein, 81 aa, Homo sapiens
GYSGQLAGVAVSAGSPPIPTSSMWSPMVRLGGFSPELQHLPQTLLHRCPLGQPCMGVLTFRDVALEFSLEEWQCLDTAQQN

SEQ ID NO: 690 - protein, 81 aa, Homo sapiens
SPEVTQPDEDLHLQAEETQLVKESVTFKDVAIDFTLEEWRLMDPTQRNLHKDVMLENYRNLVSLGLAVSKPDMISHLENGK

SEQ ID NO: 691 - protein, 81 aa, Homo sapiens
MLENYRNLVSLGLTVSKPELISRLEQRQEPWNVKRHETIAKPPAMSSHYTEDLLPEQCMQDSFQKVILRRYGSCGLEDLHL

SEQ ID NO: 692 - protein, 81 aa, Homo sapiens
PLSFKDVAVVFTEEELELLDSTQRQLYQDVMQENFRNLLSVGDKNGKDTEYIQDEELRFFSHKELSSCKIWEEVAGELPGS

SEQ ID NO: 693 - protein, 81 aa, Homo sapiens
QDSVTFDDVAVEFTPEEWALLDTTQKYLYRDVMLENYMNLASVDFFFCLTSEWEIQPRTKRSSLQQGFLKNQIFTGIQMTR

SEQ ID NO: 694 - protein, 81 aa, Homo sapiens
ASGSVTFEDVAVYFSWEEWDLLDEAQKHLYFDVMLENFALTSSLGLISSWSHVVAQLGLGEVPSVLHRMFMTPASARWDQR

SEQ ID NO: 695 - protein, 81 aa, Homo sapiens
MLENYCHLISVGCHMTKPDVILKLERGEEPWTSFAGHTCLEENWKAEDFLVKFKEHQEKYSRSVVSINHKKLVKEKSKIYE

SEQ ID NO: 696 - protein, 81 aa, Homo sapiens
SQELVTFEDVAVYFIRKEWKRLEPAQRDLYRDVMLENYGNVSSLDRETRTENDQEISEDTRSHGVLLGRFQKDISQGLKFK

SEQ ID NO: 697 - protein, 81 aa, Homo sapiens
PLAMAEMDPTQGRVVFEDVAIYFSQEEWGHLDEAQRLLYRDVMLENLALLSSLGKALTLAQCPGLGCVTPFYPKAALRFPQ

SEQ ID NO: 698 - protein, 81 aa, Homo sapiens
WSQNSVTFQEVAVDFSQEEWGLLDPAQKNLYKDVMLENFRNLASVGYQLCRHSLISKVDQEQLKTDERGILQGDCADWETQ

SEQ ID NO: 699 - protein, 81 aa, Homo sapiens
QAMVKIEDMAVSLILEEWGCQNLARRNLSRDNRQENYGSAFPQGGENRNENEESTSKAETSEDSASRGETTGRSQKEFGEK

SEQ ID NO: 700 - protein, 81 aa, Homo sapiens
MVQNYENLVSVGLSVTKPYVIMLLEDGKEPWMMEKKLSKDWESRWENKELSTKKDIYDEDSPQPVTMEKVVKQSYEFSNSN

SEQ ID NO: 701 - protein, 81 aa, Homo sapiens
YHIIKPDVISKLEQGEEPWIVEGEFLLQSYPDEVWQTDDLIERIQEEENKPSRQTVFIETLIEERGNVPGKTFDVETNPVP

SEQ ID NO: 702 - protein, 81 aa, Homo sapiens
MLETYNHLVSLEIPSSKPKLIAQLERGEAPWREERKCPLDLCPESKPEIQLSPSCPLIFSSQQALSQHVWLSHLSQLFSSL

SEQ ID NO: 703 - protein, 81 aa, Homo sapiens
MAAPDLAHGGHVSRDSVCLHEEQTQAAGMVAGWLINCYQDAVTFDDVAVDFTQEEWTLLDPSQRDLYRDVMLENYENLASV

SEQ ID NO: 704 - protein, 81 aa, Homo sapiens
TQGQLSFSDVAIEFSQEEWKCLDPGQKALYRDVMLENYRNLVSLGICLPDLSVTSMLEQKRDPWTLQSEVKIINNPDGREC

SEQ ID NO: 705 - protein, 81 aa, Homo sapiens
MAEGSVMFSDVSIDFSQEEWDCLDPVQRDLYRDVMLENYGNLVSMGKGICTSDSQFSSGMSPSSTVNFSAAFQDFTLLSLK

SEQ ID NO: 706 - protein, 81 aa, Homo sapiens
MPQVTFNDVAIDFTHEEWGWLSSAQRDLYKDVMVQNYENLVSVGLSVTKPYVITLLEDGKEPWMMEKKLSKGMIPDWESRW

SEQ ID NO: 707 - protein, 81 aa, Homo sapiens
DMGPLTFRDVAIEFSLEEWQCLDTAQQDLYRKVMLENYRNLVFLAGIAVSKPDLVTCLEQGKDPWNMKGHSTVVKPPGFLP

SEQ ID NO: 708 - protein, 81 aa, Homo sapiens
KLYRDVMVENFKNLVAVGHLPFQPDMVSQLEAEEKLWMMETETQRSSKHQNKMETLQKFALKYLSNQELSCWQIWKQVASE

SEQ ID NO: 709 - protein, 81 aa, Homo sapiens
DMGPLTFRDVAIEFSLEEWQCLDTAQQDLYRKVMLENYRNLVFLGIAVSKPDLVTCLEQGKDPWNMKGHSTVVKPPGFLPP

SEQ ID NO: 710 - protein, 81 aa, Homo sapiens
SITFKDLAVRFSEEEWRLLEEGQREFYRDVMRENYETLVSVGTAELLPLSAFLSPSEPGRAVGGGSHADEGQEPAGCGDPQ

SEQ ID NO: 711 - protein, 81 aa, Homo sapiens
VHGSVTFRDVAIDFSQEEWECLQPDQRTLYRDVMLENYSHLISLAGSSISKPDVITLLEQEKEPWMVVRKETSRRYPDLEL

SEQ ID NO: 712 - protein, 81 aa, Homo sapiens
MLENYRNLIFLGIVVSKQDLITSMSSHYTEDLLPEQCMQDSFQKVILRRYGSCGLEDLHLRKDGENVGECKDQKEIYNGLN

SEQ ID NO: 713 - protein, 81 aa, Homo sapiens
MELVTFRDVAIEFSPEEWKCLDPAQQNLYRDVMLENYRNLVSLAICSPFSQDLSPVQGIEDSFHKLILKRYEKCGHENLQL

SEQ ID NO: 714 - protein, 81 aa, Homo sapiens
SLELVSFEEVAVHFTWEEWQDLDDAQRTLYRDVMLETYSSLVSLGHYITKPEMIFKLEQGAEPWIVEETPNLRLSAVQIID

SEQ ID NO: 715 - protein, 81 aa, Homo sapiens
SQELVTFEDVAVYFIRKEWKRLKPAQRDLYRDVMLENYGNVFSLDRETRTENDQEISEDTRSHGVLLGRFQKDISQGLKFK

SEQ ID NO: 716 - protein, 81 aa, Homo sapiens
DSVTFEDVAVDFTQEEWTLLDQTQRNLYRDVMLENYKNLVAVDWESHINTKWSAPQQNFLQGKTSSVVEMVRFRRYNLLSS

SEQ ID NO: 717 - protein, 81 aa, Homo sapiens
ARGKSKSKAPITFGDLAIYFSQEEWEWLSPIQKDLYEDVMLENYRNLVSLGLSFRRPNVITLLEKGKAPWMVEPVRRRRAP

SEQ ID NO: 718 - protein, 81 aa, Homo sapiens
RVQSCVTFEDVFVYFSREEWELLEEAQRFLYRDVMLENFALVATLAFIFPVPCSCAVGGGRKPWVPDRADITAATVKETYR

SEQ ID NO: 719 - protein, 81 aa, Homo sapiens
AVTFKDVAVVFSREELRLLDLTQRKLYRDVMVENFKNLVAVGSKHQNKMETLQKFALKYLSNQELSCWQIWKQVASELTRC

SEQ ID NO: 720 - protein, 81 aa, Homo sapiens
MLENYGNLVSVGLLSSKPKLITQLEQGAEPWTEVREAPSGTHAVEDYWFETKMSALKQSTSEASVLGERTKSVMMEKGLDW

SEQ ID NO: 721 - protein, 81 aa, Homo sapiens
GQVNFEDVFVYFSQEEWVLLDEAQRLLYRDVMLENFALMASLGCWHGMEDEEIPFEQSFSIGMSQIRIPKGGPSTQKAYPC

SEQ ID NO: 722 - protein, 80 aa, Homo sapiens
MWAPREQLLGWTAEALPAKDSAWPWEEKPRYLGPVTFEDVAVLFTEAEWKRLSLEQRNLYKEVMLENLRNLVSLVLSYQI

SEQ ID NO: 723 - protein, 81 aa, Homo sapiens
TGGDVTFSDVAIDFSHEEWACLDSAQRDLYKDVMVQNYENLVSVGLSVTKPYVIMLLEDGKEPWMMEKKLSKDWESRWENK

SEQ ID NO: 724 - protein, 81 aa, Homo sapiens
AVLTDRAQVSVTFDDVAVTFTKEEWGQLDLAQRTLYQEVMLENCGLLVSLAPLQTHPGSIRCILQSNQVDTLIKIPEHTEH

SEQ ID NO: 725 - protein, 81 aa, Homo sapiens
QGLVTFRDVALDFSQEEWEWLKPSQKDLYRDVMLENYRNLVWLGDGCSCCSTLRTTVTAEASSSSSSIQASFHSLALPLMS

SEQ ID NO: 726 - protein, 81 aa, Homo sapiens
SQGLLTFRDVAIEFSQEEWKCLDPAQRTLYRDVMLENYRNLVSLGLISRDLCYLRKTPRRQRKGARDGSSSGILDFQRCGY

SEQ ID NO: 727 - protein, 81 aa, Homo sapiens
LLTFRDVAIEFSQEEWKCLDPAQRTLYRDVMLENYRNLVSLGIFSKCEIKELPPKKESNTGEIFQTVMLERHESHDIQDFC

SEQ ID NO: 728 - protein, 81 aa, Homo sapiens
GTVTFEDVAVKFTQEEWNLLSEAQRCLYRDVTLENLALMSSLGCWCGVEDEAAPSKQSIYIQRETQVRTPMTGVSPKKAHP

SEQ ID NO: 729 - protein, 81 aa, Homo sapiens
FQAKLTFEDVAVLLSQDEWDRLCPAQRGLYRNVMMGTYGNVVSLGLPGSKPDIISQLERGEDPWVLDRKGAKKSQGLWSDY

SEQ ID NO: 730 - protein, 81 aa, Homo sapiens
WEQLDPSQRILYMDVMLENYSNLLSVEVWKADDQMERDHRNPDEQARQFLILKNQTPIEERGDLFGKALNLNTDFVSLRQV

SEQ ID NO: 731 - protein, 81 aa, Homo sapiens
QLTFRDVAIEFSQDEWKCLNSTQRTLYRDVMLENYRNLVSLDLSRNCVIKELAPQQEGNPGEVFHTVTLEQHEKHDIEEFC

SEQ ID NO: 732 - protein, 81 aa, Homo sapiens
QEGVNFKIVTVDFTREEQGTCNPAQRTLDRDVILENHRDLVSWDLATAVGKKDSTSKQRIFDEEPANGVKIERFTRDDPWL

SEQ ID NO: 733 - protein, 81 aa, Homo sapiens
LFQLLVTFRDVAIDFSQEEWECLDPAQRDLYRDVMLENYSNLISLDLESSCVTKKLSPEKEIYEMESLQWENMGKRINHHL

SEQ ID NO: 734 - protein, 81 aa, Homo sapiens
YQEFVTFEDVAVHLTREEWGYLDPVQRDLYREVMLENYGNVVSLGFPISKPDGISQLEQDLQVFDLETKTREVLRDDCSDG

SEQ ID NO: 735 - protein, 81 aa, Homo sapiens
DSVTFEDVAVDFTQEEWTLLDQTQRNLYRDVMLENYKNLVAVDWESHINTKWSAPQQNFLQGKTSSVVEMSLTVSPRLECS

SEQ ID NO: 736 - protein, 81 aa, Homo sapiens
SKAPITFGDLAIYFSQEEWEWLSPIQKDLYEDVMLENYRNLVSLGLSFRRPNVITLLEKGKAPWMVEPVRRRRAPGWTTMM

SEQ ID NO: 737 - protein, 81 aa, Homo sapiens
KVPVTFVDIAVYFSEDEWKNLDEWQKELYNNLVKENYKTLMSLDAEGSVPKPDAPVQAEPYSCPECGKSFGVRKSLIIHHR

SEQ ID NO: 738 - protein, 81 aa, Homo sapiens
SQAPVTFEDMAMYLTREDWRPLDAAQRDLYRDVMQENYGNVVSLDFEIRSENEVNPKQEISEDVQFGTTSERPAENAEGNP

SEQ ID NO: 739 - protein, 81 aa, Homo sapiens
MLENYSLLLSVGYCITKPEVVCKLEHGQVLWILEEESPSQSHLDCCIDDDLMEKRQENQDQHLQKVDFVNNKTLTMDRNGV

SEQ ID NO: 740 - protein, 81 aa, Homo sapiens
QASVCFEDVAMAFTQEEWEQLDLAQRTLYREVTLETWEHIVSLDWKATLEENRLNSEKDRAREELSHHVEVYRSGPEEPPS

SEQ ID NO: 741 - protein, 81 aa, Homo sapiens
MAFTQLTFRDVAIEFSQDEWKCLNSTQRTLYRDVMLENYRNLVSLEYYPMWEHRKEPWTIESQVRVARKPKGWEWIKGVKT

SEQ ID NO: 742 - protein, 81 aa, Homo sapiens
VQGLLTFRDVAIEFSQEEWKCLDPAQRTLYRDVMLENYRNLVSLEFWSVIPAKVQWCHLRSLQPPLPRFKQFSCLSLPSTW

SEQ ID NO: 743 - protein, 81 aa, Homo sapiens
AQGLVTFADVAIDFSQEEWACLNSAQRDLYWDVMLENYSNLVSLDLESAYENKSLPTEKNIHEIWASKRNSDRRSKSLGRN

SEQ ID NO: 744 - protein, 81 aa, Homo sapiens
TQGQLSFSDVAIEFSQEEWKCLDPGQKALYRDVMLENYRNLVSLGICLPDLSVNSMLEQKRDPWTLQSEVKIVNNPDGREC

SEQ ID NO: 745 - protein, 81 aa, Homo sapiens
TLPQVGNSGDQAGATVLRMVRPQDTVAYEDLSVDYTQKKWKSLTLSQRALQWNMMPENHHSMASLDGETGTEEELIPKHHS

SEQ ID NO: 746 - protein, 81 aa, Homo sapiens
PQGLLTFRDVAIEFSQEEWKCLDPAQRTLYRDVMLENYRNLVSLGSCCAVEVGLDLLGSRHPPRPPKKLGLQAPTPVPNYW

SEQ ID NO: 747 - protein, 81 aa, Homo sapiens
PQGSLTFRDVAVEFSQEEWKCLDPVQKALYRDVMLENYRNLGFLGLCLPDLNIISMLEQGKEPWTVVSQVKIARNPNCGEC

SEQ ID NO: 748 - protein, 81 aa, Homo sapiens
TQGQVTFRDVAIEFSQEEWTCLDPAQRTLYRDVMLENYRNLASLAGISCFDLSIISMLEQGKEPFTLESQVQIAGNPDGWE

SEQ ID NO: 749 - protein, 81 aa, Homo sapiens
PKVPMTFDDVAVQFSEQVWGKLEDWQKELCKHVMRGNCEMLVSLDYAISKSEVLSQIEQGKEPCNWHRPDPKIPDVPVDPS

SEQ ID NO: 750 - protein, 81 aa, Homo sapiens
AQGTVTFEDVAVNFTWEEWNLLSEAQRCLYRDVTLENLALISSLGMTFLHVCQALDSLRQVIHPPTSASQSAGITGSHSIP

SEQ ID NO: 751 - protein, 81 aa, Homo sapiens
SQGLVTFGDVAVDFSQEEWEWLNPIQRNLYRKVMLENYRNLAWLGLCVSKPDVISSLEQGKEPWTVKRKMTRAWCPDLKAV

SEQ ID NO: 752 - protein, 81 aa, Homo sapiens
AEPLHPVCTCGRHFRRPEPCREPLASPIQDSVAFEDVAVNFTQEEWALLDSSQKNLYREVMQETCRNLASVEIISYRDCVK

SEQ ID NO: 753 - protein, 81 aa, Homo sapiens
AQESVMFSDVSVDFSQEEWECLNDDQRDLYRDVMLENYSNLVSMAGHSISKPNVISYLEQGKEPWLADRELTRGQWPVLES

SEQ ID NO: 754 - protein, 81 aa, Homo sapiens
SKAPITFGDLAIYFSQEEWEWLSPIQKDLYEDVMLENYRNLVSLGLSFRRPNVITLLEKGKAPWMVEPVRRRRAPELVTVA

SEQ ID NO: 755 - protein, 81 aa, Homo sapiens
GYVTFEDVAVYFSQEEWRLLDDAQRLLYRNVMLENFTLLASLGCWHGAEAEEAPEQIASVGLLSSNIQQHQKQHCGEKPLK

SEQ ID NO: 756 - protein, 81 aa, Homo sapiens
RAEEAVTFKDVAVIFTEEELGLLDPAQRKLYRDVMLENFRNLLSVGHQPFHGDTFHFLREEKFWVMGTTSQREGNLGTILL

SEQ ID NO: 757 - protein, 81 aa, Homo sapiens
QVSVTFDDVAVTFTKEEWGQLDLAQRTLYQEVMLENCGLLVSLGDKGKPKTTEPTTCEPALSEGISLQGQVTQGNSVDSQL

SEQ ID NO: 758 - protein, 81 aa, Homo sapiens
AQQIVYRNVMLENYKNLVSLGYQLTKPDVILRLEKGEEPWLVEREIHQETHPDSETAFEIKSSVSSRSIFKDKQSCDIKME

SEQ ID NO: 759 - protein, 81 aa, Homo sapiens
MEEMLSFWDVAIDFSPEEKECLDPAQWDLYRDVMLENFSHLDFLGLAVAKPYLVTFLEQNQGSSGVKSQTSATIPPGTTGN

SEQ ID NO: 760 - protein, 81 aa, Homo sapiens
MLENYSHLISVGYCITKPKVISKLEKGEEPWSLEDEFLNQRYPGYFKVDHIKGIREKQEKPLWQEIFISDADKTLSKEGQK

SEQ ID NO: 761 - protein, 81 aa, Homo sapiens
MLETYGHLLSVGNQIAKPEVISLLEQGEEPWSVEQACPQRTCPEWVRNLESKALIPAQSIFEEEQSHGMKLERYIWDDPWF

SEQ ID NO: 762 - protein, 81 aa, Homo sapiens
MELLTFKDVAIEFSPEEWKCLDISQQNLYRDVMLENYRNLVSLGVTISNPDLVTSLEQRKEPYNLKIHETAARPPVISLQV

SEQ ID NO: 763 - protein, 81 aa, Homo sapiens
VTFKDVAVTFTREEWRQLDLAQRTLYREVMLETCGLLVSLGDRAQVHTREPTTYPPVLSERAFLRGSLTLESSTSSDSRLG

SEQ ID NO: 764 - protein, 81 aa, Homo sapiens
KISIVTFKDVAVNFSQEEWRYLDPSQKLLYKRDVMLENYRNLVSLGNDVSKPDVISCLEQGSEPWIRKTPPDLRKYPRISY

SEQ ID NO: 765 - protein, 81 aa, Homo sapiens
SVVFEDVDVNFTQEEWALLDPSQKNLYRDVMQETFRNLASVGKKWKDQKIEDEYKNPRRNLSLRKWSWSLYARQTLGLDSP

SEQ ID NO: 766 - protein, 81 aa, Homo sapiens
MGLLAFRDVALEFSPEEWECLDPAQRSLYRDVMLENYRNLISLGLAMSKPELIICLEARKEPWNVNTEKTAKHSVATRFRH

SEQ ID NO: 767 - protein, 81 aa, Homo sapiens
PQASVCFEDVAMAFTQEEWEQLDLAQRTLYREVTLETWEHIVSLGLFLSKSDVISQLEQEEDLCRAEQEAPREKGMLPGSF

SEQ ID NO: 768 - protein, 81 aa, Homo sapiens
CYQDSVTFDDLAVDFTPEEWTLLDPTQRNLYRDVMLENYKNLATVGYQLFKPSLISWLEQEESRTVQRGDFQASEWKVQLK

SEQ ID NO: 769 - protein, 81 aa, Homo sapiens
VTFEDVAVYLSREEWGRLGPAQRGLYRDVMLETYGNLVSLALGTRTEYKELTSQETFGEEDPQGSEPVEACDHISKSEGSL

SEQ ID NO: 770 - protein, 81 aa, Homo sapiens
MFKEAVTFKDVAVAFTEEELGLLGPAQRKLYRDVMVENFRNLLSVGHPPFKQDVSPIERNEQFWIMTTATRRQGNLGEKNQ

SEQ ID NO: 771 - protein, 81 aa, Homo sapiens
SQGLVTFKDVAVCFSQDQWSDLDPTQKEFYGEYVLEEDCGIVVSLSFPIPRPDEISQVREEEPWVPDIQEPQETQEPEILS

SEQ ID NO: 772 - protein, 81 aa, Homo sapiens
SQEQVSFKDVCVDFTQEEWYLVDPAQKILYRDVILENYSNLVSVGYCITKPEVIFKIEQGEEPWILEKGFPSQCHPERKWK

SEQ ID NO: 773 - protein, 81 aa, Homo sapiens
SYGSITFGDVAIDFSHQEWEYLSLVQKTLYQEVMMENYDNLVSLGHSVSKPDLITLLEQGKEPWMIVREETRGECTAELQS

SEQ ID NO: 774 - protein, 81 aa, Homo sapiens
PKVPVTFDDVAVYFSEQEWGKLEDWQKELYKHVMRGNYETLVSLDYAISKPEVLSQIEQGKEPCNWRRPGPKIPDVPVDPS

SEQ ID NO: 775 - protein, 81 aa, Homo sapiens
RQAEQIPVTFPRDVAVFSQEEWRKLDPLQKLYDVMLENYPTLVSVGQKPIRIISLEQLKPWGIFLRVSSSDKQLDFLLQAS

SEQ ID NO: 776 - protein, 81 aa, Homo sapiens
MELVTFRDVAIEFSPEEWKCLDPARQNLYRDVMLENYRNLVSLGFVISNPDLVTCLEQIKEPCNLKIHETAAKPPAICSPF

SEQ ID NO: 777 - protein, 81 aa, Homo sapiens
MDVAIEFSLEEWQCLDTAQRNVYRHVMLENYRNLVFLALCSRFAQDLWLEQNIKDSFQKVTLSRYGKYGHKNLQLRKGCKS

SEQ ID NO: 778 - protein, 81 aa, Homo sapiens
MLENYNSIVSLGLPVPQPDVIFQLKRGDKPWMVDLHGSEEREWPESVSLDWETKPEIHDASDKKSEGSLRECLGRQSPLCP

SEQ ID NO: 779 - protein, 80 aa, Homo sapiens
MLREEAAQKRKGKEPGMALPQGRLTFRDVAIEFSLAEWKCLNPSQRALYREVMLENYRNLEAVETGFHCVSQDGLNLLTS

SEQ ID NO: 780 - protein, 81 aa, Homo sapiens
MLDNFSSVAALGFCSPRPDLVSRLEQWEEPWVEDRERPEFQAVQRGPRPGARKSADPKRPCDHPAWAHKKTHVRRERAREG

SEQ ID NO: 781 - protein, 81 aa, Homo sapiens
MLENYGNMVSLGFPFPKPPLISHLEREVDPCVQDPQDRESLSCSYPVSADKMWPENEKASSQQEIFENGEAYWMKFNSLLK

SEQ ID NO: 782 - protein, 81 aa, Homo sapiens
EKGPLTFRDVAIEFSLEEWQCLDTAQQDLYRKVMLENYRNLVFLGIAVSKPDLITCLEQGKEPWNMKRHAMVDQPPVTYSH

SEQ ID NO: 783 - protein, 81 aa, Homo sapiens
EKGPLTFRDVAIEFSLEEWQCLDSAQQGLYRKVMLENYRNLVFLGIALTKPDLITCLEQGKEPWNIKRHEMVAKPPVICSH

SEQ ID NO: 784 - protein, 81 aa, Homo sapiens
KRKGKEPGMALPQGRLTFRDVAIEFSLAEWKCLNPSQRALYREVMLENYRNLEAVESHFVTQAGVQWCDPGSLQPLPPRFK

SEQ ID NO: 785 - protein, 81 aa, Homo sapiens
KMTKFQEAVTFKDVAVVFSREELRLLDLTQRKLYRDVMVENFKNLVAVDMVSQLEAEEKLWMMETETQRSSKHQNKMETLQ

SEQ ID NO: 786 - protein, 81 aa, Homo sapiens
LVTFRDVALDFSQEEWEWLKPSQKDLYRDVMLENYRNLVWLDWESWCEIEELSPKWFIDEDEISQEMVMERLASHGLECSS

SEQ ID NO: 787 - protein, 81 aa, Homo sapiens
FPREPICPFEEKTKIGTMVEDHRSNSYQDSVTFDDVAVEFTPEEWALLDTTQKYLYRDVMLENYMNLASVADKKLQWMETL

SEQ ID NO: 788 - protein, 81 aa, Homo sapiens
ARDLVMFRDVAVDFSQEEWECLNSYQRNLYRDVILENYSNLVSLGCSISKPDVITLLEQGKEPWMVVRDEKRRWTLDLESR

SEQ ID NO: 789 - protein, 81 aa, Homo sapiens
VGLQYHGSVTFEDVAIAFSQQEWESLDSSQRGLYRDVMLENYRNLVSMAGHSRSKPHVIALLEQWKEPEVTVRKDGRRWCT

SEQ ID NO: 790 - protein, 81 aa, Homo sapiens
ESCSGFSGFCASPIEESHGALISSCNSRTMTDGLVTFRDVAIDFSQEEWECLDPAQRDLYVDVMLENYSNLVSLGKVICLK

SEQ ID NO: 791 - protein, 81 aa, Homo sapiens
MLETYSHLLSVGYQVPKPEVVMLEQGKEPWALQGERPRHSCPGEKLWDHNQHRKIIGYKPASSQDQKIYSGEKSYECAEFG

SEQ ID NO: 792 - protein, 81 aa, Homo sapiens
MLENYSNLVSVGYHVSKPDVIFKLEQGEEPWIVEEFSNQNYPDIDDALEKNKEIQDKHLTQTVFFSNKTLITERENVFGKT

SEQ ID NO: 793 - protein, 81 aa, Homo sapiens
QDTVAYEDLSVDYTQKKWKSLTLSQRALQWNMMPENHHSMASLGENMMKGSELTPKQEFFKGSESSNRTSGGLFGVVPGAA

SEQ ID NO: 794 - protein, 81 aa, Homo sapiens
QGHVTFEDIAVYFSQEEWGLLDEAQRCLYHDVMLENFSLMASVAGLSQSNHKDSCSQQKVPVSLNNCVAQCSPDDGHYDPK

SEQ ID NO: 795 - protein, 81 aa, Homo sapiens
GELTSSCGSKTMANVSLAFRDVSIDLSQEEWECLDAVQRDLYKDVMLENYSNLVSLGYTIPKPDVITLLEQEKEPWIVMRE

SEQ ID NO: 796 - protein, 81 aa, Homo sapiens
LKSMVTFEDVAVYFSQEEWELLDAAQRHLYHSVMLENLELVTSLGNALSQHDVFTCSVEADLPNCFPNWLHHFTSLSAVYK

SEQ ID NO: 797 - protein, 81 aa, Homo sapiens
MLAIGLSLCDHLSQDVFCLHESKFEEERMVAGWLTNYSQDSVTFEDVAVDFTQEEWTLLDQTQRNLYRDVMLENYKNLVAV

SEQ ID NO: 798 - protein, 81 aa, Homo sapiens
MVEGEEEWQQLNPAQKTLHRDVMLETYNHLVSVGCSGIKPDVIFKLEHGKDPWIIESELSRWIYPDRVKGLESSQQIISGE

SEQ ID NO: 799 - protein, 81 aa, Homo sapiens
CWGLLSFKDISMGFTWDEWQLLDSTQKYLYRDVILENYHNLISVGYHGTKPDLIFKLEQGEDPWIINAKISRQSCPDGWEE

SEQ ID NO: 800 - protein, 81 aa, Homo sapiens
WEYLNSDQRDLYRDVMLENYTNLVSLDFNFTTESNKLSSEKRNYEVNAYHQETWKRNKTFNLMRFIFRTDPQYTIEFGRQQ

SEQ ID NO: 801 - protein, 81 aa, Homo sapiens
VTFEDVTIIFTWEEWKFLDSSQKRLYREVMWENYTNVMSVENWNESYKSQEEKFRYLEYENFSCWQGWWNAGAQMYENQNY

SEQ ID NO: 802 - protein, 81 aa, Homo sapiens
QLSFSDVAIEFSQEEWKCLDPGQKALYRDVMLENYRNLVSLDFSLLAWDARVFRVEAWRASGGAEEPTGPNFVGNDSPLPS

SEQ ID NO: 803 - protein, 81 aa, Homo sapiens
TVLTMDHELVTLRDVVINFSQEEWEYLDSAQRNLYWDVMMENYSNLLSLDLESRNETKHLSVGKDIIQNTGSQWEVMESSK

SEQ ID NO: 804 - protein, 81 aa, Homo sapiens
RSLENDGVCFTEQEWENLEDWQKELYRNVMESNYETLVSLSSSDSPASASRVAEITEVLGQTEGEAELGTEMLGDLEEEGP

SEQ ID NO: 805 - protein, 81 aa, Homo sapiens
GWLTNYSQDSVTFEDVAVDFTQEEWTLLDQTQRNLYRDVMLENYKNLVAVDWESHINTKWSAPQQNFLQGKTSSVVEMGWV

SEQ ID NO: 806 - protein, 81 aa, Homo sapiens
PMPGPQEAVVFEDVAVYFTRIEWSCLAPDQQALYRDVMLENYGNLASLALISLLEQGEEPGALILQVAEQSVAKASLCTDS

SEQ ID NO: 807 - protein, 81 aa, Homo sapiens
FWQYNLVLPSQDPALPQKEQEKMTKFQEMVTFKDVAVVFTREELGLLDLAQRKLYQDVMLENFRNLLSVGYQPFKLDVILQ

SEQ ID NO: 808 - protein, 81 aa, Homo sapiens
AQGSLSFGDVAVGFTRKEWQQLDLEQRTLYQDVMLEIYSHLLSVGCQVSKPAVISSLEQGKEPWMEEEEIRTWSFPEEVWQ

SEQ ID NO: 809 - protein, 81 aa, Homo sapiens
VKIEEVADVAVSFILEEWGHLDQSQKSLYRDDRKENYGSITSMGYESRDNMELIVKQISDDSESHWVAPEHTERSVPQDPD

SEQ ID NO: 810 - protein, 81 aa, Homo sapiens
MIESQEEWQQLNPAQKTLHRDVMLETYNHLVSVGCSGIKPDVIFKLEHGKDPWIIESELSRWIYPDRVKGLESSQQIISGE

SEQ ID NO: 811 - protein, 81 aa, Homo sapiens
YLGPVTFEDVAVLFTEAEWKRLSLEQRNLYKEVMLENLRNLVSLESKPEVHTCPSCPLAFGSQQFLSQDELHNHPIPGFHA

SEQ ID NO: 812 - protein, 81 aa, Homo sapiens
QGLLTFRDVAIEFSQEEWKCLDPAQRTLYRDVMLENYRNLVSLGISSKCTMKEFSSTAQGNTEVIHTGTLQRHERHHIGDF

SEQ ID NO: 813 - protein, 81 aa, Homo sapiens
VHGSVTFRDVAIDFSQEEWECLQPDQRTLYRDVMLENYSHLISLAGSSISKPDVITLLEQEKEPWIVIWSQNMDLRKYLQK

SEQ ID NO: 814 - protein, 81 aa, Homo sapiens
MDVAIEFSVEEWQCLDTAQQNLYRNVMLENYRNLVFLGIAVSKPDLITCLEQGKEPWNMERHEMVAKPPGMCCYFAQDLRP

SEQ ID NO: 815 - protein, 81 aa, Homo sapiens
SASRVAETTGTRPHSRDSVTFADVAVNFTKEEWTLLDPAQRNLYRDVMLENSRNLAFIDWATPCKTKDATPQPDILPKRTF

SEQ ID NO: 816 - protein, 81 aa, Homo sapiens
FQELVTFRDVAIDFSRQEWEYLDPNQRDLYRDVMLENYRNLVSLEMRSRSVARVGLKLLVSSDPPTSAFQNAGIIGVSHHA

SEQ ID NO: 817 - protein, 81 aa, Homo sapiens
AQGTVTFEDVAVNFTWEEWNLLSEAQRCLYRDVTLENLALISSLGMTFLHVCQALDSLRQVIHPPTSASQSAGITGVSHCA

SEQ ID NO: 818 - protein, 81 aa, Homo sapiens
YQDAVTFDDVAVDFTQEEWTLLDPSQRDLYRDVMLENYENLASVGHHLFQPSVIYWLEQEEELRAGRRAVLQEWRLKTKGP

SEQ ID NO: 819 - protein, 81 aa, Homo sapiens
MLENYQNLLALGPPLHKPDVISHLERGEEPWSMQREVPRGPCPEWELKAVPSQQQGICKEEPAQEPIMERPLGGAQAWGRQ

SEQ ID NO: 820 - protein, 81 aa, Homo sapiens
MATGLLRAKKEEEWRLLSPAQRTLHREVMLETYNHLVSLEIPSSKPKLIAQLERGEAPWREERKCPLDLCPAESKPEIQLS

SEQ ID NO: 821 - protein, 81 aa, Homo sapiens
LLTFRDVAIEFSQEEWKCLDPAQRTLYRDVMLENYRNLVSLVRRSEVCCTDIWAEVIVADISSKCMLKTLSSTGQGNTEVI

SEQ ID NO: 822 - protein, 81 aa, Homo sapiens
MLENYFNLTSVGCQVPKPEVIFSLEQEEPCMLDGEIPSQSRPDGDIGFGPLQQRMSEEVSFQSEININLFTRDDPYSILEE

SEQ ID NO: 823 - protein, 81 aa, Homo sapiens
LESVTFRDVTVDFTQEEWQQLEPAQKDLYRDVMLENYRNLVSLDWETRPEMKELDPKNDISEDKLSVVGEATGGPTRNGAR

SEQ ID NO: 824 - protein, 81 aa, Homo sapiens
DGLVTFRDVAIDFSQEEWECLDPAQRDLYVDVMLENYSNLVSLDLESKTYETKKIFSENDIFEINFSQWEMKDKSKTLGLE

SEQ ID NO: 825 - protein, 81 aa, Homo sapiens
PRGSTFFSSVTVAFAQEGWRCLVSTPRDRFKEGIPGKSRSLVLLGLPVSQPGMNSQLEQREGAWMLEGEDLRSPSPGWKII

SEQ ID NO: 826 - protein, 81 aa, Homo sapiens
MLENYSNLVSVGYCVHKPEVIFRLQQGEEPWKQEEEFPSQSFPEMGFHHVPVAGLKLLSSSDPPALASQSGRITGMSHSIP

SEQ ID NO: 827 - protein, 80 aa, Homo sapiens
MALSQGLFTFKDVAIEFSQEEWECLDPAQRALYRDVMLENYRNLLSLDEDNIPPEDAFYSIRELRETLVFLIPYSSKICL

SEQ ID NO: 828 - protein, 81 aa, Homo sapiens
REEAAQKRKGKESGMALPQGRLTFRDVAIEFSLAEWKFLNPAQRALYREVMLENYRNLEAVDISSKHMMKEVLSTGQGNRE

SEQ ID NO: 829 - protein, 81 aa, Homo sapiens
MNVMLENYKNLVFLGIAVSKQDPITSLEQEKEPWNMKICEMVDESPGYMCRMCSYVFFFYQRPLARARHKRFFSTSDTEKT

SEQ ID NO: 830 - protein, 81 aa, Homo sapiens
MEPLTFRDVAIEFSPEEWKCLDPAQQNLYRDVMLENYRNLVSLAMCSHFTQDFLPVQGIEDSFHKLILRRYEKFSSLISSC

SEQ ID NO: 831 - protein, 81 aa, Homo sapiens
NLQREVIESSHQAQWLTPVIPALWEAKADGASQMFQDPVACEDVAVNFTQEEWALLDISQRKLYREVMLETFRNLTSIGVS

SEQ ID NO: 832 - protein, 81 aa, Homo sapiens
EMGPLTFMDVAIEFCLEEWQCLDIAQQNLYRNVMLENYRNLVFLGIAVSKPDLITCLEQEKEPWEPMRRHEMVAKPPVMCS

SEQ ID NO: 833 - protein, 81 aa, Homo sapiens
EDYTQKKWKGLALSQRALHWNMMLENDRSMASLAGRNMMESSELTPKQEIFKGSESSNSTSGGLFGVVPGGTETGDVCEDT

SEQ ID NO: 834 - protein, 81 aa, Homo sapiens
MLENYRNLVSLGICLPDLSIISMMKQRTEPWTVENEMKVAKNPDRWEGIKDINTGRSCAVRSKAGNKPITNQLGLTFQLPL

SEQ ID NO: 835 - protein, 81 aa, Homo sapiens
QGLLTFRDVAIEFSQEEWKCLDPAQRTLYRDVMLENYRNLVSLGQGNTEVIHTGTLQRQASYHIGAFCSQEIEKDIHDFVF

SEQ ID NO: 836 - protein, 81 aa, Homo sapiens
QGRLTFRDVAIEFSLEEWKCLNPAQRALYRAVMLENYRNLEFVDISSKCMMKEFSSTAQGNTEVIHTGTLQRHESHHIRDF

SEQ ID NO: 837 - protein, 81 aa, Homo sapiens
PQKSVTFEDVAVYFTQAEWDGLSPAQRTLYRDVMLENYGNVASLGFPLLKPAVISQLEGGSELGGSSPLAAGTGLQGLQTV

SEQ ID NO: 838 - protein, 81 aa, Homo sapiens
MLENYGNVASLGFPLLKPAVISQLEGGIDIQTDNDLTKEMYEGKENVSFELQRDFSQETDFSEASLLEKQQEVHSAGNIKK

SEQ ID NO: 839 - protein, 81 aa, Homo sapiens
SVAFEDVAVNFTHEEWALLGPSQKNLYRDVMRETIRNLNCIGMKWENQNIDDQHQNLRRNPRLSETWLQNFILIHYGHLVA

SEQ ID NO: 840 - protein, 81 aa, Homo sapiens
PHLLVTFRDVAIDFSQEEWECLDPAQRDLYRDVMLENYSNLISLEPARTREEQHNLPVPKAGSVNLAAGFGHSRSQTGCGS

SEQ ID NO: 841 - protein, 81 aa, Homo sapiens
PPPAPLLAPRPGETRPGCRKPGTVSFADVAVYFSPEEWGCLRPAQRALYRDVMQETYGHLGALGESPGSEPPPPSPGSQGR

SEQ ID NO: 842 - protein, 81 aa, Homo sapiens
MLENYRNLASLGISCFDLSIISMLEQGKEPFTLESQVQIAGNPDGWEWIKAVITALSSEFVMKDLLHKGKSNTGEVFQTVM

SEQ ID NO: 843 - protein, 81 aa, Homo sapiens
SQESVTFQDVAVDFTEEEWPLLDSSQRKLYKDVMLENYSNLTSLGYQVGKPSLISHLEQEEEPRTEERGAHQGACADWETP

SEQ ID NO: 844 - protein, 81 aa, Homo sapiens
QGLLTFRDVAIEFSQEEWKCLDPAQRTLYRDVMLENYRNLVSLDTGFLLFCLADLKLLPSGDPSTSASETAAITDISSKCM

SEQ ID NO: 845 - protein, 81 aa, Homo sapiens
MLETYSSLVSLGHYITKPEMIFKLEQGAEPWIVEETPNLRLSAVQIIDDLIERSHESHDRFFWQIVITNSNTSTQERVELG

SEQ ID NO: 846 - protein, 81 aa, Homo sapiens
SLELVSFEEVAVHFTWEEWQDLDDAQRTLYRDVMLETYSSLVSLGHYITKPEMIFKLEQGAEPWIVEETPNLRLSGGSKKQ

SEQ ID NO: 847 - protein, 81 aa, Homo sapiens
MLENYRNLVFVGIAASKPDLITCLEQGKEPWNVKRHEMVTEPPVVYSYFAQDLWPKQGKKNYFQKVILRTYKKCGRENLQL

SEQ ID NO: 848 - protein, 81 aa, Homo sapiens
MLENFGNLTALGYPVPKPALISLLERGDMAWGLEAQDDPPAERTKNVCKDVETNIDSESTLIQGISEERDGMMSHGQLKSV

SEQ ID NO: 849 - protein, 81 aa, Homo sapiens
MGLLTFRDVAVEFSLEEWEHLEPAQKNLYQDVMLENYRNLVSLGLVVSKPDLLTEHCTEASFQKVISRRHGSCDLENLHLR

SEQ ID NO: 850 - protein, 81 aa, Homo sapiens
RLIRDQDLGASLLPAAPQWRQLDSTQKEQYWDLMLETYGKMVSGGISHPKSDLTNSIEFGEELAGIYLHVNEKIPRPTCIG

SEQ ID NO: 851 - protein, 81 aa, Homo sapiens
MPQVTFNDVAIDFTHEEWGWLSSAQRDLYKDVMVQNYENLVSVAGLSVTKPYVITLLEDGKEPWMMEKKLSKDWESRWENK

SEQ ID NO: 852 - protein, 81 aa, Homo sapiens
AQELLTLEDVTVEFTWEEWQLLGPFQKDLYRDVMLEIYSNLLSMGYQVSKPDALSKLERGEEPWTMEDERHSRICSENNEV

SEQ ID NO: 853 - protein, 81 aa, Homo sapiens
PPCPFPFGNWGRLSPVLHTSRHADTVVFSAAHTAGFLVFKPELISRLEQGEEPWVLDLQGAEGTEAPRTSKTDSTIRTENE

SEQ ID NO: 854 - protein, 81 aa, Homo sapiens [sequence omitted]

SEQ ID NO: 855 - protein, 81 aa, Homo sapiens
DSVTFEDVAVDFTQEEWTLLDQTQRNLYRDVMLENYKNLVAVDWESHINTKWSAPQQNFLQGKTSSVVEMRCGLAVLPRLV

SEQ ID NO: 856 - protein, 81 aa, Homo sapiens
SQEPVTFADVAVVFTPEEWVFLDSTQRSLYRDVMLENYRNLASVADQLCKPNALSYLEERGEQWTTDRGVLSDTCAEPQCQ

SEQ ID NO: 857 - protein, 81 aa, Homo sapiens
QGLLTFRDVAIEFSQEEWKCLDPAQRTLYRDVMLENYRNLVSLDGVFALVAQAGVQWHNLGSPPPPPPGFKRFSRLSLRSC

SEQ ID NO: 858 - protein, 81 aa, Homo sapiens
TGLSISKPNMISLLEQGKEPWMVERKMSQGHCADWESWCEIEELSPKWFIDEDEISQEMVMERLASHGLECSSFREAWKYK

SEQ ID NO: 859 - protein, 81 aa, Homo sapiens
QGLLTFRDVAIEFSQEEWKCLDPAQRTLYRDVMLENYRNLVSLGHDLILFFLFPRWSFCSCCPGWSAVAQSRLTTTSASRV

SEQ ID NO: 860 - protein, 81 aa, Homo sapiens
MYLIRESHASGSSSVTSSCSLPSESPTLRQWRPCSCLPHPKPGVISQLERGDEPWVLDVQGTSGKEHLRVNSPALGTRTEY

SEQ ID NO: 861 - protein, 81 aa, Homo sapiens
QPLPGTPRQKQKSRRIEKVLEWLFISQEQPKITKSWGPLSFMDVFVDFTWEEWQLLDPAQKCLYRSVMLENYSNLVSLGYQ

SEQ ID NO: 862 - protein, 81 aa, Homo sapiens
QSTGSARTVQWPGRRREEWGLLNVTQKGLYRDVMLENFALVSSLGLAPSRSPVFTQLEDDEQSWVPSWVDVTPVSRAEARR

SEQ ID NO: 863 - protein, 81 aa, Homo sapiens
MLDTFRLLVSVGHWLPKPNVISLLEQEAELWAVESRLPQGVYPDLETRPKVKLSVLKQGISEEISNSVILVERFLWDGLWY

SEQ ID NO: 864 - protein, 81 aa, Homo sapiens
MGPLTFMDVAIEFSLEEWQCLDTAQRNVYRHVMLENYRNLVFLDLITCLEQGKEPWNMKRHEMVVAKHSALCSRFAQDLWL

SEQ ID NO: 865 - protein, 81 aa, Homo sapiens
PQGLVTFEDVAVDFTQEEWQYLNPPQRTLYRDVMLETYSNLVFVGQQVTKPNLILKLEVEECPAEGKIPFWNFPVCQVDEQ

SEQ ID NO: 866 - protein, 80 aa, Homo sapiens
MELLTFRDVAIEFSPEEWKCLDPAQQNLYRDVMLENYRNLVSLELHTEHHQRTDGHFISLGEGQVYHAVMAIPASIGVWV

SEQ ID NO: 867 - protein, 81 aa, Homo sapiens
AHALVTFRDVAIDFSQKEWECLDTTQRKLYRDVMLENYNNLVSLAGYSGSKPDVITLLEQGKEPCVVARDVTGRQCPGLLS

SEQ ID NO: 868 - protein, 81 aa, Homo sapiens
MLENYSNLVAVGYQASKPDALFKLEQGEQLWTIEDGIHSGACSDIWKVDHVLERLQSESLVNRRKPCHEHDAFENIVHCSK

SEQ ID NO: 869 - protein, 81 aa, Homo sapiens
PQGLLTFRDVAIEFSQEEWKCLDPAQRTLYRDVMLENYRNLVSLDFRSVTQAKVQWCHLGSLQPPLPRFKQFSCLSLPSSW

SEQ ID NO: 870 - protein, 81 aa, Homo sapiens
EFSLEEWQCLDTAQQDLYRKVMLENYRNLVFLAGIAVSKPDLVTCLEQGKDPWNMKGHSTVVKPPGGDCSIFLMEHQGDVT

SEQ ID NO: 871 - protein, 81 aa, Homo sapiens
QMDLVTFDSVAVEFTQEEWTLLDPAQRNLYSDVMLENYKNLSSVGYQLFKPSLISWLEEEEELSTLPRVLQEWKMCLKTKG

SEQ ID NO: 872 - protein, 81 aa, Homo sapiens
DTVAYEDLSVDYTQKKWKSLTLSQRALQWNMMPENHHSMASLAGENMMKGSELTPKQEFFKGSESSNRTSGGLFGVVPGAA

SEQ ID NO: 873 - protein, 81 aa, Homo sapiens
QEPVTFKDVVVEFSKEEWGQLDSAVKNLYRNVMLENFRNLNSLRKAHLLSKPFESLKLESKKKRWIMEKEIPRKTIFDMKS

SEQ ID NO: 874 - protein, 81 aa, Homo sapiens
SCESITLKDVAVNFSRGEWKKLEPFQKELYKEVLLENLRNLEFLDFPVSKLELISQLKWVELPWLLEEVSKSSRLDESALD

SEQ ID NO: 875 - protein, 81 aa, Homo sapiens
GMVTFEDTAVSLTWEEWERLDPARRDFCRESAQKDSGSTVPPSLESRVENKELIPMQQILEEAEPQGQLQEAFQGKRPLFS

SEQ ID NO: 876 - protein, 81 aa, Homo sapiens
ETQPGLVTIKNLAVDFRQQLHPAQKNFCKNGIWENNSDLGSAGHCVAKPDLVSLLEQEKEPWMVKRELTGSLFSGQRSVHE

SEQ ID NO: 877 - protein, 81 aa, Homo sapiens
IRDQDLGASLLPAAPQEQWRQLDSTQKEQYWDLMLETYGKMVSGAGISHPKSDLTNSIEFGEELAGIYLHVNEKIPRPTCI

SEQ ID NO: 878 - protein, 81 aa, Homo sapiens
QLQETMTFKDVEVTFSQDEWGWLDSAQRNLYRDVMLENYRNMASLVGPFTKPALISWLEAREPWGLNMQAAQPKGNPVAAP

SEQ ID NO: 879 - protein, 81 aa, Homo sapiens
SSLTTHQRTHTREQPYEYNESFYQNPNFTKCQRDNIEETLVNILKAQKPSPSWTRSIAETTQVGGSVSLKDVTVDFTQEEW

SEQ ID NO: 880 - protein, 81 aa, Homo sapiens
IRDQDLGASLLSAAPQEQWRQLDSTQKEQYWDLMLETYGKMVSGAGISHPKSDLTNSIEFGEELAGIYLHVNEKIPRPTCI

SEQ ID NO: 881 - protein, 81 aa, Homo sapiens
IRDQDLGASLLPAAPQEQWRQLDSTQKEQYWDLMLETYGKMVSGGISHPKSDLTNSIEFGEELAGILSLFFTKELTPERHT

SEQ ID NO: 882 - protein, 81 aa, Homo sapiens
TESCESITLKDVAVNFSRGEWKKLEPFQKELYKEVLLENLRNLEFLDFPVSKLELISQLKWVELPWLLEEVSKSSRLGSVI

SEQ ID NO: 883 - protein, 81 aa, Homo sapiens
GHQEPASTSFHPPRIQEEWGLLDRSQKELYWDAMLEKYGTVVSLGLPPHQPEAQAQSELGMLLTGTGVCRSLRSETRLEPA

SEQ ID NO: 884 - protein, 81 aa, Homo sapiens
SWGPLSFMDVFVDFTWEEWQLLDPAQKCLYRSVMLENYSNLVSLGYQHTKPDIIFKLEQGEELCLVQAQVPNQTCPILKAG

SEQ ID NO: 885 - protein, 81 aa, Homo sapiens
SQSLLTFEEVAMYFSQEEWELLDPTQKALYNDVMQENYETVISLALFVLPKPKVISCLEQGEEPWVQVSPEFKDSAGKSPT

SEQ ID NO: 886 - protein, 81 aa, Homo sapiens
DFAQCTSPVPTLPQVGNSGDQAGATVLRMVRPQDTVAYEDLSVDYTQKKWKSLTLSQRALQWNMMPENHHSMASLGWSTMA

SEQ ID NO: 887 - protein, 81 aa, Homo sapiens
SQEPVTFADVAVVFTPEEWVFLDSTQRSLYRDVMLENYRNLASVADQLCKPNALSYLEERGEQWTTDRGVLPDTCAEPQCQ

SEQ ID NO: 888 - protein, 81 aa, Homo sapiens
VKIEEAADVAVSFILEEWGHLDQSQKSLYRDDRKENYGSITSMGYESRDNMELIVKQISDDSESHWVAPEHTERSVPQDPD

SEQ ID NO: 889 - protein, 81 aa, Pan paniscus
MAKRPGPPGSREMGLLTFRDIAIEFSLAEWQCLDLAQQNLYRDVMLENYRNLVSLGIAVSKPDLITCLEQNKEPQNIKRNE

SEQ ID NO: 890 - protein, 81 aa, Pan paniscus
MAKRPGPPGSREMGLLTFRDIAIEFSLEEWQCLDCAQRNLYRDVMLENYRNLVSLGIAVSKPDLITCLEQNKESQNIKRNK

SEQ ID NO: 891 - protein, 81 aa, Pan paniscus
EPGSLHSGHQEQLNRKRERRPLPKNARPSPWVPALADEWNTLDQEVTTTRLPAGSQEPVKDVHVARGFSYRKSVHQIPAQR

SEQ ID NO: 892 - protein, 81 aa, Pan paniscus
NTLDQEVTTTRLPAGSQEPVKDVHVARGFSYRKSVHQIPAQRDLYRDFRKENVGNVVSLGSAVSTSNKITRLEQRKEPWTL

SEQ ID NO: 893 - protein, 81 aa, Pan paniscus
GPVSFKDVAVDFTQEEWQQLDPDEKIAYGDVMLENYSHLVSVGYDYHQAKHHHGVEVKEVEQGEEPWIMEGEFPCQHSPDL

SEQ ID NO: 894 - protein, 81 aa, Pan paniscus
MNTLQGPVSFKDVAVDFTQEEWQQLDPDEKIAYGDVMLENYSHLVSVGYDYHQAKHHHGVEVKEVEQGEEPWIMEGEFPCQ

SEQ ID NO: 895 - protein, 81 aa, Pan paniscus
GPVSFKDVAVDFTQEEWQQLDPDEKIAYGDVMLENYSHLVSVGYDYHQAKHHHGVEVKEVEQGEEPWIMEGEFPCQHSPVQ

SEQ ID NO: 896 - protein, 81 aa, Pan paniscus
KENLEDISGWGLPEARSKESVSFKDVAVDFTQEEWGQLDSPQRALYRDVMLENYQNLLALGPPLHKPDVISHLERGEEPWS

SEQ ID NO: 897 - protein, 81 aa, Pan paniscus
KENLEDISGWGLPEARSKESVSFKDVAVDFTQEEWGQLDSPQRALYRDVMLENYQNLLALEWELKAVPSQQQGICKEEPAQ

SEQ ID NO: 898 - protein, 81 aa, Pan paniscus
MLVAAAAERNKDPILHVLQQYLDPAQRGVRVLEVASGSGQHAAHFARAFPLAEWQPSDVDQRCLDRNPEWGLRDTALLEDL

SEQ ID NO: 899 - protein, 81 aa, Pan paniscus
VLQQYLDPAQRGVRVLEVASGSGQHAAHFARAFPLAEWQPSDVDQRCLDRNPEWGLRDTALLEDLGKANGLLLERMVDMPA

SEQ ID NO: 900 - protein, 81 aa, Pan paniscus
RGVRVLEVASGSGQHAAHFARAFPLAEWQPSDVDQRCLDRNPEWGLRDTALLEDLGKANGLLLERMVDMPANNKCLIFRKN

SEQ ID NO: 901 - protein, 81 aa, Pan paniscus
MLVAAAAERNKDPILHVLQQYLDPAQRGVRVLEVASGSGQHAAHFARAFPLAEWQPSDVDQRCLDRGSSEQQDTCSNPGPC

SEQ ID NO: 902 - protein, 81 aa, Pan paniscus
LQQYLDPAQRGVRVLEVASGSGQHAAHFARAFPLAEWQPSDVDQRCLDRGSSEQQDTCSNPGPCSSPMGPMPSMGRSTPRA

SEQ ID NO: 903 - protein, 81 aa, Pan paniscus
AAAERNKDPILHVLQQYLDPAQRGVRVLEVASGSGQHAAHFARAFPLAEWQPSDVDQRCLDRGSSEQQDTCSNPGPCSSPM

SEQ ID NO: 904 - protein, 81 aa, Pan paniscus
LQQYLDPAQRGVRVLEVASGSGQHAAHFARAFPLAEWQPSDVDQRCLDRGSSEQQDTCSNPGPCSSPMGEGLPFHSPNPSL

SEQ ID NO: 905 - protein, 81 aa, Pan paniscus
SDVDQRCLDRGSSEQQDTCSNPGPCSSPMGEGLPFHSPNPSLQVCPRLSGKYPDLGPVGCVPMPTALCHQWEDLPPEQRGL

SEQ ID NO: 906 - protein, 81 aa, Pan paniscus
MAAALLMAGSQAPVTFEDMAMYLTREEWRPLDAAQRDLYRDVMQENYGNVVSLDFEIRSENEVNPKQEISEDVQFGTTSER

SEQ ID NO: 907 - protein, 81 aa, Pan paniscus
FGTTSERPAENAEENPESEEGFESGDRSERQWGDLTAEEWVSYPLQQVTDLLVHKEVHTGIRYHICSHCGKAFSQISDLNR

SEQ ID NO: 908 - protein, 81 aa, Pan paniscus
GESLESRVTLGSLTAESQELLTFKDVSVDFTQEEWGQLAPAHRNLYREVMLENYGNLVSVGCQLSKPGVISQLEKGEEPWL

SEQ ID NO: 909 - protein, 81 aa, Pan paniscus
RESLEDEVTPGLPTAESQELLTFKDISIDFTQEEWGQLAPAHQNLYREVMLENYSNLVSVGYQLSKPSVISQLEKGEEPWM

SEQ ID NO: 910 - protein, 81 aa, Pan paniscus
EEPWMAEKEGPGDPSSDLKSKIETIESTAKSAISQERLYHGIMMESFMRDDIIYSTLRKVSTYDDVLERHQETCMRDVRQA

SEQ ID NO: 911 - protein, 81 aa, Pan paniscus
QRESLEDEVTPGLPTAESQELLTFKDISIDFTQEEWGQLAPAHQNLYREVMLENYSNLVSVAGYQLSKPSVISQLEKGEEP

SEQ ID NO: 912 - protein, 81 aa, Pan paniscus
RESLEDEVTPGLPTAESQELLTFKDISIDFTQEEWGQLAPAHQNLYREVMLENYSNLVSVDLKSKIETIESTAKSAISQER

SEQ ID NO: 913 - protein, 81 aa, Pan paniscus
LYREVMLENYSNLVSVDLKSKIETIESTAKSAISQERLYHGIMMESFMRDDIIYSTLRKVSTYDDVLERHQETCMRDVRQA

SEQ ID NO: 914 - protein, 81 aa, Pan paniscus
MISFQESVTFQDVAVDFTAEEWQLLDCAERTLYWDVMLENYRNLISVGCPITKTKVILKVEQGQEPWMVEEVNPHESSPES

SEQ ID NO: 915 - protein, 81 aa, Pan paniscus
MISFQESVTFQDVAVDFTAEEWQLLDCAERTLYWDVMLENYRNLISVGCPITKTKVILKVEQGQEPWMVEEVNPHESSPGW

SEQ ID NO: 916 - protein, 81 aa, Pan paniscus
EDGPADMQKVRICSEGGWVPALFDEVAIYFSDEEWEVLTEQQKALYREVMRMNYETVLSLEFPFPKPDMITRLEGEEESQN

SEQ ID NO: 917 - protein, 81 aa, Pan paniscus
QKALYREVMRMNYETVLSLEFPFPKPDMITRLEGEEESQNSDEWQLQGGTSAENEESDVKPPDWPNPMNATSQFPQPQHFD

SEQ ID NO: 918 - protein, 81 aa, Pan paniscus
EDGPADMQKVRICSEGGWVPALFDEVAIYFSDEEWEVLTEQQKALYREVMRMNYETVLSLENEESDVKPPDWPNPMNATSQ

SEQ ID NO: 919 - protein, 81 aa, Pan paniscus
NSFPQVILLPNPPKVLRLQGLLAFSDVVIEFSPEEWACLDPAQRNLYRDVMFENYRNLVSLAILSYSIQDLLPEQDMKDLC

SEQ ID NO: 920 - protein, 81 aa, Pan paniscus
AQRNLYRDVMFENYRNLVSLAILSYSIQDLLPEQDMKDLCQKVTLTRHRSWGLDNLHLVKDWRTVNEGKGQKEYCNRLTQC

SEQ ID NO: 921 - protein, 81 aa, Pan paniscus
MGLLAFRDVALEFSPEEWECLDPAQRSLYRDVMLENYRNLISLGLAMSKPELIICLEARKEPWNVNTEKTAKHSALSSYLT

SEQ ID NO: 922 - protein, 81 aa, Pan paniscus
EARKEPWNVNTEKTAKHSALSSYLTEDILPEQGLQVSFQKVMLRRYERCCLEKLRLRNDWEIVVETGFHRVSQDGLDLLTS

SEQ ID NO: 923 - protein, 81 aa, Pan paniscus
MGLLAFRDVALEFSPEEWECLDPAQRSLYRDVMLENYRNLISLGLAMSKPELIICLEARKEPWNVNTEKTAKHSVETRFRH

SEQ ID NO: 924 - protein, 81 aa, Pan paniscus
ISLGLAMSKPELIICLEARKEPWNVNTEKTAKHSALSSYLTEDILPEQGLQVSFQKVMLRRYERCCLEKLRLRNDWEIVAM

SEQ ID NO: 925 - protein, 81 aa, Pan paniscus
MGLLAFRDVALEFSPEEWECLDPAQRSLYRDVMLENYRNLISLGEDNFNMQFLFHSLAMSKPELIICLEARKEPWNVNTEK

SEQ ID NO: 926 - protein, 81 aa, Pan paniscus
LFHSLAMSKPELIICLEARKEPWNVNTEKTAKHSALSSYLTEDILPEQGLQVSFQKVMLRRYERCCLEKLRLRNDWEIVAM

SEQ ID NO: 927 - protein, 81 aa, Pan paniscus
RKEPWNVNTEKTAKHSALSSYLTEDILPEQGLQVSFQKVMLRRYERCCLEKLRLRNDWEILCEDVLASPLPSAMIVSFLRP

SEQ ID NO: 928 - protein, 81 aa, Pan paniscus
MDSVSFEDVAVAFTQEEWALLDPSQKNLYRDVMQEIFRNLASVGNKSEDQNIQDDFKNPGRNLSSHVVERLFEIKEGSQYG

SEQ ID NO: 929 - protein, 81 aa, Pan paniscus
MDSVAFEDVAVNFTQEEWALLDSSQKNLYREVMQETCRNLASVGSQWKDQNIEDHFKKPGKDIRNHIVQRLCESKEGGQYG

SEQ ID NO: 930 - protein, 81 aa, Pan paniscus
RHFRRPEPCREPRASPTQDSVAFEDVAVNFTQEEWALLDSSQKNLYREVMQETCRNLASVGSQWKDQNIEDHFKKPGKDIR

SEQ ID NO: 931 - protein, 81 aa, Pan paniscus
AEPLHPVCTCGRHFRRPEPCREPRASPTQDSVAFEDVAVNFTQEEWALLDSSQKNLYREVMQETCRNLASVEIISYRDCVK

SEQ ID NO: 932 - protein, 81 aa, Pan paniscus
MSGHPGSWEMNSVAFEDVAVNFTQEEWALLDPSQKNLYRDVMQETFRNLASIGNKGEDQSIEDQYKNSSRNLSSFQIHQRN

SEQ ID NO: 933 - protein, 81 aa, Pan paniscus
MSGHPGSWEMNSVAFEDVAVNFTQEEWALLDPSQKNLYRDVMQETFRNLASIGNKGEDQSIEDQYKNSSRNLRHIISHSGN

SEQ ID NO: 934 - protein, 81 aa, Pan paniscus
LQEENVRDTQQVTTLQLPPSRVSPFKDMILCFSEEDWSLLDPAQTGFYGEFIIGEDYGVSMPPNDLAAQPDLSQGEENEPR

SEQ ID NO: 935 - protein, 81 aa, Pan paniscus
LGSGGKKAQIISVLSQIYVSRVSPFKDMILCFSEEDWSLLDPAQTGFYGEFIIGEDYGVSMPPNDLAAQPDLSQGEENEPR

SEQ ID NO: 936 - protein, 81 aa, Pan paniscus
MNKSQEQVSFKDVCVDFTQEEWYLLDPAQKILYRDVILENYSNLVSVGYCITKPEVIFKIEQGEEPWILEKGFPSQCHPER

SEQ ID NO: 937 - protein, 81 aa, Pan paniscus
MNKFQGPVTLKDVIVEFTKEEWKLLTPAQRTLYKDVMLENYSHLVSVGYHVNKPNAVFKLKQGKEPWILEVEFPHRGFPED

SEQ ID NO: 938 - protein, 81 aa, Pan paniscus
SNWMSSPLYSTEVEQKSQESVSFKDVTVGFTQEEWQHLDPSQRALYRDVMLENYSNLVSVGYCVHKPEVIFRLQQGEEPWK

SEQ ID NO: 939 - protein, 81 aa, Pan paniscus
MANATRGSGVEQKSQESVSFKDVTVGFTQEEWQHLDPSQRALYRDVMLENYSNLVSVGYCVHKPEVIFRLQQGEEPWKLEE

SEQ ID NO: 940 - protein, 81 aa, Pan paniscus
MNKVEQKSQESVSFKDVTVGFTQEEWQHLDPSQRALYRDVMLENYSNLVSVGYCVHKPEVIFRLQQGEEPWKLEEEFPSQS

SEQ ID NO: 941 - protein, 81 aa, Pan paniscus
SPSFQEQNKMNKVEQKSQESVSFKDVTVGFTQEEWQHLDPSQRALYRDVMLENYSNLVSVGYCVHKPEVIFRLQQGEEPWK

SEQ ID NO: 942 - protein, 81 aa, Pan paniscus
MITSQGSVSFRDVTVGFTQEEWQHLDPAQRTLYRDVMLENYSHLVSVGYCIPKPEVILKLEKGEEPWILEEKFPSQSHLGS

SEQ ID NO: 943 - protein, 81 aa, Pan paniscus
MITSQGSVSFRDVTVGFTQEEWQHLDPAQRTLYRDVMLENYSHLVSVGYCIPKPEVILKLEKGEEPWILEEKFPSQSHLEL

SEQ ID NO: 944 - protein, 81 aa, Pan paniscus
MITSQGSVSFRDVTVGFTQEEWQHLDPAQRTLYRDVMLENYSHLVSVGYCIPKPEVILKLEKGEEPWILEEKFPSQSHLGC

SEQ ID NO: 945 - protein, 81 aa, Pan paniscus
HLDPSQRALYRDVMLENYSNLVSVGYCAHKPEVIFRLEQGEEPWRLEEEFPSQSFPEVWTADHLKERSQENQSKHLWEVVF

SEQ ID NO: 946 - protein, 81 aa, Pan paniscus
MSAVDQKFQGSVSFKDVTVGFTQEEWQHLDPSQRALYRDVMLENYSNLVSVGYCAHKPEVIFRLEQGEEPWRLEEEFPSQS

SEQ ID NO: 947 - protein, 81 aa, Pan paniscus
MSKVDQKFQGSVSFKDVTVGFTQEEWQHLDPSQRALYRDVMLENYSNLVSVGYCAHKPEVIFRLEQGEEPWRLEEEFPSQS

SEQ ID NO: 948 - protein, 81 aa, Pan paniscus
MANATRRESEVDQKFQGSVSFKDVTVGFTQEEWQHLDPSQRALYRDVMLENYSNLVSVGYCAHKPEVIFRLEQGEEPWRLE

SEQ ID NO: 949 - protein, 81 aa, Pan paniscus
MPGQLVRSLALSPRLKCRGSVSFSDVAVGFTQEEWQHLDHAQRTPYRDVMLENYSLLLSVGYCITKPEVFCKLEHGQVLWI

SEQ ID NO: 950 - protein, 81 aa, Pan paniscus
VMLENYSLLLSVGYCITKPEVFCKLEHGQVLWILEEESPSQSHLDCCIDDDLMEKRQENQDQHLQKVDFVNNKTLTMDRNG

SEQ ID NO: 951 - protein, 81 aa, Pan paniscus
MAPRAQIQGPLTFGDVAVAFTRIEWRHLDAAQRALYRDVMLENYGNLVSVGLLSSKPKLITQLEQGAEPWTEVREAPSGTH

SEQ ID NO: 952 - protein, 81 aa, Pan paniscus
RDVMLENYGNLVSVGLLSSKPKLITQLEQGAEPWTEVREAPSGTHAVQDYWFETKMSALKQSTSEGSVLGERTKSVMMEKG

SEQ ID NO: 953 - protein, 81 aa, Pan paniscus
MTLLTFRDVAIEFSLEEWKCLDLAQQNLYRDVMLENYRNLFSVGLTVSKPGLITCLEQRKEPWNVKRQEAADGHPAMSSHF

SEQ ID NO: 954 - protein, 81 aa, Pan paniscus
SHFTQDLLPEQGIQDAFPKTILRGYGNCGLDNLYLRKDWESLDECKLQKDYNGLNQCSSTTHSKIFQYNKYVKIFDNFSNL

SEQ ID NO: 955 - protein, 81 aa, Pan paniscus
MTLLTFRDVAIEFSLEEWKCLDLAQQNLYRDVMLENYRNLFSVGLTVSKPGLITCLEQRKEPWNVKRQEAADGHPEMGFHH

SEQ ID NO: 956 - protein, 81 aa, Pan paniscus
MAGAQTLLTFRDVAIEFSLEEWKCLDLAQQNLYRDVMLENYRNLFSVGLTVSKPGLITCLEQRKEPWNVKRQEAADGHPAM

SEQ ID NO: 957 - protein, 81 aa, Pan paniscus
MAGAQTLLTFRDVAIEFSLEEWKCLDLAQQNLYRDVMLENYRNLFSVGLTVSKPGLITCLEQRKEPWNVKRQEAADGHPEM

SEQ ID NO: 958 - protein, 81 aa, Pan paniscus
SSHFTQDLLPEQGIQDAFPKTILRGYGNCGLDNLYLRKDWESLDECKLQKDYNGLNQCSSTTHSKIFQYNKYVKIFDNFSN

SEQ ID NO: 959 - protein, 81 aa, Pan paniscus
MAGAQTLLTFRDVAIEFSLEEWKCLDLAQQNLYRDVMLENYRNLFSVGLTVSKPGLITCLEQRKEPWNVKRQEAADGHPDI

SEQ ID NO: 960 - protein, 81 aa, Pan paniscus
MAGAQTLLTFRDVAIEFSLEEWKCLDLAQQNLYRDVMLENYRNLFSVGLTVSKPGLITCLEQRKEPWNVKRQEAADGHPAL

SEQ ID NO: 961 - protein, 81 aa, Pan paniscus
MTLLTFRDVAIEFSLEEWKCLDLAQQNLYRDVMLENYRNLFSVGLTVSKPGLITCLEQRKEPWNVKRQEAADGHPGWCSGV

SEQ ID NO: 962 - protein, 81 aa, Pan paniscus
VSVDKFTAMSSHFTQDLLPEQGIQDAFPKTILRGYGNCGLDNLYLRKDWESLDECKLQKDYNGLNQCSSTTHSKIFQYNKY

SEQ ID NO: 963 - protein, 81 aa, Pan paniscus
VSKPGLITCLEQRKEPWNVKRQEAADGHPAMSSHFTQDLLPEQGIQDAFPKTILRGYGNCGLDNLYLRKDWESLDECKLQK

SEQ ID NO: 964 - protein, 81 aa, Pan paniscus
MPWAERNLLVYSSSKETLLTFRDVAIEFSLEEWKCLDLAQQNLYRDVMLENYRNLFSVGLTVSKPGLITCLEQRKEPWNVK

SEQ ID NO: 965 - protein, 80 aa, Pan paniscus
MTLLTFRDVAIEFSLEEWKCLDLAQQNLYRDVMLENYRNLFSVGLTVSKPGLITCLEQRKEPWNVKRQEAADGHPASANV

SEQ ID NO: 966 - protein, 81 aa, Pan paniscus
MTLLTFRDVAIEFSLEEWKCLDLAQQNLYRDVMLENYRNLFSVGLTVSKPGLITCLEQRKEPWNVKRQEAADGHPEFHSIT

SEQ ID NO: 967 - protein, 81 aa, Pan paniscus
PGLITCLEQRKEPWNVKRQEAADGHPEFHSITQAVVQWRHLSSLQPLPPGLEPSSHFSLLRTWNYRGTPPHPANFCVFNRD

SEQ ID NO: 968 - protein, 81 aa, Pan paniscus
MAGAQTLLTFRDVAIEFSLEEWKCLDLAQQNLYRDVMLENYRNLFSVGLTVSKPGLITCLEQRKEPWNVKRQEAADGHPGP

SEQ ID NO: 969 - protein, 81 aa, Pan paniscus
QMGSIKEKMKAGSRTGKPQEPVTFKDVVVEFSKEEWGQLDSAVKNLYRNVMLENFRNLNSLRKAHLLSKPFESLKLESKKK

SEQ ID NO: 970 - protein, 81 aa, Pan paniscus
MAVTFEDVTIIFTWEEWKFLDSSQKRLYREVMWENYTNVMSVENWNESYKSQEEKFRYLEYENFSCWQGWWNAGAQMYENQ

SEQ ID NO: 971 - protein, 81 aa, Pan paniscus
PRKNLSMVKEQKLIVEHSYIPVEEALPQYVGVICQKDLLRDSMEEKYCGCNKCKEIYYWNSRCVFHKRNQPGENLYQCSIR

SEQ ID NO: 972 - protein, 81 aa, Pan paniscus
ERSSGDSEMVALLTALSQGLVTFKDVAVCFSQDQWSDLDPTQKEFYGEYVLEEDCGIVVSLSFPIPRPDEISQVREEEPWV

SEQ ID NO: 973 - protein, 81 aa, Pan paniscus
CTTENLFEEPLGISHTEQGLVTFKDVAVCFSQDQWSDLDPTQKEFYGEYVLEEDCGIVVSLSFPIPRPDEISQVREEEPWV

SEQ ID NO: 974 - protein, 81 aa, Pan paniscus
GNTGDWEMAAALLAAGSQGLVTIKDVSLCFSQEEWRSLDPSQTDFYGEYVMQENCGIVVSLRFPIPKLDMLSQLEGGEEQW

SEQ ID NO: 975 - protein, 81 aa, Pan paniscus; identical to SEQ ID NO: 355

SEQ ID NO: 976 - protein, 81 aa, Pan paniscus
MIQSQISFEDVAVDFTLEEWQLLNPTQKNLYRDVMLENYSNLVFLEVWLDNPKMWLRDNQDNLKSMERGHKYDVFGKIFNS

SEQ ID NO: 977 - protein, 81 aa, Pan paniscus
MIQSQISFEDVAVDFTLEEWQLLNPTQKNLYRDVMLENYSNLVFLGFQILKPDAMFKLEQQDPWIIGQEILNQNFSEVWLD

SEQ ID NO: 978 - protein, 81 aa, Pan paniscus
MATSFRTASCWGLLSFKDISMEFTWDEWQLLDSTQKYLYRDVILENYHNLISVGYHGTKPDLIFKLEQGEDPWIINAKISR

SEQ ID NO: 979 - protein, 80 aa, Pan paniscus
MATSFRTASCWGLLSFKDISMEFTWDEWQLLDSTQKYLYRDVILENYHNLISVDGWEEWYQNNQDELESIERSYACSVLG

SEQ ID NO: 980 - protein, 81 aa, Pan paniscus
FGNLLGVPWAQGNSALPEGLLSFKDISMEFTWDEWQLLDSTQKYLYRDVILENYHNLISVGYHGTKPDLIFKLEQGEDPWI

SEQ ID NO: 981 - protein, 81 aa, Pan paniscus
RDVILENYHNLISVGYHGTKPDLIFKLEQGEDPWIINAKISRQSCPDGWEEWYQNNQDELESIERSYACSVLGRLNLSKTH

SEQ ID NO: 982 - protein, 81 aa, Pan paniscus
MTMLQESFSFDDLSVDFTQKEWQLLDPSQKNLYKDVMLENYSSLVSLGYEVMKPDVIFKLEQGEEPWVGDGEIPSSDSPEV

SEQ ID NO: 983 - protein, 81 aa, Pan paniscus
MTMLQESFSFDDLSVDFTQKEWQLLDPSQKNLYKDVMLENYSSLVSLGYEVMKPDVIFKLEQGEEPWVGDGEIPSSDSPVW

SEQ ID NO: 984 - protein, 81 aa, Pan paniscus
MTMLQESFSFDDLSVDFTQKEWQLLDPSQKNLYKDVMLENYSSLVSLGYEVMKPDVIFKLEQGEEPWVGDGEIPSSDSPGT

SEQ ID NO: 985 - protein, 81 aa, Pan paniscus
MTMLQESFSFDDLSVDFTQKEWQLLDPSQKNLYKDVMLENYSSLVSLGYEVMKPDVIFKLEQGEEPWVGDGEIPSSDSPVS

SEQ ID NO: 986 - protein, 81 aa, Pan paniscus
MSQGSVTFRDVAIDFSQEEWKWLQPAQRDLYRCVMLENYGHLVSLGLSISKPDVVSLLEQGKEPWLGKREVKRDLFSVSES

SEQ ID NO: 987 - protein, 81 aa, Pan paniscus; identical to SEQ ID NO: 356

SEQ ID NO: 988 - protein, 81 aa, Pan paniscus
MSQGSVTFRDVAIDFSQEEWKWLQPAQRDLYRCVMLENYGHLVSLAGLSISKPDVVSLLEQGKEPWLGKREVKRDLFSGFF

SEQ ID NO: 989 - protein, 81 aa, Pan paniscus
MSQGSVTFRDVAIDFSQEEWKWLQPAQRDLYRCVMLENYGHLVSLGLSISKPDVVSLLEQGKEPWLGKREVKRDLFSVLKE

SEQ ID NO: 990 - protein, 81 aa, Pan paniscus
REFGGMRAGHANICPSFQGSVTFRDVAIDFSQEEWKWLQPAQRDLYRCVMLENYGHLVSLGLSISKPDVVSLLEQGKEPWL

SEQ ID NO: 991 - protein, 81 aa, Pan paniscus
RNAEEERMIAVFLTTWLQEPMTFKDVAVEFTQEEWMMLDSAQRSLYRDVMLENYRNLTSVEYQLYRLTVISPLDQEEIRNM

SEQ ID NO: 992 - protein, 81 aa, Pan paniscus
MDAKSLTAWSRTLVTFKDVFVDFTREEWKLLDTAQQIVYRNVMLENYKNLVSLGYQLTKPDVILRLEKGEEPWLVEREIHQ

SEQ ID NO: 993 - protein, 81 aa, Pan paniscus
VLEWLFISQEQPKITKSWGPLSFMDVFVDFTWEEWQLLDPAQKCLYRSVMLENYSNLVSLGYQHTKPDIIFKLEQGEELCM

SEQ ID NO: 994 - protein, 81 aa, Pan paniscus; identical to SEQ ID NO: 357

SEQ ID NO: 995 - protein, 81 aa, Pan paniscus
KQKSRRIEKVLEWLFISQEQPKITKSWEWQLLDPAQKCLYRSVMLENYSNLVSLGYQHTKPDIIFKLEQGEELCMVQAQVP

SEQ ID NO: 996 - protein, 81 aa, Pan paniscus
MATRVRTASIWGPLSFMDVFVDFTWEEWQLLDPAQKCLYRSVMLENYSNLVSLGYQHTKPDIIFKLEQGEELCMVQAQVPN

SEQ ID NO: 997 - protein, 81 aa, Pan paniscus
GPLSFMDVFVDFTWEEWQLLDPAQKCLYRSVMLENYSNLVSLGYQHTKPDIIFKLEQGEELCMVQAQVPNQTCPILKAGKS

SEQ ID NO: 998 - protein, 81 aa, Pan paniscus
QWGNELKNSMSSFRPGRGHNDSRRTVFYTNEEWELLDPTPKDLEESIVQEEKKKLTPEGNKGVTGSGFPFDFGRNPYKGKR

SEQ ID NO: 999 - protein, 81 aa, Pan paniscus
SGDPSSEGTSGSGSVSIRKPASEMQLQVQSQQEELEQLKKDLSSQKELVRLLQQTVRSSQYDKYFTSSRLCEGVPKDTLEL

SEQ ID NO: 1000 - protein, 81 aa, Pan paniscus
SSGDPSSEGTSGSGSVSIRKPASEMQLQVQSQQEELEQLKKDLSSQKELVRLLQQTVRSSQYDKYFTSSRLCEGVPKDTLE

SEQ ID NO: 1001 - protein, 81 aa, Pan paniscus
EGRTRDRQMAAALLTAWSQMPVTFEDVALYLSREEWGRLDHTQQNFYRDVLQKKNRLSLGFPFSRPFWAPQAHGKGEASGS

SEQ ID NO: 1002 - protein, 81 aa, Pan paniscus
EGRTRDRQMAAALLTAWSQMPVTFEDVALYLSREEWGRLDHTQQNFYRDVLQKKNRLSLGAVEVGQRVQTSSVAALGNVKP

SEQ ID NO: 1003 - protein, 81 aa, Pan paniscus
LKEGRPGETTDTCFVSGVHGPVALGDIPFYFSREEWGTLDPAQRDLFWGIKRENSRNTTLGFGLKGQSEKSLLQEMVPVVP

SEQ ID NO: 1004 - protein, 81 aa, Pan paniscus
SRNTTLGFGLKGQSEKSLLQEMVPVVPGQTGSDVTVSWSPEEAEAWESENRPRAALGPVVGARRGRPPTRRRQFRDLAAEK

SEQ ID NO: 1005 - protein, 81 aa, Pan paniscus
RPLVKLLPKGVQREQETVSLYLKANPELVVFEDLNVFHCQEECVSLDPTQQLTSEKEDDSSVGEMMLLAVNGSNPEGEDPE

SEQ ID NO: 1006 - protein, 81 aa, Pan paniscus
PLVKLLPKGVQREQETVSLYLKANPEELVVFEDLNVFHCQEECVSLDPTQQLTSEKEDDSSVGEMMLLAVNGSNPEGEDPE

SEQ ID NO: 1007 - protein, 81 aa, Pan paniscus
PLVKLLPKGVQREQETVSLYLKANPEELVVFEDLNVFHCQEECVSLDPTQQLTSEKEDDSSVGEMMLLVNGSNPEGEDPER

SEQ ID NO: 1008 - protein, 81 aa, Pan paniscus
LFPPEGNVEDKEMTGPQLPESLEDVAMYISQEEWGHQDPSKRALSRDTVQESYENVDSLESHIPSQEVPGTQVGQGGKLWD

SEQ ID NO: 1009 - protein, 81 aa, Pan paniscus
QTNTKDWTVTPEHVLPESQSLLTFEEVAMYFSQEEWELLDPTQKALYNDVMQENYETVISLALFVLPKPKVISCLEQGEEP

SEQ ID NO: 1010 - protein, 81 aa, Pan paniscus
MYFSQEEWELLDPTQKALYNDVMQENYETVISLALFVLPKPKVISCLEQGEEPWVQVSPEFKDSAGKSPTGLKLKNDTENR

SEQ ID NO: 1011 - protein, 81 aa, Pan paniscus
MCDNRAVSLCQQEWMCPGPAKRALYRGATQRKDRHVSLATGVPWGYEETKTLLAILSSSQFYGKLQTCQQNSQIYRAMAEG

SEQ ID NO: 1012 - protein, 81 aa, Pan paniscus
NTGLHDQETGAVVWTAGSQGPAMCDNRAVSLCQQEWMCPGPAKRALYRGATQRKDRHVSLATGVPWGYEETKTLLAILSSS

SEQ ID NO: 1013 - protein, 81 aa, Pan paniscus
MASMPPTPEAQGPMLFEDLAVYFSQEECVTLHPAQRSLSKDGTKESLEVAALMGEEGKPEINQQLSLESMELDELALEKYP

SEQ ID NO: 1014 - protein, 81 aa, Pan paniscus
WPERGPPAPRHQEMASASPFLSAWSQVPVNLEDVAVYLSGEEPRCLDPAQRDAPLENEGPGIQLEDGGEGREDAPVRMEWY

SEQ ID NO: 1015 - protein, 81 aa, Pan paniscus
MGLLTFRDVAVEFSLEEWEHLEPAQKTLYQDVMLENYRNLVSLGLVVSKPDLITFLEQRKEPWNVKSEETVAIQPDVFSHY

SEQ ID NO: 1016 - protein, 81 aa, Pan paniscus; identical to SEQ ID NO: 358

SEQ ID NO: 1017 - protein, 81 aa, Pan paniscus
MCQGLLTFRDVAIEFSREEWEHLDSDQKLLYGDVMLENYGNLVSLGLAVSKPDLITFLEQRKEPWNVKSAETVAIQPDIFS

SEQ ID NO: 1018 - protein, 81 aa, Pan paniscus; identical to SEQ ID NO: 359

SEQ ID NO: 1019 - protein, 81 aa, Pan paniscus
MGLLTFRDVAIEFSREEWEHLDSDQKLLYGDVMLENYGNLVSLGLAVSKPDLITFLEQRKEPWNVKSAETVAIQPEVKVNT

SEQ ID NO: 1020 - protein, 81 aa, Pan paniscus
PDLITFLEQRKEPWNVKSAETVAIQPDIFSHDTQGLLRKKLIEASFQKAILDGYGSCGPQNLNLRKEWESEEKNQYNKSDT

SEQ ID NO: 1021 - protein, 81 aa, Pan paniscus
EVTEHLTGWAPAPVPSVEGLLTFRDVAIEFSREEWEHLDSDQKLLYGDVMLENYGNLVSLGLAVSKPDLITFLEQRKEPWN

SEQ ID NO: 1022 - protein, 81 aa, Pan paniscus
PAQGPGKARPSRKRGRRPRALKFVDVAVYFSPEEWGCLRPAQRALYRDVMRETYGHLGALGCAGPKPALISWLERNTDDWE

SEQ ID NO: 1023 - protein, 81 aa, Pan paniscus
PAHVPGEAGPRRTRESRPGAVSFADVAVYFSPEEWECLRPAQRALYRDVMRETFGHLGALGFSGPKPAFISWVEGEVEAWS

SEQ ID NO: 1024 - protein, 81 aa, Pan paniscus
APLLAPRPGETRPGCRKPGTVSFADVAVYFSPEEWGCLRPAQRALYRDVMQETYGHLGALGFPGPKPALISWMEQESEAWS

SEQ ID NO: 1025 - protein, 81 aa, Pan paniscus
APLPPRDPNGAGPEWREPGAVSFADVAVYFCREEWGCLRPAQRALYRDVMRETYGHLSALGIGGNKPALISWVEEEAELWG

SEQ ID NO: 1026 - protein, 81 aa, Pan paniscus
APLPPRDPNGAGPEWRKPGAVSFADVAVYFSREEWGCLRPAHRALYRDVMRETYGHLGALGESPTCLPGPCASTGPAAPLG

SEQ ID NO: 1027 - protein, 81 aa, Pan paniscus
APLPPRDPNGAGPEWRKPGAVSFADVAVYFSREEWGCLRPAHRALYRDVMRETYGHLGALGVGGSKPALISWVEEKAELWD

SEQ ID NO: 1028 - protein, 81 aa, Pan paniscus
MAPRPPTAAPQESVTFKDVSVDFTQEEWYHVDPAQRSLYRDVMLENYSHLVSLGYQVSKPEVIFKLEQGEEPWISEGEIQR

SEQ ID NO: 1029 - protein, 81 aa, Pan paniscus
VTFKDVSVDFTQEEWYHVDPAQRSLYRDVMLENYSHLVSLGYQVSKPEVIFKLEQGEEPWISEGEIQRPFYPAVYFNRKEE

SEQ ID NO: 1030 - protein, 81 aa, Pan paniscus
ESVTFKDVSVDFTQEEWYHVDPAQRSLYRDVMLENYSHLVSLGYQVSKPEVIFKLEQGEEPWISEGEIQRPFYPGFVCLLP

SEQ ID NO: 1031 - protein, 81 aa, Pan paniscus
MAAMPLKAQYQEMVTFEDVAVHFTKTEWTGLSPAQRALYRSVMLENFGNLTALGYPVPKPALISLLEGGDMAWGLEAQDDP

SEQ ID NO: 1032 - protein, 80 aa, Pan paniscus
VTFEDVAVHFTKTEWTGLSPAQRALYRSVMLENFGNLTALGYPVPKPALISLLEGGDMAWGLEAQDDPPAERTKNVCKGR

SEQ ID NO: 1033 - protein, 81 aa, Pan paniscus
MVTFEDVAVHFTKTEWTGLSPAQRALYRSVMLENFGNLTALGYPVPKPALISLLEGGDMAWGLEAQDDPPAERTKNVCKVI

SEQ ID NO: 1034 - protein, 81 aa, Pan paniscus
MLENYGNVASLGFPLLKPAVISQLEGGGELGGPSPLAAGTGLQGLQTDIQTDNDLTKEMHEGKENVSFELQRDFSQETDFS

SEQ ID NO: 1035 - protein, 81 aa, Pan paniscus
MLENYGNVASLGFPLLKPAVISQLEGGGELGGPSPLAAGTGLQGLQTDGVSLCRPNWSAVARTWLTATSVSRVRAILLPHP

SEQ ID NO: 1036 - protein, 81 aa, Pan paniscus
MLENYGNVASLGFPLLKPAVISQLEGGVDIQTDNDLTKEMHEGKENVSFELQRDFSQETDFSEASLLEKQQEVHSAGNIKK

SEQ ID NO: 1037 - protein, 81 aa, Pan paniscus
SQLEGGVDIQTDNDLTKEMHEGKENVSFELQRDFSQETDFSEASLLEKQQEVHSAGNIKKEKSNTIDGTVKDETNPVEECF

SEQ ID NO: 1038 - protein, 81 aa, Pan paniscus
MHLTTWPQKSVTFEDVAVYFTQAEWDGLSPAQRTLYRDVMLENYGNVASLGFPLLKPAVISQLEGGGELGGPSPLAAGTGL

SEQ ID NO: 1039 - protein, 81 aa, Pan paniscus
MNKSQGSVSFTDVTVDFTQEEWEQLDPSQRILYMDVMLENYSNLLSVEVWKADDQMERDHRNPDEQARQFLILKNQTPIEE

SEQ ID NO: 1040 - protein, 81 aa, Pan paniscus
MDVMLENYSNLLSVEVWKADDQMERDHRNPDEQARQFLILKNQTPIEERGDLFGKALNLNTDFVSLRQIPYKYDLHEKTLK

SEQ ID NO: 1041 - protein, 81 aa, Pan paniscus
PRGKHAFQTGWLNDLVTKESMTFKDVAVDITQEDWELMRPVQKELYKTVTLQNYWNMVSLGLTVYRPTVIPILEEPWMVIK

SEQ ID NO: 1042 - protein, 81 aa, Pan paniscus
TQPDEDLHLQAEETQLVKESVTFKDVAIDFTLEEWRLMDPTQRNLHKDVMLENYRNLVSLGLAVSKPDMISHLENGKGPWV

SEQ ID NO: 1043 - protein, 81 aa, Pan paniscus
PEVTQPDEDLHLQAEETQLVKESVTFKDVAIDFTLEEWRLMDPTQRNLHKDVMLENYRNLVSLGLAVSKPDMISHLENGKG

SEQ ID NO: 1044 - protein, 81 aa, Pan paniscus
FQEKSTEEGEVAALRLTARSQETVTFKDVAMDFTPEEWGKLDPVQRDVMLENYRNLVSLWLPVSKPENYNLENGKEPLKLE

SEQ ID NO: 1045 - protein, 81 aa, Pan paniscus
EGEVAALRLTARSQETVTFKDVAMDFTPEEWGKLDPVQRDVMLENYRNLVSLWLPVSKPENYNLENGKEPLKLERKAPKSS

SEQ ID NO: 1046 - protein, 81 aa, Pan paniscus
ASQPARLEERLIRDQDLGASLLPAAPQEQWRHLDSTQKEQYWDLMLETYGKMVSGAGISHPKSDLTNSIEFGEELAGLYLH

SEQ ID NO: 1047 - protein, 81 aa, Pan paniscus
ASQPARLEERLIRDQDLGASLLPAAPQEQWRHLDSTQKEQYWDLMLETYGKMVSGGISHPKSDLTNSIEFGEELAGLYLHV

SEQ ID NO: 1048 - protein, 81 aa, Pan paniscus
AASQPARLEERLIRDQDLGASLLPAAPQWRHLDSTQKEQYWDLMLETYGKMVSGGISHPKSDLTNSIEFGEELAGLYLHVN

SEQ ID NO: 1049 - protein, 81 aa, Pan paniscus
ASQPARLEERLIRDQDLGASLLPAAPQEQWRHLDSTQKEQYWDLMLETYGKMVSGGDRQENDKENLNLENHRDQELLHASC

SEQ ID NO: 1050 - protein, 81 aa, Pan paniscus
VLFQEATAFENMTKDWNYLEGSQKDCYRDTMLDSYENTVPQGSFLQFSMMPQRAGNDPPGVSNASEMEMEISNMREKFLMS

SEQ ID NO: 1051 - protein, 81 aa, Pan paniscus
LQGKYGNVTKEVIVLYLTLCKQCHQKNPVPKRGLAPQPMTFKDIDSTCQVEILDMQSSADGEFKFILYYQDHSTKFIILRP

SEQ ID NO: 1052 - protein, 81 aa, Pan paniscus
FSPCPKTVWSLWQQPVLFQEATAFENMTKDWNYLEGSQKDCYRDTMLDSYENTVPQGSFLQFSMMPQRAGNDPPGVSNASE

SEQ ID NO: 1053 - protein, 81 aa, Pan paniscus
MELLTFRDVAIEFSPEEWKCLDPAQQNLYRDVMLENYRNLVSLAVYSYYNQGILPEQGIEDSFKKATLGRYGSCGLENICL

SEQ ID NO: 1054 - protein, 80 aa, Pan paniscus
MELLTFRDVAIEFSPEEWKCLDPAQQNLYRDVMLENYRNLVSLELHAEHHQRTDGHFISLGEGQVYHAVMAIPASIGVWV

SEQ ID NO: 1055 - protein, 81 aa, Pan paniscus
MVTCAHLGRRARLPAAQPSACPGTCFSQEERMAAGYLPRWSQELVTFEDVSVDFSQEEWELLEPAQKNLYREVMLENYRNV

SEQ ID NO: 1056 - protein, 81 aa, Pan paniscus
CFSQEERMAAGYLPRWSQELVTFEDVSVDFSQEEWELLEPAQKNLYREVMLENYRNVVSLEGLKNQCTDVGIKEGPLSPAQ

SEQ ID NO: 1057 - protein, 81 aa, Pan paniscus
MLETFRNLASVDDETQFKASGSVSQQDIYGEKIPKESKIATFTRNVSWASVLGKIWDSLSIEDQTTNQGRNLSRNHVLERL

SEQ ID NO: 1058 - protein, 81 aa, Pan paniscus
EKIPKESKIATFTRNVSWASVLGKIWDSLSIEDQTTNQGRNLSRNHVLERLCESNDQCGEALSQIPHLNLYKKIPPGVKQY

SEQ ID NO: 1059 - protein, 81 aa, Pan paniscus
MDSVVFEDVAVDFTPEEWALLDSAQRDLYRDVMLETFRNLASVDDETQFKASGSVSQQDIYGEKIPKESKIATFTRNVSWA

SEQ ID NO: 1060 - protein, 81 aa, Pan paniscus; identical to SEQ ID NO: 360

SEQ ID NO: 1061 - protein, 81 aa, Pan paniscus
MDSVVFEDVAVDFTLEEWALLDSAQRDLYRDVMLETFRNLASVGCEMWERANGSVSLQDMYGQEKSKEQTIPNFTGNNSCA

SEQ ID NO: 1062 - protein, 81 aa, Pan paniscus; identical to SEQ ID NO: 361

SEQ ID NO: 1063 - protein, 81 aa, Pan paniscus
MDSVVFEEVAVNFTPEEWALLDHAQRSLYRDVMLETCRNLASLDCYIYVRTSGSSSQRDVFGNGISNDEEIVKFTGSDSWS

SEQ ID NO: 1064 - protein, 81 aa, Pan paniscus
GHTQGGELVNELLTSWLRGLVTFEDVAVEFTQEEWALLDPAQRTLYRDVMLENCRNLASLGCRVNKPSLISQLEQDKKVIT

SEQ ID NO: 1065 - protein, 81 aa, Pan paniscus
DLFACSGLEPHTPSAGSQESVTFQDVAVDFTEKEWPLLDSSQRKLYKDVMLENYSNLTSLGYQVGKPSLISHLEQEEEPRT

SEQ ID NO: 1066 - protein, 81 aa, Pan paniscus
DLFACSGLEPHTPSAGSQESVTFQDVAVDFTEKEWPLLDSSQRKLYKDVMLENYSNLTSLDWETPSKTKWSLLMEDIFGKE

SEQ ID NO: 1067 - protein, 81 aa, Pan paniscus
SSKDRSCPQNLDLFACSGLEPHTPSAGSQESVTFQDVAVDFTEKEWPLLDSSQRKLYKDVMLENYSNLTSLEILAPPFCRS

SEQ ID NO: 1068 - protein, 81 aa, Pan paniscus
MEEERKTAELQKNRIQDSVVFEDVAVDFTQEEWALLDLAQRNLYRDVMLENFQNLASLGYPLHTPHLISQWEQEEDLQTVK

SEQ ID NO: 1069 - protein, 81 aa, Pan paniscus
MAAGWLTTWSQNSVTFQEVAVDFSQEEWALLDPAQKNLYKDVMLENFRNLASVGYQLCRHSLISKVDQEQLKTDERGILQG

SEQ ID NO: 1070 - protein, 81 aa, Pan paniscus
SKFEEERMVAGWLTNYSQDSVTFEDVAVDFTQEEWTLLDQTQRNLYRDVMLENYKNLVAVDWESHINTKWSAPQQNFLQGK

SEQ ID NO: 1071 - protein, 81 aa, Pan paniscus
MVAGWLTNYSQDSVTFEDVAVDFTQEEWTLLDQTQRNLYRDVMLENYKNLVAVDWESHINTKWSAPQQNFLQGKTSSVVEM

SEQ ID NO: 1072 - protein, 81 aa, Pan paniscus
EKTEVERVVADCLTNCYQDSVTFDDLAVDFTPEEWTLLDPTQRNLYRDVMLENYKNLATVGYQLFKPSLISWLEQEESRTV

SEQ ID NO: 1073 - protein, 81 aa, Pan paniscus
MAYCLTNCYQDSVTFEDTAVDFTQEEWTLLDPVQRNLYRDVMLENYENVAKVGFQLLKPSVISWLEEEELRTLQQGVLQDW

SEQ ID NO: 1074 - protein, 81 aa, Pan paniscus
VSALQQDFWKIQTSNGIQTDLVTFDSVAVEFTQEEWTLLDPTQRNLYSDVMLENYKNLSSVVYQLFKPSLISWLEEEEELS

SEQ ID NO: 1075 - protein, 81 aa, Pan paniscus
EKTPAGRIVADCLTDCYQDSVTFDDVAVDFTQEEWTLLDSTQRSLYSDVMLENYKNLATVGGQIIKPSLISWLEQEESRTV

SEQ ID NO: 1076 - protein, 81 aa, Pan paniscus
MDSVTFDDVAVDFTQEEWTLLDSTQRSLYSDVMLENYKNLATVGGQIIKPSLISWLEQEESRTVQGGVLQGWEMRLETQWS

SEQ ID NO: 1077 - protein, 81 aa, Pan paniscus
EKTKVERMVEDSLANGYQDSVTFDDVAVDFTPEEWALLDTTEKYLYRDVMLENYTNLASVEWEIQPRTKRSSLQQGFLKNQ

SEQ ID NO: 1078 - protein, 81 aa, Pan paniscus
FFSREPICPFEEKTKVERMVEDSLANGYQDSVTFDDVAVDFTPEEWALLDTTEKYLYRDVMLENYTNLASVDKRLQWMETL

SEQ ID NO: 1079 - protein, 81 aa, Pan paniscus
EKTKIGTMVEDHRSNSYQDSVTFDDVAVEFTPEEWALLDTTQKYLYRDVMLENYMNLASVDFFFCLTSEWEIQPRTKRSSL

SEQ ID NO: 1080 - protein, 81 aa, Pan paniscus
FSREPICPFEEKTKIGTMVEDHRSNSYQDSVTFDDVAVEFTPEEWALLDTTQKYLYRDVMLENYMNLASVADKKLQWMETL

SEQ ID NO: 1081 - protein, 81 aa, Pan paniscus
VDSVTFDDVAVEFTPEEWALLDTTQKYLYRDVMLENYMNLASVDFFFCLTSEWEIQPRTKRSSLQQGFLKNQIFTGIQMQT

SEQ ID NO: 1082 - protein, 81 aa, Pan paniscus
LASVDFFFCLTSEWEIQPRTKRSSLQQGFLKNQIFTGIQMQTRSYSGWKLCENCGEVFSEQFCLKTHMRAQNGGNTFEGNC

SEQ ID NO: 1083 - protein, 81 aa, Pan paniscus
SYQDSVTFDDVAVEFTPEEWALLDTTQKYLYRDVMLENYMNLASVDFFFCLTSEWEIQPRTKRSSLQQGFLKNQIFTGIQM

SEQ ID NO: 1084 - protein, 81 aa, Pan paniscus
MDSSQHLVTFEDVAVDFTQEEWTLLDQAQRDLYRDVMLENYKNLIILAGSELFKHSLMSGLEQMEELRTGVTGVLQGEKQY

SEQ ID NO: 1085 - protein, 81 aa, Pan paniscus
MDSSQHLVTFEDVAVDFTQEEWTLLDQAQRDLYRDVMLENYKNLIILAGSELFKHSLMSGLEQMEELRTGVTGVLQELDLQ

SEQ ID NO: 1086 - protein, 81 aa, Pan paniscus
MDSSQHLVTFEDVAVDFTQEEWTLLDQAQRDLYRDVMLENYKNLIILELDLQLKTKGSPLLQDISAERSPNGVQLERSNTA

SEQ ID NO: 1087 - protein, 81 aa, Pan paniscus
MDSSQHLVTFEDVAVDFTQEEWTLLDQAQRDLYRDVMLENYKNLIILGSELFKHSLMSGLEQMEELRTGVTGVLQELDLQL

SEQ ID NO: 1088 - protein, 81 aa, Pan paniscus
MDSVAFEDVAVNFTLEEWALLDPSQKNLYRDVMRETFRNLASVGKQWEEQNIEDPFKIPRRNISHIPERLCESKEGGQGEE

SEQ ID NO: 1089 - protein, 81 aa, Pan paniscus
MDSVAFEDVAVNFTQEEWALLGPSQKSLYRNVMQETIRNLDCIEMKWEDQNIGDQCQNAKRNLRSHTCEIKDDSQCGETFG

SEQ ID NO: 1090 - protein, 81 aa, Pan paniscus
MDSVAFEDVAINFTCEEWALLGPSQKSLYRDVMQETIRNLDCIGMIWQNHDIEEDQYKDLRRNLRCHMVERSCEIKDNSQC

SEQ ID NO: 1091 - protein, 81 aa, Pan paniscus
MDPVAFKDVAVNFTQEEWALLDISQRRLYREVMLETFRNLTSVGKRWKDQNIEYEYQNPRRNFSSLIEEKVNEIKQDSHCG

SEQ ID NO: 1092 - protein, 81 aa, Pan paniscus
MMFQDPVAFKDVAVNFTQEEWALLDISQRRLYREVMLETFRNLTSVGKRWKDQNIEYEYQNPRRNFSSLIEEKVNEIKQDS

SEQ ID NO: 1093 - protein, 81 aa, Pan paniscus
MFQDPVAFKDVAVNFTQEEWALLDISQRRLYREVMLETFRNLTSVGKRWKDQNIEYEYQNPRRNFSSLIEEKVNEIKQDSH

SEQ ID NO: 1094 - protein, 81 aa, Pan paniscus
MDPVAFKDVAVNFTQEEWALLDISQKNLYREVMLETFWNLTSIGKKWKDQNIEYEYQNPRRNFRSLIEEKVNEIKQDSHCG

SEQ ID NO: 1095 - protein, 81 aa, Pan paniscus
MFQDPVAFKDVAVNFTQEEWALLDISQKNLYREVMLETFWNLTSIGKKWKDQNIEYEYQNPRRNFRSLIEEKVNEIKQDSH

SEQ ID NO: 1096 - protein, 81 aa, Pan paniscus
MLSLSPILLYTCEMFQDPVAFKDVAVNFTQEEWALLDISQKNLYREVMLETFWNLTSIGKKWKDQNIEYEYQNPRRNFRSL

SEQ ID NO: 1097 - protein, 81 aa, Pan paniscus
CSHRRCREDPGTSESQEMDPVAFDDVAVNFTQEEWALLDISQRKLYREVMLETFRNLTSIGKSWKDQNIEYEYQNPRRNFR

SEQ ID NO: 1098 - protein, 81 aa, Pan paniscus
MPCCSHRRCREDPGTSESQEMEEWALLDISQRKLYREVMLETFRNLTSIGKSWKDQNIEYEYQNPRRNFRSLIEKKVNEIK

SEQ ID NO: 1099 - protein, 81 aa, Pan paniscus
RSCREDPGTSESREMMFQDPVAFEDVAVNFTQEEWTLLDISQKNLFREVMLETFRNLTSIGKKWSDQNIEYEYQNPRRSFR

SEQ ID NO: 1100 - protein, 81 aa, Pan paniscus
CSHRSCREDPGTSESREMDPVAFEDVAVNFTQEEWTLLDISQKNLFREVMLETFRNLTSIGKKWSDQNIEYEYQNPRRSFR

SEQ ID NO: 1101 - protein, 81 aa, Pan paniscus
MFQDPVAFEDVAVNFTQEEWTLLDISQKNLFREVMLETFRNLTSIGKKWSDQNIEYEYQNPRRSFRSLIEEKVNEIKEDSH

SEQ ID NO: 1102 - protein, 81 aa, Pan paniscus
CSHRSCREDPGTSESREMDPVAFDDVAVNFTQEEWALLDISQRKLYREVMLETFRNLTSIGKKWKDQNIEYEYQNPRRNFR

SEQ ID NO: 1103 - protein, 81 aa, Pan paniscus
QIHERTHTGEKPCECSKCNRAFRSHRSYLRHKRSHTGEKPYQCKECRKAFTYPSSLRRHERTHSAKNLMNVSSVGKHYLIL

SEQ ID NO: 1104 - protein, 81 aa, Pan paniscus
MPCCSHRSCREDPGTSESREMRPESSDCKLRPVRNLQREVIESSHQAQWLTPVIPALWEAKADGASQMFQDPVAFDDVAVN

SEQ ID NO: 1105 - protein, 81 aa, Pan paniscus
NLQREVIESSHQAQWLTPVIPALWEAKADGASQMFQDPVAFDDVAVNFTQEEWALLDISQRKLYREVMLETFRNLTSIGVS

SEQ ID NO: 1106 - protein, 81 aa, Pan paniscus
MDPVAFDDVAVNFTQEEWALLDISQRKLYREVMLETFRNLTSIGKKWKDQNIEYEYQNPRRNFRSLIEGNVNEIKEDSHCG

SEQ ID NO: 1107 - protein, 81 aa, Pan paniscus
MMFQDPVAFDDVAVNFTQEEWALLDISQRKLYREVMLETFRNLTSIGKKWKDQNIEYEYQNPRRNFRSLIEGNVNEIKEDS

SEQ ID NO: 1108 - protein, 81 aa, Pan paniscus
PPVLSLSPILLYTCEMFQDPVAFDDVAVNFTQEEWALLDISQRKLYREVMLETFRNLTSIGKKWKDQNIEYEYQNPRRNFR

SEQ ID NO: 1109 - protein, 81 aa, Pan paniscus
MMFQDSVAFEDVAVTFTQEEWALLDPSQKNLYRDVMQETFRNLASIGKKWKPQNIYVEYENLRRNLRIVGERLFESKEGHQ

SEQ ID NO: 1110 - protein, 81 aa, Pan paniscus
MDSVAFEDVAVTFTQEEWALLDPSQKNLYRDVMQETFRNLASIGKKWKPQNIYVEYENLRRNLRIVGERLFESKEGHQHGE

SEQ ID NO: 1111 - protein, 81 aa, Pan paniscus
MLVLSIFLYTCEMFQDSVAFEDVAVTFTQEEWALLDPSQKNLYRDVMQETFRNLASIGKKWKPQNIYVEYENLRRNLRIVG

SEQ ID NO: 1112 - protein, 81 aa, Pan paniscus
MDSVAFEDVAVNFTQEEWALLDPSQKNLYREVMQETLRNLTSIGKKWNNQYIEDEHQNPRRNLRRLIGERLSESKESHQHG

SEQ ID NO: 1113 - protein, 81 aa, Pan paniscus
MDSVAFEDVAVNFTQEEWSLLDPSQKNLYREVMQETLRNLASIGEKWKDQYIEDQYKNPRNNLRSLLGERVDENTEENHCG

SEQ ID NO: 1114 - protein, 81 aa, Pan paniscus
MDSVAFEDVAVSFTQEEWALLDPSQKNLYRDVMQETFKNLTSVGKTWKVQNIEDEYKNPRRNLRRSFTLVAQAGVRQDLGS

SEQ ID NO: 1115 - protein, 81 aa, Pan paniscus
MMFQDSVAFEDVAVSFTQEEWALLDPSQKNLYRDVMQETFKNLTSVGKTWKVQNIEDEYKNPRRNLSLMREKLCESKESHH

SEQ ID NO: 1116 - protein, 81 aa, Pan paniscus
MDSVAFEDVAVSFTQEEWALLDPSQKNLYRDVMQETFKNLTSVGKTWKVQNIEDEYKNPRRNLSLMREKLCESKESHHCGE

SEQ ID NO: 1117 - protein, 81 aa, Pan paniscus
MDSVVFEDVDVNFTQEEWALLDPSQKNLYRDVMQETFRNLASVGKKWKDQKIEDEYKNPRRNLSLRKWSWSLYARQTLGLD

SEQ ID NO: 1118 - protein, 81 aa, Pan paniscus
DSVVFEDVDVNFTQEEWALLDPSQKNLYRDVMQETFRNLASVGKKWKDQKIEDEYKNPRRNLSLRKWSWSLYARQTLGLDS

SEQ ID NO: 1119 - protein, 81 aa, Pan paniscus
MDSVVFEDVDVNFTQEEWALLDPSQKNLYRDVMQETFRNLASVGKKWKDQKIEDEYKNPRRNLRGLMGERLLESKKDHQHG

SEQ ID NO: 1120 - protein, 81 aa, Pan paniscus
NRHHRADTGHKPYEYQEYGQKPYKCTYCKKAFSDLPYFRTHEWAHTGGKPYDCEECGKSFISRSSIRRHRIMHSGDGPYKC

SEQ ID NO: 1121 - protein, 81 aa, Pan paniscus
MDSVAFEDVDVNFTQEEWALLDPSQKNLYRDVMWETMRNLASIGKKWKDQNIKDHYKHRGRNLRSHMLERLYQTKDGSQRG

SEQ ID NO: 1122 - protein, 81 aa, Pan paniscus
TLPRGQPEVLEWGLPKDQDSVAFEDVAVNFTHEEWALLSPSQKNLYRDVMRETIRNLNCIGMKWENQNIDDQYQNLRRNPR

SEQ ID NO: 1123 - protein, 81 aa, Pan paniscus
MDSVAFEDVAVNFTHEEWALLSPSQKNLYRDVMRETIRNLNCIGMKWENQNIDDQYQNLRRNPRCDVVERFGKSKDGSQCG

SEQ ID NO: 1124 - protein, 81 aa, Pan paniscus
MDAVAFEDVAVNFTQEEWALLGPSQKNLYRYVMQETIRNLDCIRMIWEEQNTEDQYKNPRRNLRCHIVERFSESKDSSQCG

SEQ ID NO: 1125 - protein, 81 aa, Pan paniscus
HTHKQRGKAFSYHHSFQSCGRPHTGKKRYECKECGKTFSSRRNLRRHMVVQGGNRPYKFPIEDMRECTLGRNRMNVSSVLK

SEQ ID NO: 1126 - protein, 81 aa, Pan paniscus
RNDFFLPDSQTNEERKQYDSVAFEDVAVNFTQEEWALLGPSQKSLYRDVMWETIRNLDCIEMKWEDTNIEDQHKNPRRSLR

SEQ ID NO: 1127 - protein, 81 aa, Pan paniscus
MASVALEDVAVNFTREEWALLGPCQKNLYKDVMQETIRNLDCVGMKWKDQNIEDQYRYPRKNLRCRMLERFVESKGGSQCG

SEQ ID NO: 1128 - protein, 80 aa, Pan paniscus; identical to SEQ ID NO: 362

SEQ ID NO: 1129 - protein, 81 aa, Pan paniscus; identical to SEQ ID NO: 363

SEQ ID NO: 1130 - protein, 81 aa, Pan paniscus
SDQRRRRKEARTPGSRDTDSVVFEDVAVNFTQEEWALLGPSQKKLYRDVMQETFVNLASIGENWEEKNIEDHKNQGRKLRS

SEQ ID NO: 1131 - protein, 81 aa, Pan paniscus
MDSVASEDVAVNFTLEEWALLDPSQKKLYRDVMRETFRNLACVGKKWEDQSIEDWYKNQGRILRNHMEEGLSESKEYDQCG

SEQ ID NO: 1132 - protein, 81 aa, Pan paniscus
VLQMQNSEHHGQSIKTQTDSISLEDVAVNFTLEEWALLDPGQRNIYRDVMRATFKNLACIGEKWKDQDIEDEHKNQGRNLR

SEQ ID NO: 1133 - protein, 81 aa, Pan paniscus
MDSISLEDVAVNFTLEEWALLDPGQRNIYRDVMRATFKNLACIGEKWKDQDIEDEHKNQGRNLRSPMVEALCENKEDCPCG

SEQ ID NO: 1134 - protein, 81 aa, Pan paniscus
MDSVAFEDVSVSFSQEEWALLAPSQKKLYRDVMQETFKNLASIGEKWEDPNVEDQHKNQGRNLRSHTGERLCEGKEGSQCA

SEQ ID NO: 1135 - protein, 81 aa, Pan paniscus
MESVTFEDVAVEFIQEWALLDSARRSLCKYRMLDQCRTLASRGTPPCKPSCVSQLGQRAEPKATERGILHATGVAWESQLK

SEQ ID NO: 1136 - protein, 81 aa, Pan paniscus
EDKVEEEAMAPGLPTACSQEPVTFADVAVVFTPEEWVFLDSTQRSLYRDVMLENYRNLASVADQLCKPNALSYLEERGEQW

SEQ ID NO: 1137 - protein, 81 aa, Pan paniscus
MESVTFEDVAVEFIQEWALLDSARRSLCKYRMLDQCRTLASRGAGAVPEDAAGALHRREGDTIDSRGPASSPGAALVSGMH

SEQ ID NO: 1138 - protein, 81 aa, Pan paniscus
MDSVAFEDVAVNFTQEEWALLSPSQKNLYRDVTLETFRNLTSVGIQWKDQDIENLYQNLGIKLRSLVERLCGRKEGNEHRE

SEQ ID NO: 1139 - protein, 81 aa, Pan paniscus
MDSVSFEDVAVNFTLEEWALLDSSQKKLYEDVMQETFKNLVCLGKKWEDQDIEDDHRNQGKNQRCHMVERLCESRRGSKCG

SEQ ID NO: 1140 - protein, 81 aa, Pan paniscus
MGPLEFRDVAIEFSLEEWHCLDTAQRNLYRNVMLENYRHLVFLGIVVSKPNLITCLEQGKKPLTMKRHEMIAKPPVMYSHF

SEQ ID NO: 1141 - protein, 81 aa, Pan paniscus
LRRYEKCRHDNLQLKKGCESVDECPVHKRGYNGLKQCLTTTQRKILQCDEYVKFLHKFSNSNKHKIRDTGKKPFKCIEYGK

SEQ ID NO: 1142 - protein, 81 aa, Pan paniscus
MGPLEFRDVAIEFSLEEWHCLDTAQRNLYRNVMLENYRHLVFLGIVVSKPNLITCLEQGKKPLTMKRHEMIAKPPGQARWL

SEQ ID NO: 1143 - protein, 81 aa, Pan paniscus
MGPLEFRDVAIEFSLEEWHCLDTAQRNLYRNVMLENYRHLVFLGIVVSKPNLITCLEQGKKPLTMKRHEMIAKPPDGVSVF

SEQ ID NO: 1144 - protein, 81 aa, Pan paniscus
MGPLEFRDVAIEFSLEEWHCLDTAQRNLYRNVMLENYRHLVFLVMYSHFAQDLWSEHSIKDSFQKVILRRYEKCRHDNLQL

SEQ ID NO: 1145 - protein, 81 aa, Pan paniscus
MGPLEFRDVAIEFSLEEWHCLDTAQRNLYRNVMLENYRHLVFLGIVVSKPNLITCLEQGKKPLTMKRHEMIAKPPETGFHR

SEQ ID NO: 1146 - protein, 81 aa, Pan paniscus; identical to SEQ ID NO: 364

SEQ ID NO: 1147 - protein, 81 aa, Pan paniscus
LRRYEKCRHDNLQLKKGCKSVGEHKVHKGGYNGLNQCLTTTQKEIFQCDKYGKVFHKFSNSNTYKTRHTGINLFKCIICGK

SEQ ID NO: 1148 - protein, 81 aa, Pan paniscus
GPLQFRDVAIEFSLEEWHCLDTAQRNLYRDVMLENYRNLVFLGIVVSKPDLVTCLEQGKKPLTMERHEMIAKPPVMSSHFA

SEQ ID NO: 1149 - protein, 81 aa, Pan paniscus
MGPLQFRDVAIEFSLEEWHCLDTAQRNLYRNVMLENYSNLVFLGIVVSKPDLIAHLEQGKKPLTMKRHEMVANPSGPGVVV

SEQ ID NO: 1150 - protein, 81 aa, Pan paniscus; identical to SEQ ID NO: 365

SEQ ID NO: 1151 - protein, 81 aa, Pan paniscus
MGPLQFRDVAIEFSLEEWHCLDTAQRNLYRNVMLENYSNLVFLGIVVSKPDLIAHLEQGKKPLTMKRHEMVANPSDGVNLC

SEQ ID NO: 1152 - protein, 81 aa, Pan paniscus
MGPLQFRDVAIEFSLEEWHCLDTAQRNLYRNVMLENYSNLVFLGIVVSKPDLIAHLEQGKKPLTMKRHEMVANPSGARLLS

SEQ ID NO: 1153 - protein, 81 aa, Pan paniscus
MELLTFRDVTIEFSLEEWEFLNPAQQSLYRKVMLENYRNLVSLGLTVSKPELISCLEQREEPWNVKRHETIAKPPGTYRVG

SEQ ID NO: 1154 - protein, 81 aa, Pan paniscus
MLENYRNLVSLGLTVSKPELISCLEQREEPWNVKRHETIAKPPAMSSHYTEDLLPEQGMQDSFQKVILRRYGSCGLEDLHL

SEQ ID NO: 1155 - protein, 81 aa, Pan paniscus
MELLTFRDVTIEFSLEEWEFLNPAQQSLYRKVMLENYRNLVSLGLTVSKPELISCLEQREEPWNVKRHETIAKPPAMSSHY

SEQ ID NO: 1156 - protein, 81 aa, Pan paniscus
MFCFVFQELLTFRDVTIEFSLEEWEFLNPAQQSLYRKVMLENYRNLVSLGLTVSKPELISCLEQREEPWNVKRHETIAKPP

SEQ ID NO: 1157 - protein, 81 aa, Pan paniscus
EQGMQDSFQKVILRRYGSCGLEDLHLRKDGENVGECKDQKEIYNGLNQCLSTLPSKIFPYNKCVKVFSKSSNLNRENIRHT

SEQ ID NO: 1158 - protein, 81 aa, Pan paniscus
MELLTFRDVTIEFSLEEWEFLNPAQQSLYRKVMLENYRNLVSLGLTVSKPELISCLEQREEPWNVKRHETIAKPPDYSLTI

SEQ ID NO: 1159 - protein, 81 aa, Pan paniscus
MGPLQFRDVAIEFSLEEWHCLDTAQRNLYRNVMLENYRNLVFLGIVVTKPDLITCLEQGKKPFTVKRHEMIAKPPDGVHFL

SEQ ID NO: 1160 - protein, 81 aa, Pan paniscus
MGPLQFRDVAIEFSLEEWHCLDTAQRNLYRNVMLENYRNLVFLGIVVTKPDLITCLEQGKKPFTVKRHEMIAKPPVMCFHF

SEQ ID NO: 1161 - protein, 81 aa, Pan paniscus
MPGPLRSLEMESLQFRDVAVEFSLEEWHCLDTAQQNLYRDVMLENYRHLVFLGIIVSKPDLITCLEQGIKPLTMKRHEMIA

SEQ ID NO: 1162 - protein, 81 aa, Pan paniscus
MAPLQFRDVAIEFSLEEWHCLDTAQRNLYRNVMLENYRNLVFLGIVVSKPDLITCLEQGEKPLTMKKHEMVANPSVTCSHF

SEQ ID NO: 1163 - protein, 81 aa, Pan paniscus
MAPLQFRDVAIEFSLEEWHCLDTAQRNLYRNVMLENYRNLVFLGIVVSKPDLITCLEQGEKPLTMKKHEMVANPSETGFHH

SEQ ID NO: 1164 - protein, 81 aa, Pan paniscus
MGPLQFRDVAIEFSLEEWHCLDTAQRNYKDVMLENYRNLIFLGITVSKPDLITCLEQGRKPLTMKRNEMIAKPSVMCSHFA

SEQ ID NO: 1165 - protein, 81 aa, Pan paniscus
MGPLQFRDVAIEFSLEEWHCLDTAQRNYKDVMLENYRNLIFLGITVSKPDLITCLEQGRKPLTMKRNEMIAKPSVSFLQVH

SEQ ID NO: 1166 - protein, 81 aa, Pan paniscus
MGPLQFRDVAIEFSLEEWHCLDMAQRNLYRDVMLENYRNLVFLGIVVSKPDLITHLEQGKKPSTMKRHEMVANPSVLCSHF

SEQ ID NO: 1167 - protein, 81 aa, Pan paniscus
MGPLQFRDVAIEFSLEEWHCLDMAQRNLYRDVMLENYRNLVFLGIVVSKPDLITHLEQGKKPSTMKRHEMVANPSGPVLHI

SEQ ID NO: 1168 - protein, 81 aa, Pan paniscus
MGPLTFRDVAIEFSLEEWQCLDTAQRNLYRNVMLENYRNLVFLGIAVSKPDLITCLEQGKEAWSMKRHEIMVAKPTVMCSH

SEQ ID NO: 1169 - protein, 81 aa, Pan paniscus
MGPLTFRDVAIEFSLEEWQCLDTAQRNLYRNVMLENYRNLVFLDLITCLEQGKEAWSMKRHEIMVAKPTVMCSHFAQDLWP

SEQ ID NO: 1170 - protein, 81 aa, Pan paniscus
MGPLTFRDVAIEFSLEEWQCLDTAQRNLYRNVMLENYRNLVFLGIAVSKPDLITCLEQGKEAWSMKRHEIMVAKPTESYSV

SEQ ID NO: 1171 - protein, 81 aa, Pan paniscus
MGPLTFRDVAIEFSLEEWQCLDTAQRNLYRNVMLENYRNLVFLGIAVSKPDLITCLEQGKEAWSMKRHEIMVAKPTGEVSR

SEQ ID NO: 1172 - protein, 81 aa, Pan paniscus
MGPLTFRDVAIEFSLEEWQCLDTAQRNLYRNVMLENYRNLVFLGIAVSKPDLITCLEQGKEAWSMKRHEIMVAKPTGCLSK

SEQ ID NO: 1173 - protein, 81 aa, Pan paniscus
MGPLTFRDVAIEFSLEEWQCLDTAQRNLYRNVMLENYRNLVFLVMCSHFAQDLWPEQNIKDSFQKVTLKRYGKCRHENLPL

SEQ ID NO: 1174 - protein, 81 aa, Pan paniscus
ASGCPVADRNLLVYSFYEKGPLTFKDVAIEFSLEEWQCLDTAQQDLYRKVMLENYRNLVSLAGIAVSKPDLITCLEQGKEP

SEQ ID NO: 1175 - protein, 81 aa, Pan paniscus
SGCPVADRNLLVYSFYEKGPLTFKDVAIEFSLEEWQCLDTAQQDLYRKVMLENYRNLVSLGIAVSKPDLITCLEQGKEPWN

SEQ ID NO: 1176 - protein, 81 aa, Pan paniscus
MNVMLENYKNLVFLGIAVSKQDPITSLEQEKEPWNMKICEIVDESPGQVWCLTPVIPALWEARAGGLLEPRNLRPAWSTWK

SEQ ID NO: 1177 - protein, 81 aa, Pan paniscus
MNVMLENYKNLVFLGIAVSKQDPITSLEQEKEPWNMKICEIVDESPGYMCRMSYVFFFYQRPLARARHKRFFSTSDTEKTW

SEQ ID NO: 1178 - protein, 81 aa, Pan paniscus
MNVMLENYKNLVFLAGIAVSKQDPITSLEQEKEPWNMKICEIVDESPAMCSSFIRDLWPEQDIKDSFQQVILRRHGKCEHE

SEQ ID NO: 1179 - protein, 81 aa, Pan paniscus
MNVMLENYKNLVFLGIAVSKQDPITSLEQEKEPWNMKICEIVDESPAMCSSFIRDLWPEQDIKDSFQQVILRRHGKCEHEN

SEQ ID NO: 1180 - protein, 81 aa, Pan paniscus
SGCPGAERNLLVYSYFEKETLTFRDVAIEFSLEEWECLNPAQQNLYMNVMLENYKNLVFLGVAVSKQDPVTCLEQEKEPWN

SEQ ID NO: 1181 - protein, 81 aa, Pan paniscus
SQVQVILLPQPPELLGLQETLTFRDVAIEFSLEEWECLNPAQQNLYMNVMLENYKNLVFLGVAVSKQDPVTCLEQEKEPWN

SEQ ID NO: 1182 - protein, 81 aa, Pan paniscus
ASGCPGAERNLLVYSYFEKETLTFRDVAIEFSLEEWECLNPAQQNLYMNVMLENYKNLVFLAGVAVSKQDPVTCLEQEKEP

SEQ ID NO: 1183 - protein, 81 aa, Pan paniscus
MGPLTFMDVAIEFSLEEWQCLDTAQQNLYRNVMLENYRNLVFLGIAVSNLDLITCLEQGKEPWNMKIHEMVAKPPAMCSHF

SEQ ID NO: 1184 - protein, 81 aa, Pan paniscus
SGYPGAERNLLEYSYFEKGPLTFRDVVIEFSQEEWQCLDTAQQDLYRKVMLENFRNLVFLGIDVSKPDLITCLEQGKDPWN

SEQ ID NO: 1185 - protein, 81 aa, Pan paniscus
TPGPPESLEMGPLTFRDVAIEFSLEEWQCLDTAQQDLYRKVMLENYRNLVFLAGIAVSKPDLVTCLEQGKDPWNMKRHSTV

SEQ ID NO: 1186 - protein, 81 aa, Pan paniscus
MGPLTFRDVAIEFSLEEWQCLDTAQQDLYRKVMLENYRNLVFLGIAVSKPDLVTCLEQGKDPWNMKRHSTVVKPPVICSHF

SEQ ID NO: 1187 - protein, 81 aa, Pan paniscus
TPGPPESLEMGPLTFRDVAIEFSLEEWQCLDTAQQDLYRKVMLENYRNLVFLGIAVSKPDLVTCLEQGKDPWNMKRHSTVV

SEQ ID NO: 1188 - protein, 81 aa, Pan paniscus
GPLTFRDVAIEFSLEEWQCLDTAQQDLYRKVMLENYRNLVFLAGIAVSKPDLVTCLEQGKDPWNMKRHSTVVKPPGGDCSI

SEQ ID NO: 1189 - protein, 81 aa, Pan paniscus; identical to SEQ ID NO: 366

SEQ ID NO: 1190 - protein, 81 aa, Pan paniscus
MGPLTFTDVAIEFSLEEWQCLDTAQQNLYRNVMLENYRNLVFLGIAVSKPDLITCLEKEKEPCKMKRHEMVDEPPDGVSLL

SEQ ID NO: 1191 - protein, 81 aa, Pan paniscus
RRYDKRGHENLQLRKGYKTVGDCKLYKGGYNGLNQCLTLTQSKMYHCDIYVKVFYAFSNADRYKTRHTGKKPFQCKKCGKP

SEQ ID NO: 1192 - protein, 81 aa, Pan paniscus
MGPLTFTDVAIEFSLEEWQCLDTAQQNLYRNVMLENYRNLVFLVVCSHFAEDFWPEQDIKDSFQKVTLRRYDKRGHENLQL

SEQ ID NO: 1193 - protein, 81 aa, Pan paniscus
MPGHPGSWEMGPLTFMDVAIEFCLEEWQCLDTAQQNLYRNVMLENYRNLVFLGIAVSKPDLITCLEQEKEPWEPVRRHEMV

SEQ ID NO: 1194 - protein, 81 aa, Pan paniscus
MDVAIEFCLEEWQCLDTAQQNLYRNVMLENYRNLVFLGIAVSKPDLITCLEQEKEPWEPVRRHEMVAKPPVMCSHFTQDFW

SEQ ID NO: 1195 - protein, 81 aa, Pan paniscus
MGPLTFMDVAIEFCLEEWQCLDTAQQNLYRNVMLENYRNLVFLGIAVSKPDLITCLEQEKEPWEPVRRHEMVAKPPVMCSH

SEQ ID NO: 1196 - protein, 81 aa, Pan paniscus
MDVAIEFCLEEWQCLDTAQQNLYRNVMLENYRNLVFLGIAVSKPDLITCLEQEKEPWEPVRRHEMVAKPPGGIVSLLNVFF

SEQ ID NO: 1197 - protein, 81 aa, Pan paniscus
MGSLTFRDVAIEFSLEEWQCLDTAQQNLYRNVMLENYRNLVFLGIAAFKPDLIIFLEEGKEPWNMKRHEMVEESPVICSHF

SEQ ID NO: 1198 - protein, 81 aa, Pan paniscus
MGSLTFRDVAIEFSLEEWQCLDTAQQNLYRNVMLENYRNLVFLGIAAFKPDLIIFLEEGKEPWNMKRHEMVEESPGMVGSS

SEQ ID NO: 1199 - protein, 81 aa, Pan paniscus
MGPLTIRDVTVEFSLEEWHCLDTAQQNLYRDVMLENYRNLVFLGIAVSKPDLITCLEQGKEPCNMKRHEMVAKPPDSHSVS

SEQ ID NO: 1200 - protein, 81 aa, Pan paniscus
MGPLTIRDVTVEFSLEEWHCLDTAQQNLYRDVMLENYRNLVFLGIAVSKPDLITCLEQGKEPCNMKRHEMVAKPPDGVSLF

SEQ ID NO: 1201 - protein, 81 aa, Pan paniscus; identical to SEQ ID NO: 367

SEQ ID NO: 1202 - protein, 81 aa, Pan paniscus
MGPLTIRDVTVEFSLEEWHCLDTAQQNLYRDVMLENYRNLVFLGIAVSKPDLITCLEQGKEPCNMKRHEMVAKPPAFYLMG

SEQ ID NO: 1203 - protein, 81 aa, Pan paniscus
MPGAPGSLEMGPLTFRDVTIEFSLEEWQCLDTVQQNLYRDVMLENYRNLVFLGMAVFKPDLITCLKQGKEPWNMKRHEMVT

SEQ ID NO: 1204 - protein, 81 aa, Pan paniscus
CLKQGKEPWNMKRHEMVTKPPVMRSHFTQDLWPDQSTKDSFQEVILRTYARCGHKNLRLRKDCKSANEGKMHEEGYNKLNQ

SEQ ID NO: 1205 - protein, 81 aa, Pan paniscus
MLENYRNLVFMGIAASKPDLITCLEQGKEPWNVKRHEMVAEPPVVCSYFAQDLWPKQGKKNYFQKVVLRRYKKCGCENLQL

SEQ ID NO: 1206 - protein, 81 aa, Pan paniscus
MPGPLGSLEVGVLTFRDVAIEFSLEEWQCLDTAQQNLYRNVMLENYRNLVFMGIAASKPDLITCLEQGKEPWNVKRHEMVA

SEQ ID NO: 1207 - protein, 81 aa, Pan paniscus
PIPTSSMWSPMVRLGGFSPELQHLPQTLLHRCPLGQPRMGVLTFRDVAIEFSLEEWQCLDTAQQNLYRNVMLENYRNLVFM

SEQ ID NO: 1208 - protein, 81 aa, Pan paniscus
MGSLTFRDVTIEFSLEEWQCLDTAQQNLYRNVMLENYRNLVFLGIAVSKPDLITCLKQGKEPWNMKRHEMVTKPPVISSHF

SEQ ID NO: 1209 - protein, 81 aa, Pan paniscus
SEKCTRLILYDLKIALKNGSLTFRDVTIEFSLEEWQCLDTAQQNLYRNVMLENYRNLVFLGIAVSKPDLITCLKQGKEPWN

SEQ ID NO: 1210 - protein, 81 aa, Pan paniscus
MGPLTFTDVAIKFSLEEWQFLDTAQQNLYRDVMLENYRNLVFLGVGVSKPDLITCLEQGEEPWKRHKMVSKPPVVCSHFAQ

SEQ ID NO: 1211 - protein, 81 aa, Pan paniscus
MGSLTFWDVAIQFSLEEWQCLDTAQQNLYRNVMLENYRNLVFLGIAAPKPDLIIFLEQGKEPWNMKRHELVKEPPVICSHF

SEQ ID NO: 1212 - protein, 81 aa, Pan paniscus
MGALTFRDVAIEFSLEEWQCLDTEQQNLHRNVMLENYRNLVFLGIAVSKPDLITCLEQEKEPWNLKTHDMVAKPPVICSHI

SEQ ID NO: 1213 - protein, 81 aa, Pan paniscus; identical to SEQ ID NO: 368

SEQ ID NO: 1214 - protein, 81 aa, Pan paniscus
MDVAIEFSVEEWQCLDTAQQNLYRNVMLENYRNLVFLGIAVSKPDLITCLEQGKEPWNMERHEMVAKPPGMCCYFAQDLWP

SEQ ID NO: 1215 - protein, 81 aa, Pan paniscus
TPGTPGSLEMGLLTFRDVAIEFSPEEWQCLDTAQQNLYRNVMLENYRNLAFLGIAVSKPDLITCLEQGKEPWNMKQHEMVD

SEQ ID NO: 1216 - protein, 81 aa, Pan paniscus
QYWRATAKTPGTPGSLEMGLLTFRDVAIEFSPEEWQCLDTAQQNLYRNVMLENYRNLAFLGIAVSKPDLITCLEQGKEPWN

SEQ ID NO: 1217 - protein, 81 aa, Pan paniscus
TPGTPGSLEMGLLTFRDVAIEFSPEEWQCLDTAQQNLYRNVMLENYRNLAFLGICPHFPQDFWPEQSMEDSFQKVLLRKYE

SEQ ID NO: 1218 - protein, 81 aa, Pan paniscus
MGLLTFRDVAIEFSLEEWQCLDTAQRNLYKNVILENYRNLVFLGIAVSKQDLITCLEQEKEPLTVKRHEMVNEPPGSVGQT

SEQ ID NO: 1219 - protein, 81 aa, Pan paniscus
MGLLTFRDVAIEFSLEEWQCLDTAQRNLYKNVILENYRNLVFLGIAVSKQDLITCLEQEKEPLTVKRHEMVNEPPGLPLMP

SEQ ID NO: 1220 - protein, 81 aa, Pan paniscus; identical to SEQ ID NO: 369

SEQ ID NO: 1221 - protein, 81 aa, Pan paniscus
MGLLTFRDVAIEFSLEEWQCLDTAQRNLYKNVILENYRNLVFLGIAVSKQDLITCLEQEKEPLTVKRHEMVNEPPAVDKHP

SEQ ID NO: 1222 - protein, 81 aa, Pan paniscus
MGLLTFRDVAIEFSLEEWQCLDTAQRNLYKNVILENYRNLVFLGIAVSKQDLITCLEQEKEPLTVKRHEMVNEPPESCPVV

SEQ ID NO: 1223 - protein, 81 aa, Pan paniscus; identical to SEQ ID NO: 370

SEQ ID NO: 1224 - protein, 81 aa, Pan paniscus
MGLLTFRDVAIEFSLEEWQCLDTAQKNLYRNVMLENYRNLAFLGIAVSKPDLIICLEKEKEPWNMKRDEMVDEPPDGVSLC

SEQ ID NO: 1225 - protein, 81 aa, Pan paniscus
MGLLTFRDVAIEFSLEEWQCLDTAQKNLYRNVMLENYRNLAFLGIAVSKPDLIICLEKEKEPWNMKRDEMVDEPPGLAVSN

SEQ ID NO: 1226 - protein, 81 aa, Pan paniscus; identical to SEQ ID NO: 371

SEQ ID NO: 1227 - protein, 81 aa, Pan paniscus; identical to SEQ ID NO: 372

SEQ ID NO: 1228 - protein, 81 aa, Pan paniscus
MPGPPRSLEMGLLTFRDVAIEFSLEEWQHLDIAQQNLYRNVMLENYRNLAFLGIAVSKPDLITCLEQGKEPWNMKRHEMVD

SEQ ID NO: 1229 - protein, 81 aa, Pan paniscus; identical to SEQ ID NO: 373

SEQ ID NO: 1230 - protein, 81 aa, Pan paniscus; identical to SEQ ID NO: 374

SEQ ID NO: 1231 - protein, 81 aa, Pan paniscus; identical to SEQ ID NO: 375

SEQ ID NO: 1232 - protein, 81 aa, Pan paniscus
MSQVTFSDVAIDFSHEEWACLDSAQRDLYKDVMVQNYENLVSVGLSVTKPYVIMLLEDGKEPWMMEKKLSKDWESRWENKE

SEQ ID NO: 1233 - protein, 81 aa, Pan paniscus
EELVGQNHGMEGEACTGGDVTFSDVAIDFSHEEWACLDSAQRDLYKDVMVQNYENLVSVGLSVTKPYVIMLLEDGKEPWMM

SEQ ID NO: 1234 - protein, 81 aa, Pan paniscus
MSQVTFSDVAIDFSHEEWACLDSAQRDLYKDVMVQNYENLVSVGLSVTKPYVIMLLEDGKEPWMMEKKLSKGMIPDWESRW

SEQ ID NO: 1235 - protein, 81 aa, Pan paniscus
MSQVTFSDVAIDFSHEEWACLDSAQRDLYKDVMVQNYENLVSVAGLSVTKPYVIMLLEDGKEPWMMEKKLSKGMIPDWESR

SEQ ID NO: 1236 - protein, 81 aa, Pan paniscus
SNEELVGQNHGMEGEACIGGDVTFNDVAIDFSHEEWGWLSSAQRDLYKDVMVQNYENLVSVAGLSITKPYVITLLEDGKEP

SEQ ID NO: 1237 - protein, 81 aa, Pan paniscus
MPQVTFNDVAIDFSHEEWGWLSSAQRDLYKDVMVQNYENLVSVAGLSITKPYVITLLEDGKEPWMMEKKLSKGMIPHWESR

SEQ ID NO: 1238 - protein, 81 aa, Pan paniscus
MPQVTFNDVAIDFSHEEWGWLSSAQRDLYKDVMVQNYENLVSVGLSITKPYVITLLEDGKEPWMMEKKLSKGMIPHWESRR

SEQ ID NO: 1239 - protein, 81 aa, Pan paniscus
MPQVTFNDVAIDFSHEEWGWLSSAQRDLYKDVMVQNYENLVSVAGLSITKPYVITLLEDGKEPWMMEKKLSKDWESRRENK

SEQ ID NO: 1240 - protein, 81 aa, Pan paniscus
MAAPALALVSFEDVVVTFTGEEWGHLDLAQRTLYQEVMLETCRLLVSLGHPVPKPELIYLLEHGQELWTVKRGLSQSTCTG

SEQ ID NO: 1241 - protein, 81 aa, Pan paniscus
MAAPALALVSFEDVVVTFTGEEWGHLDLAQRTLYQEVMLETCRLLVSLGHPVPKPELIYLLEHGQELWTVKRGLSQSTCTA

SEQ ID NO: 1242 - protein, 81 aa, Pan paniscus
MAHKYVGLQYQGSVTFEDVAIAFSQQEWESLDSSQRGLYRDVMLENYRNLVSMAGHSLSKPHVIALLEQWKEPEVTVRKDG

SEQ ID NO: 1243 - protein, 81 aa, Pan paniscus
MAHKYVGLQYQGSVTFEDVAIAFSQQEWESLDSSQRGLYRDVMLENYRNLVSMGHSLSKPHVIALLEQWKEPEVTVRKDGR

SEQ ID NO: 1244 - protein, 81 aa, Pan paniscus
MAAAALRDPAQGCVTFEDVTIYFSQEEWVLLDEAQRLLYCDVMLENFALIASLGLISFRSHIVSQLEMGKEPWVPDSVDMT

SEQ ID NO: 1245 - protein, 81 aa, Pan paniscus
MAQGLVTFRDVAIEFSLEEWKCLEPAQRDLYREVTLENFGHLASLGLSISKPDVVSLLEQGKDPWMIANDVTGPWCPDLES

SEQ ID NO: 1246 - protein, 81 aa, Pan paniscus
EESREIRAGQIVLKAMAQGLVTFRDVAIEFSLEEWKCLEPAQRDLYREVTLENFGHLASLGLSISKPDVVSLLEQGKDPWM

SEQ ID NO: 1247 - protein, 81 aa, Pan paniscus
MAHGSVTFRDVAIDFSQEEWEFLDPAQRDLYRDVMWENYSNFISLGPSISKPDVITLLDEERKEPGMVVREGTRRYCPDLE

SEQ ID NO: 1248 - protein, 81 aa, Pan paniscus
MAHGSVTFRDVAIDFSQEEWEFLDPAQRDLYRDVMWENYSNFISLAGPSISKPDVITLLDEERKEPGMVVREGTRRYCPGE

SEQ ID NO: 1249 - protein, 81 aa, Pan paniscus
MALRSVMFSDVSIDFSPEEWEYLDLEQKDLYRDVMLENYSNLVSLGCFISKPDVISSLEQGKEPWKVVRKGRRQYPDLETK

SEQ ID NO: 1250 - protein, 81 aa, Pan paniscus
MALRSVMFSDVSIDFSPEEWEYLDLEQKDLYRDVMLENYSNLVSLAGCFISKPDVISSLEQGKEPWKVVRKGRRQYPDLET

SEQ ID NO: 1251 - protein, 81 aa, Pan paniscus
MAQESVMFSDVSVDFSQEEWECLNDDQRDLYRDVMLENYSNLVSMGHSISKPNVISYLEQGKEPWLVDRELTRGQWPVLES

SEQ ID NO: 1252 - protein, 81 aa, Pan paniscus
MAQESVMFSDVSVDFSQEEWECLNDDQRDLYRDVMLENYSNLVSMAGHSISKPNVISYLEQGKEPWLVDRELTRGQWPVLE

SEQ ID NO: 1253 - protein, 81 aa, Pan paniscus
PVLESRCETKKLFLKKEIYEIESTQWEIMEKLTRHDFQCSSFRDDWECNRQFKKELGSQGGHFNQLVFTHEDLPTLSHHPS

SEQ ID NO: 1254 - protein, 81 aa, Pan paniscus
MPEVEFPDQFFTVLTMDHELVTLRDVVINFSQEEWEYLDSAQRNLYWDVMMENYSNLLSLDLESRNETKHLSVGKDIKNTG

SEQ ID NO: 1255 - protein, 81 aa, Pan paniscus
MMENYSNLLSLDLESRNETKHLSVGKDIKNTGSQWEVMESSKLCGLEGSIFRNDWQSKSKIEVQGPEVGYFSQMKIISENV

SEQ ID NO: 1256 - protein, 81 aa, Pan paniscus
FTVLTMDHELVTLRDVVINFSQEEWEYLDSAQRNLYWDVMMENYSNLLSLDLESRNETKHLSVGKDIKNTGSQWEVMESSK

SEQ ID NO: 1257 - protein, 81 aa, Pan paniscus
MPLQGSVSFKDVTVDFTQEEWQQLDPAQKALYRDVMLENYCHFVSVGFHMAKPDMIRKLEQGEELWTQRIFPSYSYLEEDG

SEQ ID NO: 1258 - protein, 81 aa, Pan paniscus
FHMAKPDMIRKLEQGEELWTQRIFPSYSYLEEDGKTEDVLVKFKEYQDRHSRSLILINHKKLIKERSNIYGKTFTLGRNRI

SEQ ID NO: 1259 - protein, 81 aa, Pan paniscus
MSQGSVSFKDVTVDFTQEEWQQLDPAQKALYRDVMLENYCHFVSVGFHMAKPDMIRKLEQGEELWTQRIFPSYSYLEEDGK

SEQ ID NO: 1260 - protein, 81 aa, Pan paniscus
MPLQGSVSFKDVTVDFTQEEWQQLDPAQKALYRDVMLENYCHFVSVGFHMAKPDMIRKLEQGEELWTQRIFPSYSYLEDGK

SEQ ID NO: 1261 - protein, 81 aa, Pan paniscus
GFHMAKPDMIRKLEQGEELWTQRIFPSYSYLEDGKTEDVLVKFKEYQDRHSRSLILINHKKLIKERSNIYGKTFTLGRNRI

SEQ ID NO: 1262 - protein, 81 aa, Pan paniscus
MAHELVMFRDVAIDVSQEEWECLNPAQRNLYKEVMLENYSNLVSLGLSVSKPAVISSLEQGKEPWMVVREETGRWCPGTWK

SEQ ID NO: 1263 - protein, 81 aa, Pan paniscus
MAHELVMFRDVAIDVSQEEWECLNPAQRNLYKEVMLENYSNLVSLGLSVSKPAVISSLEQGKEPWMVVREETGRWCPDLAS

SEQ ID NO: 1264 - protein, 81 aa, Pan paniscus
LTHELVMFRDVAIDVSQEEWECLNPAQRNLYKEVMLENYSNLVSLGLSVSKPAVISSLEQGKEPWMVVREETGRWCPGTWK

SEQ ID NO: 1265 - protein, 81 aa, Pan paniscus
MAQGSVSFNDVTVDFTQEEWQHLDHAQKTLYMDVMLENYCHLISVGCHMTKPDVILKLERGEEPWTSFAGHTCLEENWKAE

SEQ ID NO: 1266 - protein, 81 aa, Pan paniscus
MDVMLENYCHLISVGCHMTKPDVILKLERGEEPWTSFAGHTCLEENWKAEDFLVKFKEHQEKYSRSVVSINHKKLVKEKSK

SEQ ID NO: 1267 - protein, 81 aa, Pan paniscus
MNMEGLVMFQDLSIDFSQEEWECLDAAQKDLYRDVMMENYSSLVSLGLSIPKPDVISLLEQGKEPWMVSRDVLGGWCRDRL

SEQ ID NO: 1268 - protein, 81 aa, Pan paniscus
MNMEGLVMFQDLSIDFSQEEWECLDAAQKDLYRDVMMENYSSLVSLDSEFRCKTKDSCLPKEIYEVTSSQWVRMEKCHSLV

SEQ ID NO: 1269 - protein, 81 aa, Pan paniscus
MNMEGLVMFQDLSIDFSQEEWECLDAAQKDLYRDVMMENYSSLVSLGLSIPKPDVISLLEQGKEPWMVSRDVLGGWCRDSE

SEQ ID NO: 1270 - protein, 81 aa, Pan paniscus
MAHLMMFRDVAVDFSQEEWECLDLEQRGLYRDVMLENYSNMVSLGLCIYQPEAFSLLEKGKEPWKILRDETRGPCPDMQSR

SEQ ID NO: 1271 - protein, 81 aa, Pan paniscus
HPEEEERMHDELLQAVSKGPVMFRDVSIDFSQEEWECLDAGQMNLYKEVMLENFSNLVSVGLSNSKPAVISLLEQGKEPWM

SEQ ID NO: 1272 - protein, 81 aa, Pan paniscus
CSQESALSEEEEDTTRPLETVTFKDVAVDLTQEEWEQMKPAQRNLYRDVMLENYSNLVTVGCQVTKPDVIFKLEQEEEPWV

SEQ ID NO: 1273 - protein, 81 aa, Pan paniscus
QEEWEQMKPAQRNLYRDVMLENYSNLVTVGCQVTKPDVIFKLEQEEEPWVMEEEMFGRHCPERRGENCCASEVMAEMEFCS

SEQ ID NO: 1274 - protein, 81 aa, Pan paniscus
MKPAQRNLYRDVMLENYSNLVTVGCQVTKPDVIFKLEQEEEPWVMEEEMFGRHCPEVWEVDEQIKKQQETLVRKVTSISKK

SEQ ID NO: 1275 - protein, 81 aa, Pan paniscus
RHCPERRGENCCASEVMAEGLKFKDVVIYFSQKEWECLHSAQKDLYRDVMLENYGNLVLLGLSDTKPNVISLLEQKKEPWM

SEQ ID NO: 1276 - protein, 81 aa, Pan paniscus
MKPAQRNLYRDVMLENYSNLVTVGCQVTKPDVIFKLEQEEEPWVMEEEMFGRHCPERRGENCCASEVMAEGLKFKDVVIYF

SEQ ID NO: 1277 - protein, 81 aa, Pan paniscus
MAEGLKFKDVVIYFSQKEWECLHSAQKDLYRDVMLENYGNLVLLGLSDTKPNVISLLEQKKEPWMVKRKETKEWCPDWEFG

SEQ ID NO: 1278 - protein, 81 aa, Pan paniscus
MARKLVMFRDVAIDFSQEEWECLDSAQRDLYRDVMLENYSNLVSLDLPSRCASKDLSPEKNTYETELSQWEMSDRFENCDL

SEQ ID NO: 1279 - protein, 81 aa, Pan paniscus
TELSQWEMSDRFENCDLEESNSRDYLEAKGKMEKQQENQKEYFRQGMIIYDKMSIFNQHTYLSQHSRCHSTEKPYKCKECG

SEQ ID NO: 1280 - protein, 81 aa, Pan paniscus
LAPEDHGSSYEGSVSFRDVAIDFSREEWRHLDPSQRNLYRDVMLETYSHLLSVGYQVPEAEVVMLQQGKEPWALQGERPRH

SEQ ID NO: 1281 - protein, 81 aa, Pan paniscus
SPQKSSTLAPEDHGSSYEGSVSFRDVAIDFSREEWRHLDLSQRNLYRDVMLETYSHLLSVGYQVPKPEVVMLEQGKEPWAL

SEQ ID NO: 1282 - protein, 81 aa, Pan paniscus
SPQKSSALAPEDHGSSYEGSVSFRDVAIDFSREEWRHLDPSQRNLYRDVMLETYSHLLSVGYQVPEAEVVMLQQGKEPWAL

SEQ ID NO: 1283 - protein, 81 aa, Pan paniscus
MQLNEEINKGSVSFRDVAIDFSREEWRHLDLSQRNLYRDVMLETYSHLLSVGYQVPKPEVVMLEQGKEPWALQGERPRHSC

SEQ ID NO: 1284 - protein, 81 aa, Pan paniscus
REEWRHLDLSQRNLYRDVMLETYSHLLSVGYQVPKPEVVMLEQGKEPWALQGERPRHSCPGEKLWDHNQHRKIIGYKPASS

SEQ ID NO: 1285 - protein, 81 aa, Pan paniscus
NEEINKGSVSFRDVAIDFSREEWRHLDLSQRNLYRDVMLETYSHLLSVGYQVPKPEVVMLEQGKEPWALQGERPRHSCPGE

SEQ ID NO: 1286 - protein, 81 aa, Pan paniscus
MAEGSVMFSDVSIDFSQEEWDCLDPVQRDLYRDVMLENYSNLVSMGLYTPKPQVISLLEQGKEPWMVGRELTRGLCSDLES

SEQ ID NO: 1287 - protein, 81 aa, Pan paniscus
MAEGSVMFSDVSIDFSQEEWDCLDPVQRDLYRDVMLENYSNLVSMGKGICTSDSQFSSGMSASSTVNFSAAFQDFTLLSLK

SEQ ID NO: 1288 - protein, 81 aa, Pan paniscus
MLETYNHLVSLEIPSSKPKLIAQLERGEEPWREERKCPLDLCPESKPEIQLSPSCPLIFSNQQALSQHVWLSHLSQLFSSL

SEQ ID NO: 1289 - protein, 81 aa, Pan paniscus
GEEPWREERKCPLDLCPESKPEIQLSPSCPLIFSNQQALSQHVWLSHLSQLFSSLWAGNPLQLGKHYPEDPKQQQDPFCLS

SEQ ID NO: 1290 - protein, 81 aa, Pan paniscus
MATGLLRAKKEEEWRLLSPAQRTLHREVMLETYNHLVSLEIPSSKPKLIAQLERGEEPWREERKCPLDLCPAESKPEIQLS

SEQ ID NO: 1291 - protein, 81 aa, Pan paniscus
KLIAQLERGEEPWREERKCPLDLCPAESKPEIQLSPSCPLIFSNQQALSQHVWLSHLSQLFSSLWAGNPLQLGKHYPEDPK

SEQ ID NO: 1292 - protein, 81 aa, Pan paniscus
MATGLLRAKKEAFVAFRDVAVDFTQEEWRLLSPAQRTLHREVMLETYNHLVSLEIPSSKPKLIAQLERGEEPWREERKCPL

SEQ ID NO: 1293 - protein, 81 aa, Pan paniscus
PWREERKCPLDLCPESKPEIQLSPSCPLIFSNQQALSQHVWLSHLSQLFSSLWAGNPLQLGKHYPEDPKQQQDPFCLSGKA

SEQ ID NO: 1294 - protein, 81 aa, Pan paniscus
WREERKCPLDLCPAESKPEIQLSPSCPLIFSNQQALSQHVWLSHLSQLFSSLWAGNPLQLGKHYPEDPKQQQDPFCLSGKA

SEQ ID NO: 1295 - protein, 81 aa, Pan paniscus
TCMVHRQTMSCSGAGGITAFVAFRDVAVDFTQEEWRLLSPAQRTLHREVMLETYNHLVSLEIPSSKPKLIAQLERGEEPWR

SEQ ID NO: 1296 - protein, 81 aa, Pan paniscus
MAVGLCKAMSQGLVTFRDVALDFSQEEWEWLKPSQKDLYRDVMLENYRNLVWLGLSISKPNMISLLEQGKEPWMVERKMSQ

SEQ ID NO: 1297 - protein, 81 aa, Pan paniscus
MAVGLCKAMSQGLVTFRDVALDFSQEEWEWLKPSQKDLYRDVMLENYRNLVWLDWESWCEIEELSPKWFIDEDEISQEMVM

SEQ ID NO: 1298 - protein, 81 aa, Pan paniscus
MAVGLCKAMSQGLVTFRDVALDFSQEEWEWLKPSQKDLYRDVMLENYRNLVWLGDGCSCHSTLRTTVTAEASSSSSSIQAS

SEQ ID NO: 1299 - protein, 81 aa, Pan paniscus
MTESQGTVTFKDVAIDFTQEEWKRLDPAQRKLYRNVMLENYNNLITVGYPFTKPDVIFKLEQEEEPWVMEEEVLRRHWQGE

SEQ ID NO: 1300 - protein, 81 aa, Pan paniscus
TSAGPIPSQKEEEMTESQGTVTFKDVAIDFTQEEWKRLDPAQRKLYRNVMLENYNNLITVGYPFTKPDVIFKLEQEEEPWV

SEQ ID NO: 1301 - protein, 81 aa, Pan paniscus
EMTESQGTVTFKDVAIDFTQEEWKRLDPAQRKLYRNVMLENYNNLITVGYPFTKPDVIFKLEQEEEPWVMEEEVLRRHWQG

SEQ ID NO: 1302 - protein, 81 aa, Pan paniscus
KSQEEERMAVGLLKAMYQELVTFRDVAVDFSQEEWDCLDSSQRHLYSNVMLENYRILVSLGLCFSKPSVILLLEQGKAPWM

SEQ ID NO: 1303 - protein, 81 aa, Pan paniscus
PICETEELTPKQDFYEEHQSQKIIETLTSYNLEYSSLREEWKCEGYFERQPRNQKACFKEEIITHEEPLFDEREQEYKSWG

SEQ ID NO: 1304 - protein, 81 aa, Pan paniscus
MAVGLLKAMYQELVTFRDVAVDFSQEEWDCLDSSQRHLYSNVMLENYRILVSLGLCFSKPSVILLLEQGKAPWMVKRELTK

SEQ ID NO: 1305 - protein, 81 aa, Pan paniscus
QGKAPWMVKRELTKGLCSGWEPICETEELTPKQDFYEEHQSQKIIETLTSYNLEYSSLREEWKCEGYFERQPRNQKACFKE

SEQ ID NO: 1306 - protein, 81 aa, Pan paniscus
MIEYQIPVSFKDVVVGFTQEEWHQLSPAQRALYRDVMLETYSNLVSVGYEGTKPDVILRLEQEEAPWIGEAACPGCHCWED

SEQ ID NO: 1307 - protein, 81 aa, Pan paniscus
MIEYQIPVSFKDVVVGFTQEEWHQLSPAQRALYRDVMLETYSNLVSVGYEGTKPDVILRLEQEEAPWIGEAACPGCHCWGI

SEQ ID NO: 1308 - protein, 81 aa, Pan paniscus
VVVGFTQEEWHQLSPAQRALYRDVMLETYSNLVSVGYEGTKPDVILRLEQEEAPWIGEAACPGCHCWGISKLWPTDWPPAL

SEQ ID NO: 1309 - protein, 81 aa, Pan paniscus
MIEYQIPVSFKDVVVGFTQEEWHQLSPAQRALYRDVMLETYSNLVSVGYEGTKPDVILRLEQEEAPWIGEAACPGCHCWGK

SEQ ID NO: 1310 - protein, 81 aa, Pan paniscus
EWHQLSPAQRALYRDVMLETYSNLVSVGYEGTKPDVILRLEQEEAPWIGEAACPGCHCWGKCDKSSKKGTEGGWHLWNFVQ

SEQ ID NO: 1311 - protein, 81 aa, Pan paniscus
EWHQLSPAQRALYRDVMLETYSNLVSVGYEGTKPDVILRLEQEEAPWIGEAACPGCHCWEDIWRVNIQRKRRQDMLLRQGA

SEQ ID NO: 1312 - protein, 81 aa, Pan paniscus
SFKDVVVGFTQEEWHQLSPAQRALYRDVMLETYSNLVSVGYEGTKPDVILRLEQEEAPWIGEAACPGCHCWALTVLRELQP

SEQ ID NO: 1313 - protein, 81 aa, Pan paniscus
FKDVVVGFTQEEWHQLSPAQRALYRDVMLETYSNLVSVGYEGTKPDVILRLEQEEAPWIGEAACPGCHCWALTVLRELQPH

SEQ ID NO: 1314 - protein, 81 aa, Pan paniscus
MAHALVTFRDVAIDFSQKEWECLDTTQRKLYRDVMLENYNNLVSLGYSGSKPDVITLLEQGKEPCVAARDVTGRQCPGLLS

SEQ ID NO: 1315 - protein, 81 aa, Pan paniscus
MAHALVTFRDVAIDFSQKEWECLDTTQRKLYRDVMLENYNNLVSLGLLSLHKTKKLSSEKDIHEISLSKGSIIEKSKTLHV

SEQ ID NO: 1316 - protein, 81 aa, Pan paniscus
MAHALVTFRDVAIDFSQKEWECLDTTQRKLYRDVMLENYNNLVSLAGYSGSKPDVITLLEQGKEPCVAARDVTGRQCPGLL

SEQ ID NO: 1317 - protein, 81 aa, Pan paniscus
MPHLLVTFRDVAIDFSQEEWECLDPAQRDLYRDVMLENYSNLISLEPARTHEEQHNLPVPKAGSVNLAAGFGHSRSQTGCG

SEQ ID NO: 1318 - protein, 81 aa, Pan paniscus
MPHLLVTFRDVAIDFSQEEWECLDPAQRDLYRDVMLENYSNLISLDLESSCVTKKLSPEKEIYEMESLQWENMGKLTNHHL

SEQ ID NO: 1319 - protein, 81 aa, Pan paniscus
MDLLFQLLVTFRDVAIDFSQEEWECLDPAQRDLYRDVMLENYSNLISLDLESSCVTKKLSPEKEIYEMESLQWENMGKLTN

SEQ ID NO: 1320 - protein, 81 aa, Pan paniscus
MARDLVMFRDVAVDFSQEEWECLNSYQRNLYRDVILENYSNLVSLGCSISKPDVITLLEQGKEPWMVVRDEKRRWTLGPTF

SEQ ID NO: 1321 - protein, 81 aa, Pan paniscus
MARDLVMFRDVAVDFSQEEWECLNSYQRNLYRDVILENYSNLVSLAGCSISKPDVITLLEQGKEPWMVVRDEKRRWTLDLE

SEQ ID NO: 1322 - protein, 81 aa, Pan paniscus
MARDLVMFRDVAVDFSQEEWECLNSYQRNLYRDVILENYSNLVSLGCSISKPDVITLLEQGKEPWMVVRDEKRRWTLDLES

SEQ ID NO: 1323 - protein, 81 aa, Pan paniscus
MAYGSITFGDVAIDFSHQEWEYLSLVQKTLYQEVMMENYDNLVSLAGHSVSKPDLITLLEQGKEPWMIVREETRGECTDLD

SEQ ID NO: 1324 - protein, 81 aa, Pan paniscus
MAYGSITFGDVAIDFSHQEWEYLSLVQKTLYQEVMMENYDNLVSLGHSVSKPDLITLLEQGKEPWMIVREETRGECTDLDS

SEQ ID NO: 1325 - protein, 81 aa, Pan paniscus
MAYGSITFGDVAIDFSHQEWEYLSLVQKTLYQEVMMENYDNLVSLGHSVSKPDLITLLEQGKEPWMIVREETRGECTAELQ

SEQ ID NO: 1326 - protein, 81 aa, Pan paniscus
CNWGRPLKVCPTKYMKFQELVTFRDVAIDFSRQEWEYLDPNQRDLYRDVMLENYRNLVSLGGHSISKPVVVDLLERGKEPW

SEQ ID NO: 1327 - protein, 81 aa, Pan paniscus
HQVGLIRSYNSKTMTCFQELVTFRDVAIDFSRQEWEYLDPNQRDLYRDVMLENYRNLVSLGGHSISKPVVVDLLERGKEPW

SEQ ID NO: 1328 - protein, 81 aa, Pan paniscus
MLENYRNLVSLDLDLQCEIISYIEVPTYETDISSTQLQSIYKREKLYECKKCQKKFSSGYQLILHHRFHVIERPYECKECG

SEQ ID NO: 1329 - protein, 81 aa, Pan paniscus
HQVGLIRSYNSKTMTCFQELVTFRDVAIDFSRQEWEYLDPNQRDLYRDVMLENYRNLVSLEMRSRCVARVGLKLLVSSDPP

SEQ ID NO: 1330 - protein, 81 aa, Pan paniscus
EPHQVGLIRSYNSKTMTCELVTFRDVAIDFSRQEWEYLDPNQRDLYRDVMLENYRNLVSLGGHSISKPVVVDLLERGKEPW

SEQ ID NO: 1331 - protein, 81 aa, Pan paniscus
MTCFQELVTFRDVAIDFSRQEWEYLDPNQRDLYRDVMLENYRNLVSLGGHSISKPVVVDLLERGKEPWMILREETQFTVRI

SEQ ID NO: 1332 - protein, 81 aa, Pan paniscus
TCNWGRPLKVCPTKYMKFQELVTFRDVAIDFSRQEWEYLDPNQRDLYRDVMLENYRNLVSLGGHSISKPVVVDLLERGKEP

SEQ ID NO: 1333 - protein, 81 aa, Pan paniscus
EETQGELTSSCGSKTMANVSLAFRDVSIDLSQEEWECLDTVQRDLYKDVMLENYSNLVSLGYTIPKPDVITLLEQEKEPWI

SEQ ID NO: 1334 - protein, 81 aa, Pan paniscus
MQVDPPLHGPPNDFLIFQIIPLHSLSIMPRFLWILCFSMEETQGELTSSCGSKTMANVSLAFRDVSIDLSQEEWECLDTVQ

SEQ ID NO: 1335 - protein, 81 aa, Pan paniscus
MVHGSVTFRDVAIDFSQEEWECLQPDQRTLYRDVMLENYSHLISLGSSISKPDVITLLEQEKEPWIVVSKETSRWYPDLES

SEQ ID NO: 1336 - protein, 81 aa, Pan paniscus
MVHGSVTFRDVAIDFSQEEWECLQPDQRTLYRDVMLENYSHLISLAGSSISKPDVITLLEQEKEPWIVIWSQNMDLRKYLQ

SEQ ID NO: 1337 - protein, 81 aa, Pan paniscus
MLENYSHLISLGSSISKPDVITLLEQEKEPWMVVRKETSRRYPDLESKYGPEKASPENDTSEVNLPKQVIKQISTTLGVEA

SEQ ID NO: 1338 - protein, 81 aa, Pan paniscus
GRSPRKIDQFCNSSNMVHGSVTFRDVAIDFSQEEWECLQPDQRTLYRDVMLENYSHLISLGSSISKPDVITLLEQEKEPWM

SEQ ID NO: 1339 - protein, 81 aa, Pan paniscus
MVHGSVTFRDVAIDFSQEEWECLQPDQRTLYRDVMLENYSHLISLGSSISKPDVITLLEQEKEPWMVVRKETSRRYPDLES

SEQ ID NO: 1340 - protein, 81 aa, Pan paniscus
MVHGSVTFRDVAIDFSQEEWECLQPDQRTLYRDVMLENYSHLISLAGSSISKPDVITLLEQEKEPWMVVRKETSRRYPDLE

SEQ ID NO: 1341 - protein, 81 aa, Pan paniscus
ESHGALISSRSSRTMTDGLVTFRDVAIDFSQEEWECLDPAQRDLYVDVMLENYSNLVSLDLESTTYETKKIFSENDIFEIN

SEQ ID NO: 1342 - protein, 81 aa, Pan paniscus
EESHGALISSRSSRTMTDGLVTFRDVAIDFSQEEWECLDPAQRDLYVDVMLENYSNLVSLDLESTTYETKKIFSENDIFEI

SEQ ID NO: 1343 - protein, 81 aa, Pan paniscus
ESCSGFSGFCASPIEESHGALISSRSSRTMTDGLVTFRDVAIDFSQEEWECLDPAQRDLYVDVMLENYSNLVSLGKLICLK

SEQ ID NO: 1344 - protein, 81 aa, Pan paniscus
MAQVPLTFSYVAIDFSQEEWEYLNSDQRDLYRDVMLENYTNLVSLEFDFTTESDKLSSEKRNYEVNAYHQETWKRNKTFNL

SEQ ID NO: 1345 - protein, 81 aa, Pan paniscus
FQVPLTFSYVAIDFSQEEWEYLNSDQRDLYRDVMLENYTNLVSLEFDFTTESDKLSSEKRNYEVNAYHQETWKRNKTFNLM

SEQ ID NO: 1346 - protein, 81 aa, Pan paniscus
MTKSKEAVTFKDVAVVFSEEELQLLDLAQRKLYQDVMLENFRNVVSVGHQSTPDGLPQLEREEKLWMMKMATQRDNSSGAK

SEQ ID NO: 1347 - protein, 81 aa, Pan paniscus
MLENFRNVVSVGHQSTPDGLPQLEREEKLWMMKMATQRDNSSGAKNLKEMETLQEVGLRYLPHEELFCSQIWQQITRELIK

SEQ ID NO: 1348 - protein, 81 aa, Pan paniscus
HLGLCKFPEVEGKMTTFKETVTFKDVAVVFTEEELGLLDPAQRKLYRDVMLENFRSLLLVGNQPFHQDTFHFLRKEEFWMM

SEQ ID NO: 1349 - protein, 81 aa, Pan paniscus
AQRKLYRDVMLENFRSLLLVGNQPFHQDTFHFLRKEEFWMMKTTSQREGNSGGKIQIEMETVPEAGPHEEWSYQQIREQIA

SEQ ID NO: 1350 - protein, 81 aa, Pan paniscus
MTTFKEAVTFKDVAVVFTEEELGLLDPAQRKLYRDVMLENFRNLLSVGHQPFHQDTCHFLREEKFWMMGTATQREGNSGGK

SEQ ID NO: 1351 - protein, 81 aa, Pan paniscus
FKDVAVVFTEEELGLLDPAQRKLYRDVMLENFRNLLSVGHQPFHQDTCHFLREEKFWMMGTATQREGNSGGKIQTELESVP

SEQ ID NO: 1352 - protein, 81 aa, Pan paniscus
LREEKFWMMGTATQREGNSGGKIQTELESVPEAGAHEEWSCQQIWEQIAKDLTRSQDCIINNSQFFENGDVPSQVEAGLPT

SEQ ID NO: 1353 - protein, 81 aa, Pan paniscus
MIKRSKVLVFCSKIMEEAVTFKDVAVVFTEEELGLLDPAQRKLYRDVMLENFRNLLSVGHQPFHQDTCHFLREEKFWMMGT

SEQ ID NO: 1354 - protein, 81 aa, Pan paniscus
DPAQRKLYRDVMLENFRNLLSVGHQPFHQDTCHFLREEKFWMMGTATQREGNSGGKIQTELESVPEAGAHEEWSCQQIWEQ

SEQ ID NO: 1355 - protein, 81 aa, Pan paniscus
DVMLENFRNLLSVGHQPFHQDTCHFLREEKFWMMGTATQREGNSGGKIQTELESVPEAGAHEEWSCQQIWEQIAKDLTRSQ

SEQ ID NO: 1356 - protein, 81 aa, Pan paniscus
MTTCKEAVTFKDVAVFFTEEELGLLDPAQRKLYQDVMLENFTNLLSVGHQPFHPFHFLREEKFWMMETATQREGNSGGKTV

SEQ ID NO: 1357 - protein, 81 aa, Pan paniscus
INNSHFFEQGDVPSQVEAGLSIIHTGQKPSQNGKCKQSFSDVAIFDPPQQFHSGEKSHTCNECGKSFCYISALRIHQRVHL

SEQ ID NO: 1358 - protein, 81 aa, Pan paniscus
MTTCKEAVTFKDVAVFFTEEELGLLDPAQRKLYQDVMLENFTNLLSVGHQPFHPFHFLREEKFWMMETATQREGNSGKKQA

SEQ ID NO: 1359 - protein, 81 aa, Pan paniscus
MIDSGEKKPGRRAEEAVTFKDVAVIFTEEELGLLDPAQRKLYRDVMLENFRNLLSVGHQPFHGDTFHFLREEKFWVMGTTS

SEQ ID NO: 1360 - protein, 81 aa, Pan paniscus
GRRAEEAVTFKDVAVIFTEEELGLLDPAQRKLYRDVMLENFRNLLSVGHQPFHGDTFHFLREEKFWVMGTTSQREGNLGPL

SEQ ID NO: 1361 - protein, 81 aa, Pan paniscus
MAKLYEAVTFKDVAVIFTEEELGLLDPAQRKLYRDVMLENFRNLLSVGGKIQTEMETVPEAGTHEEFSCKQIWEQIASDLT

SEQ ID NO: 1362 - protein, 81 aa, Pan paniscus
HSGLCKFPKVGGKMTMSKEAVTFKDVAVVFTEEELGLLDLAQRKLYRDVMLENFRNLLSVGHQPFHRDTFHFLREEKFWMM

SEQ ID NO: 1363 - protein, 81 aa, Pan paniscus
MTMSKEAVTFKDVAVVFTEEELGLLDLAQRKLYRDVMLENFRNLLSVGHQPFHRDTFHFLREEKFWMMDIATQREGNSGGK

SEQ ID NO: 1364 - protein, 81 aa, Pan paniscus
MTMSKEAVTFKDVAVVFTEEELGLLDLAQRKLYRDVMLENFRNLLSVGHQPFHRDTFHFLREEKFWMMDIATQREGNSGKK

SEQ ID NO: 1365 - protein, 81 aa, Pan paniscus
TFKDVAVVFTEEELGLLDLAQRKLYRDVMLENFRNLLSVGHQPFHRDTFHFLREEKFWMMDIATQREGNSGKKHATVCPCL

SEQ ID NO: 1366 - protein, 81 aa, Pan paniscus
MTMSKEAVTFKDVAVVFTEEELGLLDLAQRKLYRDVMLENFRNLLSVGHQPFHRDTFHFLREEKFWMMDIATQREGNSGGS

SEQ ID NO: 1367 - protein, 81 aa, Pan paniscus
MLENFRNLLSVGHQPFHRDTFHFLREEKFWMMDIATQREGNSGGKIQPEMKTFPEAGPHEGWSCQQIWEEIASDLTRPQDS

SEQ ID NO: 1368 - protein, 81 aa, Pan paniscus
MTMFKEAVTFKDVAVVFTEEELGLLDVSQRKLYRDVMLENFRNLLSVGHQLSHRDTFHFQREEKFWIMETATQREGNSGGK

SEQ ID NO: 1369 - protein, 81 aa, Pan paniscus
QREEKFWIMETATQREGNSGGKIQTELESVPETGPQEEWSCQQIWEQTASELTRPQDSISSSQFSTQGDVPSQVDAGLSII

SEQ ID NO: 1370 - protein, 81 aa, Pan paniscus
MTTFKEAMTFKDVAVVFTEEELGLLDLAQRKLYRDVMLENFRNLLSVGHQAFHRDTFHFLREEKIWMMKTAIQREGNSGDK

SEQ ID NO: 1371 - protein, 81 aa, Pan paniscus
MTTLKEAVTFKDVAVVFTEEELRLLDLAQRKLYREVMLENFRNLLSVGHQSLHRDTFYFLKEEKFWMMEIATQREGNLGGK

SEQ ID NO: 1372 - protein, 81 aa, Pan paniscus
ELRLLDLAQRKLYREVMLENFRNLLSVGHQSLHRDTFYFLKEEKFWMMEIATQREGNLGGKIQTEMETVSESGTHEGLFSH

SEQ ID NO: 1373 - protein, 81 aa, Pan paniscus
RNLLSVGHQSLHRDTFYFLKEEKFWMMEIATQREGNLGGKIQTEMETVSESGTHEGLFSHQTWEQISSDLTRFQDSMVNSF

SEQ ID NO: 1374 - protein, 81 aa, Pan paniscus
MTTLKEAVTFKDVAVVFTEEELRLLDLAQRKLYREVMLENFRNLLSVGHQSLHRDTFYFLKEEKFWMMEIATQREGNLGPA

SEQ ID NO: 1375 - protein, 81 aa, Pan paniscus
KDVAVVFTEEELRLLDLAQRKLYREVMLENFRNLLSVGHQSLHRDTFYFLKEEKFWMMEIATQREGNLGPAFQIPIKTEGF

SEQ ID NO: 1376 - protein, 81 aa, Pan paniscus
MTTFKEGLTFKDVAVVFTEEELGLLDPVQRNLYQDVMLENFRNLLSVGHHPFKHDVFLLEKEKKLDIMKTAIQRKGKSADK

SEQ ID NO: 1377 - protein, 81 aa, Pan paniscus
MTTFKEGLTFKDVAVVFTEEELGLLDPVQRNLYQDVMLENFRNLLSVADKIQSEVETVPEAGRHEELYWGQIWKQIASDLI

SEQ ID NO: 1378 - protein, 81 aa, Pan paniscus
MNMFKEAVTFKDVAVAFTEEELGLLGPAQRKLYRDVMVENFRNLLSVGHQPFKQDVSPIERNEQLWIMTTATRRQGNLGEK

SEQ ID NO: 1379 - protein, 81 aa, Pan paniscus
VGHQPFKQDVSPIERNEQLWIMTTATRRQGNLGEKNQSKLITVQDRESEEELSCWQIWQQIANDLTRCQDSMINNSQCHKQ

SEQ ID NO: 1380 - protein, 81 aa, Pan paniscus
MNMFKEAVTFKDVAVAFTEEELGLLGPAQRKLYRDVMVENFRNLLSVGHQPFKQDVSPIERNEQLWIMTTATRRQGNLGKN

SEQ ID NO: 1381 - protein, 81 aa, Pan paniscus
MNMFKEAVTFKDVAVAFTEEELGLLGPAQRKLYRDVMVENFRNLLSVGHQPFKQDVSPIERNEQLWIMTTATRRQGNLDTL

SEQ ID NO: 1382 - protein, 81 aa, Pan paniscus
MVENFRNLLSVGHQPFKQDVSPIERNEQLWIMTTATRRQGNLGEKNQSKLITVQDRESEEELSCWQIWQQIANDLTRCQDS

SEQ ID NO: 1383 - protein, 81 aa, Pan paniscus
RNEQLWIMTTATRRQGNLGEKNQSKLITVQDRESEEELSCWQIWQQIANDLTRCQDSMINNSQCHKQGDFPYQVGTELSIQ

SEQ ID NO: 1384 - protein, 81 aa, Pan paniscus
IERNEQLWIMTTATRRQGNLGEKNQSKLITVQDRESEEELSCWQIWQQIANDLTRCQDSMINNSQCHKQGDFPYQVGTELS

SEQ ID NO: 1385 - protein, 81 aa, Pan paniscus
SQNYDLPQKKQEKMTKFQEAVTFKDVAVVFSREELRLLDLTQRKLYRDVMVENFKNLVAVGHLPFQPDMVSQLEAEEKLWM

SEQ ID NO: 1386 - protein, 81 aa, Pan paniscus
SQNYDLPQKKQEKMTKFQEAVTFKDVAVVFSREELRLLDLTQRKLYRDVMVENFKNLVAVGSKHQNKMETLQKFALKYLSN

SEQ ID NO: 1387 - protein, 81 aa, Pan paniscus; identical to SEQ ID NO: 376

SEQ ID NO: 1388 - protein, 81 aa, Pan paniscus
MTKFQEAVTFKDVAVVFSREELRLLDLTQRKLYRDVMVENFKNLVAVGHLPFQPDMVSQLEAEEKLWMMETETQRKMRSCC

SEQ ID NO: 1389 - protein, 81 aa, Pan paniscus
MTKFQEAVTFKDVAVVFSREELRLLDLTQRKLYRDVMVENFKNLVAVDMVSQLEAEEKLWMMETETQRSSKHQNKMETLQK

SEQ ID NO: 1390 - protein, 81 aa, Pan paniscus
MTKFQEAVTFKDVAVAFTEEELGLLDSAQRKLYRDVMLENFRNLVSVGHQSFKPDMISQLEREEKLWMKELQTQRGKHSET

SEQ ID NO: 1391 - protein, 81 aa, Pan paniscus
MTKFQEAVTFKDVAVAFTEEELGLLDSAQRKLYRDVMLENFRNLVSVGHQSFKPDMISQLEREEKLWMKELQTQRGKHSVW

SEQ ID NO: 1392 - protein, 81 aa, Pan paniscus
MTKFQEAVTFKDVAVAFTEEELGLLDSAQRKLYRDVMLENFRNLVSVGHQSFKPDMISQLEREEKLWMKELQTQRGKHSGF

SEQ ID NO: 1393 - protein, 81 aa, Pan paniscus
MTKFQEAVTFKDVAVAFTEEELGLLDSAQRKLYRDVMLENFRNLVSVGHQSFKPDMISQLEREEKLWMKELQTQRGKHSGD

SEQ ID NO: 1394 - protein, 81 aa, Pan paniscus
MTKFQEAVTFKDVAVAFTEEELGLLDSAQRKLYRDVMLENFRNLVSVGHQSFKPDMISQLEREEKLWMKELQTQRGDRNQN

SEQ ID NO: 1395 - protein, 81 aa, Pan paniscus
SPRTLPFPRRRGKMTKFQEAVTFKDVAVAFTEEELGLLDSAQRKLYRDVMLENFRNLVSVGHQSFKPDMISQLEREEKLWM

SEQ ID NO: 1396 - protein, 81 aa, Pan paniscus
MTKFQEMVTFKDVAVVFTREELGLLDLAQRKLYQDVTLENFRNLLSVGYQPFKLDVILQLGKEDKLLMMETEIQGDGCSGE

SEQ ID NO: 1397 - protein, 81 aa, Pan paniscus
MTKFQEMVTFKDVAVVFTREELGLLDLAQRKLYQDVTLENFRNLLSVGYQPFKLDVILQLGKEDKLLMMETEIQGDGCSGH

SEQ ID NO: 1398 - protein, 81 aa, Pan paniscus
FWRYNLVLPSQDPALPQKEQEKMTKFQEMVTFKDVAVVFTREELGLLDLAQRKLYQDVTLENFRNLLSVGYQPFKLDVILQ

SEQ ID NO: 1399 - protein, 81 aa, Pan paniscus
MTKFQEMVTFKDVAVVFTREELGLLDLAQRKLYQDVTLENFRNLLSVGYQPFKLDVILQLGKEDKLLMMETEIQGDGCSGL

SEQ ID NO: 1400 - protein, 81 aa, Pan paniscus
MTKFQEMVTFKDVAVVFTREELGLLDLAQRKLYQDVTLENFRNLLLSTLQTRCDITVGKRRQASDDGDRNPRRWVFRTQES

SEQ ID NO: 1401 - protein, 81 aa, Pan paniscus
MVTFKDVAVVFTEEELGLLDSVQRKLYRDVMLENFRNLLLVAHQPFKPDLISQLEREEKLLMVETETPGDGCSGRKNQQKM

SEQ ID NO: 1402 - protein, 81 aa, Pan paniscus
MTKFQEMVTFKDVAVVFTEEELGLLDSVQRKLYRDVMLENFRNLLLVAHQPFKPDLISQLEREEKLLMVETETPGDGCSGR

SEQ ID NO: 1403 - protein, 81 aa, Pan paniscus
SLPFSRKRKRKMTKFQEMVTFKDVAVVFTEEELGLLDSVQRKLYRDVMLENFRNLLLVAHQPFKPDLISQLEREEKLLMVE

SEQ ID NO: 1404 - protein, 81 aa, Pan paniscus
MIKFQMVTFKDVAVVFTEEELGLLDSVQRKLYRDVMLENFRNLLLVAHQPFKPDLISQLEREEKLLMVETETPGDGCSGRK

SEQ ID NO: 1405 - protein, 81 aa, Pan paniscus
MIKFQERVTFKDVAVVFTKEELALLDKAQINLYQDVMLENFRNLMSVRDGIKNNILNLQAKGLSYLSQEVLHCWQIWKQRI

SEQ ID NO: 1406 - protein, 81 aa, Pan paniscus
MIKFQIQGIHVQERVTFKDVAVVFTKEELALLDKAQINLYQDVMLENFRNLMSVRDGIKNNILNLQAKGLSYLSQEVLHCW

SEQ ID NO: 1407 - protein, 81 aa, Pan paniscus
HSQASAISQDREEKIMSQEPLSFKDVAVVFTEEELELLDSTQRQLYQDVMQENFRNLLSVGDKNGKDMEYIQDEELRFFSH

SEQ ID NO: 1408 - protein, 81 aa, Pan paniscus
HSQASAISQDREEKIMSQEPLSFKDVAVVFTEEELELLDSTQRQLYQDVMQENFRNLLSVGERNPLGDKNGKDMEYIQDEE

SEQ ID NO: 1409 - protein, 81 aa, Pan paniscus
TLTSRHEKRALHSQASAISQDREEKIMSQEPLSFKDVAVVFTEEELELLDSTQRQLYQDVMQENFRNLLSVGERNPLGNWN

SEQ ID NO: 1410 - protein, 81 aa, Pan paniscus
LHSQASAISQDREEKIMSQEPLSFKDVAVVFTEEELELLDSTQRQLYQDVMQENFRNLLSVAEKSSLGISFLRTRISFLGV

SEQ ID NO: 1411 - protein, 81 aa, Pan paniscus
IIIKVEGEDTGSLTIPSQEGVNFKIVTVDFTQEEQGTWNPAQRTLDRDVILENHRDLVSWDLATAVGKKDSTSKQRIFDEE

SEQ ID NO: 1412 - protein, 81 aa, Pan paniscus
SMEEQDEKPPEPPKACAQEGVNFKIVTVDFTQEEQGTWNPAQRTLDRDVILENHRDLVSWDLATAVGKKDSTSKQRIFDEE

SEQ ID NO: 1413 - protein, 81 aa, Pan paniscus
MSQDSVTFADVAVNFTKEEWTLLDPAQRNLYRDVMLENSRNLAFIDWATPCKTKDATPQPDILPKRTFPEANRVCLTSISS

SEQ ID NO: 1414 - protein, 81 aa, Pan paniscus
PSSASRVAETTGTRPHSRDSVTFADVAVNFTKEEWTLLDPAQRNLYRDVMLENSRNLAFIDWATPCKTKDATPQPDILPKR

SEQ ID NO: 1415 - protein, 81 aa, Pan paniscus
MAEEFVTLKDVGMDFTLGDWEQLGLEQGDTFWDTALDNCQDLFLLDPPRPNLTSHPDGGEDLEPLAGGSPEATGPDVTETK

SEQ ID NO: 1416 - protein, 81 aa, Pan paniscus
MDFTLGDWEQLGLEQGDTFWDTALDNCQDLFLLDPPRPNLTSHPDGGEDLEPLAGGSPEATGPDVTETKNSPLMEDFFEEG

SEQ ID NO: 1417 - protein, 81 aa, Pan paniscus
LSQKPQVLGPEKQDGSCEASVSFEDVTVDFSREEWQQLDPAQRCLYRDVMLELYSHLFSVGYHIPNPEVIFRMLKEKEPRV

SEQ ID NO: 1418 - protein, 81 aa, Pan paniscus
NATIVMSVRREQGSSSGEGSLSFEDVAVGFTREEWQFLDQSQKVLYREVMLEDYSNLVSIGYQGTKPDSLFKLEQGEPPGI

SEQ ID NO: 1419 - protein, 81 aa, Pan paniscus
MTKAQESLTLEDVAVDFTWEEWQFLSPAQKNLYRDVMLENYSNLVAVGYQAGKPDALTKLEQGEPLWTLEDEIHSPAHPEI

SEQ ID NO: 1420 - protein, 81 aa, Pan paniscus; identical to SEQ ID NO: 377

SEQ ID NO: 1421 - protein, 81 aa, Pan paniscus
YSNLVSVGYQASKPDALFKLEQGEPWTVENEIHSQICPEIKKVDNHLQMHSQKQRCLKRVEQCHKHNAFGNIIHQRKSDFP

SEQ ID NO: 1422 - protein, 81 aa, Pan paniscus
MIKSQESLTLEDVAVEFTWEEWQLLGPAQKDLYRDVMLENYSNLVSVGYQASKPDALFKLEQGEPWTVENEIHSQICPEIK

SEQ ID NO: 1423 - protein, 81 aa, Pan paniscus
MIQAQESLTLEDVAVDFTWEEWQLLSPAQKDLYRDVMLENYSNLVAVGYQASKPDALFKLEQGEQPWTTEDGIHSGACSDI

SEQ ID NO: 1424 - protein, 81 aa, Pan paniscus
FAYMSCLVKHKRIHTREKQEAAKVENPPAERHSSLHTSDVMQEKNSANGVTTQVPSVAPQTSLNISGLLANRNVVLVGQPV

SEQ ID NO: 1425 - protein, 81 aa, Pan paniscus
MLENYSNLVAVGYQASKPDALFKLEQGEQPWTTEDGIHSGACSDIWKVDHVLERLQSESLVNRRKPCHEHDAFENIVHCSK

SEQ ID NO: 1426 - protein, 81 aa, Pan paniscus
MMQAQESLTLEDVAVDFTWEEWQFLSPAQKDLYQDVMLENYSNLVAVGYQASKPDAFSKLERGEETCTTEDEIYSRICSDS

SEQ ID NO: 1427 - protein, 81 aa, Pan paniscus
MMQAQESLTLEDVAVDFTWEEWQFLSPAQKDLYQDVMLENYSNLVAVGYQASKPDAFSKLERGEETCTTEDEIYSRICSEI

SEQ ID NO: 1428 - protein, 81 aa, Pan paniscus
MRPEPTKFWEESLTLEDVAVDFTWEEWQFLSPAQKDLYQDVMLENYSNLVAVGYQASKPDAFSKLERGEETCTTEDEIYSR

SEQ ID NO: 1429 - protein, 81 aa, Pan paniscus
MMQAQESLTLEDVAVDFTWEEWQFLSPAQKDLYQDVMLENYSNLVAVGYQASKPDAFSKLERGEETCTTEDEIYSRICSGR

SEQ ID NO: 1430 - protein, 81 aa, Pan paniscus
MESLTLEDVAVDFTWEEWQFLSPAQKDLYQDVMLENYSNLVAVGYQASKPDAFSKLERGEETCTTEDEIYSRICSDSGGAS

SEQ ID NO: 1431 - protein, 81 aa, Pan paniscus
MIKTQESLTLEDVAVEFSWEEWQLLDTAQKNLYRDVMVENYNHLVSLGYQTSKPDVLSKLAHGQEPWITDGKIQNKNCPGI

SEQ ID NO: 1432 - protein, 80 aa, Pan paniscus
MIKTQESLTLEDVAVEFSWEEWQLLDTAQKNLYRDVMVENYNHLVSLGYQTSKPDVLSKLAHGQEPWITDGKIQNKNCPD

SEQ ID NO: 1433 - protein, 81 aa, Pan paniscus
MINAQELLTLEDVTVEFTWEEWQLLGPFQKDLYRDVMLEIYSNLLSMGYQVSKPDALSKLERGEEPWTMEDERHSRICPEN

SEQ ID NO: 1434 - protein, 81 aa, Pan paniscus
ALSKLERGEEPWTMEDERHSRICPENNKVDDHLQDHLENQRMLKSVEQYHEHNAFGNTASQTKSLCLFRENHDTFELYIKT

SEQ ID NO: 1435 - protein, 81 aa, Pan paniscus
LLSMGYQVSKPDALSKLERGEEPWTMEDERHSRICPENNKVDDHLQDHLENQRMLKSVEQYHEHNAFGNTASQTKSLCLFR

SEQ ID NO: 1436 - protein, 81 aa, Pan paniscus
MINAQELLTLEDVTVEFTWEEWQLLGPFQKDLYRDVMLEIYSNLLSMGYQVSKPDALSKLERGEEPWTMEDERHSRICPGT

SEQ ID NO: 1437 - protein, 81 aa, Pan paniscus
MALPQGSLTFRDVAIEFSQEEWKCLDSVQKALYRDVMLENYRNLGFLGLCLPDLNIISVLEQGKEPWTVVSQVKIARNPNC

SEQ ID NO: 1438 - protein, 81 aa, Pan paniscus
MATQGHLTFKDVAIEFSQEEWKCLEPMQKALYKDVMLENYRNLVFLGISPKYVIKELPPTENSNTGERFQTVPLERHQSYD

SEQ ID NO: 1439 - protein, 81 aa, Pan paniscus
MALTQGPLTFRDVAIEFSQEEWKSLDPVQKALYWDVMLENYRNLVFLGILPKCMTKELPPIGNSNTGEKCQTVTLERHECY

SEQ ID NO: 1440 - protein, 81 aa, Pan paniscus
CIDKSSPIAHVEMCFSFQGPLTFRDVAIEFSQEEWKSLDPVQKALYWDVMLENYRNLVFLGILPKCMTKELPPIGNSNTGE

SEQ ID NO: 1441 - protein, 81 aa, Pan paniscus
LDPVQKALYWDVMLENYRNLVFLGILPKCMTKELPPIGNSNTGEKCQTVTLERHECYDVENFYLREIQKNLQDLEFQWKDG

SEQ ID NO: 1442 - protein, 81 aa, Pan paniscus
MALTQGPLTFRDVAIEFSQEEWKSLDPVQKALYWDVMLENYRNLVFLGKDNFALEVKICPRVFLYFLCCLSWEPFHYLTET

SEQ ID NO: 1443 - protein, 81 aa, Pan paniscus
MAQLRRGHLTFRDVAIEFSQEEWKCLDPVQKALYRDVMLENYRNLVSLGICLPDLSIISMMKQRTEPWAVENEMKVAKNPD

SEQ ID NO: 1444 - protein, 81 aa, Pan paniscus
EGEAQKRNAEESGMPLTQGHLTFRDVAIEFSQEEWKCLDPVQKALYRDVMLENYRNLVSLGICLPDLSIISMMKQRTEPWA

SEQ ID NO: 1445 - protein, 81 aa, Pan paniscus
MLENYRNLVSLGICLPDLSIISMMKQRTEPWAVENEMKVAKNPDRWEGIKDINTGRSCAVRSKAGNKPITNQLGLTFHLPL

SEQ ID NO: 1446 - protein, 81 aa, Pan paniscus
MGHLTFRDVAIEFSQEEWKCLDPVQKALYRDVMLENYRNLVSLGICLPDLSIISMMKQRTEPWAVENEMKVAKNPDRWEGI

SEQ ID NO: 1447 - protein, 81 aa, Pan paniscus
AQKRRKRKAKESGMALPQGHLTFRDVAIEFSQAEWKCLDPAQRALYKDVMLENYRNLVSLGISLPDLNINSMLEQRREPWS

SEQ ID NO: 1448 - protein, 81 aa, Pan paniscus
AQKRRKRKAKESGMALPQGHLTFRDVAIEFSQAEWKCLDPAQRALYKDVMLENYRNLVSLGSSYALGSNAEDKPIKKQLGV

SEQ ID NO: 1449 - protein, 81 aa, Pan paniscus
PWSGENEVKIAKNSDGKECIKGVNTGWSAMVQSRLTATSTSWVQAVLLPQPPEQLGLQGAAMHWEAMQKTNQLKNNLEYPF

SEQ ID NO: 1450 - protein, 81 aa, Pan paniscus
DEEAQKRKAKESGMALPQGHLTFTDVAIEFSQEEWKSLDPGQRALYRDVMLENYRNLVFLGICLPDLSIISMLKQRREPLI

SEQ ID NO: 1451 - protein, 81 aa, Pan paniscus
DEEAQKRKAKESGMALPQGHLTFTDVAIEFSQEEWKSLDPGQRALYRDVMLENYRNLVFLGRSCVLGSNAENKPIKNQLGL

SEQ ID NO: 1452 - protein, 81 aa, Pan paniscus
MLRRGHLTFRDVAIEFSQEEWKCLDPAQRTLYREVMVENYRNLVFLGICLPDLSVISMLEQRRDPRNLQSEVKIANNPGGR

SEQ ID NO: 1453 - protein, 81 aa, Pan paniscus
MLRRGHLTFRDVAIEFSQEEWKCLDPAQRTLYREVMVENYRNLVFLGICLPDLSVISMLEQRRDPRNLQSEVKIANNPGSC

SEQ ID NO: 1454 - protein, 81 aa, Pan paniscus
MALTQGPLKFMDVAIEFSQEEWKCLDPAQRTLYRDVMLENYRNLVSLGICLPDLSVTSMLEQKRDPWTLQSEEKIANDPDG

SEQ ID NO: 1455 - protein, 81 aa, Pan paniscus
MDVAIEFSQEEWKCLDPAQRTLYRDVMLENYRNLVSLGICLPDLSVTSMLEQKRDPWTLQSEEKIANDPDGRECIKGVNTV

SEQ ID NO: 1456 - protein, 81 aa, Pan paniscus
KEATRKRKEKKSGMALTQGPLKFMDVAIEFSQEEWKCLDPAQRTLYRDVMLENYRNLVSLGICLPDLSVTSMLEQKRDPWT

SEQ ID NO: 1457 - protein, 81 aa, Pan paniscus
LYRDVMLENYRNLVSLGICLPDLSVTSMLEQKRDPWTLQSEEKIANDPDGRECIKGVNTDSPLLQCITSVPCVFCTASMIN

SEQ ID NO: 1458 - protein, 81 aa, Pan paniscus
MALAQGQLSFSDVAIEFSQEEWKCLDPGQKALYRDVMLENYRNLISLGICLPDLSVTSMLEQKRDPWTLQSEVKIVNNPDG

SEQ ID NO: 1459 - protein, 81 aa, Pan paniscus
MALAQGQLSFSDVAIEFSQEEWKCLDPGQKALYRDVMLENYRNLISLGEDNVPPEACFCSGICLPDLSVTSMLEQKRDPWT

SEQ ID NO: 1460 - protein, 81 aa, Pan paniscus
MALAQGQLSFSDVAIEFSQEEWKCLDPGQKALYRDVMLENYRNLISLDFSLLAWDARVSRVEAWRASGGAEEPTDPNFVGN

SEQ ID NO: 1461 - protein, 81 aa, Pan paniscus
EEAAQKRKGKEPGMALPQGRLTFRDVAIEFSLAEWKFLNPSQRALYREVMLENYRNLEAVDISSKRMMKEVLSTGQGNTEV

SEQ ID NO: 1462 - protein, 81 aa, Pan paniscus
EEAAQKRKGKEPGMALPQGRLTFRDVAIEFSLAEWKCLNPSQRALYREVMLENYRNLEAVDISSKRMMKEVLSTGQGNTEV

SEQ ID NO: 1463 - protein, 81 aa, Pan paniscus
REEAAQKRKGKEPGMALPQGRLTFRDVAIEFSLAEWKCLNPSQRALYREVMLENYRNLEAVDISSKRMMKEVLSTGQGNTE

SEQ ID NO: 1464 - protein, 81 aa, Pan paniscus
KTRKRKRKAKESGMALPQGLLTFRDVAIEFSQEEWKCLDPAQRTLYRDVMLENYRNLVFLDTSSKCMMKMFSSTGQGNTEV

SEQ ID NO: 1465 - protein, 81 aa, Pan paniscus
MALPQGLLTFRDVAIEFSQEEWKCLDPAQRTLYRDVMLENYRNLVFLDTSSKCMMKMFSSTGQGNTEVVHTGTLQIHASHH

SEQ ID NO: 1466 - protein, 81 aa, Pan paniscus
EEAAQKRKGREPGMALPQGRLTFRDVAIEFSLAEWKFLNPAQRALYREVMLENYRNLEAVDISSKRMMKEVLSTGQGNTEV

SEQ ID NO: 1467 - protein, 81 aa, Pan paniscus
EEAAQKRKGREPGMALPQGRLTFRDVAIEFSLAEWKFLNPAQRALYREVMLENYRNLEAVESHFVTQAGVQWCDPGSLQPL

SEQ ID NO: 1468 - protein, 80 aa, Pan paniscus
MLREEAAQKRKGREPGMALPQGRLTFRDVAIEFSLAEWKFLNPAQRALYREVMLENYRNLEAVETGFHCVSQDGLNLLTS

SEQ ID NO: 1469 - protein, 81 aa, Pan paniscus
MALPQGLLTFRDVAIEFSQEEWKCLDPAQRTLYRDVMLENYRNLVSLDISSKCMMKTFFSTGQGNTEVIHTGTLQRQASHH

SEQ ID NO: 1470 - protein, 81 aa, Pan paniscus
MALPQGLLTFRDVAIEFSQEEWKCLDPAQRTLYRDVMLENYRNLVSLDFRSVTQAKVQWCHLGSLQPPLPRFKQFSCLSLP

SEQ ID NO: 1471 - protein, 81 aa, Pan paniscus
MALPQGLLTFRDVAIEFSQEEWKCLDPAQRTLYRDVMLENYRNLVSLDISSKCMLKTLSSTGQGNTEVIHTGTLQRQASHH

SEQ ID NO: 1472 - protein, 81 aa, Pan paniscus
MALPQGLLTFRDVAIEFSQEEWKCLDPAQRTLYRDVMLENYRNLVSLEFWSVTPAKVQWCHLRSLQPLLPRFKQFSCLSLP

SEQ ID NO: 1473 - protein, 81 aa, Pan paniscus
KCLDPAQRTLYRDVMLENYRNLVSLEFWSVTPAKVQWCHLRSLQPLLPRFKQFSCLSLPSTWDYRYLFQMHVEDVVINRAR

SEQ ID NO: 1474 - protein, 81 aa, Pan paniscus
LEFWSVTPAKVQWCHLRSLQPLLPRFKQFSCLSLPSTWDYRYLFQMHVEDVVINRARQYRSDPHRDIAKTSKSSHWRILFP

SEQ ID NO: 1475 - protein, 81 aa, Pan paniscus
MALPQGLLTFRDVAIEFSQEEWKCLDPAQRTLYRDVMLENYRNLVSLVRRSEVCCTDIWAEVIVADISSKCMLKTLSSTGQ

SEQ ID NO: 1476 - protein, 81 aa, Pan paniscus
MSLVQGLLTFRDVAIEFSQEEWKCLDPAQRTLYRDVMLENYRNLVSLEFWSVTPAKVQWCHLRSLQPLLPRFKQFSCLSLP

SEQ ID NO: 1477 - protein, 81 aa, Pan paniscus
MALPQSLLTFRDVAIEFSQEEWKCLDPAQRTLYRDVMLENYRNLVSLGLISRDLCYVRKTPRRQRKGARDGSSSGMLDFQR

SEQ ID NO: 1478 - protein, 81 aa, Pan paniscus
MALPQSLLTFRDVAIEFSQEEWKCLDPAQRTLYRDVMLENYRNLVSLDISSKCMMNTLSSTGQGNTEVIHTGTLQRQASYH

SEQ ID NO: 1479 - protein, 81 aa, Pan paniscus
MALPQSLLTFRDVAIEFSQEEWKCLDPAQRTLYRDVMLENYRNLVSLGQGNTEVIHTGTLQRQASYHIGAFCSQEIEKDIH

SEQ ID NO: 1480 - protein, 81 aa, Pan paniscus
MALPQGLLTFRDVAIEFSQEEWKCLDPAQRTLYRDVMLENYRNLVSLDISSKCMMKEFSSIGKGNTEVIHTGTLQRLARHH

SEQ ID NO: 1481 - protein, 81 aa, Pan paniscus
EEATKKSKEKEPGMALPQGRLTFRDVAIEFSLEEWKCLNPAQRALYRAVMLENYRNLEFVDISSKCMMKVFSSTAQGNREM

SEQ ID NO: 1482 - protein, 81 aa, Pan paniscus
LTGSTDQYDQRHAGNKLIKGQLGSSSHSHLPEHIFQPEWKIANQVEKSIINASLILTSQRISCSPKTHISNNYGNNSLHSS

SEQ ID NO: 1483 - protein, 81 aa, Pan paniscus
EEATKKSKEKEPGMALPQGRLTFRDVAIEFSLEEWKCLNPAQRALYRAVMLENYRNLEFVDSSLKSMMEFSSTRHSNTGEV

SEQ ID NO: 1484 - protein, 81 aa, Pan paniscus
EEATKKSKEKEPGMALPQGRLTFRDVAIEFSLEEWKCLNPAQRALYRAVMLENYRNLEFVGEENVPPDMRNLHLSILALSG

SEQ ID NO: 1485 - protein, 81 aa, Pan paniscus
MALTQVRLTFRDVAIEFSQEEWKCLGPAQRILYRDVMLENYWNLVSLGLCHFDMNIISMLEEGKEPWTVKSCVKIARKPRM

SEQ ID NO: 1486 - protein, 81 aa, Pan paniscus
MLENYWNLVSLGLCHFDMNIISMLEEGKEPWTVKSCVKIARKPRMRECVKGVVTDIPPKCTIKDLLPKEKSSTEAVFHTVV

SEQ ID NO: 1487 - protein, 81 aa, Pan paniscus
MAFTQLTFRDVAIEFSQDEWKCLNSTQRTLYRDVMLENYRNLVSLDLSRNCVIKELAPQQEGNPGEVFHTVTLEQHEKHDI

SEQ ID NO: 1488 - protein, 81 aa, Pan paniscus
MAFTQLTFRDVAIEFSQDEWKCLNSTQRTLYRDVMLENYRNLVSLEYYPMWEHRKEPWTIESQVQVARKPKGWEWIKGVKT

SEQ ID NO: 1489 - protein, 81 aa, Pan paniscus
MDGDGLTFRDVAIEFSQDEWKCLNSTQRTLYRDVMLENYRNLVSLDLSRNCVIKELAPQQEGNPGEVFHTVTLEQHEKHDI

SEQ ID NO: 1490 - protein, 81 aa, Pan paniscus
AHEEETQKRRAKESGMAFTQLTFRDVAIEFSQDEWKCLNSTQRTLYRDVMLENYRNLVSLDLSRNCVIKELAPQQEGNPGE

SEQ ID NO: 1491 - protein, 81 aa, Pan paniscus
MDGDGLTFRDVAIEFSQDEWKCLNSTQRTLYRDVMLENYRNLVSLEYYPMWEHRKEPWTIESQVQVARKPKGWEWIKGVKT

SEQ ID NO: 1492 - protein, 81 aa, Pan paniscus
MALTQGQVTFRDVAIEFSQEEWTCLDPAQRTLYRDVMLENYRNLASLGISCFDLSIISMLEQGKEPFTVESQVQIARNPDG

SEQ ID NO: 1493 - protein, 81 aa, Pan paniscus
MALTQGQVTFRDVAIEFSQEEWTCLDPAQRTLYRDVMLENYRNLASLAGISCFDLSIISMLEQGKEPFTVESQVQIARNPD

SEQ ID NO: 1494 - protein, 81 aa, Pan paniscus
MLENYRNLASLGISCFDLSIISMLEQGKEPFTVESQVQIARNPDGWEWIKAVITALSSEFVMKDLPHKGKSNTGEVFQTVM

SEQ ID NO: 1495 - protein, 81 aa, Pan paniscus
SMLEQGKEPFTVESQVQIARNPDGWEWIKAVITALSSEFVMKDLPHKGKSNTGEVFQTVMLERQESQDIEGCSFRELQKNT

SEQ ID NO: 1496 - protein, 81 aa, Pan paniscus
MALPQGQLTFKDVAIEFSQEEWTCLDPAQKTLYRDVMLENYRNLVSLDISCKCVNTDLPPKGKNNMGEAFYTVKLERLESC

SEQ ID NO: 1497 - protein, 81 aa, Pan paniscus
MALSQGLFTFKDVAIEFSQEEWECLDPAQRALYRDVMLENYRNLLSLDEDNIPPENDISVGFTSKGLSPKENNKEELYHLV

SEQ ID NO: 1498 - protein, 81 aa, Pan paniscus
ALYRDVMLENYRNLLSLDEDNIPPENDISVGFTSKGLSPKENNKEELYHLVILERKESHGINNFDLKEVWENMPKFDSLWD

SEQ ID NO: 1499 - protein, 81 aa, Pan paniscus
LYRDVMLENYRNLLSLDEDNIPPENDISVGFTSKGLSPKENNKEELYHLVILERKESHGINNFDLKEVWENMPKFDSLWDY

SEQ ID NO: 1500 - protein, 80 aa, Pan paniscus
MALSQGLFTFKDVAIEFSQEEWECLDPAQRALYRDVMLENYRNLLSLDEDNIPPENAFYSIQELRETLVFLIPYSSKICL

SEQ ID NO: 1501 - protein, 81 aa, Pan paniscus
MALPQSLLTFRDVAIEFSQEEWKCLDPAQRTLYRDVMLENYRNLVSLDISSKCMMKEFSSTAQGNTEVIHTGTLQRHERHH

SEQ ID NO: 1502 - protein, 81 aa, Pan paniscus
MALPQGLLTFRDVAIEFSQEEWKCLDPAQRTLYRDVMLENYRNLVSLGSCCAVEVGLDLLGSRHPPRPPKKLGLQAPTPVP

SEQ ID NO: 1503 - protein, 81 aa, Pan paniscus
MALPQGLLTFRDVAIEFSQEEWKCLDPAQRTLYRDVMLENYRNLVSLGISSKCTMKEFSSTAQGNTEVIHTGTLQRHESHH

SEQ ID NO: 1504 - protein, 81 aa, Pan paniscus
MLENYRNLVSLGISSKCTMKEFSSTAQGNTEVIHTGTLQRHESHHIGDFSFQEIEKDIHNFEFQWQEDERNGHEAPMTKIK

SEQ ID NO: 1505 - protein, 81 aa, Pan paniscus
MALPQGLLTFRDVAIEFSQEEWKCLDPAQRTLYRDVMLENYRNLVSLDISSKCMMKEFSSTAQGNREVFHAGTSQRHESHH

SEQ ID NO: 1506 - protein, 81 aa, Pan paniscus
MAFSQGLLTFRDVAIEFSQEEWKCLDPAQRTLYRDVMLENYRNLVSLDISSKCTMKEFLSTAQGNREVFHAGTLQIHESHH

SEQ ID NO: 1507 - protein, 81 aa, Pan paniscus
MALPQGLLTFRDVAIEFSQEEWKCLDPAQRTLYRDVMLENYRNLVSLDISSKCMMKEVLSTAQGNTEVIHTGTLQRHESHH

SEQ ID NO: 1508 - protein, 81 aa, Pan paniscus
MALPQGLLTFRDVAIEFSQEEWKCLDPAQRTLYRDVMLENYRNLVSLDTGFLLFCLADLKLLPSGDPSTSASKTAAITDIS

SEQ ID NO: 1509 - protein, 81 aa, Pan paniscus
MAQCLVTFADVAIDFSQEEWACLNSAQRDLYWDVMLENYSNLVSLDLESAYENKSLPTEKNIHEIRASKRNSDRRSKSLGR

SEQ ID NO: 1510 - protein, 81 aa, Pan paniscus
PVTTQDTVPAQCALAMSQGSVTFQDVAIDFSKEEWGFLNPAQRDLYTTVMLENYQNLVWLGLSISKSVISLLEKRKLPWIM

SEQ ID NO: 1511 - protein, 81 aa, Pan paniscus
MSLGSELFRDVAIVFSQEEWQWLAPAQRDLYRDVMLETYSNLVSLGLAVSKPDVISFLEQGKEPWMVERVVSGGLCPGAKG

SEQ ID NO: 1512 - protein, 81 aa, Pan paniscus
MSLGSELFRDVAIVFSQEEWQWLAPAQRDLYRDVMLETYSNLVSLGLAVSKPDVISFLEQGKEPWMVERVVSGGLCPVLES

SEQ ID NO: 1513 - protein, 81 aa, Pan paniscus
DTKELFPKQHVYEVESTQWEIMESLTSYGLECSSFQDDWECRNQFDRQQGNPDRHFHQMIIRHEEMPTFDQHASLTFYQKI

SEQ ID NO: 1514 - protein, 81 aa, Pan paniscus
MSKDLVTFGDVAVNFSQEEWEWLNPAQRNLYRKVMLENYRSLVSLGVSVSKPDVISLLEQGKEPWMVKKEGTRGPCPDWEY

SEQ ID NO: 1515 - protein, 81 aa, Pan paniscus
ITHKEILPEVQNKEYNKSWQTFHQDTIFDIEQSFPTKEKAHKHEPQKKSYRKKSVEMKHRKVYVEKKLLKCNDCEKVFNQS

SEQ ID NO: 1516 - protein, 81 aa, Pan paniscus
MPSARGKSKSKAPITFGDLAIYFSQEEWEWLSPIQKDLYEDVMLENYRNLVSLGLSFRRPNVITLLEKGKAPWMVEPVRRR

SEQ ID NO: 1517 - protein, 81 aa, Pan paniscus
MNVEVVKVMPQDLVTFKDVAIDFSQEEWQWMNPAQKRLYRSMMLENYQSLVSLGLCISKPYVISLLEQGREPWEMTSEMTR

SEQ ID NO: 1518 - protein, 81 aa, Pan paniscus
NKKLEAVGTGIEPKTMSQGLVTFGDVAVDFSQEEWEWLNPIQRNLYRKVMLENYRNLASLGLCVSKPDVISSLEQGKEPWT

SEQ ID NO: 1519 - protein, 81 aa, Pan paniscus
LEYSLLGEHWDYDALFETQPGLVTIKNLAVDFRQQLHPAQKNFCKNGIWENNSDLGSAGHCVAKPDLVSLLEQEKEPWMVK

SEQ ID NO: 1520 - protein, 81 aa, Pan paniscus
SQEEVEVAGIKLCKAMSLGSVTFTDVAIDFSQDEWEWLNLAQRSLYKKVMLENYRNLVSVGLCISKPDVISLLEQEKDPWV

SEQ ID NO: 1521 - protein, 81 aa, Pan paniscus
MAAQLLTDEAVESVTFRDVTVDFTQEEWQQLEPAQKDLYRDVMLENYRNLVSLDWETRPEMKELDPKNDISEDKLSVVGVA

SEQ ID NO: 1522 - protein, 81 aa, Pan paniscus
RDSRAYESRSQDAESYQNVVDLAEDRKPHNTIQDNMENYRKLLSLGFLAQDSVPAEKRNTEMLDNLPSAGSQFLDFKHLGT

SEQ ID NO: 1523 - protein, 81 aa, Pan paniscus
AGSQFLDFKHLGTFLVFEELVTFEDVLVDFSPEELSSLSAAQRNLYREVMLENYRNLVSLGHQFSKPDVISRLEEEESHAM

SEQ ID NO: 1524 - protein, 81 aa, Pan paniscus
MNNSQGRVTFEDVTVNFTQGEWQRLNPEQRNLYRDVMLENYSNLVSVGQEETTKPDVILRLEQGKEPWSEEEEVLGSGRAE

SEQ ID NO: 1525 - protein, 81 aa, Pan paniscus
MAAAVLTDRAQVSVTFDDVAVTFTKEEWGQLDLAQRTLYQEVMLENCGLLVSLGCPVPKAELICHLEHGQEPWTRKEDLSQ

SEQ ID NO: 1526 - protein, 81 aa, Pan paniscus
MAAAVLTDRAQVSVTFDDVAVTFTKEEWGQLDLAQRTLYQEVMLENCGLLVSLAPSQTHPGSIRCILQSNQVDTLIKIPEH

SEQ ID NO: 1527 - protein, 81 aa, Pan paniscus
MAAAVLTDRAQVSVTFDDVAVTFTKEEWGQLDLAQRTLYQEVMLENCGLLVSLGDKGKPKTTEPTTCEPALSEGISLQGQV

SEQ ID NO: 1528 - protein, 81 aa, Pan paniscus
MAMALTDPAQVSVTFDDVAVTFTQEEWGQLDLAQRTLYQEVMLENCGLLVSLGCPVPRPELICHLEHEQEPWTRKEDLSQG

SEQ ID NO: 1529 - protein, 81 aa, Pan paniscus
MAAAWMAPAQESVTFEDVAVTFTQEEWGQLDVTQRALYVEVMLETCGLLVALGDSTKPETVEPIPSHLALPEEVSLQEQLA

SEQ ID NO: 1530 - protein, 81 aa, Pan paniscus
MAASAQVSVTFQDVAVTFTQEEWGQLDAAQRTLYQEVMLETCGLLMSLGCPLFKPELIYQLDHRQELWMATKDLSQSSYPG

SEQ ID NO: 1531 - protein, 81 aa, Pan paniscus
MAAAVLMDRVQSCVTFEDVFVYFSREEWELLEEAQRFLYRDVMLENFALVATLGFWCEAEHEAPSEQSVSVEGVSQVRTAE

SEQ ID NO: 1532 - protein, 81 aa, Pan paniscus
MAAAVLMDRVQSCVTFEDVFVYFSREEWELLEEAQRFLYRDVMLENFALVATLAFIFPVPCSCAVGGGRKPWVPDRADITA

SEQ ID NO: 1533 - protein, 81 aa, Pan paniscus
MAEMNPAQGRVVFEDVAIYFSQEEWGHLDEAQRLLYRDVMLENLALLSSLGCCHGAEDEEAPLEPGVSVGVSQVMAPKPCL

SEQ ID NO: 1534 - protein, 81 aa, Pan paniscus
MYSSFPIWQGRVVFEDVAIYFSQEEWGHLDEAQRLLYRDVMLENLALLSSLGCCHGAEDEEAPLEPGVSVGVSQVMAPKPC

SEQ ID NO: 1535 - protein, 81 aa, Pan paniscus
VSVGVSQVMAPKPCLSTQNTQPCETCSSLLKDILRLAEHDGTHPEQGLYTCPAHLHQHQKEQIREKLSRGDGGRPTFVKNH

SEQ ID NO: 1536 - protein, 81 aa, Pan paniscus
MAEMNPAQGRVVFEDVAIYFSQEEWGHLDEAQRLLYRDVMLENLALLSSLGSWHGAEDEEAPSQQGFSVGVSEVTTSKPCL

SEQ ID NO: 1537 - protein, 81 aa, Pan paniscus
MNLTEGRVVFEDVAIYFSQEEWGHLDEAQRLLYRDVMLENLALLSSLGSWHGAEDEEAPSQQGFSVGVSEVTTSKPCLSSQ

SEQ ID NO: 1538 - protein, 81 aa, Pan paniscus
MNLTESPLAMAEMDPTQGRVVFEDVAIYFSQEEWGHLDEAQRLLYRDVMLENLALLSSLGSWHGAEDEEAPSQQGFSVGVS

SEQ ID NO: 1539 - protein, 81 aa, Pan paniscus
MNLTESPLAMAEMDPTQGRVVFEDVAIYFSQEEWGHLDEAQRLLYRDVMLENLALLSSLGKALTLAQCPGLGCVTPFYPKA

SEQ ID NO: 1540 - protein, 81 aa, Pan paniscus
MAEMDPTQGRVVFEDVAIYFSQEEWGHLDEAQRLLYRDVMLENLALLSSLGSWHGAEDEEAPSQQGFSVGVSEVTTSKPCL

SEQ ID NO: 1541 - protein, 81 aa, Pan paniscus
MNLTESPLAMAEMDPTQGRVVFEDVAIYFSQEEWGHLDEAQRLLYRDVMLENLALLSSLGFIAVAAMLMDAGQDYMVFEDV

SEQ ID NO: 1542 - protein, 81 aa, Pan paniscus
AIYFSQEEWGHLDEAQRLLYRDVMLENLALLSSLGFIAVAAMLMDAGQDYMVFEDVAIHFSQEEWGILNDVQRHLHSDVML

SEQ ID NO: 1543 - protein, 81 aa, Pan paniscus
MNLTESPLAMAEMDPTQDYMVFEDVAIHFSQEEWGILNDVQRHLHSDVMLENFALLSSVGCWHGAKDEEAPSKQCVSVGVS

SEQ ID NO: 1544 - protein, 81 aa, Pan paniscus
MLMDAGQDYMVFEDVAIHFSQEEWGILNDVQRHLHSDVMLENFALLSSVGCWHGAKDEEAPSKQCVSVGVSQVTTLKPALS

SEQ ID NO: 1545 - protein, 81 aa, Pan paniscus
MNLTEDYMVFEDVAIHFSQEEWGILNDVQRHLHSDVMLENFALLSSVGCWHGAKDEEAPSKQCVSVGVSQVTTLKPALSTQ

SEQ ID NO: 1546 - protein, 81 aa, Pan paniscus
MNLTEDCMVFEDVAIYFSQEEWGILNDAQRHLHSNVMLENFALLSSVGCWHGAKDEEVPSKQCVSVRVLQVTIPKPALSTL

SEQ ID NO: 1547 - protein, 81 aa, Pan paniscus
MGPAQVPMNSEVIVDPIQGQVNFEDVFVYFSQEEWVLLDEAQRLLYRDVMLENFALMASLGIPQTMAAFGLKYLLNDTGYT

SEQ ID NO: 1548 - protein, 81 aa, Pan paniscus
MGPAQVPMNSEVIVDPIQGQVNFEDVFVYFSQEEWVLLDEAQRLLYRDVMLENFALMASLGHTSFMSHIVASLVMGSEPWV

SEQ ID NO: 1549 - protein, 81 aa, Pan paniscus
MGPAQVPMNSEVIVDPIQGQVNFEDVFVYFSQEEWVLLDEAQRLLYRDVMLENFALMASLGCWHGMEDEEIPFEPSFSIGM

SEQ ID NO: 1550 - protein, 81 aa, Pan paniscus
MAAAEPMGPAQGQVNFEDVFVYFSQEEWVLLDEAQRLLYRDVMLENFALMASLGHTSFMSHIVASLVMGSEPWVPDWVDMT

SEQ ID NO: 1551 - protein, 81 aa, Pan paniscus
MNSEVIVDPIQGQVNFEDVFVYFSQEEWVLLDEAQRLLYRDVMLENFALMASLGHTSFMSHIVASLVMGSEPWVPDWVDMT

SEQ ID NO: 1552 - protein, 81 aa, Pan paniscus
MAAAALRDPAQQGYVTFEDVAVYFSQEEWRLLDDAQRLLYRNVMLENFTLLASLGLASSKTHEITQLESWEEPFMPAWEVV

SEQ ID NO: 1553 - protein, 81 aa, Pan paniscus
MAAAALRDPAQGYVTFEDVAVYFSQEEWRLLDDAQRLLYRNVMLENFTLLASLGLASSKTHEITQLESWEEPFMPAWEVVT

SEQ ID NO: 1554 - protein, 81 aa, Pan paniscus
DPAQVPVAADLLTDHEEQGYVTFEDVAVYFSQEEWRLLDDAQRLLYRNVMLENFTLLASLGKVLTPHPSILSWARLFLLFL

SEQ ID NO: 1555 - protein, 81 aa, Pan paniscus
MAAAALRDPAQGYVTFEDVAVYFSQEEWRLLDDAQRLLYRNVMLENFTLLASLGKVLTPHPSILSWARLFLLFLGRGLFFP

SEQ ID NO: 1556 - protein, 81 aa, Pan paniscus
DPAQVPVAADLLTDHEEQGYVTFEDVAVYFSQEEWRLLDDAQRLLYRNVMLENFTLLASLGLASSKTHEITQLESWEEPFM

SEQ ID NO: 1557 - protein, 81 aa, Pan paniscus
DPAQVPVAADLLTDHEEQGYVTFEDVAVYFSQEEWRLLDDAQRLLYRNVMLENFTLLASLGCWQGAEAEEAPEQSASVGLL

SEQ ID NO: 1558 - protein, 81 aa, Pan paniscus
MAAAALRDPAQGYVTFEDVAVYFSQEEWRLLDDAQRLLYRNVMLENFTLLASLGCWQGAEAEEAPEQSASVGLLSSNIQQH

SEQ ID NO: 1559 - protein, 81 aa, Pan paniscus; identical to SEQ ID NO: 378

SEQ ID NO: 1560 - protein, 81 aa, Pan paniscus
MAAAALRDPAQQGYVTFEDVAVYFSQEEWRLLDDAQRLLYRNVMLENFTLLASLGCWQGAEAEEAPEQSASVGLLSSNIQQ

SEQ ID NO: 1561 - protein, 81 aa, Pan paniscus
RDPAQVPVAADLLTDHEEGYVTFEDVAVYFSQEEWRLLDDAQRLLYRNVMLENFTLLASLGLASSKTHEITQLESWEEPFM

SEQ ID NO: 1562 - protein, 81 aa, Pan paniscus
RDPAQVPVAADLLTDHEEGYVTFEDVAVYFSQEEWRLLDDAQRLLYRNVMLENFTLLASLGCWQGAEAEEAPEQSASVGLL

SEQ ID NO: 1563 - protein, 81 aa, Pan paniscus
MAEAALVNTPQGHVTFEDIAVYFSQEEWGLLDEAQRCLYHDVMLENFSLMASVGCLHGIEAEEAPSEQTVSAQGVSQARTP

SEQ ID NO: 1564 - protein, 81 aa, Pan paniscus
VNTPQIPMVTEEFVKPSQGHVTFEDIAVYFSQEEWGLLDEAQRCLYHDVMLENFSLMASVGCLHGIEAEEAPSEQTVSAQG

SEQ ID NO: 1565 - protein, 81 aa, Pan paniscus
LVNTPQIPMVTEEFVKPSQGHVTFEDIAVYFSQEEWGLLDEAQRCLYHDVMLENFSLMASVAGLSQSNHKDSCSQQKVPVS

SEQ ID NO: 1566 - protein, 81 aa, Pan paniscus
MAETKDAAQMLVTFKDVAVTFTREEWRQLDLAQRTLYREVMLETCGLLVSLGHRVPKPELVHLLEHGQELWIVKRGLSHAT

SEQ ID NO: 1567 - protein, 81 aa, Pan paniscus
MLVTFKDVAVTFTREEWRQLDLAQRTLYREVMLETCGLLVSLGDRAQVHTREPTTYPPVLSERAFLRGSLTLESSTSSDSR

SEQ ID NO: 1568 - protein, 81 aa, Pan paniscus
RDSTSVPVTAEAKLMGFTQGCVTFEDVAIYFSQEEWGLLDEVQRLLYRDVMLENFALITALVCWHGMEDEETPEQSVSVEG

SEQ ID NO: 1569 - protein, 81 aa, Pan paniscus
MDLTKGCVTFEDIAIYFSQDEWGLLDEAQRLLYLEVMLENFALVASLGCGHGTEDEETPSDQNVSVGVSQSKAGSSTQKTQ

SEQ ID NO: 1570 - protein, 81 aa, Pan paniscus
MAAAALRAPTQGCVTFEDIAIYFSQDEWGLLDEAQRLLYLEVMLENFALVASLGCGHGTEDEETPSDQNVSVGVSQSKAGS

SEQ ID NO: 1571 - protein, 81 aa, Pan paniscus
RAPTQVTVSPETHMDLTKGCVTFEDIAIYFSQDEWGLLDEAQRLLYLEVMLENFALVASLGCGHGTEDEETPSDQNVSVGV

SEQ ID NO: 1572 - protein, 81 aa, Pan paniscus; identical to SEQ ID NO: 379

SEQ ID NO: 1573 - protein, 81 aa, Pan paniscus
MAAALRAPTQQGFVAFEDVAIYFSQEEWELLDEMQRLLYRDVMLENFAVMASLGCWCGAVDEGAPSAESVSVEELSQGRTP

SEQ ID NO: 1574 - protein, 81 aa, Pan paniscus
PASASQVAGTTGMRHHAQGSVTFEDVAVYFSWEEWDLLDEAQKHLYFDVMLENFALTSSLGCWCGVEHEETPSEQRISGER

SEQ ID NO: 1575 - protein, 81 aa, Pan paniscus
VQLRPQTRMATALRDPASGSVTFEDVAVYFSWEEWDLLDEAQKHLYFDVMLENFALTSSLGLTLSWSHVVAQLGLGEVPSV

SEQ ID NO: 1576 - protein, 81 aa, Pan paniscus
RDPASVPIATEVLFKLTQGSVTFEDVAVYFSWEEWDLLDEAQKHLYFDVMLENFALTSSLGCWCGVEHEETPSEQRISGER

SEQ ID NO: 1577 - protein, 81 aa, Pan paniscus
VQLRPQTRMATALRDPASGSVTFEDVAVYFSWEEWDLLDEAQKHLYFDVMLENFALTSSLGCWCGVEHEETPSEQRISGER

SEQ ID NO: 1578 - protein, 81 aa, Pan paniscus
RDPASVPIATEVLFKLTQGSVTFEDVAVYFSWEEWDLLDEAQKHLYFDVMLENFALTSSLGLTLSWSHVVAQLGLGEVPSV

SEQ ID NO: 1579 - protein, 81 aa, Pan paniscus
MTFEDVAIYFSQEEWELLDESQRFLYCDVMLENFAHVTSLGYCHGMENEAIASEQSVSIQVRTSKGNTPTQKTHLSEIKMC

SEQ ID NO: 1580 - protein, 81 aa, Pan paniscus
SLPSPRSSMAAVALRDSAQGMTFEDVAIYFSQEEWELLDESQRFLYCDVMLENFAHVTSLGYCHGMENEAIASEQSVSIQV

SEQ ID NO: 1581 - protein, 81 aa, Pan paniscus
MAAVALRDSAQGTVTFEDVAVNFSQEEWSLLSEAQRCLYHDVMLENLTLISSLGCWYGAKDETPSKQTLSIQQESPLRTHW

SEQ ID NO: 1582 - protein, 81 aa, Pan paniscus
MAAATLRTPTQGTVTFEDVAVHFSWEEWGLLDEAQRCLYREVMLENLALLTSLDVHHQKQHLGEKHFRSNVGRALFVKTCT

SEQ ID NO: 1583 - protein, 81 aa, Pan paniscus
PAAVRAHGPMAELTDSARGCVVFEDVFVYFSREEWELLDDAQRLLYHDVMLENFALLASLGIAFSRSRAVMKLERGEEPWV

SEQ ID NO: 1584 - protein, 81 aa, Pan paniscus
MAAAALRSPAQGTVTFEDVAVNFSQEEWSLLSEAQRCLYHDVMLENLTLISSLGCWYGAKDETPSKQTLSIQQESPLRTHW

SEQ ID NO: 1585 - protein, 81 aa, Pan paniscus
MAAAAALRAPAQSSVTFEDVAVNFSLEEWSLLNEAQGCLYHDVMLETLTLISSLGGVPPHTLFPTGACGPQVPSSRIRPSP

SEQ ID NO: 1586 - protein, 81 aa, Pan paniscus
MAAAAALRAPAQSSVTFEDVAVNFSLEEWSLLNEAQRCLYRDVMLETLTLISSLGCWHGGEDEAAPSKQSTCIHIYKDQGG

SEQ ID NO: 1587 - protein, 81 aa, Pan paniscus
MAAAALRFPVQGTVTFEDVAVKFTQEEWNLLSEAQRCLYRDVTLENLALMSSLGCWCGVEDEAAPSKQSIYIQRETQVRTP

SEQ ID NO: 1588 - protein, 81 aa, Pan paniscus
MAAAAPRRPTQGTVTFEDVAVKFTQEEWNLLSEAQRCLYRDVTLENLALISSLGCWCGVEDEAAPSKQSIYIQRETQVRTP

SEQ ID NO: 1589 - protein, 81 aa, Pan paniscus
MAVAVTLRLSAQGTVTFEDVAVKFTQEEWNLLSEAQRCLYRDVTLENLALISSLGCWCGVEDEAAPSKQSIYIQRETQVRT

SEQ ID NO: 1590 - protein, 81 aa, Pan paniscus
MAAAAPRRPTQGTVTFEDVAVNFSQEEWCLLSEAQRCLYRDVMLENLALISSLGCWCGSKDEEAPCKQSISVQRESQSRTP

SEQ ID NO: 1591 - protein, 81 aa, Pan paniscus
MAAAAPRRPTQQGTVTFEDVAVNFSQEEWCLLSEAQRCLYRDVMLENLALISSLGCWCGSKDEEAPCKQSISVQRESQSRT

SEQ ID NO: 1592 - protein, 81 aa, Pan paniscus
MAAAATLRLSAQGTVTFEDVAVNFTWEEWNLLSEAQRCLYRDVTLENLALISSLDPALDGSADNTQTGNLGQSVLPSHPEQ

SEQ ID NO: 1593 - protein, 81 aa, Pan paniscus
WRDHGSPQPPPTGDILIQGTVTFEDVAVNFTWEEWNLLSEAQRCLYRDVTLENLALISSLDPALDGSADNTQTGNLGQSVL

SEQ ID NO: 1594 - protein, 81 aa, Pan paniscus
MAAAATLRLSAQGTVTFEDVAVNFTWEEWNLLSEAQRCLYRDVTLENLALISSLGMTFLHVCQALDSLRQVIHPPRPPKML

SEQ ID NO: 1595 - protein, 81 aa, Pan paniscus
LSAQGTVTFEDVAVNFTWEEWNLLSEAQRCLYRDVTLENLALISSLGMTFLHVCQALDSLRQVIPTSASQNAGITGSHSIP

SEQ ID NO: 1596 - protein, 81 aa, Pan paniscus
MAAAATLRLSAQGTVTFEDVAVNFTWEEWNLLSEAQRCLYRDVTLENLALISSLGCWCGVEDEAAPSKQSIYIQRGTQVRT

SEQ ID NO: 1597 - protein, 81 aa, Pan paniscus
VAVNFSQEEWCLLSEAQRCLYRDVMLENLALISSLDCHLHLCQFLDLSPCWRVCLDKPYLFLRPAALRWVKEWNVCASAKA

SEQ ID NO: 1598 - protein, 81 aa, Pan paniscus
MAAAAPRRPTQQGTVTFEDVAVNFSQEEWCLLSEAQRCLYRDVMLENLALISSLGCWCGSKDEEAPCKQRISVQRESQSRT

SEQ ID NO: 1599 - protein, 81 aa, Pan paniscus
MAAAAPRRPTQGTVTFEDVAVNFSQEEWCLLSEAQRCLYRDVMLENLALISSLGCWCGSKDEEAPCKQRISVQRESQSRTP

SEQ ID NO: 1600 - protein, 81 aa, Pan paniscus
MQGTVAFEDVAVNFSQEEWSLLSEVQRCLYHDVMLENWVLISSLGCWCGSEDEEAPSKKSISIQRVSQVSTPGAGVSPKKA

SEQ ID NO: 1601 - protein, 81 aa, Pan paniscus
MQQGTVAFEDVAVNFSQEEWSLLSEVQRCLYHDVMLENWVLISSLGCWCGSEDEEAPSKKSISIQRVSQVSTPGAGVSPKK

SEQ ID NO: 1602 - protein, 81 aa, Pan paniscus
HRMTWDCIAIGSHENSVQGTVAFEDVAVNFSQEEWSLLSEVQRCLYHDVMLENWVLISSLGCWCGSEDEEAPSKKSISIQR

SEQ ID NO: 1603 - protein, 81 aa, Pan paniscus
MQGTVAFEDVAVNFSQEEWSLLSEVQRCLYHDVMLENWVLISSLGCWCGSEDEEAPSKKSISIQRVSQSVRLSAQAGVARS

SEQ ID NO: 1604 - protein, 81 aa, Pan paniscus
MAPAALRLPAQQGTVAFEDVAVNFSQEEWSLLSEVQRCLYHDVMLENWVLISSLGCWCGSEDEEAPSKKSISIQRVSQVST

SEQ ID NO: 1605 - protein, 81 aa, Pan paniscus
MAAAELTAPAQGIVTFEDVAVYFSWKEWGLLDEAQKCLYHDVMLENLTLTTSLGGSGAGDEEAPYEQSTSPQRVSQVRIPK

SEQ ID NO: 1606 - protein, 81 aa, Pan paniscus
GSLEEGRRATGLPAAQVQEPVTFKDVAVDFTQEEWGQLDLVQRTLYRDVMLETYGHLLSVGNQIAKPEVISLLEQGEEPWS

SEQ ID NO: 1607 - protein, 81 aa, Pan paniscus
RRRSVGCRCRGLCLAVRREQVTFEDVVVDFSQEEWGQLKPAQRTLYRDVMLDTFRLLVSVGHWLPKPNVISLLEQEAELWA

SEQ ID NO: 1608 - protein, 81 aa, Pan paniscus
MTPGVRVSTDPEQVTFEDVVVDFSQEEWGQLKPAQRTLYRDVMLDTFRLLVSVGHWLPKPNVISLLEQEAELWAVDSGLPQ

SEQ ID NO: 1609 - protein, 81 aa, Pan paniscus
QEEKQEDAAICPVTVLPEEPVTFQDVAVDFSREEWGLLGPTQRTEYRDVMLETFGHLVSVGWETTLENKELAPNSDIPEEE

SEQ ID NO: 1610 - protein, 81 aa, Pan paniscus
MASRLPTAWSCEPVTFEDVTLGFTPEEWGLLDLKQKSLYREVMLENYRNLVSVEHQLSKPDVVSQLEEAEDFWPVERGIPQ

SEQ ID NO: 1611 - protein, 81 aa, Pan paniscus
MASRLPTAWSCEPVTFEDVTLGFTPEEWGLLDLKQKSLYREVMLENYRNLVSVEYPELQLDPKLDPLPAESPLMNIEVVEV

SEQ ID NO: 1612 - protein, 81 aa, Pan paniscus; identical to SEQ ID NO: 380

SEQ ID NO: 1613 - protein, 81 aa, Pan paniscus
MEARSMLVPPQASVCFEDVAMAFTQEEWEHLDLAQRTLYREVTLETWEHIVSLGLFLSKSDVISQLEQEEDLCRAEQEAPR

SEQ ID NO: 1614 - protein, 81 aa, Pan paniscus
EDVAMAFTQEEWEHLDLAQRTLYREVTLETWEHIVSLGLFLSKSDVISQLEQEEDLCRAEQEAPRDGVSLLLPRLECNGTI

SEQ ID NO: 1615 - protein, 81 aa, Pan paniscus
EDVAMAFTQEEWEHLDLAQRTLYREVTLETWEHIVSLGLFLSKSDVISQLEQEEDLCRAEQEAPRGTRASKKQRRYRARRI

SEQ ID NO: 1616 - protein, 81 aa, Pan paniscus
MEARSMLVPPQASVCFEDVAMAFTQEEWEHLDLAQRTLYREVTLETWEHIVSLDWKATLEENRLNSEKDAREELSHHVEVY

SEQ ID NO: 1617 - protein, 81 aa, Pan paniscus
PQASVCFEDVAMAFTQEEWEHLDLAQRTLYREVTLETWEHIVSLGLFLSKSDVISQLEQEEDLCRAEQEAPRGTSGLSQVH

SEQ ID NO: 1618 - protein, 81 aa, Pan paniscus
DEGVAGVMSVGPPAARLQEPVTFRDVAVDFTQEEWGQLDPTQRILYRDVMLETFGHLLSIGPELPKPEVISQLEQGTELWV

SEQ ID NO: 1619 - protein, 81 aa, Pan paniscus
MAGEAEAQLDPSLQGLVMFEDVTVYFSREEWGLLNVTQKGLYRDVMLENFALVSSLGLAPSRSPVFTQLEDDEQSWVPSWV

SEQ ID NO: 1620 - protein, 81 aa, Pan paniscus
MAGEAEGLVMFEDVTVYFSREEWGLLNVTQKGLYRDVMLENFALVSSLGLAPSRSPVFTQLEDDEQSWVPSWVDVTPVSRA

SEQ ID NO: 1621 - protein, 81 aa, Pan paniscus
GPAQHTSWPCGSAVPTLKGMVTFEDVAVYFSQEEWELLDAAQRHLYHSVMLENLELVTSLGCWRGVEGEEAHPEQNVSVEV

SEQ ID NO: 1622 - protein, 81 aa, Pan paniscus
PTLKGMVTFEDVAVYFSQEEWELLDAAQRHLYHSVMLENLELVTSLGNALSQHDVFTCSVEADLPNCFPNWLHHFTSLSAV

SEQ ID NO: 1623 - protein, 81 aa, Pan paniscus
MTFEDVAVYFSQEEWGLLDTTQRALYRHVMLENFTLVTSLGLSTSRPHVVIQLERGEEPWVPSGKDMTLARNTYGRLNSGS

SEQ ID NO: 1624 - protein, 81 aa, Pan paniscus
MTFEDVAVYFSQEEWGLLDTTQRALYRHVMLENFTLVTSLGLSTSRPHVVIQLERGEEPWVPSGKDMTLARNTYGRLNSGE

SEQ ID NO: 1625 - protein, 81 aa, Pan paniscus; identical to SEQ ID NO: 381

SEQ ID NO: 1626 - protein, 81 aa, Pan paniscus
PLAAQSPEGHHGHQEPASTSFHPPRIQEEWGLLDRSQKELYWDAMLEKYGTVVSLGLPPHQPEAQAQSELGMLLTGTGVCR

SEQ ID NO: 1627 - protein, 81 aa, Pan paniscus; identical to SEQ ID NO: 382

SEQ ID NO: 1628 - protein, 81 aa, Pan paniscus
LPSNDTDCPQKKEGKAQIVVPVTFRDVTVIFTEAEWKRLSPEQRNLYKEVMLENYRNLLSLAEPKPEIYTCSSCLLAFSCQ

SEQ ID NO: 1629 - protein, 81 aa, Pan paniscus
PSNDTDCPQKKEGKAQIVVPVTFRDVTVIFTEAEWKRLSPEQRNLYKEVMLENYRNLLSLDGVSLLLPRLECTRAISAHHN

SEQ ID NO: 1630 - protein, 81 aa, Pan paniscus
AKGLPSNDTDCPQKKEGKAQIVVPVTFRDVTVIFTEAEWKRLSPEQRNLYKEVMLENYRNLLSLGQEIETILANIVKSHLY

SEQ ID NO: 1631 - protein, 81 aa, Pan paniscus; identical to SEQ ID NO: 383

SEQ ID NO: 1632 - protein, 81 aa, Pan paniscus
MAFRDVAVDFTQDEWRLLSPAQRTLYREVMLENYSNLVSLGISFSKPELITQLEQGKETWREEKKCSPATCPDPEPELYLD

SEQ ID NO: 1633 - protein, 81 aa, Pan paniscus; identical to SEQ ID NO: 384

SEQ ID NO: 1634 - protein, 81 aa, Pan paniscus
MAFRDVAVDFTQDEWRLLSPAQRTLYREVMLENYSNLVSLGISFSKPELITQLEQGKETWREEKKCSPATCPDHQEYGNNC

SEQ ID NO: 1635 - protein, 81 aa, Pan paniscus
MAHMAFRDVAVDFTQDEWRLLSPAQRTLYREVMLENYSNLVSLGISFSKPELITQLEQGKETWREEKKCSPATCPADPEPE

SEQ ID NO: 1636 - protein, 81 aa, Pan paniscus
DCLLGKGGTPELLTAQLQAHMAFRDVAVDFTQDEWRLLSPAQRTLYREVMLENYSNLVSLGISFSKPELITQLEQGKETWR

SEQ ID NO: 1637 - protein, 81 aa, Pan paniscus
MGPQGARRQAFLAFGDVTVDFTQKEWRLLSPAQRALYREVTLENYSHLVSLGILHSKPELIRRLEQGEAPWGEERRRRPGP

SEQ ID NO: 1638 - protein, 81 aa, Pan paniscus
MENEKERPVSFQDLTVNFTQEEWQQLDPAQRLLYRDVMLENYSNLVSVGYHVSKPDVIFKLEQGEEPWIVEEFSNQNYPDV

SEQ ID NO: 1639 - protein, 81 aa, Pan paniscus
LKMKKFQRPVSFQDLTVNFTQEEWQQLDPAQRLLYRDVMLENYSNLVSVGYHVSKPDVIFKLEQGEEPWIVEEFSNQNYPD

SEQ ID NO: 1640 - protein, 81 aa, Pan paniscus
MLENYSNLVSVGYHVSKPDVIFKLEQGEEPWIVEEFSNQNYPDVDDALEKNKEIQDKHLTQTVFFSNKTLITERENVFGKT

SEQ ID NO: 1641 - protein, 81 aa, Pan paniscus
MAAVSPTTRCQESVTFEDVAVVFTDEEWSRLVPIQRDLYKEVMLENYNSIVSLGLPVPQPDVIFQLKRGDKPWMVDLHGSE

SEQ ID NO: 1642 - protein, 81 aa, Pan paniscus
MAAVSPTTRCQESVTFEDVAVVFTDEEWSRLVPIQRDLYKEVMLENYNSIVSLDWETKPEIHDASDKKSEGSLRECLGRQS

SEQ ID NO: 1643 - protein, 81 aa, Pan paniscus
MTFEDVAVEFSQWEWGQLNPAQKDLYREVMLENFRNLAILGLLVSKPYVICQLEEGGEPFMVEREISTGAHSDWERRSKSK

SEQ ID NO: 1644 - protein, 81 aa, Pan paniscus
EEAAQKRKEKEPGMALPQGHLTFRDVAIEFSLEEWKCLDPMQRALYRAMMLENYRNLHSVDISSKCMMKKFSSTAQGNTEV

SEQ ID NO: 1645 - protein, 81 aa, Pan paniscus
MLQTVWFQGLGRNLLFQEPVTFEDVAVYFTQNEWASLHPMQRALHREVMLENYANVTSLYPTAGGFPLDTDRTEKVPGALS

SEQ ID NO: 1646 - protein, 81 aa, Pan paniscus
MLQTVWFQGLGRNLLFQEPVTFEDVAVYFTQNEWASLHPMQRALHREVMLENYANVTSLSAFPFPKPDLIFQLKQGEAAWG

SEQ ID NO: 1647 - protein, 81 aa, Pan paniscus
MFQTAWRQEPVTFEDVAVYFTQNEWASLDSVQRALYREVMLENYANVASLAFPFTTPVLVSQLEQGELPWGLDPWEPMGRE

SEQ ID NO: 1648 - protein, 81 aa, Pan paniscus
MLQTTWPQESVTFEDVAVYFTQNQWASLDPAQRALYGEVMLENYANVASLVAFPFPKPALISHLERGEAPWGPDPWDTEIL

SEQ ID NO: 1649 - protein, 81 aa, Pan paniscus
MMTAVSLTTRPQESVAFEDVAVYFTTKEWAIMVPAERALYRDVMLENYEAVAFVVPPTSKPALVSHLEQGKESCFTQPQGV

SEQ ID NO: 1650 - protein, 81 aa, Pan paniscus
LGLVLELLPGQPALPRARRESVTFEDVAVYFSENEWIGLGPAQRALYRDVMLENYGAVASLAFPFPKPALISQLERGETPW

SEQ ID NO: 1651 - protein, 81 aa, Pan paniscus
AQILELLVLEQFLSILPGELRVWVQLHNPESGEEAVALLEELQRDLDGTSWRDPGPAQSPDVHWMGTGALRSAQIWSLASP

SEQ ID NO: 1652 - protein, 81 aa, Pan paniscus
EGCPGDQVTPTRSLTAQLQETMTFKDVEVTFSQDEWGWLDSAQRNLYRDVMLENYRNMASLVGPFTKPALISWLEAREPWG

SEQ ID NO: 1653 - protein, 81 aa, Pan paniscus; identical to SEQ ID NO: 385

SEQ ID NO: 1654 - protein, 81 aa, Pan paniscus
EDYTQKKWKGLTLSQRALHWNMMLENDRSMASLAGRNMMESSELTPKQEIFKGSESSNSTSGGLFGVVPGGTETGDVCEDT

SEQ ID NO: 1655 - protein, 81 aa, Pan paniscus
MVRPQDTVAYEDLSEDYTQKKWKGLTLSQRALHWNMMLENDRSMASLGRNMMESSELTPKQEIFKGSESSNSTSGGLFGVV

SEQ ID NO: 1656 - protein, 81 aa, Pan paniscus
YNSSLMVHQRTHTGEKPYKCNSCGKAFSDSSQLTVHQRVHTGKNLMNVLSVGKPLVSVLLLITTSELTLERSPQVWLGHLL

SEQ ID NO: 1657 - protein, 81 aa, Pan paniscus
VGNSGDQAGATVLRMVRPQDTVAYEDLSVDYTQKKWKGLTLSQRALQWNMMPENHHSMASLAGENMMKGSELTPKQEIFKG

SEQ ID NO: 1658 - protein, 81 aa, Pan paniscus
DFAQCTSPVPTLPQVGNSGDQAGATVLRMVRPQDTVAYEDLSVDYTQKKWKGLTLSQRALQWNMMPENHHSMASLGWSTMA

SEQ ID NO: 1659 - protein, 81 aa, Pan paniscus
GNSGDQAGATVLRMVRPQDTVAYEDLSVDYTQKKWKGLTLSQRALQWNMMPENHHSMASLGENMMKGSELTPKQEIFKGSE

SEQ ID NO: 1660 - protein, 81 aa, Pan paniscus
TLPQVGNSGDQAGATVLRMVRPQDTVAYEDLSVDYTQKKWKGLTLSQRALQWNMMPENHHSMASLDGETGTEEELIPKHHS

SEQ ID NO: 1661 - protein, 81 aa, Pan paniscus
APEASALSQEENPRNQLMALMLLTAQPQELVMFEEVSVCFTSEEWACLGPIQRALYWDVMLENYGNVTSLGYRKYRRQRNK

SEQ ID NO: 1662 - protein, 81 aa, Pan paniscus
ENPRNQLMALMLLTAQPQELVMFEEVSVCFTSEEWACLGPIQRALYWDVMLENYGNVTSLEWETMTENEEVTSKPSSSQRA

SEQ ID NO: 1663 - protein, 81 aa, Pan paniscus
EALPAKDSAWPWEEKPRYLGPVTFEDVAVLFTEAEWKRLSLEQRNLYKEVMLENLRNLVSLVLELGSPRSGLLPLDLNLDL

SEQ ID NO: 1664 - protein, 80 aa, Pan paniscus
MWAPREQLLGWAAEALPAKDSAWPWEEKPRYLGPVTFEDVAVLFTEAEWKRLSLEQRNLYKEVMLENLRNLVSLVLSYQI

SEQ ID NO: 1665 - protein, 81 aa, Pan paniscus
EALPAKDSAWPWEEKPRYLGPVTFEDVAVLFTEAEWKRLSLEQRNLYKEVMLENLRNLVSLAESKPEVHTCPCCPLAFGSP

SEQ ID NO: 1666 - protein, 81 aa, Pan paniscus
ALPAKDSAWPWEEKPRYLGPVTFEDVAVLFTEAEWKRLSLEQRNLYKEVMLENLRNLVSLESKPEVHTCPCCPLAFGSPQF

SEQ ID NO: 1667 - protein, 81 aa, Pan paniscus
REQLLGWAAEALPAKDSAWPWEEKPRYLGPVTFEDVAVLFTEAEWKRLSLEQRNLYKEVMLENLRNLVSLELTIFQYRRHP

SEQ ID NO: 1668 - protein, 81 aa, Pan paniscus
MELLTFRDVAIEFSPEEWKCLDPAQQNLYRDVMLENYRNLVSLAICSPFSQDLSPVQGIEDSFHKLILRRYEKCGHENLQL

SEQ ID NO: 1669 - protein, 81 aa, Pan paniscus
MELLTFRDVAIEFSPEEWKCLDPAQQNLYRDVMLENYRNLVSLGFVISNPDLVTCLEQIKEPCNLKIHETAAKPPVVQHFW

SEQ ID NO: 1670 - protein, 81 aa, Pan paniscus
MELLTFRDVAIEFSPEEWKCLDPAQQNLYRDVMLENYRNLVSLGFVISNPDLVTCLEQIKEPCNLKIHETAAKPPAICSPF

SEQ ID NO: 1671 - protein, 81 aa, Pan paniscus
MELLTFKDVAIEFSPEEWKCLDTSQQNLYRDVMLENYRNLVSLGVTISNPDLVTCLEQRKEPYNLKIHETAARPPAVCSHF

SEQ ID NO: 1672 - protein, 81 aa, Pan paniscus
MELLTFKDVAIEFSPEEWKCLDTSQQNLYRDVMLENYRNLVSLGVTISNPDLVTCLEQRKEPYNLKIHETAARPPGHYRKR

SEQ ID NO: 1673 - protein, 81 aa, Pan paniscus
MLENYRNLVSLGVTISNPDLVTCLEQRKEPYNLKIHETAARPPAVCSHFTQNLWTVQGIEDSFHKLIPKGHEKHGHENLRK

SEQ ID NO: 1674 - protein, 81 aa, Pan paniscus
MSPCPVHLLRVAVPEWHLLEYAGVGAHSASLSSELLTFRDVAIEFSPEEWKCLDPDQQNLYRDVMLENYRNLVSLGVAISN

SEQ ID NO: 1675 - protein, 81 aa, Pan paniscus
WHLLEYAGVGAHSASLSSELLTFRDVAIEFSPEEWKCLDPDQQNLYRDVMLENYRNLVSLGVAISNPDLAIYLEQRKEPYK

SEQ ID NO: 1676 - protein, 81 aa, Pan paniscus
MELLTFRDVAIEFSPEEWKCLDPDQQNLYRDVMLENYRNLVSLGVAISNPDLAIYLEQRKEPYKVKIHETVAKHPAVCSHF

SEQ ID NO: 1677 - protein, 81 aa, Pan paniscus
ELLTFRDVAIEFSPEEWKCLDPDQQNLYRDVMLENYRNLVSLGVAISNPDLAIYLEQRKEPYKVKIHETVAKHPAVCSHFT

SEQ ID NO: 1678 - protein, 81 aa, Pan paniscus
MELLTFRDVAIEFSPEEWKCLDPDQQNLYRDVMLENYRNLVSLGVAISNPDLVTCLEQRKEPYNVKIHKIVARPPAVCSHF

SEQ ID NO: 1679 - protein, 81 aa, Pan paniscus
SLGVAISNPDLVTCLEQRKEPYNVKIHKIVARPPAVCSHFTQDHWPVQGIEDSFHKLILRRYEKCGHDNLQLRKGCKSLNE

SEQ ID NO: 1680 - protein, 81 aa, Pan paniscus
LGVAISNPDLVTCLEQRKEPYNVKIHKIVARPPAVCSHFTQDHWPVQGIEDSFHKLILRRYEKCGHDNLQLRKGCKSLNEC

SEQ ID NO: 1681 - protein, 81 aa, Pan paniscus
MELLTFRDVAIEFSPEEWKCLDPDQQNLYRDVMLENYRNLVSLGVAISNPDLVTCLEQRKEPYNVKIHKIVARPPEFFHLY

SEQ ID NO: 1682 - protein, 81 aa, Pan paniscus
MEPLTFRDVAIEFSPEEWKCLDPAQQNLYRDVMLENYRNLVSLAMCSHFTQDFLPVQGIEDSFHKLILRRYEKFSSLVSSC

SEQ ID NO: 1683 - protein, 81 aa, Pan paniscus
MLENYRNLVSLAMCSHFTQDFLPVQGIEDSFHKLILRRYEKCGHDNLQLRKGCKSMNVCKVQKGVYNGINQCLSNTQSKIF

SEQ ID NO: 1684 - protein, 81 aa, Pan paniscus
MEPLTFRDVAIEFSPEEWKCLDPAQQNLYRDVMLENYRNLVSLAMCSHFTQDFLPVQGIEDSFHKLILRRYEKCGHDNLQL

SEQ ID NO: 1685 - protein, 81 aa, Pan paniscus
SQEESPEGDTERTERKPMVKDAFKDISIYFTKEEWAEMGDWGKTRYRIVKMNYNALITIGLRATRPAFMCHRRQAIKLQVD

SEQ ID NO: 1686 - protein, 81 aa, Pan paniscus
RKPMVKDAFKDISIYFTKEEWAEMGDWGKTRYRIVKMNYNALITIGLRATRPAFMCHRRQAIKLQVDDTEDSDEEWTPRQQ

SEQ ID NO: 1687 - protein, 81 aa, Pan paniscus
MMKSQGLVSFKDVAVDFTQEEWQQLDPSQRTLYRDVMLENYSHLVSMGYPVSKPDVISKLEQGEEPWIIKGDISNWIYPDE

SEQ ID NO: 1688 - protein, 81 aa, Pan paniscus
MLENYSHLVSMGYPVSKPDVISKLEQGEEPWIIKGDISNWIYPDEYQADGRQDRKSNLHNSQSCILGTVSFHHKTLKGVTR

SEQ ID NO: 1689 - protein, 81 aa, Pan paniscus
AETSSSGLLEEQKMMKSQGLVSFKDVAVDFTQEEWQQLDPSQRTLYRDVMLENYSHLVSMGYPVSKPDVISKLEQGEEPWI

SEQ ID NO: 1690 - protein, 81 aa, Pan paniscus
MAAGQREARPQVSLTFEDVAVLFTRDEWRKLAPSQRNLYRDVMLENYRNLVSLGLPFTKPKVISLLQQGEDPWEVEKDGSG

SEQ ID NO: 1691 - protein, 81 aa, Pan paniscus
MAAGQREARPQVSLTFEDVAVLFTWDEWRKLAPSQRNLYRDVMLENYRNLVSLGLSFTKPKVISLLQQGEDPWEVEKDSSG

SEQ ID NO: 1692 - protein, 81 aa, Pan paniscus
MAVSHLPTMVQESVTFKDVAILFTQEEWGQLSPAQRALYRDVMLENYSNLVSLGLLGPKPDTFSQLEKREVWMPEDTPGGF

SEQ ID NO: 1693 - protein, 81 aa, Pan paniscus
MARRLLPAHVQESVTFRDVAVFFSQDEWLHLDSAQRALYREVMLENYSILVSLGILFSKPKVISQLEQGEDPWMVESGVPQ

SEQ ID NO: 1694 - protein, 81 aa, Pan paniscus
MAVDLLSAQEPVTFRDVAVFFSQDEWLHLDSAQRALYREVMLENYGSLVSLGIPFSMPKLIHQLQQGEDPCMVEREVPSDT

SEQ ID NO: 1695 - protein, 81 aa, Pan paniscus
DSTLLQGGHNLLSSASFQESVTFKDVIVDFTQEEWKQLDPGQRDLFRDVTLENYTHLVSIGLQVSKPDVISQLEQGTEPWI

SEQ ID NO: 1696 - protein, 81 aa, Pan paniscus
GSSGDQEMTATLLTAGFQTLEKIEDMAVSLIREEWLLDPSQKDLSRDNRPEDFRNVFSLGGETRSENRELASKQVISTGIH

SEQ ID NO: 1697 - protein, 81 aa, Pan paniscus
GGCCREDAMVASRLTPGSQGLLKMEDVALTLTPGWTQLDSSQVNLYRDEKQESHSSLVSLGGEIQTKSRDLPPVKKLPEKE

SEQ ID NO: 1698 - protein, 81 aa, Pan paniscus
GGCCREDAVVASRLTPESRGLLKVEDVALTLTPEWTQQDSSQGNLCRDEKQENHGSLVSLGDEKQTKSRDLPPAEELPEKE

SEQ ID NO: 1699 - protein, 81 aa, Pan paniscus
GSQGNLPQAEITLMNQAQESVTFEDVAVNFTNREWQCLTYAQRHLYKDVMLENYGNMVSLGFPFPKPPLISHLEREVDPCV

SEQ ID NO: 1700 - protein, 81 aa, Pan paniscus
AEITLMNQAQDSRSILFQESVTFEDVAVNFTNREWQCLTYAQRHLYKDVMLENYGNMVSLGFPFPKPPLISHLEREVDPCV

SEQ ID NO: 1701 - protein, 81 aa, Pan paniscus
ATLQEAMKRDCWREARVKKKPVTFEDVAVNFTQEEWDCLDASQRVLYQDVMSETFKNLTSVARIFLHKPELITKLEQEEEQ

SEQ ID NO: 1702 - protein, 81 aa, Pan paniscus
EQLKPIEPRDCWREARVKKKPVTFEDVAVNFTQEEWDCLDASQRVLYQDVMSETFKNLTSVARIFLHKPELITKLEQEEEQ

SEQ ID NO: 1703 - protein, 81 aa, Pan paniscus
MAAGEPRSLLFFQKPVTFEDVAVNFTQEEWDCLDASQRVLYQDVMSETFKNLTSVARIFLHKPELITKLEQEEEQWRETRV

SEQ ID NO: 1704 - protein, 81 aa, Pan paniscus
MNTLQGPVSFKDVAVDFTQEEWQQLDPDEKITYRDVMLENYSHLVSVGYDTTKPNVIIKLEQGEEPWIMGGEFPCQHSPEA

SEQ ID NO: 1705 - protein, 81 aa, Pan paniscus
MNTLQGPVSFKDVAVDFTQEEWQQLDPDEKITYRDVMLENYSHLVSVGYDTTKPNVIIKLEQGEEPWIMGGEFPCQHSPAA

SEQ ID NO: 1706 - protein, 81 aa, Pan paniscus
MNKSLGPVSFKDVAVDFTQEEWQQLDPEQKITYRDVMLENYSNLVSVGYHIIKPDVISKLEQGEEPWIVEGEFLLQSYPDE

SEQ ID NO: 1707 - protein, 81 aa, Pan paniscus
MLENYSNLVSVGYHIIKPDVISKLEQGEEPWIVEGEFLLQSYPDEVWQTDDLIERIQEEENKPSRQTVFIETLIEEREYIS

SEQ ID NO: 1708 - protein, 81 aa, Pan paniscus
EEEEEDEDEDDLLTAGCQGLVTFEDVAVYFSLEEWERLEADQRGLYQEVMQENYGILVSLGYPIPKPDLIFRLEQGEEPWV

SEQ ID NO: 1709 - protein, 81 aa, Pan paniscus
MEEKEMNDGSQMVRSQESLTFQDVAVDFTREEWDQLYPAQKNLYRDVMLENYRNLVALGYQLCKPEVIAQLELEEEWVIER

SEQ ID NO: 1710 - protein, 81 aa, Pan paniscus
GNMEEKEMNDGSQMVRSQESLTFQDVAVDFTREEWDQLYPAQKNLYRDVMLENYRNLVALGYQLCKPEVIAQLELEEEWVI

SEQ ID NO: 1711 - protein, 81 aa, Pan paniscus; identical to SEQ ID NO: 386

SEQ ID NO: 1712 - protein, 81 aa, Pan paniscus
MGPLTFRDVKIEFSLEEWQCLDTAQRNLYRDVMLENYRNLVFLVMCSHFAQDVWPEHSIKDSFQKVILRTYGKYGHENLQL

SEQ ID NO: 1713 - protein, 81 aa, Pan paniscus
GIGRSTAKTPGLPGSLEMGPLTFRDVAIEFSLEEWQCLDTSQQNLYRNVMLDNYRNLVFLGIAVSKPDLITCLEQGKEPCN

SEQ ID NO: 1714 - protein, 81 aa, Pan paniscus
MEPLTFKDVAIEFSLEEWQCLDTAQRDLYRNVLLENYRNLVFLVMSFHFAQDLWPEQNIKDSFQKVTLRRYGKCEYENLQL

SEQ ID NO: 1715 - protein, 81 aa, Pan paniscus
MEPLTFKDVAIEFSLEEWQCLDTAQRDLYRNVLLENYRNLVFLGIAVSKPYLITCLEQKKEPWNIKRHEMVAKPPVMSFHF

SEQ ID NO: 1716 - protein, 81 aa, Pan paniscus
MPGPPGSLEMGPLTFRDVAIEFSLEEWQCLNTAQRNLYRKVMFENYRNLVFLGIAVSKPHLITCLEQGKQPWNRKRQEMVA

SEQ ID NO: 1717 - protein, 81 aa, Pan paniscus; identical to SEQ ID NO: 387

SEQ ID NO: 1718 - protein, 81 aa, Pan paniscus
MAKRRGSPGSREMGLLTFRDVVIEFSLEEWQCLDHAQQNLYRDVMLENYRNLVSLGIAVSKPDLITCLEQNKDPWNIKRNE

SEQ ID NO: 1719 - protein, 81 aa, Pan paniscus
MAKRPGPPGSREMGLLTFRDIAIEFSLAEWQCLDRAQQNLYRDVMLENYRNLFSLGMTVSKPDLIACLEQNKEPQNIKRNE

SEQ ID NO: 1720 - protein, 81 aa, Pan paniscus; identical to SEQ ID NO: 388

SEQ ID NO: 1721 - protein, 81 aa, Pan paniscus
MAERPGSAGSREMRLLTFRDIAIEFSLEEWQCLDCAQQNLYRDVMLENYRNLVSLGIADSKPDLITCLEQNKEAWNIKRNE

SEQ ID NO: 1722 - protein, 81 aa, Pan paniscus
MFPPARGKELLSFEDVAMYFTREEWGHLNWGQKDLYRDVMLENYRNMVLLGFQFPKPEMICQLENWDEQWILDLPRAGNRK

SEQ ID NO: 1723 - protein, 81 aa, Pan paniscus
MELLSFEDVAMYFTREEWGHLNWGQKDLYRDVMLENYRNMVLLGFQFPKPEMICQLENWDEQWILDLPRAGNRKASGSACP

SEQ ID NO: 1724 - protein, 81 aa, Pan paniscus
GEEAVAVVRALQRALDGTSSQGMVTFEDMAVSLTWEEWERLDPARSDFCRESAQKDSGSTVPPSLESRVENKELIPVQQIL

SEQ ID NO: 1725 - protein, 81 aa, Pan paniscus
SEEHGNKCKQSFHMVTWHVLKPHKSDSGDSFHHSSLFETQRQLHEERPYKCGNCGKSFKQRSDLFRHQRIHTGEKPYGCQE

SEQ ID NO: 1726 - protein, 81 aa, Pan paniscus
SQELTASLLSTGSQKLVKIEEVADVAVSFILEEWGHLDQSQKSLYRDDRKENYGSITSMGYESRDNMELIVKQISDDSESH

SEQ ID NO: 1727 - protein, 81 aa, Pan paniscus
DSQELTASLLSTGSQLVKIEEVADVAVSFILEEWGHLDQSQKSLYRDDRKENYGSITSMGYESRDNMELIVKQISDDSESH

SEQ ID NO: 1728 - protein, 81 aa, Pan paniscus
REGSPGDQAAALLTARYQEFVTFEDVAVHLTREEWGYLDPVQRDLYREVMLENYGNVVSLGILLRLPTTRIHSVNSCPALS

SEQ ID NO: 1729 - protein, 81 aa, Pan paniscus
LTGAPPVPQVPALPREGSPGDQAAALLTARYQEFVTFEDVAVHLTREEWGYLDPVQRDLYREVMLENYGNVVSLGTVGSWD

SEQ ID NO: 1730 - protein, 81 aa, Pan paniscus
QVPALPREGSPGDQAAALLTARYQSSQDVLFQEFVTFEDVAVHLTREEWGYLDPVQRDLYREVMLENYGNVVSLGTVGSWD

SEQ ID NO: 1731 - protein, 81 aa, Pan paniscus
GPGLPAVNPRDQEMAAGFFTAGSQGLGPFKDMALAFPEEEWRHVTPAQIDCFGEYVEPQDCRVSPGGGSKEKEAKPPQEDL

SEQ ID NO: 1732 - protein, 81 aa, Pan paniscus
MASALFTADSQAMVKIEDMAVSLILEEWGCQNLARRNLSRDNRQENYGSAFPQGGENRNENEESTSKAETSEDSASRGETT

SEQ ID NO: 1733 - protein, 81 aa, Pan paniscus
EGSPRDQAMASALFTADSQAMVKIEDMAVSLILEEWGCQNLARRNLSRDNRQENYGSAFPQGGENRNENEESTSKAETSED

SEQ ID NO: 1734 - protein, 81 aa, Pan paniscus
METQADLVSQEPQALLDSALPSKVPAFSDKDSLGDEMLAAALLKAKSQELVTFEDVAVYFIRKEWKRLEPAQRDLYRDVML

SEQ ID NO: 1735 - protein, 81 aa, Pan paniscus
DSLGDEMLAAALLKAKSQELVTFEDVAVYFIRKEWKRLEPAQRDLYRDVMLENYGNVFSLDWIHVSLTTQKVMLAWLTGTL

SEQ ID NO: 1736 - protein, 81 aa, Pan paniscus
DSLGDEMLAAALLKAKSQELVTFEDVAVYFIRKEWKRLEPAQRDLYRDVMLENYGNVFSLDRETRTENDQEISEDTRSHGV

SEQ ID NO: 1737 - protein, 81 aa, Pan paniscus
MLAAALLKAKSQELVTFEDVAVYFIRKEWKRLEPAQRDLYRDVMLENYGNVFSLDRETRTENDQEISEDTRSHGVLLGRFQ

SEQ ID NO: 1738 - protein, 81 aa, Pan paniscus
VPAFSDKDSLGDEMLAAALLKAKSQELVTFEDVAVYFIRKEWKRLEPAQRDLYRDVMLENYGNVFSLDRETRTENDQEISE

SEQ ID NO: 1739 - protein, 81 aa, Pan paniscus
MAEPPRLPLTFEDVAIYFSEQEWQDLEAWQKELYKHVMRSNYETLISLDDGLPKPELISWIEHGGEPFRKWRESQKSGNII

SEQ ID NO: 1740 - protein, 81 aa, Pan paniscus
MAEPASVTVTFDDVALYFSEQEWEILEKWQKQMYKQEMKTNYETLDSLGYAFSKPDLITWMEQGRMLLISEQGCLDKTRRT

SEQ ID NO: 1741 - protein, 81 aa, Pan paniscus
QEMKTNYETLDSLGYAFSKPDLITWMEQGRMLLISEQGCLDKTRRTTSPPTDEQLNMKNTGKLLCFDDEGTPRTKEEDCRL

SEQ ID NO: 1742 - protein, 81 aa, Pan paniscus
MAEPASVTVTFDDVALYFSEQEWEILEKWQKQMYKQEMKTNYETLDSLDLITWMEQGRMLLISEQGCLDKTRRTTSPPTDE

SEQ ID NO: 1743 - protein, 81 aa, Pan paniscus
WQKQMYKQEMKTNYETLDSLDLITWMEQGRMLLISEQGCLDKTRRTTSPPTDEQLNMKNTGKLLCFDDEGTPRTKEEDCRL

SEQ ID NO: 1744 - protein, 81 aa, Pan paniscus
GGGCRLCRNSGPCRSWIGVTVTFDDVALYFSEQEWEILEKWQKQMYKQEMKTNYETLDSLGYAFSKPDLITWMEQGRMLLI

SEQ ID NO: 1745 - protein, 81 aa, Pan paniscus
EMKTNYETLDSLGYAFSKPDLITWMEQGRMLLISEQGCLDKTRRTTSPPTDEQLNMKNTGKLLCFDDEGTPRTKEEDCRLN

SEQ ID NO: 1746 - protein, 81 aa, Pan paniscus
SLGYAFSKPDLITWMEQGRMLLISEQGCLDKTRRTTSPPTDEQLNMKNTGKLLCFDDEGTPRTKEEDCRLNGPQKQDLCAA

SEQ ID NO: 1747 - protein, 81 aa, Pan paniscus
KKLASCEKTVTELGNQLEGKWAVLGTLLQEYGLLQRRLENLENLLRNRNFWILRLPPGIKGDIPKVPVAFDDVSIYFSTPE

SEQ ID NO: 1748 - protein, 81 aa, Pan paniscus
RNFWILRLPPGIKGDIPKVPVAFDDVSIYFSTPEWEKLEEWQKELYKNIMKGNYESLISMDYAINQPDVLSQIQPEGEHNT

SEQ ID NO: 1749 - protein, 81 aa, Pan paniscus
KKLADCEKTAVEFGNHMESKWAVLGTLLQEYGLLQRRLENLENLLRNRNFWVLRLPPGSKGEAPKVPVTFVDIAVYFSEDE

SEQ ID NO: 1750 - protein, 81 aa, Pan paniscus
RNFWVLRLPPGSKGEAPKVPVTFVDIAVYFSEDEWKNLDEWQKELYNNLVKENYKTLMSLDAEGSVPKPDAPVQAEPREEP

SEQ ID NO: 1751 - protein, 81 aa, Pan paniscus
TLCVRGQRGLEERAIPTESITDSPISAQDLLSRIKQEEHQCVWDQQDLADRDIPTDPNSESLISAHDILSWIKQEEQPYPW

SEQ ID NO: 1752 - protein, 81 aa, Pan paniscus
KKLADCEKMAVEFGNQLEGKWAVLGTLLQEYGLLQRRLENVENLLRNRNFWILRLPPGSKGEAPKVSRSLENDGVCFTEQE

SEQ ID NO: 1753 - protein, 81 aa, Pan paniscus
RNFWILRLPPGSKGEAPKVSRSLENDGVCFTEQEWENLEDWQKELYRNVMESNYETLVSLKVLGQTEGEAELGTEMLGDLE

SEQ ID NO: 1754 - protein, 81 aa, Pan paniscus
PGGAHPAGGVMIKQELQYTQEGPADLPGEFSCIAEEQAFLSPEQTKLWGGQGSSVLLETGPGDSTLEEPVGSRDPSSSRTV

SEQ ID NO: 1755 - protein, 81 aa, Pan paniscus
YGLLQRRLENVENLLRNRNFWILRLPPGSKGEAPKVSRSLENDGVCFTEQEWENLEDWQKELYRNVMESNYETLVSLSSSD

SEQ ID NO: 1756 - protein, 81 aa, Pan paniscus
NFWILRLPPGSKGEAPKVSRSLENDGVCFTEQEWENLEDWQKELYRNVMESNYETLVSLSSSDSPASASRVAEITEVLGQT

SEQ ID NO: 1757 - protein, 81 aa, Pan paniscus
LEEEGPGGAHPAGGVMIKQELQYTQEGPADLPGEFSCIAEEQAFLSPEQTKLWGGQGSSVLLETGPGDSTLEEPVGSRDPS

SEQ ID NO: 1758 - protein, 81 aa, Pan paniscus
KKLADCEKTAVEFGNQLEGKWAVLGTLLQEYGLLQRRLENVENLLRNRNFWILRLPPGSKGEAPKVPVTFDDVAVYFSELE

SEQ ID NO: 1759 - protein, 81 aa, Pan paniscus
RNFWILRLPPGSKGEAPKVPVTFDDVAVYFSELEWGKLEDWQKELYKHVMRGNYETLVSLDYAISKPDILTRIERGEEPCL

SEQ ID NO: 1760 - protein, 81 aa, Pan paniscus
KIADCEKTAVEFANHLESKWVVLGTLLQEYGLLQRRLENMENLLKNRNFWILRLPPGSNGEVPKVPVTFDDVAVHFSEQEW

SEQ ID NO: 1761 - protein, 81 aa, Pan paniscus
RNFWILRLPPGSNGEVPKVPVTFDDVAVHFSEQEWGNLSEWQKELYKNVMRGNYESLVSMDYAISKPDLMSQMERGERPTM

SEQ ID NO: 1762 - protein, 81 aa, Pan paniscus
KKLADCEKTAVEFGNQLEGKWAVLGTLLQEYGLLQRRLENVENLLRNRNFWILRLPPGSKGESPKVPVTFDDVAVYFSEQE

SEQ ID NO: 1763 - protein, 81 aa, Pan paniscus
RNFWILRLPPGSKGESPKVPVTFDDVAVYFSEQEWGKLEDWQKELYKHVMRGNYETLVSLDYAISKPEVLSQIEQGKEPCN

SEQ ID NO: 1764 - protein, 81 aa, Pan paniscus
KKLADCEKTAVEFGNQLEGKWAVLGTLLQEYGLLQRRLENVENLLRNRNFWILRLPPGSKGESPKEWGKLEDWQKELYKHV

SEQ ID NO: 1765 - protein, 81 aa, Pan paniscus
LENVENLLRNRNFWILRLPPGSKGESPKEWGKLEDWQKELYKHVMRGNYETLVSLDYAISKPEVLSQIEQGKEPCNWRRPG

SEQ ID NO: 1766 - protein, 81 aa, Pan paniscus
MARQVSITFKDLAVRFSEEEWRLLEEGQREFYRDVMRENYETLVSVGTAELLPLSAFLSPSEPGRAVGGGSHADEGQEPAG

SEQ ID NO: 1767 - protein, 81 aa, Pan paniscus
MRENYETLVSVGTAELLPLSAFLSPSEPGRAVGGGSHADEGQEPAGCGDPQGGQPRHSLHLTALVQLVKEIPEFLFGEVKG

SEQ ID NO: 1768 - protein, 81 aa, Pan paniscus
MEPRESGKAPVTFDDITVYLLQEEWVLLSQQQKELCGSNKLVAPLGPTVANPELFCKFGRGPEPWLGSVQGQRSLLEHHPG

SEQ ID NO: 1769 - protein, 81 aa, Pan paniscus
QDPSAEGLSEEVPVVFEELPVVFEDVAVYFTREEWGMLDKRQKELYRDVMRMNYELLASLGPAAAKPDLISKLERRAAPWI

SEQ ID NO: 1770 - protein, 81 aa, Pan paniscus
MAPVTFDDITVYLLQEEWVLLSQQQKELCGSNKLVAPLGPTVANPELFCKFGRGPEPWLGSVQGQRSLLEHHPGKKQMGYM

SEQ ID NO: 1771 - protein, 81 aa, Pan paniscus
MPSPDSMTFEDIIVDFTQEEWALLDTSQRKLFQDVMLENISHLVSIGKQLCKSVVLSQLEQVEKLSTQRISFLQGREVGIK

SEQ ID NO: 1772 - protein, 81 aa, Pan paniscus
DFTQEEWALLDTSQRKLFQDVMLENISHLVSIGKQLCKSVVLSQLEQVEKLSTQRISFLQGREVGIKHQEIPFIQHIYQKG

SEQ ID NO: 1773 - protein, 81 aa, Pan paniscus
GIKHQEIPFIQHIYQKGTSTISTMRSHTQEDPFLCNDLGEDFTQHMALTQNVITYMRKKHFESGRSSEHRSVVTATSIRTW

SEQ ID NO: 1774 - protein, 81 aa, Pan paniscus
STQRISFLQGREVGIKHQEIPFIQHIYQKGTSTISTMRSHTQEDPFLCNDLGEDFTQHMALTQNVITYMRKKHFVSKKFGK

SEQ ID NO: 1775 - protein, 81 aa, Pan paniscus
SVVLSQLEQVEKLSTQRISFLQGREVGIKHQEIPFIQHIYQKGTSTISTMRSHTQEDPFLCNDLGEDFTQHMALTQNVITY

SEQ ID NO: 1776 - protein, 81 aa, Pan paniscus
MDMAQEPVTFRDVAIYFSREEWACLEPSQRTLYRDVMLDNFSSVAALGFCSPRPDLVSRLEQWEEPWVEDRERPELQAVRR

SEQ ID NO: 1777 - protein, 81 aa, Pan paniscus
MDMAQEPVTFRDVAIYFSREEWACLEPSQRTLYRDVMLDNFSSVAALAPDRTLSLAWNSGRSRGLKTGRDLSSRQCGGDPG

SEQ ID NO: 1778 - protein, 81 aa, Pan paniscus
MAATFQLPGHQEMPLTFQDVAVYFSQAEGQQLGPQQRALYRDVMLENYGNVASLGFPVPKPELISQLEQGKELWVLNLLGA

SEQ ID NO: 1779 - protein, 81 aa, Pan paniscus
AAHAHRMAATFQLPGHQEMPLTFQDVAVYFSQAEGQQLGPQQRALYRDVMLENYGNVASLGFPVPKPELISQLEQGKELWV

SEQ ID NO: 1780 - protein, 81 aa, Pan paniscus
RKPNPQAMAALFLSAPPQAEVTFEDVAVYLSREEWGRLGPAQRGLYRDVMLETYGNLVSLGVGPAGPKPGVISQLERGDEP

SEQ ID NO: 1781 - protein, 81 aa, Pan paniscus
MAALFLSAPPQAEVTFEDVAVYLSREEWGRLGPAQRGLYRDVMLETYGNLVSLGVGPAGPKPGVISQLERGDEPWVLDVQG

SEQ ID NO: 1782 - protein, 81 aa, Pan paniscus
MAALFLSAPPQAEVTFEDVAVYLSREEWGRLGPAQRGLYRDVMLETYGNLVSLALGTRTEYKELTSQETFGEEDPQGSEPV

SEQ ID NO: 1783 - protein, 81 aa, Pan paniscus
LRKPNPQAMAALFLSAPPQAEVTFEDVAVYLSREEWGRLGPAQRGLYRDVMLETYGNLVSLALGTRTEYKELTSQETFGEE

SEQ ID NO: 1784 - protein, 81 aa, Pan paniscus
MAALFLSAPPQAEVTFEDVAVYLSREEWGRLGPAQRGLYRDVMLETYGNLVSLGKALTRTQLWEQPWGPRAQQRLGWGPHP

SEQ ID NO: 1785 - protein, 81 aa, Pan paniscus
MAMALPMPGPQEAVVLEDVAVYFTRIEWSCLAPDQQALYRDVMLENYGNLASLGFLVAKPALISLLEQGEEPGALILQVAE

SEQ ID NO: 1786 - protein, 81 aa, Pan paniscus
MAMALPMPGPQEAVVLEDVAVYFTRIEWSCLAPDQQALYRDVMLENYGNLASLALISLLEQGEEPGALILQVAEQSVAKAS

SEQ ID NO: 1787 - protein, 81 aa, Pan paniscus
ENYGNLASLALISLLEQGEEPGALILQVAEQSVAKASLCTDSRMEAGIMESPLQRKLSRQAGLPGTVWGCLPWGHPAPPHP

SEQ ID NO: 1788 - protein, 81 aa, Pan paniscus
MEVVTFGDVAVHFSREEWQCLDPGQRALYREVMLENHSSVAGLAGFLVFKPELISRLEQGEEPWVLDLQGAEGTEAPRTSK

SEQ ID NO: 1789 - protein, 81 aa, Pan paniscus
MGFLGCCCVSFQEVVTFGDVAVHFSREEWQCLDPGQRALYREVMLENHSSVAGLAGFLVFKPELISRLEQGEEPWVLDLQG

SEQ ID NO: 1790 - protein, 81 aa, Pan paniscus; identical to SEQ ID NO: 389

SEQ ID NO: 1791 - protein, 81 aa, Pan paniscus
MEVVTFGDVAVHFSREEWQCLDPGQRALYREVMLENHSSVAGLAFSDPTLWFGYLCPCFPHDGNLWAWPSRGAAAFPGFLV

SEQ ID NO: 1792 - protein, 81 aa, Pan paniscus
MAAARLLPVPAGPQAKLTFEDVAVLLSQDEWDRLCPAQRGLYRNVMMETYGNVVSLGLPGSKPDIISQLERGEDPWVLDRK

SEQ ID NO: 1793 - protein, 81 aa, Pan paniscus
AAARLLPVPAGPQPLSFQAKLTFEDVAVLLSQDEWDRLCPAQRGLYRNVMMETYGNVVSLGLPGSKPDIISQLERGEDPWV

SEQ ID NO: 1794 - protein, 81 aa, Pan paniscus
MNMSQASVSFQDVTVEFTREEWQHLGPVERTLYRDVMLENYSHLVSVGYCITKPKVISKLEKGEEPWSLEDEFLNQRYPGY

SEQ ID NO: 1795 - protein, 81 aa, Pan paniscus
MLENYSHLVSVGYCITKPKVISKLEKGEEPWSLEDEFLNQRYPGYFKVDHIKGIREKQEKPLWQEIFINDADKTLSKEGQK

SEQ ID NO: 1796 - protein, 81 aa, Pan paniscus
MTKSLESVSFKDVTVDFSRDEWQQLDLAQKSLYREVMLENYFNLISVGCQVPKPEVIFSLEQEEPCMLDGEIPSQSRPDGD

SEQ ID NO: 1797 - protein, 81 aa, Pan paniscus
MSVQSLPESVSFKDVTVDFSRDEWQQLDLAQKSLYREVMLENYFNLISVGCQVPKPEVIFSLEQEEPCMLDGEIPSQSRPD

SEQ ID NO: 1798 - protein, 81 aa, Pan paniscus
MAPGLLTTRKEALMAFWDVAVAFTQKEWKLLSSAQRTLYREVMLENYSHLVSLGIAFSKPKLIEQLEQGDEPWREENEHLL

SEQ ID NO: 1799 - protein, 81 aa, Pan paniscus
LENYSHLVSLGIAFSKPKLIEQLEQGDEPWREENEHLLDLCPGEWEALGKRGCRAVRSSAGKEGGSIFEVLGGSSSSGLLG

SEQ ID NO: 1800 - protein, 81 aa, Pan paniscus
PLRFSTLFQEQQKMNISQASVSFKDVTIEFTQEEWQQMAPVQKNLYRDVMLENYSNLVSVGYCRFKPEVIFKLEQGEEPWF

SEQ ID NO: 1801 - protein, 81 aa, Pan paniscus
EFTQEEWQQMAPVQKNLYRDVMLENYSNLVSVGYCRFKPEVIFKLEQGEEPWFSEEEFSNQSHPSELLSSSRHNSAGVVRL

SEQ ID NO: 1802 - protein, 81 aa, Pan paniscus
MDTFQASVSFQDVTVEFSQEEWQHMGPVERTLYRDVMLENYSHLVSVGYCFTKPELIFTLEQGEDPWLLEKEKGFLSRNSP

SEQ ID NO: 1803 - protein, 81 aa, Pan paniscus
MASPSPPPESKEEWDYLDPAQRSLYKDVMMENYGNLVSLDVLNRDKDEEPTVKQEIEEIEEEVEPQGVIVTRIKSEIDQDP

SEQ ID NO: 1804 - protein, 81 aa, Pan paniscus
MMENYGNLVSLDVLNRDKDEEPTVKQEIEEIEEEVEPQGVIVTRIKSEIDQDPMGRETFELVGRLDKQRGIFLWEIPRESL

SEQ ID NO: 1805 - protein, 81 aa, Pan paniscus
MASPSPPPESKGLLTFEDVAVFFTQEEWDYLDPAQRSLYKDVMMENYGNLVSLDVLNRDKDEEPTVKQEIEEIEEEVEPQG

SEQ ID NO: 1806 - protein, 81 aa, Pan paniscus
MASPSPPPESKEEWDYLDPAQRSLYKDVMMENYGNLVSLGLTLLPGLVCSDANTACGSLNLLGLSDQSSHLSYLSSWDYRC

SEQ ID NO: 1807 - protein, 81 aa, Pan paniscus
ENSKEDKMVTVCPNTESCESITLKDVAVTFSRGEWKKLEPFQKELYKEVLLENLRNLEFLDFPVSKLELISQLKWVELPWL

SEQ ID NO: 1808 - protein, 81 aa, Pan paniscus
DRRRSAGTTKEAGRPLEMAVSEPEASAAEWKQLDPAPRNLYNDVMLENYSNQASMGCQAPKPDMISKLEKGEAPWLGKGKR

SEQ ID NO: 1809 - protein, 81 aa, Pan paniscus
RRRSAGTTKEAGRPLEMAVSEPEASAAKEWKQLDPAPRNLYNDVMLENYSNQASMGCQAPKPDMISKLEKGEAPWLGKGKR

SEQ ID NO: 1810 - protein, 81 aa, Pan paniscus
EAGRPLEMAVSEPEASAAVSVTFKHVTMAFTQKEWKQLDPAPRNLYNDVMLENYSNQASMGCQAPKPDMISKLEKGEAPWL

SEQ ID NO: 1811 - protein, 81 aa, Pan paniscus
MAAGLLTAGPRGSTFFSSVTVAFAQEGWRCLVSTPRERFKEGIPGKSRSLVLLGLPVSQPGMNSQLEQREGAWMLEGKDLR

SEQ ID NO: 1812 - protein, 81 aa, Pan paniscus
ENTGEEGMAAGLLTAGPRGSTFFSSVTVAFAQEGWRCLVSTPRERFKEGIPGKSRSLVLLGLPVSQPGMNSQLEQREGAWM

SEQ ID NO: 1813 - protein, 81 aa, Pan paniscus
MAMSQESLTFKDVFVDFTLEEWQQLDSAQKNLYRDVMLENYSHLVSVGYLVAKPDVIFRLGPGEESWMADGGTPVRTCAEV

SEQ ID NO: 1814 - protein, 81 aa, Pan paniscus
MAMSQESLTFKDVFVDFTLEEWQQLDSAQKNLYRDVMLENYSHLVSVGYLVAKPDVIFRLGPGEESWMADGGTPVRTCAGE

SEQ ID NO: 1815 - protein, 81 aa, Pan paniscus
VAKPDVIFRLGPGEESWMADGGTPVRTCAGEDRPGESGRGKETRLVGESLASGMCSGALLRASDLWTCLGSDERNCCHVQM

SEQ ID NO: 1816 - protein, 81 aa, Pan paniscus
MAMSQESLTFKDVFVDFTLEEWQQLDSAQKNLYRDVMLENYSHLVSVGYLVAKPDVIFRLGPGEESWMADGGTPVRTCAGT

SEQ ID NO: 1817 - protein, 81 aa, Pan paniscus
MSQESLTFKDVFVDFTLEEWQQLDSAQKNLYRDVMLENYSHLVSVGYLVAKPDVIFRLGPGEESWMADGGTPVRTCADVSI

SEQ ID NO: 1818 - protein, 81 aa, Pan paniscus
MAMSQKSLTFKDVFVDFTLEEWQQLDSAQKNLYRDVMLENYSHLVSVGHLVGKPDVIFRLGPGEESWMADGGTPVRTCAGE

SEQ ID NO: 1819 - protein, 81 aa, Pan paniscus
MAMSQKSLTFKDVFVDFTLEEWQQLDSAQKNLYRDVMLENYSHLVSVGHLVGKPDVIFRLGPGEESWMADGGTPVRTCAVW

SEQ ID NO: 1820 - protein, 81 aa, Pan paniscus
MAMSQKSLTFKDVFVDFTLEEWQQLDSAQKNLYRDVMLENYSHLVSVGHLVGKPDVIFRLGPGEESWMADGGTPVRTCAVE

SEQ ID NO: 1821 - protein, 81 aa, Pan paniscus
SPQRFPALIPGEPGRSFEGSVSFEDVAVDFTRQEWHRLDPAQRTMHKDVMLETYSNLASVGLCVAKPEMIFKLERGEELWI

SEQ ID NO: 1822 - protein, 81 aa, Pan paniscus
SPPWSPALAAEGRGSSCEASVSFEDVTVDFSREEWQHLDPAQRRLYWDVTLENYSHLLSVGYQVPKSEAAFKLEQGEGPWM

SEQ ID NO: 1823 - protein, 81 aa, Pan paniscus
RPWLQRDVAAHVSIVSLQASVSFEDVTVDFSREEWQHLDPAQRRLYWDVTLENYSHLLSVGYQVPKSEAAFKLEQGEGPWM

SEQ ID NO: 1824 - protein, 81 aa, Pan paniscus
AAHVSADHAALNSIVSLQASVSFEDVTVDFSREEWQHLDPAQRRLYWDVTLENYSHLLSVGYQVPKSEAAFKLEQGEGPWM

SEQ ID NO: 1825 - protein, 81 aa, Pan paniscus
LEGEAPHQSCSGEAIGKMQQQGIPGGIFFHCERFDQPIGEDSLCSILEELWQDNDQLEQRQENQNNLLSHVKVLIKERGYE

SEQ ID NO: 1826 - protein, 81 aa, Pan paniscus
MPANEDAPQPGEHGSACEVSVSFEDVTVDFSREEWQQLDSTQRRLYQDVMLENYSHLLSVGFEVPKPEVIFKLEQGEGPWT

SEQ ID NO: 1827 - protein, 81 aa, Pan paniscus
MAKPQGLVTFEDVAVDFTQEEWQYLNPPQRTLYRDVMLETYSNLVFVGQQVTKPNLILKLEVEECPAEGKIPFWNFPEVCQ

SEQ ID NO: 1828 - protein, 81 aa, Pan paniscus
SGEASGSFYSWQKAKREQGLVTFEDVAVDFTQEEWQYLNPPQRTLYRDVMLETYSNLVFVGQQVTKPNLILKLEVEECPAE

SEQ ID NO: 1829 - protein, 81 aa, Pan paniscus
MIESQEPVTFEDVAVDFTQEEWQQLNPTQKTLHRDVMVETYNHLVSMGCSGIKPDVIFKLEHGKDPWIIESELSRWIYPGI

SEQ ID NO: 1830 - protein, 81 aa, Pan paniscus
MIESQEPVTFEDVAVDFTQEEWQQLNPTQKTLHRDVMVETYNHLVSMGCSGIKPDVIFKLEHGKDPWIIESELSRWIYPDR

SEQ ID NO: 1831 - protein, 81 aa, Pan paniscus
MVEGEEEWQQLNPTQKTLHRDVMVETYNHLVSMGCSGIKPDVIFKLEHGKDPWIIESELSRWIYPDRVKGLESSQQIISGE

SEQ ID NO: 1832 - protein, 80 aa, Pan paniscus
MIESQEPVTFEDVAVDFTQEEWQQLNPTQKTLHRDVMVETYNHLVSMGCSGIKPDVIFKLEHGKDPWIIESELSRWIYPE

SEQ ID NO: 1833 - protein, 81 aa, Pan paniscus
MIESQEEWQQLNPTQKTLHRDVMVETYNHLVSMGCSGIKPDVIFKLEHGKDPWIIESELSRWIYPDRVKGLESSQQIISGE

SEQ ID NO: 1834 - protein, 81 aa, Pan paniscus
NGDDTFAKRPRDGAKTSKKRSKAFDDIATYFSKKEWKKMKYSEKISYVYMKRNYKAMTKLGFKVTLPPFMCNKQATDFQGN

SEQ ID NO: 1835 - protein, 81 aa, Pan paniscus
GDDAFARRPKAGAQIPEKIQKAFDDIAKYFSKKEWEKMKSSEKISYVYMKRKYEAMTKLGFKATLPPFMRNTGATDLQGND

SEQ ID NO: 1836 - protein, 81 aa, Pan paniscus
GDDTFARRPTVGAQIPEKIQKAFDDIAKYFSKEEWEKMKVSEKIVYVYMKRKYEAMTKLGFKAILPPFMRNKQAEDFQGND

SEQ ID NO: 1837 - protein, 81 aa, Pan paniscus
GDDAFARRPRDDAQISEKLRKAFDDIAKYFSKEEWEKMKSSEKIVYVYMKLNYEVMTKLGFKVTLPPFMCSKRAADFHGND

SEQ ID NO: 1838 - protein, 81 aa, Pan paniscus
GDDAFARRPTVGAQIPEKIQKAFDDIAKYFSKEEWEKMKASEKIFYVYMKRKYEAMTKLGFKATLPPFMCNKRAEDFQGND

SEQ ID NO: 1839 - protein, 81 aa, Pan paniscus
KRIKHWKMASKLILPESLSLLTFEDVAVYFSEEEWQLLNPLEKTLYNDVMQDIYETVISLGLKLKNDTGNDHPISVSTSEI

SEQ ID NO: 1840 - protein, 81 aa, Pan paniscus
ALVLVEFLQREPDGTKNESLLTFEDVAVYFSEEEWQLLNPLEKTLYNDVMQDIYETVISLGLKLKNDTGNDHPISVSTSEI

SEQ ID NO: 1841 - protein, 81 aa, Pan paniscus
MAAILLTTRPKVPVSFEDVSVYFTKTEWKLLDLRQKVLYKRVMLENYSHLVSLGFSFSKPHLISQLERGEGPWVADIPRTW

SEQ ID NO: 1842 - protein, 81 aa, Pan troglodytes
MHSLEKVTFEDVAIDFTQEEWAMMDTSKRKLYRDVMLENISHLVPLGYQISKSYIILQLEQGKELWREGREFLQDQNPDRE

SEQ ID NO: 1843 - protein, 81 aa, Pan troglodytes
GSVSFEDVAVDFTRQEWHRLDPAQRTMHKDVMLETYSNLASVGLCVAKPEMIFKLERGEELWILEEESSGHGYSGSLSLLC

SEQ ID NO: 1844 - protein, 81 aa, Pan troglodytes; identical to SEQ ID NO: 390

SEQ ID NO: 1845 - protein, 81 aa, Pan troglodytes
EVTEHLTGWAPALVPSVEGLLTFRDVAIEFSREEWEHLDSDQKLLYGDVMLENYGNLVSLGLAVSKPDLITFLEQRKEPWN

SEQ ID NO: 1846 - protein, 81 aa, Pan troglodytes
MGLLAFMDVAVEFSPEEWECLDPAQRSLYRDVMLENYRNLISLGLAMSKPELIICLEARKEPWNVNTEKTAKHSALSSYLT

SEQ ID NO: 1847 - protein, 81 aa, Pan troglodytes
MGLLAFMDVAVEFSPEEWECLDPAQRSLYRDVMLENYRNLISLGLAMSKPELIICLEARKEPWNVNTEKTAKHSVETRFRH

SEQ ID NO: 1848 - protein, 81 aa, Pan troglodytes
MGLLAFMDVAVEFSPEEWECLDPAQRSLYRDVMLENYRNLISLGEDNFNMQFLFHSLAMSKPELIICLEARKEPWNVNTEK

SEQ ID NO: 1849 - protein, 81 aa, Pan troglodytes
MDSVAFEDVAVNFTQEEWALLDSSQKNLYREVMQETCRNLASVGSQWKDQNIEDHFEKPGKDIRNHIVQRLCESKEGGQYG

SEQ ID NO: 1850 - protein, 81 aa, Pan troglodytes
AEPLHPVCTCGRHFRRPEPCREPRASPIQDSVAFEDVAVNFTQEEWALLDSSQKNLYREVMQETCRNLASVEIISYRDCVK

SEQ ID NO: 1851 - protein, 81 aa, Pan troglodytes
MAGSQGLLIFRDVAIEFSPEEWSYLDPAQQNLYRDVMLENYRNLVSLGIAVSKPDLITCLEQRNEPWNVKKHETVARHPAV

SEQ ID NO: 1852 - protein, 81 aa, Pan troglodytes
SPLYSTEVSNIMVEQKSQESVSFKDVTVGFTQEEWQHLDPSQRALYRDVMLENYSNLVSVGYCVHKPEVIFRLQQGEEPWK

SEQ ID NO: 1853 - protein, 81 aa, Pan troglodytes
MNKVDQKFQGSVSFKDVTVGFTQEEWQHLDPSQRALYRDVMLENYSNLVSVGYCAHKPEVIFRLEQGEEPWRLEEEFPSQS

SEQ ID NO: 1854 - protein, 81 aa, Pan troglodytes
MTLLTFRDVAIEFSLEEWKCLDLAQQNLYRDVMLENYRNLFSVGLTVSKPGLITCLEQRKEPWNVKRQEAADGHPGWSAVV

SEQ ID NO: 1855 - protein, 81 aa, Pan troglodytes
PGLITCLEQRKEPWNVKRQEAADGHPEFHSITQAVVQWRHLSSLQPLPPGLEPSSHFSLLRTWNYRGTLPHPANFCVFNRD

SEQ ID NO: 1856 - protein, 81 aa, Pan troglodytes
SRKNLSMEKEQKLIVQHSYIPVEEALPQYVGVICQKDLLRDSMEEKYCGCNKCKEIYYWNSRCVFHKRNQPGENLYQCSIR

SEQ ID NO: 1857 - protein, 81 aa, Pan troglodytes
MHSLKKVTFEDVAIDFTQEEWAMMDTSKRKLYRDVMLENISHLVSLGYQISKSYIILQLEQGKELWREGREFLQDQNPDRE

SEQ ID NO: 1858 - protein, 81 aa, Pan troglodytes
MGLVTIKDVSLCFSQEEWRSLDPSQTDFYGEYVMQENCGIVVSLRFPIPKLDMLSQLEGGEEQWVPDPQDLEERDILRVTY

SEQ ID NO: 1859 - protein, 81 aa, Pan troglodytes
MIQSQISFEDVAVDFTLEEWQLLNPTQKNLYRDVMLENYSNLVFLEVWLDNPKMWLRDNQDNLKRPKCETGYLIMDPNRSD

SEQ ID NO: 1860 - protein, 81 aa, Pan troglodytes
MSQGSVTFRDVAIDFSQEEWKWLQPAQRDLYRCVMLENYGHLVSLGLSISKPDVVSLLEQGKEPWLGKREVKRDLFSGWSA

SEQ ID NO: 1861 - protein, 81 aa, Pan troglodytes
SFMDVFVDFTWEEWQLLDPAQKCLYRSVMLENYSNLVSLGYQHTKPDIIFKLEQGEELCMVQAQVPNQTCPILKAGKSKAK

SEQ ID NO: 1862 - protein, 81 aa, Pan troglodytes
VLQQYLDPAQRGVRVLEVASGSGQHAAHFARAFPLAEWQPSDVDQRCLDRNPEWGLRDTALLEDLGKASGLLLERMVDMPA

SEQ ID NO: 1863 - protein, 81 aa, Pan troglodytes
RGVRVLEVASGSGQHAAHFARAFPLAEWQPSDVDQRCLDRNPEWGLRDTALLEDLGKASGLLLERMVDMPANNKCLIFRKN

SEQ ID NO: 1864 - protein, 81 aa, Pan troglodytes
LQEGHPGETTDTCFVSGVHGPVALGDIPFYFSREEWGTLDPAQRDLFWGIKRENSRNTTLGFGLKGQSEKSLLQEMVPVVP

SEQ ID NO: 1865 - protein, 81 aa, Pan troglodytes
WPERGPPAPRHQEMASASPFLSAWSQVPVNLEDVAVYLSGEEPRCLDPAQRDAPLENEGPGIQLEDGGEGREDAPVKKRKR

SEQ ID NO: 1866 - protein, 81 aa, Pan troglodytes
QRGPLLWPERGPPAPRHQEMASASPFLSAWSQVPVNLEDVAVYLSGEEPRCLDPAQRDAPLENEGPGIQLEDGGEGREDAP

SEQ ID NO: 1867 - protein, 81 aa, Pan troglodytes
EPGSLHSGHQEQLNRKRERRPLPKNAQPSPWVPALADEWNTLDQEVTTTRLPAGSQEPVKDVHVARGFSYRKSVHQIPAQR

SEQ ID NO: 1868 - protein, 81 aa, Pan troglodytes
MPLKAQYQEMVTFEDVAVHFTKTEWTGLSPAQRALYRSVMLENFGNLTALGYPVPKPALISLLEGGDMAWGLEAQDDPPAE

SEQ ID NO: 1869 - protein, 81 aa, Pan troglodytes
MDVMLENYSNLLSVEVWKADDQMERDHRNPDEQARQFLILKNQTPIEERGDLFGKALNLNTDFVSLRQVPYKYDLYEKTLK

SEQ ID NO: 1870 - protein, 81 aa, Pan troglodytes
EQTQAAGMVAGWLINCYQDTVTFDDVAVDFTQEEWTLLDPSQRDLYRDVMLENYENLASVGHHLFKPSVIYWLEQEEELRA

SEQ ID NO: 1871 - protein, 81 aa, Pan troglodytes
MAAPDLAHGGHVSRDSVCLHEEQTQAAGMVAGWLINCYQDTVTFDDVAVDFTQEEWTLLDPSQRDLYRDVMLENYENLASV

SEQ ID NO: 1872 - protein, 81 aa, Pan troglodytes
EQTQAAGMVAGWLINCYQDTVTFDDVAVDFTQEEWTLLDPSQRDLYRDVMLENYENLASVEWRLKTKGPALRQDGSWFRAS

SEQ ID NO: 1873 - protein, 81 aa, Pan troglodytes
MLENYENLASVGHHLFKPSVIYWLEQEEELRAGRRAVLQEWRLKTKGPALRQDGSWFRASNETQMARSHNGGQLCDRTQCG

SEQ ID NO: 1874 - protein, 81 aa, Pan troglodytes
FQEKSTEEGEVAALRLTARSQETVTFKDVAMDFTPEEWGKLDPAQRDVMLENYRNLVSLWLPVSKPENYNLENGKEPLKLE

SEQ ID NO: 1875 - protein, 81 aa, Pan troglodytes
MDTVVFEDVVVDFTPEEWALLNPAQRKLYRDVMLETFKHLASVDNEAQLKASGSISQQDTSGEKLSLKQKIEKFTRKNIWA

SEQ ID NO: 1876 - protein, 81 aa, Pan troglodytes
GHTQGGELVNELLTSWLRGLVTFEDVAVEFTQEEWALLDPAQRTLYRDVMLENCRNLASLGCRVNKPSLISQLEQDKRVIT

SEQ ID NO: 1877 - protein, 81 aa, Pan troglodytes
SKFEEERMVAGWLTNYSQDSVTFEDVAVDFTQEEWTLLDQTQRNLYRDVMPENYKNLVAVDWESHINTKWSAPQQNFLQGK

SEQ ID NO: 1878 - protein, 81 aa, Pan troglodytes
MVAGWLTNYSQDSVTFEDVAVDFTQEEWTLLDQTQRNLYRDVMPENYKNLVAVDWESHINTKWSAPQQNFLQGKTSSVVEM

SEQ ID NO: 1879 - protein, 81 aa, Pan troglodytes
MDSSQHLVTFEDVAVDFTQEEWTLLDQAQRDLYRDVMLENYKNLIILAGSELFKRSLMSGLEQMEELRTGVTGVLQGEKQY

SEQ ID NO: 1880 - protein, 81 aa, Pan troglodytes
MDSSQHLVTFEDVAVDFTQEEWTLLDQAQRDLYRDVMLENYKNLIILAGSELFKRSLMSGLEQMEELRTGVTGVLQELDLQ

SEQ ID NO: 1881 - protein, 81 aa, Pan troglodytes
MDSSQHLVTFEDVAVDFTQEEWTLLDQAQRDLYRDVMLENYKNLIILGSELFKRSLMSGLEQMEELRTGVTGVLQELDLQL

SEQ ID NO: 1882 - protein, 81 aa, Pan troglodytes
MDPVAFKDVAVNFTQEEWALLDISQRRLYREVMLETFRNLTSVGKRWKDQNIEYEYQNPRRNFSSLIEEKVNEIKEDSHCG

SEQ ID NO: 1883 - protein, 81 aa, Pan troglodytes
MMFQDPVAFKDVAVNFTQEEWALLDISQRRLYREVMLETFRNLTSVGKRWKDQNIEYEYQNPRRNFSSLIEEKVNEIKEDS

SEQ ID NO: 1884 - protein, 81 aa, Pan troglodytes
MFQDPVAFKDVAVNFTQEEWALLDISQRRLYREVMLETFRNLTSVGKRWKDQNIEYEYQNPRRNFSSLIEEKVNEIKEDSH

SEQ ID NO: 1885 - protein, 81 aa, Pan troglodytes
MFQDPVAFKDVAVNFTQEEWALLDISQKNLYREVMLETFWNLTSIGKKWKDQNIEYEYQNPRRNFRSVIEEKVNEIKEDSH

SEQ ID NO: 1886 - protein, 81 aa, Pan troglodytes
MLSLSPILLYTCEMFQDPVAFKDVAVNFTQEEWALLDISQKNLYREVMLETFWNLTSIGKKWKDQNIEYEYQNPRRNFRSV

SEQ ID NO: 1887 - protein, 81 aa, Pan troglodytes
CSHRSCREDPGTSESREMDPVAFKDVAVNFTQEEWALLDISQRKLYREVMLETFRNLTSIGKKWKDQNIEFEYQNPRRNFR

SEQ ID NO: 1888 - protein, 81 aa, Pan troglodytes
MPCCSHRSCREDPGTSESREMRPESSDCKLRPVRNLQREVIESSHQAQWLTPVIPALWEAKADGASQMFQDPVAFKDVAVN

SEQ ID NO: 1889 - protein, 81 aa, Pan troglodytes
NLQREVIESSHQAQWLTPVIPALWEAKADGASQMFQDPVAFKDVAVNFTQEEWALLDISQRKLYREVMLETFRNLTSIGVS

SEQ ID NO: 1890 - protein, 81 aa, Pan troglodytes
DPVAFEDVAVNFTQEEWTLLDISQKNLFREVMLETFRNLTSIGKKWSDQNIEYEYQNPRRSFRSLIEEKVNEIKEDSHRGE

SEQ ID NO: 1891 - protein, 81 aa, Pan troglodytes
MDPVAFKDVAVNFTQEEWALLDISQRKLYREVMLETFRNLTSIGKKWKDQNIEFEYQNPRRNFRSLIEGNVNEIKEDSHCG

SEQ ID NO: 1892 - protein, 81 aa, Pan troglodytes
MMFQDPVAFKDVAVNFTQEEWALLDISQRKLYREVMLETFRNLTSIGKKWKDQNIEFEYQNPRRNFRSLIEGNVNEIKEDS

SEQ ID NO: 1893 - protein, 81 aa, Pan troglodytes
PPVLSLSPILLYTCEMFQDPVAFKDVAVNFTQEEWALLDISQRKLYREVMLETFRNLTSIGKKWKDQNIEFEYQNPRRNFR

SEQ ID NO: 1894 - protein, 81 aa, Pan troglodytes
DSVAFEDVAVNFTQEEWALLDPSQKNLYREVMQETLRNLTSIGKKWNNQYIEDEHQNPKRNLRRLIGERLSESKESHQHGE

SEQ ID NO: 1895 - protein, 81 aa, Pan troglodytes
SDQRRRSKEARTPGSRDTDSVVFEDVAVNFTQEEWALLGPSQKKLYRDVMQETFVNLASIGENWEEKNIEDHKNQGRKLRS

SEQ ID NO: 1896 - protein, 81 aa, Pan troglodytes
MDSVAFEDVSVSFSQEEWALLAPSQKKLYRDVMQETFKNLASIGEKWEEPNVEDQHKNQGRNLRSHTGERLCEGKEGSQCA

SEQ ID NO: 1897 - protein, 81 aa, Pan troglodytes
MGPLQFRDVAIEFSLEEWHCLDAAQRNLYRNVMLENYSNLVFLGIVVSKPNLITCLEQGKKPLTMKRHEMIAKPPVMYSHF

SEQ ID NO: 1898 - protein, 81 aa, Pan troglodytes
MGPLQFRDVAIEFSLEEWHCLDAAQRNLYRNVMLENYSNLVFLGIVVSKPNLITCLEQGKKPLTMKRHEMIAKPPGQARWL

SEQ ID NO: 1899 - protein, 81 aa, Pan troglodytes
MGPLQFRDVAIEFSLEEWHCLDAAQRNLYRNVMLENYSNLVFLGIVVSKPNLITCLEQGKKPLTMKRHEMIAKPPDGVSVF

SEQ ID NO: 1900 - protein, 81 aa, Pan troglodytes
MGPLQFRDVAIEFSLEEWHCLDAAQRNLYRNVMLENYSNLVFLVMYSHFAQDLWSEHSIKDSFQKVILRRYEKCRHDNLQL

SEQ ID NO: 1901 - protein, 81 aa, Pan troglodytes
MGPLQFRDVAIEFSLEEWHCLDAAQRNLYRNVMLENYSNLVFLGIVVSKPNLITCLEQGKKPLTMKRHEMIAKPPETGFHR

SEQ ID NO: 1902 - protein, 81 aa, Pan troglodytes
MGPLQFRDVAIEFSLEEWHCLDTAQRNLYRNVMLENYSNLVFLVICSHFAQDLWPEQNIKDSFQKVILRRYEKRGHGNLQL

SEQ ID NO: 1903 - protein, 81 aa, Pan troglodytes
MELLTFRDVTIEFSLEEWEFLNPAQQSLYRKVMLENYRNLVSLGLTVSKPELISCLEQRQEPWNVKRHETIAKPPGTYRVG

SEQ ID NO: 1904 - protein, 81 aa, Pan troglodytes
MLENYRNLVSLGLTVSKPELISCLEQRQEPWNVKRHETIAKPPAMSSHYTEDLLPEQGMQDSFQKVILRRYGSCGLEDLHL

SEQ ID NO: 1905 - protein, 81 aa, Pan troglodytes
MELLTFRDVTIEFSLEEWEFLNPAQQSLYRKVMLENYRNLVSLGLTVSKPELISCLEQRQEPWNVKRHETIAKPPAMSSHY

SEQ ID NO: 1906 - protein, 81 aa, Pan troglodytes
MFCFVFQELLTFRDVTIEFSLEEWEFLNPAQQSLYRKVMLENYRNLVSLGLTVSKPELISCLEQRQEPWNVKRHETIAKPP

SEQ ID NO: 1907 - protein, 81 aa, Pan troglodytes
MELLTFRDVTIEFSLEEWEFLNPAQQSLYRKVMLENYRNLVSLGLTVSKPELISCLEQRQEPWNVKRHETIAKPPDYSLTI

SEQ ID NO: 1908 - protein, 81 aa, Pan troglodytes
MGPLEFRDVAIEFSLEEWHCLDTAQRNLYRDVMLENYRHLVFLGIVVTKPDLITCLEQGKKPFTVKRHEMIAKPPDGVHFL

SEQ ID NO: 1909 - protein, 81 aa, Pan troglodytes
MGPLEFRDVAIEFSLEEWHCLDTAQRNLYRDVMLENYRHLVFLGIVVTKPDLITCLEQGKKPFTVKRHEMIAKPPVMCFHF

SEQ ID NO: 1910 - protein, 81 aa, Pan troglodytes
MESLQFRDVAVEFSLEEWHCLDTAQQNLYRDVMLENYRHLVFLGIIVSKPDLITCLEQGIKPLTMKRHEMIAKPPETEFCH

SEQ ID NO: 1911 - protein, 81 aa, Pan troglodytes; identical to SEQ ID NO: 391

SEQ ID NO: 1912 - protein, 81 aa, Pan troglodytes
MGPLQFRDVAIEFSLEEWHCLDTAQRNLYRNVMLENYRNLVFLGIVVSKPDLITCLEQGKKPLTMKKHEMVANPSETGFHH

SEQ ID NO: 1913 - protein, 81 aa, Pan troglodytes
MGPLQFRDVAIEFSLEEWHCLDTAQRNLYKDVMLENYRNLIFLGITVSKPDLITCLEQGRKPLTMKRNEMIAKPSVSFLQV

SEQ ID NO: 1914 - protein, 81 aa, Pan troglodytes
MGPLQFRDVAIEFSLEEWHCLDTAQRNLYKDVMLENYRNLIFLGITVSKPDLITCLEQGRKPLTMKRNEMIAKPSVMCSHF

SEQ ID NO: 1915 - protein, 81 aa, Pan troglodytes
MNVMLENYKNLVFLGIAVSKQDPITSLEQEKEPWNMKICEIVDESPGQVWCLTPVIPALWEARAGGLLEPRSWRPAWSTWK

SEQ ID NO: 1916 - protein, 81 aa, Pan troglodytes
EKVQVILLPQPPELLGLQETLTFRDVAIEFSLEEWECLNPAQQNLYMNVMLENYKNLVFLGVAVSKQDPVTCLEQEKEPWN

SEQ ID NO: 1917 - protein, 81 aa, Pan troglodytes
EFSLEEWQCLDTAQQDLYRKVMLENYRNLVFLAGIAVSKPDLVTCLEQGKDPWNMKRHSTVVKPPGGDCSIFLMEHQGDVT

SEQ ID NO: 1918 - protein, 81 aa, Pan troglodytes
MGPLTFTDVAIEFSLEEWQCLDTAQQNLYRNVMLENYRNLVFLGIAVSKPDLITCLEKEKEPCKMKRHEMVDEPPDGVLLL

SEQ ID NO: 1919 - protein, 81 aa, Pan troglodytes
MGPLTIRDVTVEFSLEEWHCLDTAQQNLYRDVMLENYRNLVFLGIAVSKPDLITCLEQGKEPCNMKRREMVAKPPDSHSVS

SEQ ID NO: 1920 - protein, 81 aa, Pan troglodytes
MGPLTIRDVTVEFSLEEWHCLDTAQQNLYRDVMLENYRNLVFLGIAVSKPDLITCLEQGKEPCNMKRREMVAKPPDGVSLF

SEQ ID NO: 1921 - protein, 81 aa, Pan troglodytes
MGPLTIRDVTVEFSLEEWHCLDTAQQNLYRDVMLENYRNLVFLGIAVSKPDLITCLEQGKEPCNMKRREMVAKPPVMCSHI

SEQ ID NO: 1922 - protein, 81 aa, Pan troglodytes
MGPLTIRDVTVEFSLEEWHCLDTAQQNLYRDVMLENYRNLVFLGIAVSKPDLITCLEQGKEPCNMKRREMVAKPPAFYLMG

SEQ ID NO: 1923 - protein, 81 aa, Pan troglodytes
FLGMAVFKPDLITCLKQGKEPWNMKRHEMVTKPPVMRSHFTQDLWPDQSTKDSFQEVILRTYARCGHNNLRLRKDCKSANE

SEQ ID NO: 1924 - protein, 81 aa, Pan troglodytes
MPGPLGSLEMGVLTFRDVAIEFSLEEWQCLDTAQQNLYRNVMLENRNLVFMGIAASKPDLITCLEQGKERWNVKRHEMVAE

SEQ ID NO: 1925 - protein, 81 aa, Pan troglodytes
GSLEMGVLTFRDVAIEFSLEEWQCLDTAQQNLYRNVMLENRNLVFMGIAASKPDLITCLEQGKERWNVKRHEMVAEPPGLQ

SEQ ID NO: 1926 - protein, 81 aa, Pan troglodytes
GYSGQWAGVAVSAGSPPIPTSSMWSPMVRLGGFSPELQHLPQTLLHRCPLGQPRMGVLTFRDVAIEFSLEEWQCLDTAQQN

SEQ ID NO: 1927 - protein, 81 aa, Pan troglodytes
TPGTPGSLEMGLLTFRDVAIEFSPEEWQCLDTAQQNLYRNVMLENYRNLAFLGIALSKPDLITCLEQGKEPWNMKQHEMVD

SEQ ID NO: 1928 - protein, 81 aa, Pan troglodytes
MGLLTFRDVAIEFSPEEWQCLDTAQQNLYRNVMLENYRNLAFLGIALSKPDLITCLEQGKEPWNMKQHEMVDEPTGICPHF

SEQ ID NO: 1929 - protein, 81 aa, Pan troglodytes
MGLLTFRDVAIEFSLEEWQCLDTAQRNLYKNVILENYRNLVFLGIAVSKQDLITCLEQEKEPLAVKRHEMVNEPPGSVGQT

SEQ ID NO: 1930 - protein, 81 aa, Pan troglodytes
MGLLTFRDVAIEFSLEEWQCLDTAQRNLYKNVILENYRNLVFLGIAVSKQDLITCLEQEKEPLAVKRHEMVNEPPGLPLMP

SEQ ID NO: 1931 - protein, 81 aa, Pan troglodytes
MGLLTFRDVAIEFSLEEWQCLDTAQRNLYKNVILENYRNLVFLGIAVSKQDLITCLEQEKEPLAVKRHEMVNEPPVMCSHF

SEQ ID NO: 1932 - protein, 81 aa, Pan troglodytes
MGLLTFRDVAIEFSLEEWQCLDTAQRNLYKNVILENYRNLVFLGIAVSKQDLITCLEQEKEPLAVKRHEMVNEPPAVDKHP

SEQ ID NO: 1933 - protein, 81 aa, Pan troglodytes
MGLLTFRDVAIEFSLEEWQCLDTAQRNLYKNVILENYRNLVFLGIAVSKQDLITCLEQEKEPLAVKRHEMVNEPPESCPVV

SEQ ID NO: 1934 - protein, 81 aa, Pan troglodytes
MGLLTFRDVAIEFSLEEWQCLDTAQKNLYRNVMLENYRNLAFLGIAVSKPDLIICLEKEKEPWNVKRDEMVDEPPDGVSLC

SEQ ID NO: 1935 - protein, 81 aa, Pan troglodytes
MGLLTFRDVAIEFSLEEWQCLDTAQKNLYRNVMLENYRNLAFLGIAVSKPDLIICLEKEKEPWNVKRDEMVDEPPGLAVSN

SEQ ID NO: 1936 - protein, 81 aa, Pan troglodytes
MGLLTFRDVAIEFSLEEWQCLDTAQKNLYRNVMLENYRNLAFLGIAVSKPDLIICLEKEKEPWNVKRDEMVDEPPGICPHF

SEQ ID NO: 1937 - protein, 81 aa, Pan troglodytes
MLENYRNLAFLGIAVSKPDLITCLEQGKEPWNMKRHEMVDEPPDMCPHFAQDLWPEQGMEDSFQKATLRRYGKYGHENLQL

SEQ ID NO: 1938 - protein, 81 aa, Pan troglodytes
MSQVTFGDVAIDFSHEEWACLDSAQRDLYKDVMVQNYENLVSVAGLSVTKPYVIMLLEDGKEPWMMEKKLSKDWESRWENK

SEQ ID NO: 1939 - protein, 81 aa, Pan troglodytes
MSQVTFGDVAIDFSHEEWACLDSAQRDLYKDVMVQNYENLVSVAGLSVTKPYVIMLLEDGKEPWMMEKKLSKAYPFPLSHS

SEQ ID NO: 1940 - protein, 81 aa, Pan troglodytes
MSQVTFGDVAIDFSHEEWACLDSAQRDLYKDVMVQNYENLVSVGLSVTKPYVIMLLEDGKEPWMMEKKLSKAYPFPLSHSV

SEQ ID NO: 1941 - protein, 81 aa, Pan troglodytes
MSQVTFGDVAIDFSHEEWACLDSAQRDLYKDVMVQNYENLVSVGLSVTKPYVIMLLEDGKEPWMMEKKLSKDWESRWENKE

SEQ ID NO: 1942 - protein, 81 aa, Pan troglodytes
EELVGQNHGMEGEACTGGDVTFGDVAIDFSHEEWACLDSAQRDLYKDVMVQNYENLVSVGLSVTKPYVIMLLEDGKEPWMM

SEQ ID NO: 1943 - protein, 81 aa, Pan troglodytes
MSQVTFGDVAIDFSHEEWACLDSAQRDLYKDVMVQNYENLVSVGLSVTKPYVIMLLEDGKEPWMMEKKLSKGMIPDWESRW

SEQ ID NO: 1944 - protein, 81 aa, Pan troglodytes
SNEELVGQNHGMEGEACIGGDVTFNDVAIDFSHEEWGWLNSAQRDLYKDVMVQNYENLVSVAGLSITKPYVITLLEDGKEP

SEQ ID NO: 1945 - protein, 81 aa, Pan troglodytes
MPQVTFNDVAIDFSHEEWGWLNSAQRDLYKDVMVQNYENLVSVAGLSITKPYVITLLEDGKEPWMMEKKLSKGMIPHWESR

SEQ ID NO: 1946 - protein, 81 aa, Pan troglodytes
MPQVTFNDVAIDFSHEEWGWLNSAQRDLYKDVMVQNYENLVSVGLSITKPYVITLLEDGKEPWMMEKKLSKGMIPHWESRW

SEQ ID NO: 1947 - protein, 81 aa, Pan troglodytes
MPQVTFNDVAIDFSHEEWGWLNSAQRDLYKDVMVQNYENLVSVAGLSITKPYVITLLEDGKEPWMMEKKLSKDWESRWENK

SEQ ID NO: 1948 - protein, 81 aa, Pan troglodytes
MAQGLVTFRDVAIEFSLEEWKCLEPAQRDLYREVTLENFGHLASLGLSISKPDVVSLLEQGKEPWMIANDVTGPWCPDLES

SEQ ID NO: 1949 - protein, 81 aa, Pan troglodytes
EESREIRAGQIVLKAMAQGLVTFRDVAIEFSLEEWKCLEPAQRDLYREVTLENFGHLASLGLSISKPDVVSLLEQGKEPWM

SEQ ID NO: 1950 - protein, 81 aa, Pan troglodytes
MAEGSVMFSDVSIDFSQEEWDCLDPVQRDLYRDVMLENYSNLVSMGKGICTSDSQFSSGMSASSTVNFSAPFQDFTLLSLK

SEQ ID NO: 1951 - protein, 81 aa, Pan troglodytes
SPQKSSALAPEDHGSSYEGSVSFRDVAIDFSREEWRHLDLSQRNLYRDVMLETYSHLLSVGYQVPKPEVVMLEQGKEPWAL

SEQ ID NO: 1952 - protein, 81 aa, Pan troglodytes
MARKLVMFRDVAIDFSQEEWECLDSAQRDLYRDVMLENYSNLVSLDLPSRCASKDLSPEKNTYETELSQWEMSDRLENCDL

SEQ ID NO: 1953 - protein, 81 aa, Pan troglodytes
TELSQWEMSDRLENCDLEESNSRDYLEAKGKMEKQQENQKEYFRQGMIIYDKMSIFNQHTYLSQHSKCHSTEKPYKCKECG

SEQ ID NO: 1954 - protein, 81 aa, Pan troglodytes
FRDVAIDFSQEEWECLDSAQRDLYRDVMLENYSNLVSLDLPSRCASKDLSPEKNTYETELSQWEMSDRLENCDLEESNSRD

SEQ ID NO: 1955 - protein, 81 aa, Pan troglodytes
MKPAQRNLYRDVMLENYSNLVTVGCQVTKPDVIFKLEQEEEPWVMEEEMFGRHCPEPRRGENCCASEVMAEGLKFKDVVIY

SEQ ID NO: 1956 - protein, 81 aa, Pan troglodytes
HCPEPRRGENCCASEVMAEGLKFKDVVIYFSQKEWECLHSAQKDLYRDVMLENYGNLVLLGLSDTKPNVISLLEQKKEPWM

SEQ ID NO: 1957 - protein, 81 aa, Pan troglodytes
QEEWEQMKPAQRNLYRDVMLENYSNLVTVGCQVTKPDVIFKLEQEEEPWVMEEEMFGRHCPEPRRGENCCASEVMAEMEFC

SEQ ID NO: 1958 - protein, 81 aa, Pan troglodytes
MAHLMMFRDVAVDFSQEEWECLDLEQRDLYRDVMLENYSNMVSLGLCIYQPEAFSLLEKGKEPWKILRDETRGPCPDMQSR

SEQ ID NO: 1959 - protein, 81 aa, Pan troglodytes
MNMEGLVMFQDLSIDFSQEEWECLDAAQKDLYRDVMMENYSSLVSLGLSIPKPDVISLLEQGKEPWMVSRDVLGGWCRELE

SEQ ID NO: 1960 - protein, 81 aa, Pan troglodytes
MAQGSVSFNDVTVDFTQEEWQHLDHAQKTLYMDVMLENYCHLISVGCHMTKPDVILKLERGEEPWTSFAGHTCLGGEDGLT

SEQ ID NO: 1961 - protein, 81 aa, Pan troglodytes
FHMAKPDMIRKLEQGEELWTQRIFPSYSYLEEDGKTEDVLVKFKEYQDRHSRPLILINHKKLIKERSNIYGKTFTLGRNRI

SEQ ID NO: 1962 - protein, 81 aa, Pan troglodytes
GFHMAKPDMIRKLEQGEELWTQRIFPSYSYLEDGKTEDVLVKFKEYQDRHSRPLILINHKKLIKERSNIYGKTFTLGRNRI

SEQ ID NO: 1963 - protein, 81 aa, Pan troglodytes
MLETYNHLVSLEIPSSKPKLIAQLEQGEEPWREERKCPLDLCPESKPEIQLSPSCPLIFSNQQALSQHVWLSHLSQLFSSL

SEQ ID NO: 1964 - protein, 81 aa, Pan troglodytes
MATGLLRAKKEEEWRLLSPAQRTLHREVMLETYNHLVSLEIPSSKPKLIAQLEQGEEPWREERKCPLDLCPAESKPEIQLS

SEQ ID NO: 1965 - protein, 81 aa, Pan troglodytes
KLIAQLEQGEEPWREERKCPLDLCPAESKPEIQLSPSCPLIFSNQQALSQHVWLSHLSQLFSSLWAGNPLQLGKHYPEDPK

SEQ ID NO: 1966 - protein, 81 aa, Pan troglodytes
MATGLLRAKKEAFVAFRDVAVDFTQEEWRLLSPAQRTLHREVMLETYNHLVSLEIPSSKPKLIAQLEQGEEPWREERKCPL

SEQ ID NO: 1967 - protein, 81 aa, Pan troglodytes
TCMVHRQTMSCSGAGGITAFVAFRDVAVDFTQEEWRLLSPAQRTLHREVMLETYNHLVSLEIPSSKPKLIAQLEQGEEPWR

SEQ ID NO: 1968 - protein, 81 aa, Pan troglodytes
MAMGLCKAMSQGLVTFRDVALDFSQEEWEWLKPSQKDLYRDVMLENYRNLVWLGLSISKPNMISLLEQGKEPWMVERKMSQ

SEQ ID NO: 1969 - protein, 81 aa, Pan troglodytes
MAMGLCKAMSQGLVTFRDVALDFSQEEWEWLKPSQKDLYRDVMLENYRNLVWLDWESWCEIEELSPKWFIDEDEISQEMVM

SEQ ID NO: 1970 - protein, 81 aa, Pan troglodytes
MAMGLCKAMSQGLVTFRDVALDFSQEEWEWLKPSQKDLYRDVMLENYRNLVWLGDGCSCRSTLRTTVTAEASSSSSSIQAS

SEQ ID NO: 1971 - protein, 81 aa, Pan troglodytes
PICETEELTPKQDFYEEHQSQKIIETLTSYNLEYSSLREEWKCEGYFERQPGNQKACFKEEIITHEEPLFDEREQEYKSWG

SEQ ID NO: 1972 - protein, 81 aa, Pan troglodytes
QGKAPWMVKRELTKGLCSGWEPICETEELTPKQDFYEEHQSQKIIETLTSYNLEYSSLREEWKCEGYFERQPGNQKACFKE

SEQ ID NO: 1973 - protein, 81 aa, Pan troglodytes
MAHALVTFRDVAIDFSQKEWECLDTTQRKLYRDVMLENYNNLVSLGYSGSKPDVITLLEQGKEPCVAAKDVTGRQCPGLLS

SEQ ID NO: 1974 - protein, 81 aa, Pan troglodytes
MAHALVTFRDVAIDFSQKEWECLDTTQRKLYRDVMLENYNNLVSLGLLSRHKTKKLSSEKDIHEISLSKGSIIEKSKTLHL

SEQ ID NO: 1975 - protein, 81 aa, Pan troglodytes
MAHALVTFRDVAIDFSQKEWECLDTTQRKLYRDVMLENYNNLVSLAGYSGSKPDVITLLEQGKEPCVAAKDVTGRQCPGLL

SEQ ID NO: 1976 - protein, 81 aa, Pan troglodytes
CNWGRPLKFCPTKYMKFQELVTFRDVAIDFSRQEWEYLDPNQRDLYRDVMLENYRNLVSLGGHSISKPVVVDLLERGKEPW

SEQ ID NO: 1977 - protein, 81 aa, Pan troglodytes
MTCFQELVTFRDVAIDFSRQEWEYLDPNQRDLYRDVMLENYRNLVSLGGHSISKPVVVDLLERGKEPWMILREETQFTDLD

SEQ ID NO: 1978 - protein, 81 aa, Pan troglodytes
TCNWGRPLKFCPTKYMKFQELVTFRDVAIDFSRQEWEYLDPNQRDLYRDVMLENYRNLVSLGGHSISKPVVVDLLERGKEP

SEQ ID NO: 1979 - protein, 81 aa, Pan troglodytes
MLENYSHLISLGSSISKPDVITLLEQEKEPWMVVRKETSRWYPDLESKYGPEKVSPENDTSEVNLPKQVIKQISTTLGVEA

SEQ ID NO: 1980 - protein, 81 aa, Pan troglodytes
GRSLRKIDQFCNSSNMVHGSVTFRDVAIDFSQEEWECLQPDQRTLYRDVMLENYSHLISLGSSISKPDVITLLEQEKEPWM

SEQ ID NO: 1981 - protein, 81 aa, Pan troglodytes
MVHGSVTFRDVAIDFSQEEWECLQPDQRTLYRDVMLENYSHLISLGSSISKPDVITLLEQEKEPWMVVRKETSRWYPDLES

SEQ ID NO: 1982 - protein, 81 aa, Pan troglodytes
MVHGSVTFRDVAIDFSQEEWECLQPDQRTLYRDVMLENYSHLISLAGSSISKPDVITLLEQEKEPWMVVRKETSRWYPDLE

SEQ ID NO: 1983 - protein, 81 aa, Pan troglodytes
MAQVPLTFSDVAIDFSQEEWEYLNSDQRDLYRDVMLENYTNLVSLEFDFTTESDKLSSEKRNYEVNAYHQETWKRNKTFNL

SEQ ID NO: 1984 - protein, 81 aa, Pan troglodytes
FQVPLTFSDVAIDFSQEEWEYLNSDQRDLYRDVMLENYTNLVSLEFDFTTESDKLSSEKRNYEVNAYHQETWKRNKTFNLM

SEQ ID NO: 1985 - protein, 81 aa, Pan troglodytes
MTKSKEAVTFKDVAVVFSEEELQLLDLAQRKLYQDVMLENFRNVVSVGHQSTPDGLPQLEREEKLWVMKMATQRDNSSGAK

SEQ ID NO: 1986 - protein, 81 aa, Pan troglodytes
MLENFRNVVSVGHQSTPDGLPQLEREEKLWVMKMATQRDNSSGAKNLKEMETLQEVGLRYLPHEELFCSQIWQQITRELIK

SEQ ID NO: 1987 - protein, 81 aa, Pan troglodytes
HLGLCKFPEVEGKMTTFKEAVTFKDVAVVFTEEELGLLDPAQRKLYRDVMLENFRNLLLVGNQPFHQDTFHFLRKEEFWMM

SEQ ID NO: 1988 - protein, 81 aa, Pan troglodytes
HFLRKEEFWMMKTTSQREGNSGGKIQIEMETVPEAGPHEEWSCQQIREQIASDLTRSQNSIRNSSQFFKEGDVPCQTEAEL

SEQ ID NO: 1989 - protein, 81 aa, Pan troglodytes
EQCEKGYNSKFNLDMHQRVHRGERPYNCKECGKSFGWASCLLKHQRLHSGQKPLKSGVWEEIYSEFTASFTSVSLYGRKAI

SEQ ID NO: 1990 - protein, 81 aa, Pan troglodytes
AQRKLYRDVMLENFRNLLLVGNQPFHQDTFHFLRKEEFWMMKTTSQREGNSGGKIQIEMETVPEAGPHEEWSCQQIREQIA

SEQ ID NO: 1991 - protein, 81 aa, Pan troglodytes
LREEKFWMMGTATQREGNSGGKIQTELESVPEAGAHEEWSCQQIWEQIANDLTRSQDSIINNSQFFENAVILRREVYTCDE

SEQ ID NO: 1992 - protein, 81 aa, Pan troglodytes
LREEKFWMMGTATQREGNSGGKIQTELESVPEAGAHEEWSCQQIWEQIANDLTRSQDSIINNSQFFENGDVPSQVEAGLPT

SEQ ID NO: 1993 - protein, 81 aa, Pan troglodytes
DVMLENFRNLLSVGHQPFHQDTCHFLREEKFWMMGTATQREGNSGGKIQTELESVPEAGAHEEWSCQQIWEQIANDLTRSQ

SEQ ID NO: 1994 - protein, 81 aa, Pan troglodytes
HFLREEKFWMMGTATQREGNSGGKIQIEMETVPEAGPHEEWSCQQIREQIASDLTRSQNSIRNSSQFFKEGDVPCQTEAEL

SEQ ID NO: 1995 - protein, 81 aa, Pan troglodytes
MTTFKEAVTFKDVAVFFTEEELGLLDPAQRKLYQDVMLENFTNLLSVGHQPFHPFHFLREEKFWMMETATQREGNSGGKTV

SEQ ID NO: 1996 - protein, 81 aa, Pan troglodytes
MTTFKEAVTFKDVAVFFTEEELGLLDPAQRKLYQDVMLENFTNLLSVGHQPFHPFHFLREEKFWMMETATQREGNSGKKQA

SEQ ID NO: 1997 - protein, 81 aa, Pan troglodytes
QREEKFWIMETATQREGNSGGKIQTELESVPETGPQEEWSCQQIWEQTASELTRPQDSVSSSQFSTQGDVPSQVDAGLSII

SEQ ID NO: 1998 - protein, 81 aa, Pan troglodytes
MTMFKEAMTFKDVAVVFTEEELGLLDLAQRKLYRDVMLENFRNLLSVGHQAFHRDTFHFLREEKIWMMKTAIQREGNSGDK

SEQ ID NO: 1999 - protein, 81 aa, Pan troglodytes
LLSVGHQAFHRDTFHFLREEKIWMMKTAIQREGNSGDKIQTEMETVSEAGTHQEWSFQQIWEKIASDLTRSQDLVINSSQF

SEQ ID NO: 2000 - protein, 81 aa, Pan troglodytes
MTTFKEGLTFKDVAVVFTEEELGLLDPVQRNLYQDVMLENFRNLLSVGDLSLHISEFSVLTADKIQSEVETVPEAGRHEEL

SEQ ID NO: 2001 - protein, 81 aa, Pan troglodytes
MNMFKEAVTFKDVAVAFTEEELGLLGPAQRKLYRDVMVENFRNLLSVGHQPFKQDVSPIERNEQLWVMTTATRRQGNLGEK

SEQ ID NO: 2002 - protein, 81 aa, Pan troglodytes
VGHQPFKQDVSPIERNEQLWVMTTATRRQGNLGEKNQSKLITVQDRESEEELSCWQIWQQIANDLTRCQDSMINNSQCHRQ

SEQ ID NO: 2003 - protein, 81 aa, Pan troglodytes
MNMFKEAVTFKDVAVAFTEEELGLLGPAQRKLYRDVMVENFRNLLSVGHQPFKQDVSPIERNEQLWVMTTATRRQGNLGKN

SEQ ID NO: 2004 - protein, 81 aa, Pan troglodytes
MNMFKEAVTFKDVAVAFTEEELGLLGPAQRKLYRDVMVENFRNLLSVGHQPFKQDVSPIERNEQLWVMTTATRRQGNLDTL

SEQ ID NO: 2005 - protein, 81 aa, Pan troglodytes
MVENFRNLLSVGHQPFKQDVSPIERNEQLWVMTTATRRQGNLGEKNQSKLITVQDRESEEELSCWQIWQQIANDLTRCQDS

SEQ ID NO: 2006 - protein, 81 aa, Pan troglodytes
RNEQLWVMTTATRRQGNLGEKNQSKLITVQDRESEEELSCWQIWQQIANDLTRCQDSMINNSQCHRQGDFPYQVGTELSIQ

SEQ ID NO: 2007 - protein, 81 aa, Pan troglodytes
IERNEQLWVMTTATRRQGNLGEKNQSKLITVQDRESEEELSCWQIWQQIANDLTRCQDSMINNSQCHRQGDFPYQVGTELS

SEQ ID NO: 2008 - protein, 81 aa, Pan troglodytes
PGTLPFPRRRRGKMTKFQEAVTFKDVAVAFTEEELGLLDSAQRKLYRDVMLENFRNLVSVGHQSFKPDMISQLEREEKLWM

SEQ ID NO: 2009 - protein, 81 aa, Pan troglodytes
MTKFQEMVTFKDVAVVFTREELGLLDLAQRKLYQDVMLENFRNLLSVGYQPFKLDVILQLGKEDKLRMMETEIQGDGCSGE

SEQ ID NO: 2010 - protein, 81 aa, Pan troglodytes
MTKFQEMVTFKDVAVVFTREELGLLDLAQRKLYQDVMLENFRNLLSVGYQPFKLDVILQLGKEDKLRMMETEIQGDGCSGH

SEQ ID NO: 2011 - protein, 81 aa, Pan troglodytes
FWRYNLVLPSQDPALPQKEQEKMTKFQEMVTFKDVAVVFTREELGLLDLAQRKLYQDVMLENFRNLLSVGYQPFKLDVILQ

SEQ ID NO: 2012 - protein, 81 aa, Pan troglodytes
MTKFQEMVTFKDVAVVFTREELGLLDLAQRKLYQDVMLENFRNLLSVGYQPFKLDVILQLGKEDKLRMMETEIQGDGCSGL

SEQ ID NO: 2013 - protein, 81 aa, Pan troglodytes
MVTFKDVAVVFTEEELGLLDSVQRKLYRDVMLENFRNLLLVAHQPFKPDLISQLEREEKLLMVETETPRDGCSGRKNQQKM

SEQ ID NO: 2014 - protein, 81 aa, Pan troglodytes
MTKFQEMVTFKDVAVVFTEEELGLLDSVQRKLYRDVMLENFRNLLLVAHQPFKPDLISQLEREEKLLMVETETPRDGCSGR

SEQ ID NO: 2015 - protein, 81 aa, Pan troglodytes
MIKFQMVTFKDVAVVFTEEELGLLDSVQRKLYRDVMLENFRNLLLVAHQPFKPDLISQLEREEKLLMVETETPRDGCSGRK

SEQ ID NO: 2016 - protein, 81 aa, Pan troglodytes
MEALEADLKHRFTRQEWDLAKSLQKTIQAARSENYSLTDFWAYMVISKQTRELPESHLSNMKKPVEEGTLPYPIFAAIDND

SEQ ID NO: 2017 - protein, 81 aa, Pan troglodytes
SWPQAIVPPQPPKVLGLQDSVTFADVAVNFTKEEWTLLDPAQRNLYRDVMLENSRNLAFIDWATPCKTKDATPQPDILPKR

SEQ ID NO: 2018 - protein, 81 aa, Pan troglodytes
LSQKPQVLGPEKQDGSCEASVSFEDVTVDFSREEWQQLDPAQRCLYRDVMLELYSHLFSVGYHIPNPEVIFRMPKEKEPRV

SEQ ID NO: 2019 - protein, 81 aa, Pan troglodytes
NATIVMSVRREQGSSAGEGSLSFEDVAVGFTREEWQFLDQSQKVLYREVMLENYSNLVSIGYQGTKPDSLFKLEQGEPPGI

SEQ ID NO: 2020 - protein, 81 aa, Pan troglodytes
MTKAQESLTLEDVAVDFTWEEWQFLSPAQKDLYRDVMLENYSNLVSVGYQAGKPDALTKLEQGEPLWTLEDEIHSPAHPEI

SEQ ID NO: 2021 - protein, 81 aa, Pan troglodytes
MIKSQESLALEDVAVEFTWEEWQLLGPAQKDLYRDVMLENYSNLVSVGYQASKPDALFKLEQGEPWTVENEIHSQICPEIK

SEQ ID NO: 2022 - protein, 81 aa, Pan troglodytes
MIQAQESITLEDVAVDFTWEEWQFLSPAQKDLYRDVMLENYSNLVAVGYQASKPDALFKLEQGEQPWTIEDGIHSGACSDI

SEQ ID NO: 2023 - protein, 81 aa, Pan troglodytes
MLENYSNLVAVGYQASKPDALFKLEQGEQPWTIEDGIHSGACSDIWKVDHVLERLQSESLVNRRKPCHEHDAFENIVHCSK

SEQ ID NO: 2024 - protein, 81 aa, Pan troglodytes
MMQAQESLTLEDVAVDFTWEEWQLLSPAQKDLYRDVMLENYSNLVSVGYQASKPDAFSKLERGEETCTTEDEIYSRICSDS

SEQ ID NO: 2025 - protein, 81 aa, Pan troglodytes
MMQAQESLTLEDVAVDFTWEEWQLLSPAQKDLYRDVMLENYSNLVSVGYQASKPDAFSKLERGEETCTTEDEIYSRICSEI

SEQ ID NO: 2026 - protein, 81 aa, Pan troglodytes
MRPEPTKFWEESLTLEDVAVDFTWEEWQLLSPAQKDLYRDVMLENYSNLVSVGYQASKPDAFSKLERGEETCTTEDEIYSR

SEQ ID NO: 2027 - protein, 81 aa, Pan troglodytes
MESLTLEDVAVDFTWEEWQLLSPAQKDLYRDVMLENYSNLVSVGYQASKPDAFSKLERGEETCTTEDEIYSRICSDSGGAS

SEQ ID NO: 2028 - protein, 81 aa, Pan troglodytes
MIKTQESLTLEDVAVEFSWEEWQLLDTAQKNLYRDVMVENYNHLVSLGYQTSKPDVLSKLAHGQEPWITDAKIQNKNCPGI

SEQ ID NO: 2029 - protein, 80 aa, Pan troglodytes [sequence omitted]

SEQ ID NO: 2030 - protein, 81 aa, Pan troglodytes
MALPQGSLTFRDVAIEFSQEEWKCLDPVQKALYRDVMLENYRNLGFLGLCLPDLNIISVLEQGKEPWTVVSQVKIARNPNC

SEQ ID NO: 2031 - protein, 81 aa, Pan troglodytes
EAQERKKKEKEPGMALPQGSLTFRDVAIEFSQEEWKCLDPVQKALYRDVMLENYRNLGFLGLCLPDLNIISVLEQGKEPWT

SEQ ID NO: 2032 - protein, 81 aa, Pan troglodytes
MATQGHLTFKDVAIEFSQEEWKCLEPMQKALYKDVMLENYRNLVFLGISPKCVIKELPPTENSNTGERFQTVPLERHQSYD

SEQ ID NO: 2033 - protein, 81 aa, Pan troglodytes
MLENYRNLVSLGICLPDLSIISMMKQRTEPWAVENEMKVAKNPDRWEGIKDTNTGRSCAVRSKAGNKPITNQLGLTFHLPL

SEQ ID NO: 2034 - protein, 81 aa, Pan troglodytes
PWSGENEVKIAKNSDGRECIKGVNTGWSAMVQSRLTATSTSWVQAVLLPQPPEQLGLQGAAMHWEAMQKTNQLKNNLEYPF

SEQ ID NO: 2035 - protein, 81 aa, Pan troglodytes
DEEAQKRKAKESGMALPQGHLTFMDVAIEFSQEEWKSLDPGQRALYRDVMLENYRNLVFLGICLPDLSIISMLKQRREPLI

SEQ ID NO: 2036 - protein, 81 aa, Pan troglodytes
DEEAQKRKAKESGMALPQGHLTFMDVAIEFSQEEWKSLDPGQRALYRDVMLENYRNLVFLGRSCVLGSNAENKPIKNQLGL

SEQ ID NO: 2037 - protein, 81 aa, Pan troglodytes
VSWRPGSRLRGVTVMLRRGHLTFRDVAIEFSQEEWKCLDPAQRTLYREVMVENYRNLVFLETISSIIPSGLKITAFFRILP

SEQ ID NO: 2038 - protein, 81 aa, Pan troglodytes
LYRDVMLENYRNLVSLGICLPDLSVTSMLEQKRDPWTLQSEEKIANDPDGRECIKGVNTDSPLLQCITSVPCVFCTASMIY

SEQ ID NO: 2039 - protein, 81 aa, Pan troglodytes
MALTQGQLSFSDVAIEFSQEEWKCLDPGQKALYRDVMLENYRNLISLGICLPDLSVTSMLEQKRDPWTLQSEVKIVNNPDG

SEQ ID NO: 2040 - protein, 81 aa, Pan troglodytes
MALTQGQLSFSDVAIEFSQEEWKCLDPGQKALYRDVMLENYRNLISLGEDNVPPEACFCSGICLPDLSVTSMLEQKRDPWT

SEQ ID NO: 2041 - protein, 81 aa, Pan troglodytes
MALTQGQLSFSDVAIEFSQEEWKCLDPGQKALYRDVMLENYRNLISLGICLPDLSVTSIFFTSGLGRARLQGGSLARVSRV

SEQ ID NO: 2042 - protein, 81 aa, Pan troglodytes
EEAAQKRKGKEPGMALPQGRLTFRDVAIEFSLAEWKFLNPAQRALYREVMLENYRNLEAVDISSKRMMREVLSTGQGNTEV

SEQ ID NO: 2043 - protein, 81 aa, Pan troglodytes
REEAAQKRKGKEPGMALPQGRLTFRDVAIEFSLAEWKFLNPSQRALYREVMLENYRNLEAVDISSKRMMKEVLSTGQGNTE

SEQ ID NO: 2044 - protein, 81 aa, Pan troglodytes
MALPQGLLTFRDVAIEFSQEEWKCLDPAQRTLYRDVMLENYRNLVSLGIFSKCEIKELPPKKESNTGEIFQTVMLERHESH

SEQ ID NO: 2045 - protein, 81 aa, Pan troglodytes
DPAQRTLYRDVMLENYRNLVSLGIFSKCEIKELPPKKESNTGEIFQTVMLERHESHDIQDFCFRETQKNVHDSQCLWQHDE

SEQ ID NO: 2046 - protein, 81 aa, Pan troglodytes
AIEFSQEEWKCLDPAQRTLYRDVMLENYRNLVSLGIFSKCEIKELPPKKESNTGEIFQTVMLERHESHDIQDFCFRETQKN

SEQ ID NO: 2047 - protein, 81 aa, Pan troglodytes
MALPQGLLTFRDVAIEFSQEEWKCLDPAQRTLYRDVMLENYRNLVSLGHDLILFFLFLRWSFSCCPGWSAVAQSRLTTTSA

SEQ ID NO: 2048 - protein, 81 aa, Pan troglodytes
MALPQGLLTFRDVAIEFSQEEWKCLDPAQRTLYRDVMLENYRNLVSLGHDLILFFLFLRWSFALVAQAGVQWHNLGSPQPP

SEQ ID NO: 2049 - protein, 81 aa, Pan troglodytes
EEAAQKRKGKEPGMALPQGRLTFRDVAIEFSLAEWKFLNPAQRALYREVMLENYRNLEAVDISSKHMMKEVLSTGQGNTEV

SEQ ID NO: 2050 - protein, 81 aa, Pan troglodytes
EEAAQKRKGKEPGMALPQGRLTFRDVAIEFSLAEWKFLNPAQRALYREVMLENYRNLEAVESHFVTQAGVQWCDPGSLQPL

SEQ ID NO: 2051 - protein, 80 aa, Pan troglodytes
MLREEAAQKRKGKEPGMALPQGRLTFRDVAIEFSLAEWKFLNPAQRALYREVMLENYRNLEAVETGFHCVSQDGLNLLTS

SEQ ID NO: 2052 - protein, 81 aa, Pan troglodytes
MALPQGLLTFRDVAIEFSQEEWKCLDPAQRTLYRDVMLENYRNLVSLDISSKCMLKTLSSTGQGNTEVIHTGTLHRQASHH

SEQ ID NO: 2053 - protein, 81 aa, Pan troglodytes
LEFWSVTPAKVQWCHLRSLQPLLPRFKQFSCLSLPSTWDYRYLFQMHVEDVVINRARQYRSDPHRDIAQTSKSSHWRILFP

SEQ ID NO: 2054 - protein, 81 aa, Pan troglodytes
MALPQGLLTFRDVAIEFSQEEWKCLDPAQRTLYRDVMLENYRNLVSLVLRSEVCCTDIWAEVIVADISSKCMLKTLSSTGQ

SEQ ID NO: 2055 - protein, 81 aa, Pan troglodytes
MALPQSLLTFRDVAIEFSQEEWKCLDPAQRTLYRDVMLENYRNLVSLGLISRDLCYLRKTPRRQRKGARDGSSSGMLDFQR

SEQ ID NO: 2056 - protein, 81 aa, Pan troglodytes
MALPQGLLTFRDVAIEFSQEEWKCLDPAQRTLYRDVMLENYRNLVSLDISSKCMMKEFSSIGKGNTEVIHTGTLQRLASHH

SEQ ID NO: 2057 - protein, 81 aa, Pan troglodytes
EEATKKSKEKEPGMALPQGRLTFRDVAIEFSLEEWKCLNPAQRALYRAVMLENYRNLEFVDISSKCMMKVFSSTAQGNREV

SEQ ID NO: 2058 - protein, 81 aa, Pan troglodytes
LTGSTDQYDQRHAGNKLIKGQLGSSSHSHLPEHIFQPEWKIANQVEKSIINASLILTSQRISCSPKTHIFNNYGNNSLHSS

SEQ ID NO: 2059 - protein, 81 aa, Pan troglodytes
MLENYWNLVSLGLCHFDMNIISMLEEGKEPWTVKSCVKIARKPRMQECVKGVVTDIPPKCTIKDLLPKEKSSTEAVFHTVV

SEQ ID NO: 2060 - protein, 81 aa, Pan troglodytes
SMLEQGKEPFTVESQVQIARNPDGWEWIKAVITALSSEFVMKDLPHKGKSNTGEVFQTVMLERQESQDIEGCSFREVQKNT

SEQ ID NO: 2061 - protein, 81 aa, Pan troglodytes
MALPQGLLTFRDVAIEFSQEEWKCLDPAQRTLYRDVMLENYRNLVSLDISSKCMMKEFSSTAQGNTEVIHTGTLQRHERHH

SEQ ID NO: 2062 - protein, 81 aa, Pan troglodytes
MALPQGLLTFRDVAIEFSQEEWKCLDPAQRTLYRDVMLENYRNLVSLGISSKCTMKEFSSTAQGNREVIHTGTLQRHESHH

SEQ ID NO: 2063 - protein, 81 aa, Pan troglodytes
MLENYRNLVSLGISSKCTMKEFSSTAQGNREVIHTGTLQRHESHHIGDFSFQEIEKDIHNFEFQWQEDERNGHEAPMTKIK

SEQ ID NO: 2064 - protein, 81 aa, Pan troglodytes
MALPQGLLTFRDVAIEFSQEEWKCLDPAQRTLYRDVMLENYRNLVSLDISSKCMMKEVLSTAQGNREVIHTGTLQRHESHH

SEQ ID NO: 2065 - protein, 81 aa, Pan troglodytes
MALPQGLLTFRDVAIEFSQEEWKCLDPAQRTLYRDVMLENYRNLVSLDTGFLLFCLANLKLLPSGDPSTSASKTAAITDIS

SEQ ID NO: 2066 - protein, 81 aa, Pan troglodytes
MSQGSVTFQDVAIDFSKEEWGFLNPAQRDLYTTVMLENYQNLVWLGLSISKSVISLLEKRKLPWIMAKEEIRGPLPGYFKV

SEQ ID NO: 2067 - protein, 81 aa, Pan troglodytes
LEYSLLGEHWDYDALFETQPGLVTIKNLAVDFPQQLHPAQKNFCKNGIWENNSDLGSAGHCVAKPDLVSLLEQEKEPWMVK

SEQ ID NO: 2068 - protein, 81 aa, Pan troglodytes
SQEEVEVAGIKLCKAMSLGSVTFTDVAIDFSQDEWEWLNLAQRSLYKKVMLENYRNLVSVGLCISKPVVISLLEQEKDPWV

SEQ ID NO: 2069 - protein, 81 aa, Pan troglodytes
QRSLYKKVMLENYRNLVSVGLCISKPVVISLLEQEKDPWVIKGGMNRGLCPEEMLCKDTTRILPSASQEERPHQEPALPAP

SEQ ID NO: 2070 - protein, 81 aa, Pan troglodytes
MAAQLLTDEALESVTFRDVTVDFTQEEWQQLEPAQKDLYRDVMLENYRNLVSLDWETRPEMKELDPKNDISEDKLSVVGVA

SEQ ID NO: 2071 - protein, 81 aa, Pan troglodytes
RDSRAYESRSQDAESYQNVVDLAEDRKPHNTIQDNMENYRKLLSLGFLAQDSVPAEKRNTEMLDNLSSAGSQFLDFKHLGT

SEQ ID NO: 2072 - protein, 81 aa, Pan troglodytes
MNNSQGRVTFEDVTVNFTQGEWQRLNPEQRNLYRDVMLENYSNLVSVGQRETTKPDVILRLEQGKEPWSEEEEVLGSGRAE

SEQ ID NO: 2073 - protein, 81 aa, Pan troglodytes
MAAAVLTDRAQVSVTFDDVAVTFTKEEWGQLDLAQRTLYQEVMLENCGLLVSLAPSQTHPGSVRCILQSNQVDTLIKIPEH

SEQ ID NO: 2074 - protein, 81 aa, Pan troglodytes
MLMDAGQDYMVFEDVAIHFSQEEWGILNDVQRHLHSDVMLENFALLSSVGCWHGAKDEEAPSKQCVSVGVSEVTTLKPALS

SEQ ID NO: 2075 - protein, 81 aa, Pan troglodytes
MNLTEDYMVFEDVAIHFSQEEWGILNDVQRHLHSDVMLENFALLSSVGCWHGAKDEEAPSKQCVSVGVSEVTTLKPALSTQ

SEQ ID NO: 2076 - protein, 81 aa, Pan troglodytes
DPAQVPVAADLLTDHEEQGYVTFEDVAVYFSQEEWRLLDDAQRLLYRNVMLENFTLLASLGKVLIPHPSILSWARLFLLFL

SEQ ID NO: 2077 - protein, 81 aa, Pan troglodytes
MAAAALRDPAQGYVTFEDVAVYFSQEEWRLLDDAQRLLYRNVMLENFTLLASLGKVLIPHPSILSWARLFLLFLGRGLFFP

SEQ ID NO: 2078 - protein, 81 aa, Pan troglodytes
DPAQVPVAADLLTDHEEQGYVTFEDVAVYFSQEEWRLLDDAQRLLYRNVMLENFTLLASLGSWQGAEAEEAPEQSASVEVL

SEQ ID NO: 2079 - protein, 81 aa, Pan troglodytes
MAAAALRDPAQGYVTFEDVAVYFSQEEWRLLDDAQRLLYRNVMLENFTLLASLGSWQGAEAEEAPEQSASVEVLSSNVQQH

SEQ ID NO: 2080 - protein, 81 aa, Pan troglodytes
RDPAQVPVAADLLTDHEEGYVTFEDVAVYFSQEEWRLLDDAQRLLYRNVMLENFTLLASLGKVLIPHPSILSWARLFLLFL

SEQ ID NO: 2081 - protein, 81 aa, Pan troglodytes
MAAAALRDPAQQGYVTFEDVAVYFSQEEWRLLDDAQRLLYRNVMLENFTLLASLGSWQGAEAEEAPEQSASVEVLSSNVQQ

SEQ ID NO: 2082 - protein, 81 aa, Pan troglodytes
RDPAQVPVAADLLTDHEEGYVTFEDVAVYFSQEEWRLLDDAQRLLYRNVMLENFTLLASLGSWQGAEAEEAPEQSASVEVL

SEQ ID NO: 2083 - protein, 81 aa, Pan troglodytes
MAETKDAAQMLVTFKDVAVTFTREEWRQLDLAQRTLYREVMLETCGLLVSVGHRVPKPELVHLLEHGQELWIVKRGLSHAT

SEQ ID NO: 2084 - protein, 81 aa, Pan troglodytes
MLVTFKDVAVTFTREEWRQLDLAQRTLYREVMLETCGLLVSVGHRVPKPELVHLLEHGQELWIVKRGLSHATCAGDRAQVH

SEQ ID NO: 2085 - protein, 81 aa, Pan troglodytes
RDSTSVPVTAEAKLMGFTQGCVTFEDVAIYFSQEEWGLLDEAQRLLYRDVMLENFALITALVCWHGMEDEETPEQSVSVEG

SEQ ID NO: 2086 - protein, 81 aa, Pan troglodytes
DRGAQVPIATEVLFKLTQGSVTFEDVAVYFSWEEWDLLDEAQKHLYFDVMLENFALTSSLGLTLSWSHVVAQLGLGEVPSV

SEQ ID NO: 2087 - protein, 81 aa, Pan troglodytes
MNTVTNGNVKTTGINDTKGSVTFEDVAVYFSWEEWDLLDEAQKHLYFDVMLENFALTSSLGCWCGVEHEETPSEQRISGER

SEQ ID NO: 2088 - protein, 81 aa, Pan troglodytes
MAAVALRDSAQGTVTFEDVAVNFSQEEWSLLSEAQRCLYHDVMLENLTLISSLGCWYEAKDETPSKQTLSIQQESPLRTHW

SEQ ID NO: 2089 - protein, 81 aa, Pan troglodytes
MAAATLRTPTQGTVTFEDVAVHFSWEEWGLLDEAQRCLYHEVMLENLALLTSLDVHHQKQHLGEKHFRSNVGRALFVKTCT

SEQ ID NO: 2090 - protein, 81 aa, Pan troglodytes
PAAVRAHGPMAELTDSARGCVVFEDVFVYFSREEWELLDDAQRLLYHDVMLENFALLASLGIAFSRSRAVMKLQRGEEPWV

SEQ ID NO: 2091 - protein, 81 aa, Pan troglodytes
MAAAALRPPAQGTVTFEDVAVNFSQEEWSLLSEAQRCLYHDVMLENLTLISSLGCWYEAKDETPSKQTLSIQQESPLRTHW

SEQ ID NO: 2092 - protein, 81 aa, Pan troglodytes
MAAAAALRAPAQSSVTFEDVAVNFSLEEWSLLNEAQGCLYHDVMLETLTLISSLGGVPPHRLFPTGACGPQVPSSRIRPSP

SEQ ID NO: 2093 - protein, 81 aa, Pan troglodytes
MAAAALRFPVQGTVTFEDVAVKFTQEEWNLLSEAQRCLYRDVTLENLALMSSLGCWCGVEDEVAPSKQSIYIQRETQVRTP

SEQ ID NO: 2094 - protein, 81 aa, Pan troglodytes
MAAAAPRRPTQGTVTFEDVAVKFTQEEWNLLSEAQRCLYRDVTLENLALMSSLGCWCGVEDEAAPSKQSIYIQRETQVRTP

SEQ ID NO: 2095 - protein, 81 aa, Pan troglodytes
MAVAVTLRLSAQGTVTFEDVAVKFTQEEWNLLSEAQRCLYRDVTLENLALMSSLGCWCGVEDEAAPSKQSIYIQRETQVRT

SEQ ID NO: 2096 - protein, 81 aa, Pan troglodytes
MAAAATLRLSAQGTVTFEDVAVNFTWEEWNLLSEAQRCLYRDVTLENLALISSLDPALDGSADNTQTGNLGQSLLPSHPQQ

SEQ ID NO: 2097 - protein, 81 aa, Pan troglodytes
WRDHGSPQPPPTGDILIQGTVTFEDVAVNFTWEEWNLLSEAQRCLYRDVTLENLALISSLDPALDGSADNTQTGNLGQSLL

SEQ ID NO: 2098 - protein, 81 aa, Pan troglodytes
MAAAATLRLSAQGTVTFEDVAVNFTWEEWNLLSEAQRCLYRDVTLENLALISSLGMTFLHVCQALDSLRQVIHPPQPPKVL

SEQ ID NO: 2099 - protein, 81 aa, Pan troglodytes
LSAQGTVTFEDVAVNFTWEEWNLLSEAQRCLYRDVTLENLALISSLGMTFLHVCQALDSLRQVIPTSASQSAGITGSHSIP

SEQ ID NO: 2100 - protein, 81 aa, Pan troglodytes
MAAAATLRLSAQGTVTFEDVAVNFTWEEWNLLSEAQRCLYRDVTLENLALISSLGCWCGVEDEAAPSKQSIYIQRETQVRT

SEQ ID NO: 2101 - RNA, 108 nt, synthetic construct
  source 1..108: mol_type = other RNA
tactggcgcttttatctcattactttgagagccatcaccagcgactatgtcgtatgggtaaagcgcaggtgggacgacctctcggtcgtcctatctgaagcatcaaag

SEQ ID NO: 2102 - RNA, 99 nt, synthetic construct
  source 1..99: mol_type = other RNA
tactggcgcttttatctcattactttgagagccatcaccagcgactatgtcgtatgggtaaagcgctgctcgacgcgtcctcgagcagaagcatcaaag

SEQ ID NO: 2103 - RNA, 97 nt, synthetic construct
  source 1..97: mol_type = other RNA
tactggcgcttttatctcattactttgagagccatcaccagcgactatgtcgtatgggtaaagcgctgctcgctccgttcgagcagaagcatcaaag

SEQ ID NO: 2104 - RNA, 91 nt, synthetic construct
  source 1..91: mol_type = other RNA
gtactggcgcttttatctcattactttgagagccatcaccagcgactatgtcgtatgggtaaagcgccctcttcggagggaagcatcaaag

SEQ ID NO: 2105 - RNA, 99 nt, synthetic construct
  source 1..99: mol_type = other RNA
tactggcgcttttatctcattactttgagagccatcaccagcgactatgtcgtatgggtaaagcgcaggagtttctatggaaaccctgaagcatcaaag

SEQ ID NO: 2106 - RNA, 99 nt, synthetic construct
  source 1..99: mol_type = other RNA
gtactggcgcctttatctcattactttgagagccatcaccagcgactatgtcgtatgggtaaagcgcttacggacttcggtccgtaagaagcatcaaag

SEQ ID NO: 2107 - RNA, 90 nt, synthetic construct
  source 1..90: mol_type = other RNA
tactggcgcttttatctcattactttgagagccatcaccagcgactatgtcgtatgggtaaagcgctgcgcttgcgcagaagcatcaaag

SEQ ID NO: 2108 - RNA, 108 nt, synthetic construct
  source 1..108: mol_type = other RNA
tactggcgcttttatctgattactttgagagccatcaccagcgactatgtcgtatgggtaaagcgcttatttatcggagagaaatccgataaataagaagcatcaaag

SEQ ID NO: 2109 - RNA, 108 nt, synthetic construct
  source 1..108: mol_type = other RNA
tactggcgcttttatcgcattactttgagagccatcaccagcgactatgtcgtatgggtaaagcgcttatttatcggagagaaatccgataaataagaagcatcaaag

SEQ ID NO: 2110 - RNA, 110 nt, synthetic construct
  source 1..110: mol_type = other RNA
tactggcgcttttatctcattactttgagagccatcaccagcgactatgtcgtatgggtaaagcgcttatttatcggagacttcggtccgataaataagaagcatcaaag

SEQ ID NO: 2111 - RNA, 97 nt, synthetic construct
  source 1..97: mol_type = other RNA
tactggcgcttttatctcattactttgagagccatcaccagcgactatgtcgtatgggtaaagcgcacatgaggattacccatgtgaagcatcaaag

SEQ ID NO: 2112 - RNA, 106 nt, synthetic construct
  source 1..106: mol_type = other RNA
gctggcgcttttatctcattactttgagagccatcaccagcgactatgtcgtatgggtaaagcgcttatttatcgtgagaaatccgataaataagaagcatcaaag

SEQ ID NO: 2113 - RNA, 96 nt, synthetic construct
  source 1..96: mol_type = other RNA
tactggcgcttttatctcattactttgagagccatcaccagcgactatgtcgtatgggtaaagcgctgcatgtctaagacagcagaagcatcaaag

SEQ ID NO: 2114 - RNA, 90 nt, synthetic construct
  source 1..90: mol_type = other RNA
tactggcgcttttatctcattactttgagagccatcaccagcgactatgtcgtatgggtaaagcgcagggcttcggccgaagcatcaaag

SEQ ID NO: 2115 - RNA, 98 nt, synthetic construct
  source 1..98: mol_type = other RNA
tactggcgcttttatctcattactttgagagccatcaccagcgactatgtcgtatgggtaaagcgcaatccattgcactccggattgaagcatcaaag

SEQ ID NO: 2116 - RNA, 108 nt, synthetic construct
  source 1..108: mol_type = other RNA
tactggcgcttttctcgcattactttgagagccatcaccagcgactatgtcgtatgggtaaagcgcttatttatcggagagaaatccgataaataagaagcatcaaag

SEQ ID NO: 2117 - RNA, 108 nt, synthetic construct
  source 1..108: mol_type = other RNA
tactggcgcttttatctcattactttgagagccatcaccagcgactatgtcgtatgggtaaagcgcttatttatcggacttcggtccgataaataagaagcatcaaag

SEQ ID NO: 2118 - RNA, 100 nt, synthetic construct
  source 1..100: mol_type = other RNA
tactggcgcttttatctcattactttgagagccatcaccagcgactatgtcgtatgggtaaagcgctgctcgtttgcggctacgagcagaagcatcaaag

SEQ ID NO: 2119 - RNA, 100 nt, synthetic construct
  source 1..100: mol_type = other RNA
tactggcgcttttatctcattactttgagagccatcaccagcgactatgtcgtatgggtaaagcgcttatttatcgagagataaataagaagcatcaaag

SEQ ID NO: 2120 - RNA, 107 nt, synthetic construct
  source 1..107: mol_type = other RNA
tacggcgcttttatctcattactttgagagccatcaccagcgactatgtcgtatgggtaaagcgcttatttatcggagagaaatccgataaataagaagcatcaaag

SEQ ID NO: 2121 - RNA, 99 nt, synthetic construct
  source 1..99: mol_type = other RNA
tactggcgccttttatctcattactttgagagccatcaccagcgactatgtcgtatgggtaaagcgcttacggacttcggtccgtaagaagcatcaaag

SEQ ID NO: 2122 - RNA, 108 nt, synthetic construct
  source 1..108: mol_type = other RNA
tactggcgcttttatctcattactttgagagccatcaccagcgactatgtcgtatcggtaaagcgcttatttatcggagagaaatccgataaataagaagcatcaaag

SEQ ID NO: 2123 - RNA, 108 nt, synthetic construct
  source 1..108: mol_type = other RNA
tactggcgcctttatctcattactttgagagccatcaccagcgactatgtcgtatgggtaaagcgcttatttatcggacttcggtccgataaataagaagcatcaaag

SEQ ID NO: 2124 - RNA, 105 nt, synthetic construct
  source 1..105: mol_type = other RNA
tactggcgcttttatctcattactttgagagccatcaccagcgactatgtcgtatgggtaaagcgcttatttatcgagaaatccgataaataagaagcatcaaag

SEQ ID NO: 2125 - RNA, 103 nt, synthetic construct
  source 1..103: mol_type = other RNA
gcgcttttatctcattactttgagagccatcaccagcgactatgtcgtatgggtaaagcgcttatttatcggagagaaatccgataaataagaagcatcaaag

SEQ ID NO: 2126 - RNA, 103 nt, synthetic construct
  source 1..103: mol_type = other RNA
tactggcgcttttatctcattactttgagagccatcaccagcgactatgtcgtatgggtaaagcgcttatttatcggagagagataaataagaagcatcaaag

SEQ ID NO: 2127 - RNA, 108 nt, synthetic construct
  source 1..108: mol_type = other RNA
tactggcgcttttatctcattactttggagagccatcaccagcgactatgtcgtatgggtaaagcgcttatttatcggagagtatccgataaataagaagcatcaaag

SEQ ID NO: 2128 - RNA, 109 nt, synthetic construct
  source 1..109: mol_type = other RNA
tactggcgcttttatctcattactttgagagccatcaccagcgactatgttcgtatgggtaaagcgcttatttatcggagagaaatccgataaataagaagcatcaaag

SEQ ID NO: 2129 - RNA, 105 nt, synthetic construct
  source 1..105: mol_type = other RNA
agcgcttttatctcattactttgagagccatcaccagcgactatgtcgtatgggtaaagcgcttatttatcggagagaaatgccgataaataagaagcatcaaag

SEQ ID NO: 2130 - RNA, 109 nt, synthetic construct
  source 1..109: mol_type = other RNA
tactggcgcttttatctcattactttgagagccatcaccagcgactatgtcgtatgggtaaagcgcttatttatcggagagaaatccgataaaataagaagcatcaaag

SEQ ID NO: 2131 - RNA, 109 nt, synthetic construct
  source 1..109: mol_type = other RNA
tactggcgcttttatctcattactttgagagccatcaccagcgactatgtcgtatgggtaaagcgcttattgtatcggagagaaatccgataaataagaagcatcaaag

SEQ ID NO: 2132 - RNA, 102 nt, synthetic construct
  source 1..102: mol_type = other RNA
gcgcttttatctcattactttgagagccatcaccagcgactatgtcgtatgggtaaagcgcttatttatcggacttcggtccgataaataagcgcatcaaag

SEQ ID NO: 2133 - RNA, 108 nt, synthetic construct
  source 1..108: mol_type = other RNA
tactggcgcttttctctcattactttgagagccatcaccagcgactatgtcgtatgggtaaagcgcttatttatcggagagaaatccgataaataagaagcatcaaag

SEQ ID NO: 2134 - RNA, 106 nt, synthetic construct
  source 1..106: mol_type = other RNA
gtggcgcttttatctcattactttgagagccatcaccagcgactatgtcgtatgggtaaagcgcttatttatcggagagaaatccgataaataagaagcatcaaag

SEQ ID NO: 2135 - RNA, 110 nt, synthetic construct
  source 1..110: mol_type = other RNA
tactggcgcttttatctcattactttgagagccatcaccagcgaccttatgtcgtatgggtaaagcgcttatttatcggagagaaatccgataaataagaagcatcaaag

SEQ ID NO: 2136 - RNA, 107 nt, synthetic construct
  source 1..107: mol_type = other RNA
gatggcgcttttatctcattactttgagagccatcaccagcgactatgtcgtatgggtaaagcgcttatttatcggacttcggtccgataaataagaagcatcaaag

SEQ ID NO: 2137 - RNA, 106 nt, synthetic construct
  source 1..106: mol_type = other RNA
tactggcgcttttatctcattactttgagagccatcaccagcgactatgtcgtatgggtaaagcgcttatttatcggagagaaatccgataaaagaagcatcaaag

SEQ ID NO: 2138 - RNA, 109 nt, synthetic construct
  source 1..109: mol_type = other RNA
tactggcgcttttatctcattactttgagagccatcaccagcgatctatgtcgtatgggtaaagcgcttatttatcggagagaaatccgataaataagaagcatcaaag

SEQ ID NO: 2139 - RNA, 106 nt, synthetic construct
  source 1..106: mol_type = other RNA
tactggcgcttttatctcattactttgagagccatcaccagcgactatgtcgtatgggtaaaggcttatttatcggagagaaatccgataaaaagaagcatcaaag

SEQ ID NO: 2140 - RNA, 107 nt, synthetic construct
  source 1..107: mol_type = other RNA
tactggcgcttttatctcattactttgagagccatcaccagcgactatgtcgtatgggtaaagcgcttatttatcggagagaaatccgataaaaagaagcatcaaag

SEQ ID NO: 2141 - RNA, 107 nt, synthetic construct
  source 1..107: mol_type = other RNA
tactggcgctttatctcattactttgagagccatcaccagcgactatgtcgtatgggtaaagcgcttatttatcggacttcggtccgataaataagaagcatcaaag

SEQ ID NO: 2142 - RNA, 98 nt, synthetic construct
  source 1..98: mol_type = other RNA
cggcgcttttctcgcattactttgagagccatcaccagcgactatgtcgtatgggtaaagcgcttattgtatcgagagataaataagaagcatcaaag

SEQ ID NO: 2143 - RNA, 107 nt, synthetic construct
  source 1..107: mol_type = other RNA
cactggcgcttttatctcattactttgagagccatcaccagcgactatgtcgtatgggtaaagcgcttattttcggagagaaatccgataaataagaagcatcaaag

SEQ ID NO: 2144 - RNA, 106 nt, synthetic construct
  source 1..106: mol_type = other RNA
tactggcgctttatctcattactttgagagccatcaccagcgacttcggtcgtatgggtaaagcgcttatgtatcggcttcggccgatacataagaagcatcaaag

SEQ ID NO: 2145 - RNA, 107 nt, synthetic construct
  source 1..107: mol_type = other RNA
tactggcgcttttatctcattactttgagagccatcaccagcgacttcggtcgtatgggtaaagcgcttatgtatcggcttcggccgatacataagaagcatcaaag

SEQ ID NO: 2146 - RNA, 109 nt, synthetic construct
  source 1..109: mol_type = other RNA
tactggcgcttttatctcattactttgagagccatcaccagcgactatgtcgtatgggtgaaagcgcttatttatcggagagaaatccgataaataagaagcatcaaag

SEQ ID NO: 2147 - RNA, 64 nt, synthetic construct
  source 1..64: mol_type = other RNA
tactggcgcttttatctcattactttgagagccatcaccagcgacttcggtcgtatgggtaaag

SEQ ID NO: 2148 - RNA, 62 nt, synthetic construct
  source 1..62: mol_type = other RNA
gatgggcttttatctcattactttgagagccatcaccagcgacttcggtcgtatgggtaaag

SEQ ID NO: 2149 - RNA, 105 nt, synthetic construct
  source 1..105: mol_type = other RNA
gatgggcttttatctcattactttgagagccatcaccagcgacttcggtcgtatgggtaaagcgcttatttatcggcttcggccgataaataagaagcatcaaag

SEQ ID NO: 2150 - RNA, 156 nt, synthetic construct
  source 1..156: mol_type = other RNA
tactggcgcttttatctcattactttgagagccatcaccagcgactatgtcgtatgggtaaagcgctacactgggatcgctgaattagagatcggcgtcctttcattctatatactttggagttttaaaatgtctctaagtacagaagcatcaaag

SEQ ID NO: 2151 - RNA, 103 nt, synthetic construct
  source 1..103: mol_type = other RNA
ggcgcttttatctcattactttgagagccatcaccagcgacttcggtcgtatgggtaaagcgcttatttatcggcttcggccgataaataagaagcatcaaag

SEQ ID NO: 2152 - RNA, 106 nt, synthetic construct
  source 1..106: mol_type = other RNA
gctggcgcttttatctcattactttgagagccatcaccagcgacttcggtcgtatgggtaaagcgcttatttatcggcttcggccgataaataagaagcatcaaag

SEQ ID NO: 2153 - RNA, 109 nt, synthetic construct
  source 1..109: mol_type = other RNA
tactggcgcttttatctcattactttgagagccatcaccagcgacttcggtcgtatgggtaaagcgcttatttatcggagagaaatccgataaataagaagcatcaaag

SEQ ID NO: 2154 - RNA, 112 nt, synthetic construct
  source 1..112: mol_type = other RNA
tactggcgcttttatctcattactttgagagccatgctccaccagcgactatgtcgtatgggtaaagcgcttatttatcggagagaaatccgataaataagaagcatcaaag

SEQ ID NO: 2155 - RNA, 97 nt, synthetic construct
  source 1..97: mol_type = other RNA
tactggcgcttttatctcattactttgagagccatcaccagcgactatgtcgtatgggtaaagcggggttagggttagggttagggaagcatcaaag

SEQ ID NO: 2156 - RNA, 96 nt, synthetic construct
  source 1..96: mol_type = other RNA
tactggcgcttttatctcattactttgagagccatcaccagcgactatgtcgtatgggtaaagcggagggagggagggagagggaaagcatcaaag

SEQ ID NO: 2157 - RNA, 101 nt, synthetic construct
  source 1..101: mol_type = other RNA
tactggcgcttttatctcattactttgagagccatcaccagcgactatgtcgtatgggtaaagcgttgggttagggttagggttagggaaaagcatcaaag

SEQ ID NO: 2158 - RNA, 91 nt, synthetic construct
  source 1..91: mol_type = other RNA
tactggcgcttttatctcattactttgagagccatcaccagcgactatgtcgtatgggtaaagcgcagggcttcggccggaagcatcaaag

SEQ ID NO: 2159 - RNA, 103 nt, synthetic construct
  source 1..103: mol_type = other RNA
tactggcgcttttatctcattactttgagagccatcaccagcgactatgtcgtatgggtaaagcgcctgctcagtacgagaggaaccgcaggaagcatcaaag

SEQ ID NO: 2160 - RNA, 90 nt, synthetic construct
  source 1..90: mol_type = other RNA
tactggcgcttttatctgattactttgagagccatcaccagcgactatgtcgtatgggtaaagcgccctcttcggagggaagcatcaaag

SEQ ID NO: 2161 - RNA, 98 nt, synthetic construct
  source 1..98: mol_type = other RNA
tactggcgcctttatctgattactttgagagccatcaccagcgactatgtcgtatgggtaaagcgcttacggacttcggtccgtaagaagcatcaaag

SEQ ID NO: 2162 - RNA, 98 nt, synthetic construct
  source 1..98: mol_type = other RNA
tactggcgcttttatctgattactttgagagccatcaccagcgactatgtcgtatgggtaaagcgcggacgacctctcggtcgtccgaagcatcaaag

SEQ ID NO: 2163 - RNA, 108 nt, synthetic construct
  source 1..108: mol_type = other RNA
tactggcgcttttatctgattactttgagagccatcaccagcgactatgtcgtatgggtaaagcgcaggtgggacgacctctcggtcgtcctatctgaagcatcaaag

SEQ ID NO: 2164 - RNA, 99 nt, synthetic construct
  source 1..99: mol_type = other RNA
tactggcgcctttatctgcattactttgagagccatcaccagcgactatgtcgtatgggtaaagcgcttacggacttcggtccgtaagaagcatcaaag

SEQ ID NO: 2165 - RNA, 97 nt, synthetic construct
  source 1..97: mol_type = other RNA
gctggcgcttttatctgattactttgagagccatcaccagcgactatgtcgtatgggtaaagcgcttacggacttcggtccgtaagaagcatcaaag

SEQ ID NO: 2166 - RNA, 108 nt, synthetic construct
  source 1..108: mol_type = other RNA
tactggcgcctttatctgattactttgagagccatcaccagcgactatgtcgtatgggtaaagcgcaggtgggacgacctctcggtcgtcctatctgaagcatcaaag

SEQ ID NO: 2167 - RNA, 98 nt, synthetic construct
  source 1..98: mol_type = other RNA
tactggcgcctttatctgattactttgagagccatcaccagcgactatgtcgtatgggtaaagcgcggacgacctctcggtcgtccgaagcatcaaag

SEQ ID NO: 2168 - RNA, 90 nt, synthetic construct
  source 1..90: mol_type = other RNA
tactggcgcctttatctcattactttgagagccatcaccagcgactatgtcgtatgggtaaagcgccctcttcggagggaagcatcaaag

SEQ ID NO: 2169 - RNA, 98 nt, synthetic construct
  source 1..98: mol_type = other RNA
tactggcgcttttatctcattactttgagagccatcaccagcgactatgtcgtatgggtaaagcgcttacggacttcggtccgtaagaagcatcaaag

SEQ ID NO: 2170 - RNA, 99 nt, synthetic construct
  source 1..99: mol_type = other RNA
tactggcgcctttatcatcattactttgagagccatcaccagcgactatgtcgtatgggtaaagcgcttacggacttcggtccgtaagaagcatcaaag

SEQ ID NO: 2171 - RNA, 194 nt, synthetic construct
  source 1..194: mol_type = other RNA
tactggcgcttttatctcattactttgagagccatcaccagcgactatgtcgtatgggtaaagcgcttatttatcggagagaaatccgataaataagaagcatcaaagggccggcatggtcccagcctcctcgctggcgccggctgggcaacattccgaggggaccgtcccctcggtaatggcgaatgggaccc

SEQ ID NO: 2172 - RNA, 108 nt, synthetic construct
  source 1..108: mol_type = other RNA
tactggcgcctttatctcattactttgagagccatcaccagcgactatgtcgtatgggtaaagcgcaggtgggacgacctctcggtcgtcctatctgaagcatcaaag

SEQ ID NO: 2173 - RNA, 106 nt, synthetic construct
  source 1..106: mol_type = other RNA
tactggcgcttttatctcattactttgagagccatcaccagcgactatgtcgtatgggtaaagcgcttatttatcggagaaatccgataaataagaagcatcaaag

SEQ ID NO: 2174 - RNA, 98 nt, synthetic construct
  source 1..98: mol_type = other RNA
tactggcgcctttatctcattactttgagagccatcaccagcgactatgtcgtatgggtaaagcgcggacgacctctcggtcgtccgaagcatcaaag

SEQ ID NO: 2175 - RNA, 92 nt, synthetic construct
  source 1..92: mol_type = other RNA
tactggcgcttttatctcattactttgagagccatcaccagcgactatgtcgtatgggtaaagcgccggacttcggtccggaagcatcaaag

SEQ ID NO: 2176 - RNA, 108 nt, synthetic construct
  source 1..108: mol_type = other RNA
tactggcgcttttatcggattactttgagagccatcaccagcgactatgtcgtatgggtaaagcgcttatttatcggagagaaatccgataaataagaagcatcaaag

SEQ ID NO: 2177 - RNA, 98 nt, synthetic construct
  source 1..98: mol_type = other RNA
tactggcgcttttatctcattactttgagagccatcaccagcgactatgtcgtatgggtaaagcgcggacgacctctcggtcgtccgaagcatcaaag

SEQ ID NO: 2178 - RNA, 89 nt, synthetic construct
  source 1..89: mol_type = other RNA
gctggcgcttttatctgattactttgagagccatcaccagcgactatgtcgtatgggtaaagcgccctcttcggagggaagcatcaaag

SEQ ID NO: 2179 - RNA, 88 nt, synthetic construct
  source 1..88: mol_type = other RNA
gctggcgcctttatctgattactttgagagccatcaccagcgactatgtcgtatgggtaaagctccctcttcggagggagcatcaaag

SEQ ID NO: 2180 - RNA, 197 nt, synthetic construct
  source 1..197: mol_type = other RNA
tactggcgcttttatctcattactttgagagccatcaccagcgactatgtcgtatgggtaaagcgcttatttatcggagagaaatccgataaataagaagcatcaaaggggtcggcatggcatctccacctcctcgcggtccgacctgggcatccgaaggaggacgcacgtccactcggatggctaagggagagcca

SEQ ID NO: 2181 - RNA, 88 nt, synthetic construct
  source 1..88: mol_type = other RNA
gctggcgcctttatctgattactttgagagccatcaccagcgactatgtcgtatgggtaaagcgccctcttcggagggcgcatcaaag

SEQ ID NO: 2182 - RNA, 186 nt, synthetic construct
  source 1..186: mol_type = other RNA
tactggcgcttttatctcattactttgagagccatcaccagcgactatgtcgtatgggtaaagcgcttatttatcggagagaaatccgataaataagaagcatcaaagttttggccggcatggtcccagcctcctcgctggcgccggctgggcaacatgcttcggcatggcgaatgggaccccggg

SEQ ID NO: 2183 - RNA, 97 nt, synthetic construct
  source 1..97: mol_type = other RNA
gatggcgcctttatctcattactttgagagccatcaccagcgactatgtcgtatgggtaaagcgcttacggacttcggtccgtaagaagcatcaaag

SEQ ID NO: 2184 - RNA, 89 nt, synthetic construct
  source 1..89: mol_type = other RNA
gctggcgcttttatctcattactttgagagccatcaccagcgactatgtcgtatgggtaaagcgccctcttcggagggaagcatcaaag

SEQ ID NO: 2185 - RNA, 96 nt, synthetic construct
  source 1..96: mol_type = other RNA
gctggcgcctttatctgattactttgagagccatcaccagcgactatgtcgtatgggtaaagctcttacggacttcggtccgtaagagcatcaaag

SEQ ID NO: 2186 - RNA, 96 nt, synthetic construct
  source 1..96: mol_type = other RNA
gctggcgcctttatctgattactttgagagccatcaccagcgactatgtcgtatgggtaaagctcggacgacctctcggtcgtccgagcatcaaag

SEQ ID NO: 2187 - RNA, 160 nt, synthetic construct
  source 1..160: mol_type = other RNA
tactggcgcttttatctcattactttgagagccatcaccagcgactatgtcgtatgggtaaagcgcttatttatcggagagaaatccgataaataagaagcatcaaagcctgtcaccggatgtgctttccggtctgatgagtccgtgaggacgaaacagg

SEQ ID NO: 2188 - RNA, 97 nt, synthetic construct
  source 1..97: mol_type = other RNA
gctggcgcttttatctgattactttgagagccatcaccagcgactatgtcgtatgggtaaagcgcggacgacctctcggtcgtccgaagcatcaaag

SEQ ID NO: 2189 - RNA, 97 nt, synthetic construct
  source 1..97: mol_type = other RNA
gctggcgcctttatctgattactttgagagccatcaccagcgactatgtcgtatgggtaaagcgcggacgacctctcggtcgtccgaagcatcaaag

SEQ ID NO: 2190 - RNA, 106 nt, synthetic construct
  source 1..106: mol_type = other RNA
gctggcgcctttatctgattactttgagagccatcaccagcgactatgtcgtatgggtaaagctcaggtgggacgacctctcggtcgtcctatctgagcatcaaag

SEQ ID NO: 2191 - RNA, 177 nt, synthetic construct
  source 1..177: mol_type = other RNA
tactggcgcttttatctcattactttgagagccatcaccagcgactatgtcgtatgggtaaagcgcttatttatcggagagaaatccgataaataagaagcatcaaaggatggccggcatggtcccagcctcctcgctggcgccggctgggcaacaccttcgggtggcgaatgggac

SEQ ID NO: 2192 - RNA, 107 nt, synthetic construct
  source 1..107: mol_type = other RNA
gctggcgcttttatctgattactttgagagccatcaccagcgactatgtcgtatgggtaaagcgcaggtgggacgacctctcggtcgtcctatctgaagcatcaaag

SEQ ID NO: 2193 - RNA, 109 nt, synthetic construct
  source 1..109: mol_type = other RNA
tactggcgcttttatctcattactttgagagccatcaccagcgactatgtcgtactgggtaaagcgcttatttatcggagagaaatccgataaataagaagcatcaaag

SEQ ID NO: 2194 - RNA, 107 nt, synthetic construct
  source 1..107: mol_type = other RNA
tactggcgcttttatctcattactttgagagccatcaccagcgactatgtcgtatgggtaaagcgcttatttatcgtgagaaatccgataaataagaagcatcaaag

SEQ ID NO: 2195 - RNA, 109 nt, synthetic construct
  source 1..109: mol_type = other RNA
gtactggcgcttttatctcattactttgagagccatcaccagcgactatgtcgtatgggtaaagcgcttatttatcggagagaaatccgataaataagaagcatcaaag

SEQ ID NO: 2196 - RNA, 97 nt, synthetic construct
  source 1..97: mol_type = other RNA
gctggcgcttttatctcattactttgagagccatcaccagcgactatgtcgtatgggtaaagcgcggacgacctctcggtcgtccgaagcatcaaag

SEQ ID NO: 2197 - RNA, 97 nt, synthetic construct
  source 1..97: mol_type = other RNA
gctggcgcctttatctgattactttgagagccatcaccagcgactatgtcgtatgggtaaagcgcttacggacttcggtccgtaagaagcatcaaag

SEQ ID NO: 2198 - RNA, 107 nt, synthetic construct
  source 1..107: mol_type = other RNA
gctggcgcttttatctcattactttgagagccatcaccagcgactatgtcgtatgggtaaagcgcttatttatcggagagaaatccgataaataagaagcatcaaag

SEQ ID NO: 2199 - RNA, 97 nt, synthetic construct
  source 1..97: mol_type = other RNA
gctggcgcctttatctcattactttgagagccatcaccagcgactatgtcgtatgggtaaagcgcttacggacttcggtccgtaagaagcatcaaag

SEQ ID NO: 2200 - RNA, 89 nt, synthetic construct
  source 1..89: mol_type = other RNA
gctggcgcctttatctgattactttgagagccatcaccagcgactatgtcgtatgggtaaagcgccctcttcggagggaagcatcaaag

SEQ ID NO: 2201 - RNA, 107 nt, synthetic construct
  source 1..107: mol_type = other RNA
gctggcgcttttatctcattactttgagagccatcaccagcgactatgtcgtatgggtaaagcgcaggtgggacgacctctcggtcgtcctatctgaagcatcaaag

SEQ ID NO: 2202 - RNA, 107 nt, synthetic construct
  source 1..107: mol_type = other RNA
gctggcgcctttatctcattactttgagagccatcaccagcgactatgtcgtatgggtaaagcgcaggtgggacgacctctcggtcgtcctatctgaagcatcaaag

SEQ ID NO: 2203 - RNA, 107 nt, synthetic construct
  source 1..107: mol_type = other RNA
gctggcgcctttatctgattactttgagagccatcaccagcgactatgtcgtatgggtaaagcgcaggtgggacgacctctcggtcgtcctatctgaagcatcaaag

SEQ ID NO: 2204 - RNA, 98 nt, synthetic construct
  source 1..98: mol_type = other RNA
tactggcgcttttatctgattactttgagagccatcaccagcgactatgtcgtatgggtaaagcgcttacggacttcggtccgtaagaagcatcaaag

SEQ ID NO: 2205 - RNA, 89 nt, synthetic construct
  source 1..89: mol_type = other RNA
gctggcgcctttatctcattactttgagagccatcaccagcgactatgtcgtatgggtaaagcgccctcttcggagggaagcatcaaag

SEQ ID NO: 2206 - RNA, 97 nt, synthetic construct
  source 1..97: mol_type = other RNA
gctggcgcttttatctcattactttgagagccatcaccagcgactatgtcgtatgggtaaagcgcttacggacttcggtccgtaagaagcatcaaag

SEQ ID NO: 2207 - RNA, 97 nt, synthetic construct
  source 1..97: mol_type = other RNA
gctggcgcctttatctcattactttgagagccatcaccagcgactatgtcgtatgggtaaagcgcggacgacctctcggtcgtccgaagcatcaaag

SEQ ID NO: 2208 - RNA, 177 nt, synthetic construct
  source 1..177: mol_type = other RNA
gatggccggcatggtcccagcctcctcgctggcgccggctgggcaacaccttcgggtggcgaatgggactactggcgcttttatctcattactttgagagccatcaccagcgactatgtcgtatgggtaaagcgcttatttatcggagagaaatccgataaataagaagcatcaaag

SEQ ID NO: 2209 - RNA, 194 nt, synthetic construct
  source 1..194: mol_type = other RNA
ggccggcatggtcccagcctcctcgctggcgccggctgggcaacattccgaggggaccgtcccctcggtaatggcgaatgggaccctactggcgcttttatctcattactttgagagccatcaccagcgactatgtcgtatgggtaaagcgcttatttatcggagagaaatccgataaataagaagcatcaaag

SEQ ID NO: 2210 - RNA, 96 nt, synthetic construct
  source 1..96: mol_type = other RNA
gctggcgcctttatctgattactttgagagccatcaccagcgactatgtcgtatgggtaaagcgcttacggacttcggtccgtaagcgcatcaaag

SEQ ID NO: 2211 - RNA, 172 nt, synthetic construct
  source 1..172: mol_type = other RNA
cgtggttagggccacgttaaatagttgcttaagccctaagcgttgatcttcggatcaggtgcaatactggcgcttttatctcattactttgagagccatcaccagcgactatgtcgtatgggtaaagcgcttatttatcggagagaaatccgataaataagaagcatcaaag

SEQ ID NO: 2212 - RNA, 197 nt, synthetic construct
  source 1..197: mol_type = other RNA
gggtcggcatggcatctccacctcctcgcggtccgacctgggcatccgaaggaggacgcacgtccactcggatggctaagggagagccatactggcgcttttatctcattactttgagagccatcaccagcgactatgtcgtatgggtaaagcgcttatttatcggagagaaatccgataaataagaagcatcaaag

SEQ ID NO: 2213 - RNA, 171 nt, synthetic construct
  source 1..171: mol_type = other RNA
tactggcgcttttatctcattactttgagagccatcaccagcgactatgtcgtatgggtaaagcgcttatttatcggagagaaatccgataaataagaagcatcaaagccagtactgatgagtccgtgaggacgaaacgagtaagctcgtctactggcgcttttatctcat

SEQ ID NO: 2214 - RNA, 99 nt, synthetic construct
  source 1..99: mol_type = other RNA
tactggcgcctttatctcattactttagagagccatcaccagcgactatgtcgtatgggtaaagcgcttacggacttcggtccgtaagaagcatcaaag

SEQ ID NO: 2215 - RNA, 157 nt, synthetic construct
  source 1..157: mol_type = other RNA
cgactactgatgagtccgtgaggacgaaacgagtaagctcgtctagtcgtactggcgcttttatctcattactttgagagccatcaccagcgactatgtcgtatgggtaaagcgcttatttatcggagagaaatccgataaataagaagcatcaaag

SEQ ID NO: 2216 - RNA, 106 nt, synthetic construct
  source 1..106: mol_type = other RNA
gctggcgcctttatctgattactttgagagccatcaccagcgactatgtcgtatgggtaaagcgcaggtgggacgacctctcggtcgtcctatctgcgcatcaaag

SEQ ID NO: 2217 - RNA, 97 nt, synthetic construct
  source 1..97: mol_type = other RNA
tactggcgcctttatctcattactttagagccatcaccagcgactatgtcgtatgggtaaagcgcttacggacttcggtccgtaagaagcatcaaag

SEQ ID NO: 2218 - RNA, 186 nt, synthetic construct
  source 1..186: mol_type = other RNA
tactggcgcttttatctcattactttgagagccatcaccagcgactatgtcgtatgggtaaagcgcttatttatcggagagaaatccgataaataagaagcatcaaagcattcctcagaaaatgacaaacctgtggggcgtaagtagatcttcggatctatgatcgtgcagacgttaaaatcaggt

SEQ ID NO: 2219 - RNA, 171 nt, synthetic construct
  source 1..171: mol_type = other RNA
tactggcgcttttatctcattactttgagagccatcaccagcgactatgtcgtatgggtaaagcgcttatttatcggagagaaatccgataaataagaagcatcaaagcgactactgatgagtccgtgaggacgaaacgagtaagctcgtctagtcgcgtgtagcgaagca

SEQ ID NO: 2220 - RNA, 186 nt, synthetic construct
  source 1..186: mol_type = other RNA
cattcctcagaaaatgacaaacctgtggggcgtaagtagatcttcggatctatgatcgtgcagacgttaaaatcaggttactggcgcttttatctcattactttgagagccatcaccagcgactatgtcgtatgggtaaagcgcttatttatcggagagaaatccgataaataagaagcatcaaag

SEQ ID NO: 2221 - RNA, 186 nt, synthetic construct
  source 1..186: mol_type = other RNA
ttttggccggcatggtcccagcctcctcgctggcgccggctgggcaacatgcttcggcatggcgaatgggaccccgggtactggcgcttttatctcattactttgagagccatcaccagcgactatgtcgtatgggtaaagcgcttatttatcggagagaaatccgataaataagaagcatcaaag

SEQ ID NO: 2222 - RNA, 171 nt, synthetic construct
  source 1..171: mol_type = other RNA
cgactactgatgagtccgtgaggacgaaacgagtaagctcgtctagtcgcgtgtagcgaagcatactggcgcttttatctcattactttgagagccatcaccagcgactatgtcgtatgggtaaagcgcttatttatcggagagaaatccgataaataagaagcatcaaag

SEQ ID NO: 2223 - RNA, 168 nt, synthetic construct
  source 1..168: mol_type = other RNA
tactggcgcttttatctcattactttgagagccatcaccagcgactatgtcgtatgggtaaagcgcttatttatcggagagaaatccgataaataagaagcatcaaaggggagccccgctgatgaggtcggggagaccgaaagggacttcggtccctacggggctccc

SEQ ID NO: 2224 - RNA, 144 nt, synthetic construct
  source 1..144: mol_type = other RNA
ccacccccaccaccacccccacccccaccaccaccctactggcgcttttatctcattactttgagagccatcaccagcgactatgtcgtatgggtaaagcgcttatttatcggagagaaatccgataaataagaagcatcaaag

SEQ ID NO: 2225 - RNA, 157 nt, synthetic construct
  source 1..157: mol_type = other RNA
tactggcgcttttatctcattactttgagagccatcaccagcgactatgtcgtatgggtaaagcgcttatttatcggagagaaatccgataaataagaagcatcaaagcgactactgatgagtccgtgaggacgaaacgagtaagctcgtctagtcg

SEQ ID NO: 2226 - RNA, 172 nt, synthetic construct
  source 1..172: mol_type = other RNA
tactggcgcttttatctcattactttgagagccatcaccagcgactatgtcgtatgggtaaagcgcttatttatcggagagaaatccgataaataagaagcatcaaagcgtggttagggccacgttaaatagttgcttaagccctaagcgttgatcttcggatcaggtgcaa

SEQ ID NO: 2227 - RNA, 184 nt, synthetic construct
  source 1..184: mol_type = other RNA
tactggcgcttttatctcattactttgagagccatcaccagcgactatgtcgtatgggtaaagcgcttatttatcggagagaaatccgataaataagaagcatcaaagggcaataaagcggttacaagcccgcaaaaatagcagagtaatgtcgcgatagcgcggcattaatgcagctttattg

SEQ ID NO: 2228 - RNA, 122 nt, synthetic construct
  source 1..122: mol_type = other RNA
tactggcgcttttatctcattactattatctcattactttgagagccatcaccagcgactatgtcgtatgggtaaagcgcttatttatcggagagaaatccgataaataagaagcatcaaag

SEQ ID NO: 2229 - RNA, 184 nt, synthetic construct
  source 1..184: mol_type = other RNA
ggcaataaagcggttacaagcccgcaaaaatagcagagtaatgtcgcgatagcgcggcattaatgcagctttattgtactggcgcttttatctcattactttgagagccatcaccagcgactatgtcgtatgggtaaagcgcttatttatcggagagaaatccgataaataagaagcatcaaag

SEQ ID NO: 2230 - RNA, 185 nt, synthetic construct
  source 1..185: mol_type = other RNA
tactggcgcttttatctcattactttgagagccatcaccagcgactatgtcgtatgggtaaagcgcttatttatcggagagaaatccgataaataagaagcatcaaagacccgcaaggccgacggcatccgccgccgctggtgcaagtccagccgccccttcgggggcgggcgctcatgggtaac

SEQ ID NO: 2231 - RNA, 63 nt, synthetic construct
  source 1..63: mol_type = other RNA
tactggcgcttttatctcattactttgagagccatcaccagcgactatgtcgtatgggtaaag

SEQ ID NO: 2232 - RNA, 168 nt, synthetic construct
  source 1..168: mol_type = other RNA
gggagccccgctgatgaggtcggggagaccgaaagggacttcggtccctacggggctccctactggcgcttttatctcattactttgagagccatcaccagcgactatgtcgtatgggtaaagcgcttatttatcggagagaaatccgataaataagaagcatcaaag

SEQ ID NO: 2233 - RNA, 171 nt, synthetic construct
  source 1..171: mol_type = other RNA
ccagtactgatgagtccgtgaggacgaaacgagtaagctcgtctactggcgcttttatctcattactggcgcttttatctcattactttgagagccatcaccagcgactatgtcgtatgggtaaagcgcttatttatcggagagaaatccgataaataagaagcatcaaag

SEQ ID NO: 2234 - RNA, 185 nt, synthetic construct
  source 1..185: mol_type = other RNA
acccgcaaggccgacggcatccgccgccgctggtgcaagtccagccgccccttcgggggcgggcgctcatgggtaactactggcgcttttatctcattactttgagagccatcaccagcgactatgtcgtatgggtaaagcgcttatttatcggagagaaatccgataaataagaagcatcaaag

SEQ ID NO: 2235 - RNA, 160 nt, synthetic construct
  source 1..160: mol_type = other RNA
cctgtcaccggatgtgctttccggtctgatgagtccgtgaggacgaaacaggtactggcgcttttatctcattactttgagagccatcaccagcgactatgtcgtatgggtaaagcgcttatttatcggagagaaatccgataaataagaagcatcaaag

SEQ ID NO: 2236 - RNA, 100 nt, synthetic construct
  source 1..100: mol_type = other RNA
gtactggcgcctttatctcattactttgagagccatcaccagcgactatgtcgtagtgggtaaagcgcttacggacttcggtccgtaagaagcatcaaag

SEQ ID NO: 2237 - RNA, 91 nt, synthetic construct
  source 1..91: mol_type = other RNA
gtactggcgcttttatctgattactttgagagccatcaccagcgactatgtcgtagtgggtaaagctccctcttcggagggagcatcaaag

SEQ ID NO: 2238 - RNA, 89 nt, synthetic construct
  source 1..89: mol_type = other RNA
actggcgcttttatctgattactttgagagccatcaccagcgactatgtcgtagtgggtaaagctccctcttcggagggagcatcaaag

SEQ ID NO: 2239 - RNA, 97 nt, synthetic construct
  source 1..97: mol_type = other RNA
actggcgcctttatctcattactttgagagccatcaccagcgactatgtcgtatgggtaaagcgcttacggacttcggtccgtaagaagcatcaaag

SEQ ID NO: 2240 - RNA, 89 nt, synthetic construct
  source 1..89: mol_type = other RNA
gctggcgcttttatctgattactttgagagccatcaccagcgactatgtcgtagtgggtaaagctccctcttcggagggagcatcaaag

SEQ ID NO: 2241 - RNA, 88 nt, synthetic construct
  source 1..88: mol_type = other RNA
actggcgcttttatctgattactttgagagccatcaccagcgactatgtcgtatgggtaaagctccctcttcggagggagcatcaaag

SEQ ID NO: 2242 - RNA, 97 nt, synthetic construct
  source 1..97: mol_type = other RNA
actggcgcctttatctgattactttgagagccatcaccagcgactatgtcgtatgggtaaagcgcttacggacttcggtccgtaagaagcatcaaag

SEQ ID NO: 2243 - RNA, 97 nt, synthetic construct
  source 1..97: mol_type = other RNA
actggcgcttttatctgattactttgagagccatcaccagcgactatgtcgtatgggtaaagcgcttacggacttcggtccgtaagaagcatcaaag

SEQ ID NO: 2244 - RNA, 98 nt, synthetic construct
  source 1..98: mol_type = other RNA
actggcgcttttatctgattactttgagagccatcaccagcgactatgtcgtagtgggtaaagcgcttacggacttcggtccgtaagaagcatcaaag

SEQ ID NO: 2245 - RNA, 89 nt, synthetic construct
  source 1..89: mol_type = other RNA
actggcgcttttatctgattactttgagagccatcaccagcgactatgtcgtattgggtaaagctccctcttcggagggagcatcaaag

SEQ ID NO: 2246 - RNA, 98 nt, synthetic construct
  source 1..98: mol_type = other RNA
actggcgcttttatctgattactttgagagccatcaccagcgactatgtcgtattgggtaaagcgcttacggacttcggtccgtaagaagcatcaaag

SEQ ID NO: 2247 - RNA, 98 nt, synthetic construct
  source 1..98: mol_type = other RNA
actggcgcctttatcatcattactttgagagccatcaccagcgactatgtcgtatgggtaaagcgcttacggacttcggtccgtaagaagcatcaaag

SEQ ID NO: 2248 - RNA, 90 nt, synthetic construct
  source 1..90: mol_type = other RNA
actggcgcttttatctgattactttgagagccatcaccagcgactatgtcgtagtgggtaaagcgccctcttcggagggaagcatcaaag

SEQ ID NO: 2249 - RNA, 96 nt, synthetic construct
  source 1..96: mol_type = other RNA
actggcgcttttatctgattactttgagagccatcaccagcgactatgtcgtagtgggtaaagctcacatgaggatcacccatgtgagcatcaaag

SEQ ID NO: 2250 - RNA, 89 nt, synthetic construct
  source 1..89: mol_type = other RNA
actggcacttttacctgattactttgagagccaacaccagcgactatgtcgtagtgggtaaagctccctcttcggagggagcatcaaag

SEQ ID NO: 2251 - RNA, 89 nt, synthetic construct
  source 1..89: mol_type = other RNA
actggcacttttatctgattactttgagagccatcaccagcgactatgtcgtagtgggtaaagctccctcttcggagggagcatcaaag

SEQ ID NO: 2252 - RNA, 89 nt, synthetic construct
  source 1..89: mol_type = other RNA
actggcccttttatctgattactttgagagccatcaccagcgactatgtcgtagtgggtaaagctccctcttcggagggagcatcaaag

SEQ ID NO: 2253 - RNA, 89 nt, synthetic construct
  source 1..89: mol_type = other RNA
actggcgcttttacctgattactttgagagccatcaccagcgactatgtcgtagtgggtaaagctccctcttcggagggagcatcaaag

SEQ ID NO: 2254 - RNA, 89 nt, synthetic construct
  source 1..89: mol_type = other RNA
actggcgcttttatctgattactttgagagccaacaccagcgactatgtcgtagtgggtaaagctccctcttcggagggagcatcaaag

SEQ ID NO: 2255 - RNA, 97 nt, synthetic construct
  source 1..97: mol_type = other RNA
actggcacctttacctgattactttgagagccaacaccagcgactatgtcgtatgggtaaagcgcttacggacttcggtccgtaagaagcatcaaag

SEQ ID NO: 2256 - RNA, 97 nt, synthetic construct
  source 1..97: mol_type = other RNA
actggcacctttatctgattactttgagagccatcaccagcgactatgtcgtatgggtaaagcgcttacggacttcggtccgtaagaagcatcaaag

SEQ ID NO: 2257 - RNA, 97 nt, synthetic construct
  source 1..97: mol_type = other RNA
actggcccctttatctgattactttgagagccatcaccagcgactatgtcgtatgggtaaagcgcttacggacttcggtccgtaagaagcatcaaag

SEQ ID NO: 2258 - RNA, 97 nt, synthetic construct
  source 1..97: mol_type = other RNA
actggcgcctttatctgattactttgagagccaacaccagcgactatgtcgtatgggtaaagcgcttacggacttcggtccgtaagaagcatcaaag

SEQ ID NO: 2259 - RNA, 89 nt, synthetic construct; identical to SEQ ID NO: 2240
  source 1..89: mol_type = other RNA

SEQ ID NO: 2260 - RNA, 90 nt, synthetic construct
  source 1..90: mol_type = other RNA
gactggcgcttttatctgattactttgagagccatcaccagcgactatgtcgtagtgggtaaagctccctcttcggagggagcatcaaag

SEQ ID NO: 2261 - RNA, 90 nt, synthetic construct
  source 1..90: mol_type = other RNA
actggcgcctttatctgattactttggagagccatcaccagcgactatgtcgtagtgggtaaagctccctcttcggagggagcatcaaag

SEQ ID NO: 2262 - RNA, 89 nt, synthetic construct
  source 1..89: mol_type = other RNA
actggcgcatttatctgattactttgtgagccatcaccagcgactatgtcgtagtgggtaaagctccctcttcggagggagcatcaaag

SEQ ID NO: 2263 - RNA, 89 nt, synthetic construct
  source 1..89: mol_type = other RNA
actggcgcctttatctgattactttgagagccatcaccagcgactatgtcgtagtgggtaaagctccctcttcggagggagcatcaaag

SEQ ID NO: 2264 - RNA, 90 nt, synthetic construct
  source 1..90: mol_type = other RNA
actggcgcttttatctgattactttggagagccatcaccagcgactatgtcgtagtgggtaaagctccctcttcggagggagcatcaaag

SEQ ID NO: 2265 - RNA, 89 nt, synthetic construct
  source 1..89: mol_type = other RNA
actggcgcatttatctgattactttgagagccatcaccagcgactatgtcgtagtgggtaaagctccctcttcggagggagcatcaaag

SEQ ID NO: 2266 - RNA, 89 nt, synthetic construct
  source 1..89: mol_type = other RNA
actggcgcttttatctgattactttgtgagccatcaccagcgactatgtcgtagtgggtaaagctccctcttcggagggagcatcaaag

SEQ ID NO: 2267 - RNA, 90 nt, synthetic construct
  source 1..90: mol_type = other RNA
actggcgcttttattctgattactttgagagccatcaccagcgactatgtcgtagtgggtaaagctccctcttcggagggagcatcaaag

SEQ ID NO: 2268 - RNA, 88 nt, synthetic construct
  source 1..88: mol_type = other RNA
acggcgcttttatctgattactttgagagccatcaccagcgactatgtcgtagtgggtaaagctccctcttcggagggagcatcaaag

SEQ ID NO: 2269 - RNA, 89 nt, synthetic construct
  source 1..89: mol_type = other RNA
actggcgcttttatatgattactttgagagccatcaccagcgactatgtcgtagtgggtaaagctccctcttcggagggagcatcaaag

SEQ ID NO: 2270 - RNA, 90 nt, synthetic construct
  source 1..90: mol_type = other RNA
actggcgcttttatcttgattactttgagagccatcaccagcgactatgtcgtagtgggtaaagctccctcttcggagggagcatcaaag

SEQ ID NO: 2271 - RNA, 89 nt, synthetic construct
  source 1..89: mol_type = other RNA
actggcgcttttatctgattactttgagagccagcaccagcgactatgtcgtagtgggtaaagctccctcttcggagggagcatcaaag

SEQ ID NO: 2272 - RNA, 89 nt, synthetic construct
  source 1..89: mol_type = other RNA
actggcgctgttatctgattacttcgagagccatcaccagcgactatgtcgtagtgggtaaagctccctcttcggagggagcatcgaag

SEQ ID NO: 2273 - RNA, 89 nt, synthetic construct
  source 1..89: mol_type = other RNA
actggcgctcttatctgattacttcgagagccatcaccagcgactatgtcgtagtgggtaaagctccctcttcggagggagcatcgaag

SEQ ID NO: 2274 - RNA, 89 nt, synthetic construct
  source 1..89: mol_type = other RNA
actggcgcttgtatctgattactctgagagccatcaccagcgactatgtcgtagtgggtaaagctccctcttcggagggagcatcagag

SEQ ID NO: 2275 - RNA, 89 nt, synthetic construct
  source 1..89: mol_type = other RNA
actggcgcttctatctgattactctgagagccatcaccagcgactatgtcgtagtgggtaaagctccctcttcggagggagcatcagag

SEQ ID NO: 2276 - RNA, 89 nt, synthetic construct
  source 1..89: mol_type = other RNA
actggcgctttgatctgattaccttgagagccatcaccagcgactatgtcgtagtgggtaaagctccctcttcggagggagcatcaagg

SEQ ID NO: 2277 - RNA, 89 nt, synthetic construct
  source 1..89: mol_type = other RNA
actggcgctttcatctgattaccttgagagccatcaccagcgactatgtcgtagtgggtaaagctccctcttcggagggagcatcaagg

SEQ ID NO: 2278 - RNA, 89 nt, synthetic construct
  source 1..89: mol_type = other RNA
actggcgctgttatctgattactttgagagccatcaccagcgactatgtcgtagtgggtaaagctccctcttcggagggagcatcaaag

SEQ ID NO: 2279 - RNA, 89 nt, synthetic construct
  source 1..89: mol_type = other RNA
actggcgcttttatctgattactttgagagccatcaccagcgactatgtcgtagtgggtaaagctccctcttcggagggagcatcgaag

SEQ ID NO: 2280 - RNA, 89 nt, synthetic construct
  source 1..89: mol_type = other RNA
actggcgcttttatctgattacttcgagagccatcaccagcgactatgtcgtagtgggtaaagctccctcttcggagggagcatcaaag

SEQ ID NO: 2281 - RNA, 98 nt, synthetic construct
  source 1..98: mol_type = other RNA
actggcacttctatctgattactctgagagccatcaccagcgactatgtcgtatgggtaaagccgcttacggacttcggtccgtaagaggcatcagag

SEQ ID NO: 2282 - RNA, 89 nt, synthetic construct
  source 1..89: mol_type = other RNA
actggcacttctatctgattactctgagagccatcaccagcgactatgtcgtagtgggtaaagctccctcttcggagggagcatcagag

SEQ ID NO: 2283 - RNA, 98 nt, synthetic construct
  source 1..98: mol_type = other RNA
actggcacctttatctgattactttgagagccatcaccagcgactatgtcgtatgggtaaagccgcttacggacttcggtccgtaagaggcatcaaag

SEQ ID NO: 2284 - RNA, 98 nt, synthetic construct
  source 1..98: mol_type = other RNA
actggcacttgtatctgattactctgagagccatcaccagcgactatgtcgtatgggtaaagccgcttacggacttcggtccgtaagaggcatcagag

SEQ ID NO: 2285 - RNA, 89 nt, synthetic construct
  source 1..89: mol_type = other RNA
actggcacttgtatctgattactctgagagccatcaccagcgactatgtcgtagtgggtaaagctccctcttcggagggagcatcagag

SEQ ID NO: 2286 - RNA, 97 nt, synthetic construct
  source 1..97: mol_type = other RNA
actggcacttttatctgattactttgagagccatcaccagcgactatgtcgtatgggtaaagcgcttacggacttcggtccgtaagaagcatcaaag

SEQ ID NO: 2287 - RNA, 97 nt, synthetic construct
  source 1..97: mol_type = other RNA
actggcacttctatctgattactctgagagccatcaccagcgactatgtcgtatgggtaaagcgcttacggacttcggtccgtaagaagcatcagag

SEQ ID NO: 2288 - RNA, 98 nt, synthetic construct
  source 1..98: mol_type = other RNA
actggcgcttctatctgattactctgagagccatcaccagcgactatgtcgtatgggtaaagccgcttacggacttcggtccgtaagaggcatcagag

SEQ ID NO: 2289 - RNA, 98 nt, synthetic construct
  source 1..98: mol_type = other RNA
actggcacttctatctgattactctgagcgccatcaccagcgactatgtcgtatgggtaaagccgcttacggacttcggtccgtaagaggcatcagag

SEQ ID NO: 2290 - RNA, 98 nt, synthetic construct
  source 1..98: mol_type = other RNA
actggcgcttctatctgattactctgagcgccatcaccagcgactatgtcgtatgggtaaagccgcttacggacttcggtccgtaagaggcatcagag

SEQ ID NO: 2291 - RNA, 98 nt, synthetic construct
  source 1..98: mol_type = other RNA
actggcgcttctatctgattactctgagcgccatcaccagcgactatgtcgtatgggtaaagcgccttacggacttcggtccgtaaggagcatcagag

SEQ ID NO: 2292 - RNA, 99 nt, synthetic construct
  source 1..99: mol_type = other RNA
actggcgcttctatctgattactctgagcgccatcaccagcgactatgtcgtagtgggtaaagccgcttacggacttcggtccgtaagaggcatcagag

SEQ ID NO: 2293 - RNA, 98 nt, synthetic construct
  source 1..98: mol_type = other RNA
acgggactttctatctgattactctgaagtccctcaccagcgactatgtcgtatgggtaaagccgcttacggacttcggtccgtaagaggcatcagag

SEQ ID NO: 2294 - RNA, 98 nt, synthetic construct
  source 1..98: mol_type = other RNA
acctgtagttctatctgattactctgactacagtcaccagcgactatgtcgtatgggtaaagccgcttacggacttcggtccgtaagaggcatcagag

SEQ ID NO: 2295 - RNA, 113 nt, synthetic construct
  source 1..113: mol_type = other RNA
actggcgcttttatctgattactttgagagccatcaccagcgactatgtcgtagtgggtaaagctgcacggtgggcgcagcttcggctgacggtacaccgtgcagcatcaaag

SEQ ID NO: 2296 - RNA, 143 nt, synthetic construct
  source 1..143: mol_type = other RNA
actggcgcttttatctgattactttgagagccatcaccagcgactatgtcgtagtgggtaaagctgcacggtgggcgcagcttcggctgacggtacaccggtgggcgcagcttcggctgacggtacaccgtgcagcatcaaag

SEQ ID NO: 2297 - RNA, 173 nt, synthetic construct
  source 1..173: mol_type = other RNA
actggcgcttttatctgattactttgagagccatcaccagcgactatgtcgtagtgggtaaagctgcacggtgggcgcagcttcggctgacggtacaccggtgggcgcagcttcggctgacggtacaccggtgggcgcagcttcggctgacggtacaccgtgcagcatcaaag

SEQ ID NO: 2298 - RNA, 203 nt, synthetic construct
  source 1..203: mol_type = other RNA
actggcgcttttatctgattactttgagagccatcaccagcgactatgtcgtagtgggtaaagctgcacggtgggcgcagcttcggctgacggtacaccggtgggcgcagcttcggctgacggtacaccggtgggcgcagcttcggctgacggtacaccggtgggcgcagcttcggctgacggtacaccgtgcagcatcaaag

SEQ ID NO: 2299 - RNA, 233 nt, synthetic construct
  source 1..233: mol_type = other RNA
actggcgcttttatctgattactttgagagccatcaccagcgactatgtcgtagtgggtaaagctgcacggtgggcgcagcttcggctgacggtacaccggtgggcgcagcttcggctgacggtacaccggtgggcgcagcttcggctgacggtacaccggtgggcgcagcttcggctgacggtacaccggtgggcgcagcttcggctgacggtacaccgtgcagcatcaaag

SEQ ID NO: 2300 - RNA, 97 nt, synthetic construct
  source 1..97: mol_type = other RNA
actggcgcttttatctgattactttgagagccatcaccagcgactatgtcgtagtgggtaaagctgcacctagcggaggctaggtgcagcatcaaag

SEQ ID NO: 2301 - RNA, 118 nt, synthetic construct
  source 1..118: mol_type = other RNA
actggcgcttttatctgattactttgagagccatcaccagcgactatgtcgtagtgggtaaagctgcacctcggcttgctgaagcgcgcacggcaagaggcgaggtgcagcatcaaag

SEQ ID NO: 2302 - RNA, 192 nt, synthetic construct
  source 1..192: mol_type = other RNA
actggcgcttttatctgattactttgagagccatcaccagcgactatgtcgtagtgggtaaagctgcacctctctcgacgcaggactcggcttgctgaagcgcgcacggcaagaggcgaggggcggcgactggtgagtacgccaaaaattttgactagcggaggctagaaggagagaggtgcagcatcaaag

SEQ ID NO: 2303 - RNA, 156 nt, synthetic construct
  source 1..156: mol_type = other RNA
actggcgcttttatctgattactttgagagccatcaccagcgactatgtcgtagtgggtaaagctgcacggtgcccgtctgttgtgtcgagagacgccaaaaattttgactagcggaggctagaaggagagagatgggtgccgtgcagcatcaaag

SEQ ID NO: 2304 - RNA, 96 nt, synthetic construct
  source 1..96: mol_type = other RNA
actggcgcttttatctgattactttgagagccatcaccagcgactatgtcgtagtgggtaaagctgcacatggagaggagatgtgcagcatcaaag

SEQ ID NO: 2305 - RNA, 91 nt, synthetic construct
  source 1..91: mol_type = other RNA
actggcgcttttatctgattactttgagagccatcaccagcgactatgtcgtagtgggtaaagctgcacatggagatgtgcagcatcaaag

SEQ ID NO: 2306 - RNA, 106 nt, synthetic construct
  source 1..106: mol_type = other RNA
actggcgcttttatctgattactttgagagccatcaccagcgactatgtcgtagtgggtaaagcttgggcgcagcgtcaatgacgctgacggtacaagcatcaaag

SEQ ID NO: 2307 - RNA, 145 nt, synthetic construct
  source 1..145: mol_type = other RNA
actggcgcttttatctgattactttgagagccatcaccagcgactatgtcgtagtgggtaaagctgcactatgggcgcagcgtcaatgacgctgacggtacaggccacatgaggatcacccatgtggtatagtgcagcatcaaag

SEQ ID NO: 2308 - RNA, 155 nt, synthetic construct
  source 1..155: mol_type = other RNA
actggcgcttttatctgattactttgagagccatcaccagcgactatgtcgtagtgggtaaagctgcactatgggcgcagctcatgaggatcacccatgagctgacggtacaggccacatgaggatcacccatgtggtatagtgcagcatcaaag

SEQ ID NO: 2309 - RNA, 151 nt, synthetic construct
  source 1..151: mol_type = other RNA
actggcgcttttatctgattactttgagagccatcaccagcgactatgtcgtagtgggtaaagctgcactatgggcgcagcgtcaatgacgctgacggtacaggccacatggcagtcgtaacgacgcgggtggtatagtgcagcatcaaag

SEQ ID NO: 2310 - RNA, 172 nt, synthetic construct
  source 1..172: mol_type = other RNA
actggcgcttttatctgattactttgagagccatcaccagcgactatgtcgtagtgggtaaagctgcactatgggcgcagcaaacatggcagtcctaaggacgcgggttttgctgacggtacaggccacatggcagtcgtaacgacgcgggtggtatagtgcagcatcaaag

SEQ ID NO: 2311 - RNA, 159 nt, synthetic construct
  source 1..159: mol_type = other RNA
actggcgcttttatctgattactttgagagccatcaccagcgactatgtcgtagtgggtaaagctgcactatgggcgcagacatggcagtcgtaacgacgcgggtctgacggtacaggccacatgaggatcacccatgtggtatagtgcagcatcaaag

SEQ ID NO: 2312 - RNA, 108 nt, synthetic construct
  source 1..108: mol_type = other RNA
actggcgcttttatctgattactttgagagccatcaccagcgactatgtcgtagtgggtaaagctgcactaaggagtttatatggaaacccttagtgcagcatcaaag

SEQ ID NO: 2313 - RNA, 242 nt, synthetic construct
  source 1..242: mol_type = other RNA
actggcgcttttatctgattactttgagagccatcaccagcgactatgtcgtagtgggtaaagctcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctgagcatcaaag

SEQ ID NO: 2314 - RNA, 98 nt, synthetic construct
  source 1..98: mol_type = other RNA
actggcgcttttatctgattactttgagagccatcaccagcgactatgtcgtagtgggtaaagctgcacgccctgaagaagggcgtgcagcatcaaag

SEQ ID NO: 2315 - RNA, 111 nt, synthetic construct
  source 1..111: mol_type = other RNA
actggcgcttttatctgattactttgagagccatcaccagcgactatgtcgtagtgggtaaagctgcacggctcgtgtagctcattagctccgagccgtgcagcatcaaag

SEQ ID NO: 2316 - RNA, 113 nt, synthetic construct
  source 1..113: mol_type = other RNA
actggcgcttttatctgattactttgagagccatcaccagcgactatgtcgtagtgggtaaagctgcacccgtgtgcatccgcagtgtcggatccacgggtgcagcatcaaag

SEQ ID NO: 2317 - RNA, 112 nt, synthetic construct
  source 1..112: mol_type = other RNA
actggcgcttttatctgattactttgagagccatcaccagcgactatgtcgtagtgggtaaagctgcacggaatccattgcactccggatttcactaggtgcagcatcaaag

SEQ ID NO: 2318 - RNA, 103 nt, synthetic construct
  source 1..103: mol_type = other RNA
actggcgcttttatctgattactttgagagccatcaccagcgactatgtcgtagtgggtaaagctgcacatgcatgtctaagacagcatgtgcagcatcaaag

SEQ ID NO: 2319 - RNA, 106 nt, synthetic construct
  source 1..106: mol_type = other RNA
actggcgcttttatctgattactttgagagccatcaccagcgactatgtcgtagtgggtaaagctgcacaaaacataaggaaaacctatgttgtgcagcatcaaag

SEQ ID NO: 2320 - RNA, 153 nt, synthetic construct
  source 1..153: mol_type = other RNA
actggcgcttctatctgattactctgagcgccatcaccagcgactatgtcgtagtgggtaaagccgcttacggactatgggcgcagcgtcaatgacgctgacggtacaggccagacaattattgtctggtatagtccgtaagaggcatcagag

SEQ ID NO: 2321 - RNA, 147 nt, synthetic construct
  source 1..147: mol_type = other RNA
actggcgcttctatctgattactctgagcgccatcaccagcgactatgtcgtagtgggtaaagccgcttacgggtgggcgcagcgtcaatgacgctgacggtacaggccagacaattattgtctggtacccgtaagaggcatcagag

SEQ ID NO: 2322 - RNA, 153 nt, synthetic construct
  source 1..153: mol_type = other RNA
actggcgcttctatctgattactctgagcgccatcaccagcgactatgtcgtagtgggtaaagccgcttacggtatgggcgcagcgtcaatgacgctgacggtacaggccacatgaggatcacccatgtggtataccgtaagaggcatcagag

SEQ ID NO: 2323 - RNA, 143 nt, synthetic construct
  source 1..143: mol_type = other RNA
actggcgcttttatctgattactttgagagccatcaccagcgactatgtcgtagtgggtaaagctccctatgggcgcagcgtcaatgacgctgacggtacaggccacatgaggatcacccatgtggtatagggagcatcaaag

SEQ ID NO: 2324 - RNA, 163 nt, synthetic construct
  source 1..163: mol_type = other RNA
actggcgcttctatctgattactctgagcgccatcaccagcgactatgtcgtagtgggtaaagccgcttacggtatgggcgcagctcatgaggatcacccatgagctgacggtacaggccacatgaggatcacccatgtggtataccgtaagaggcatcagag

SEQ ID NO: 2325 - RNA, 153 nt, synthetic construct
  source 1..153: mol_type = other RNA
actggcgcttttatctgattactttgagagccatcaccagcgactatgtcgtagtgggtaaagctccctatgggcgcagctcatgaggatcacccatgagctgacggtacaggccacatgaggatcacccatgtggtatagggagcatcaaag

SEQ ID NO: 2326 - RNA, 159 nt, synthetic construct
  source 1..159: mol_type = other RNA
actggcgcttctatctgattactctgagcgccatcaccagcgactatgtcgtagtgggtaaagccgcttacggtatgggcgcagcgtcaatgacgctgacggtacaggccacatggcagtcgtaacgacgcgggtggtataccgtaagaggcatcagag

SEQ ID NO: 2327 - RNA, 149 nt, synthetic construct
  source 1..149: mol_type = other RNA
actggcgcttttatctgattactttgagagccatcaccagcgactatgtcgtagtgggtaaagctccctatgggcgcagcgtcaatgacgctgacggtacaggccacatggcagtcgtaacgacgcgggtggtatagggagcatcaaag

SEQ ID NO: 2328 - RNA, 180 nt, synthetic construct
  source 1..180: mol_type = other RNA
actggcgcttctatctgattactctgagcgccatcaccagcgactatgtcgtagtgggtaaagccgcttacggtatgggcgcagcaaacatggcagtcctaaggacgcgggttttgctgacggtacaggccacatggcagtcgtaacgacgcgggtggtataccgtaagaggcatcagag

SEQ ID NO: 2329 - RNA, 170 nt, synthetic construct
  source 1..170: mol_type = other RNA
actggcgcttttatctgattactttgagagccatcaccagcgactatgtcgtagtgggtaaagctccctatgggcgcagcaaacatggcagtcctaaggacgcgggttttgctgacggtacaggccacatggcagtcgtaacgacgcgggtggtatagggagcatcaaag

SEQ ID NO: 2330 - RNA, 167 nt, synthetic construct
  source 1..167: mol_type = other RNA
actggcgcttctatctgattactctgagcgccatcaccagcgactatgtcgtagtgggtaaagccgcttacggtatgggcgcagacatggcagtcgtaacgacgcgggtctgacggtacaggccacatgaggatcacccatgtggtataccgtaagaggcatcagag

SEQ ID NO: 2331 - RNA, 157 nt, synthetic construct
  source 1..157: mol_type = other RNA
actggcgcttttatctgattactttgagagccatcaccagcgactatgtcgtagtgggtaaagctccctatgggcgcagacatggcagtcgtaacgacgcgggtctgacggtacaggccacatgaggatcacccatgtggtatagggagcatcaaag

SEQ ID NO: 2332 - protein, 81 aa, Pan troglodytes
MAAAAPRHPTQQGTVTFEDVAVNFSQEEWCLLSEAQRCLYRDVMLENLALISSLGCWCGSKDEEAPCKQSISVQRESQSRT

SEQ ID NO: 2333 - protein, 81 aa, Pan troglodytes
MAAAAPRHPTQGTVTFEDVAVNFSQEEWCLLSEAQRCLYRDVMLENLALISSLGCWCGSKDEEAPCKQSISVQRESQSRTP

SEQ ID NO: 2334 - protein, 81 aa, Pan troglodytes
MAAAAPRRPTQGTVTFEDVAVNFSQEEWCLLSEAQRCLYRDVMLENLALISSLGCWCGSKDEEAPCKQRISIVICHLCQFL

SEQ ID NO: 2335 - protein, 81 aa, Pan troglodytes
HRMTWDCIAIGSHESSVQGTVAFEDVAVNFSQEEWSLLSEVQRCLYHDVMLENWVLISSLGCWCGSEDEEAPSKKSISIQR

SEQ ID NO: 2336 - protein, 81 aa, Pan troglodytes
MAAAEQTAPAQGIVTFEDVAVYFSWKEWGLLDEAQKCLYHDVMLENLTLTTSLGGSGAGDEEAPYEQSTSPQRVSQVRIPK

SEQ ID NO: 2337 - protein, 81 aa, Pan troglodytes
MTPGVRVSADPEQVTFEDVVVDFSQEEWGQLKPAQRTLYRDVMLDTFRLLVSVGHWLPKPNVISLLEQEAELWAVDSGLPQ

SEQ ID NO: 2338 - protein, 81 aa, Pan troglodytes
EDVAMAFTQEEWEHLDLAQRTLYREVTLETWEHIVSLGLFLSKSDVISQLEQEEDLCRAEQEAPRDGISLLLPRLECNGTI

SEQ ID NO: 2339 - protein, 81 aa, Pan troglodytes
EEWEHLDLAQRTLYREVTLETWEHIVSLGLFLSKSDVISQLEQEEDLCRAEQEAPRGTSGLSQVTGVVADGSFRFQVWDFT

SEQ ID NO: 2340 - protein, 81 aa, Pan troglodytes
QSEAAGPQDGGQEAAGPQGLVMFEDVTVYFSREEWGLLNVTQKGLYRDVMLENFALVSSLGLAPSRSPVFTQLEDDEQSWV

SEQ ID NO: 2341 - protein, 81 aa, Pan troglodytes
MAGEAEVSRGCLRGMRGGHQKGLYRDVMLENFALVSSLGLAPSRSPVFTQLEDDEQSWVPSWVDVTPVSRAEARRGFGLDG

SEQ ID NO: 2342 - protein, 81 aa, Pan troglodytes
GPAQHTSWPCGSAVPTLKSMVTFEDVAVYFSQEEWELLDAAQRHLYHSVMLENLELVTSLGCWRGVEGEEAHPEQNVSVEV

SEQ ID NO: 2343 - protein, 81 aa, Pan troglodytes
PTLKSMVTFEDVAVYFSQEEWELLDAAQRHLYHSVMLENLELVTSLGNALSQHDVFTCSVEADLPNCFPNWLHHFTSLSAV

SEQ ID NO: 2344 - protein, 81 aa, Pan troglodytes
PLAAQSPEGHHGHQEPASTSFHPPRIQEEWGLLDRSQKELYWDAMLEKYGTVVSLEEHPVTYQNRPHPSFKQTPRLTVPPT

SEQ ID NO: 2345 - protein, 81 aa, Pan troglodytes
PSNDTDCPQKKEGKAQIVVPVTFRDVTVIFTEAEWKRLSPEQRNLYKEVMLENYRNLLSLDGVSLLLPRLECNRAISAHHN

SEQ ID NO: 2346 - protein, 81 aa, Pan troglodytes
EEAAQKRKEKEPGMALPQGHLTFRDVAIEFSLEEWKCLDPTQRALYRAMMLENYRNLHSVDISSKCMMKKFSSTAQGNTEV

SEQ ID NO: 2347 - protein, 81 aa, Pan troglodytes
MLQTVWFQGLGRNLLFQEPVTFEDVAVYFTQNEWASLHPMQRALHREVMLENYANVTSLYPTAGGFPLDTERTEKVPGALS

SEQ ID NO: 2348 - protein, 81 aa, Pan troglodytes
MLQTVWFQGLGRNLLFQEPVTFEDVAVYFTQNEWASLHPMQRALHREVMLENYANVTSLSAFPFPKPDLIFQLEQGEAAWG

SEQ ID NO: 2349 - protein, 81 aa, Pan troglodytes
MLETYNNLVSLQELVSFEEVAVHFTWEEWQDLDDAQRTLYRDVMLETYSSLVSLGHCITKPEMIFKLEQGAEPWIVEETPN

SEQ ID NO: 2350 - protein, 81 aa, Pan troglodytes
MELLTFRDVAIEFSPEEWKCLDPAQQNLYRDVMLENYRNLVSLGVAISNPDLAIYLEQRKEPYKVKIHETVAKHPAVCSHF

SEQ ID NO: 2351 - protein, 81 aa, Pan troglodytes
MELLTFRDVAIEFSPEEWKCLDPAQQNLYRDVMLENYRNLVSLGVAISNPDLAIYLEQRKEPYKVKIHETVAKHPEFHSCC

SEQ ID NO: 2352 - protein, 81 aa, Pan troglodytes
ELLTFRDVAIEFSPEEWKCLDPAQQNLYRDVMLENYRNLVSLGVAISNPDLAIYLEQRKEPYKVKIHETVAKHPAVCSHFT

SEQ ID NO: 2353 - protein, 81 aa, Pan troglodytes
SQEESPEEDTERTERKPMVKDAFKDISIYFTKEEWAEMGDWEKTRYRNVKRNYNALITIGLRATRPAFMCHRRQAIKLQVD

SEQ ID NO: 2354 - protein, 81 aa, Pan troglodytes
RKPMVKDAFKDISIYFTKEEWAEMGDWEKTRYRNVKRNYNALITIGLRATRPAFMCHRRQAIKLQVDDTEDSDEEWTPRQQ

SEQ ID NO: 2355 - protein, 81 aa, Pan troglodytes
MLENYSHLVSMGYPVSKPDVISKLEQGEEPWIIKGDISNWIYPDEYQADGRQDRKSNLHNSQSCILGTVSFHHKILKGVTR

SEQ ID NO: 2356 - protein, 81 aa, Pan troglodytes
MLPIVQLYPQGLVSFKDVAVDFTQEEWQQLDPSQRTLYRDVMLENYSHLVSMGYPVSKPDVISKLEQGEEPWIIKGDISNW

SEQ ID NO: 2357 - protein, 81 aa, Pan troglodytes
MAAGQREARPQVSLTFEDVAVLFTRDEWRKLAPSQRNLYRDVMLENYRNLVSLGLPFTKPKVISLLQQGEDPWEVEKDSSG

SEQ ID NO: 2358 - protein, 81 aa, Pan troglodytes
MAVSHLPTMVQESVTFKDVAILFTQEEWGQLSPAQRALYRDVMLENYSNLVSLGLLGPKPDTFSQLEKREAWMPEDTPGGF

SEQ ID NO: 2359 - protein, 81 aa, Pan troglodytes
MARRLLPGHVQESVTFRDVAVFFSQDEWLHLDSAQRALYREVMLENYSILVSLGILFSKPKVISQLEQGEDPWMVESGVPQ

SEQ ID NO: 2360 - protein, 81 aa, Pan troglodytes
GSQGNLPQADITLMSQAQESVTFEDVAVNFTNREWQCLTYAQRHLYKDVMLENYGNMVSLGFPFPKPPLISHLEREVDPCV

SEQ ID NO: 2361 - protein, 81 aa, Pan troglodytes
ADITLMSQAQDSRSILFQESVTFEDVAVNFTNREWQCLTYAQRHLYKDVMLENYGNMVSLGFPFPKPPLISHLEREVDPCV

SEQ ID NO: 2362 - protein, 81 aa, Pan troglodytes
ATLQEAMKRDCWREARVKKKPVTFEDVAVNFTQEEWDCLDASQRVLYQDVMSETFKNLISVARIFLHKPELITKLEQEEEQ

SEQ ID NO: 2363 - protein, 81 aa, Pan troglodytes
EQLKPIEPRDCWREARVKKKPVTFEDVAVNFTQEEWDCLDASQRVLYQDVMSETFKNLISVARIFLHKPELITKLEQEEEQ

SEQ ID NO: 2364 - protein, 81 aa, Pan troglodytes
MAAGEPRSLLFFQKPVTFEDVAVNFTQEEWDCLDASQRVLYQDVMSETFKNLISVARIFLHKPELITKLEQEEEQWRETQV

SEQ ID NO: 2365 - protein, 81 aa, Pan troglodytes
MAERPGSPGSREMRLLTFRDIAIEFSLEEWQCLDCAQQNLYRDVMLENYRNLVSLGIADSKPDLITCLEQNKEAWNIKRNE

SEQ ID NO: 2366 - protein, 81 aa, Pan troglodytes
MRVLTFRDVAVEFSPEEWECLDSAQQHLYRDVMLENYGNLFSLGLAIFKPDLITYLEQRKEPWNARRQKTVAKHPAGSLHF

SEQ ID NO: 2367 - protein, 81 aa, Pan troglodytes
MAKRRGSPGSREMGLLTFRDVVIEFSLEEWQCLDHAQQNLYRDVMLENYRNLVSLGIAVSKPDLITCLEQNKEPWNIKRNE

SEQ ID NO: 2368 - protein, 81 aa, Pan troglodytes
MPGPPGSLEMGPLTFRDVAIEFSLEEWQCLNTAQRNLYRKVMFENYRNLVFLGIAVSKPHLITCLEQGKEPWNRKRQEMVA

SEQ ID NO: 2369 - protein, 81 aa, Pan troglodytes
MRAAAALPSLPGPVSFKDVAVDFTQEEWQQLDPDEKIAYGDVMLENYSHLVSVGYDYHQAKHHHGVEVKEVEQGEEPWIME

SEQ ID NO: 2370 - protein, 81 aa, Pan troglodytes
GEEAVAVVRALQRALDGTSSQGMVTFEDMAVSLTWEEWERLDPARRDFCRESAQKDSGSTVPPSLESRVENKELIPVQQIL

SEQ ID NO: 2371 - protein, 81 aa, Pan troglodytes
SEEHGNKCKQSFHMVTWHMLKPHKSDSGDSFHHSSLFETQRQLHEERPYKCGNCGKSFKQRSDLFRHQRIHTGEKPYGCQE

SEQ ID NO: 2372 - protein, 81 aa, Pan troglodytes
SQELTASLLSTGSQKLVKIEEVADVAVSFILEEWGHLDQSQKSLYRDDRKENYGSITSMGYESRDNMELIVKQISDDSESR

SEQ ID NO: 2373 - protein, 81 aa, Pan troglodytes
REGSPRDQAAALLTARYQEFVTFEDVAVHLTREEWGYLDPVQRDLYREVMLENYGNVVSLGILLRLPTTRIHSVNSCPALS

SEQ ID NO: 2374 - protein, 81 aa, Pan troglodytes
LTGAPPVPQVPALPREGSPRDQAAALLTARYQEFVTFEDVAVHLTREEWGYLDPVQRDLYREVMLENYGNVVSLGTVGSWD

SEQ ID NO: 2375 - protein, 81 aa, Pan troglodytes
QVPALPREGSPRDQAAALLTARYQSSQDVLFQEFVTFEDVAVHLTREEWGYLDPVQRDLYREVMLENYGNVVSLGTVGSWD

SEQ ID NO: 2376 - protein, 81 aa, Pan troglodytes
ETRAFQEQALPVLQAGPGLPAVNPRDQEMAAGFFTAGSQGLGPFKDMALAFPEEEWRHVTPAQIDCFGEYVEPQDCRVSPG

SEQ ID NO: 2377 - protein, 81 aa, Pan troglodytes
MAEPPRLPLTFEDVAIYFSEQEWQDLEAWQKELYKHVMRSNYETLVSLDDGLPKPELISWIEHGGEPFRKWRESQKSGNTI

SEQ ID NO: 2378 - protein, 81 aa, Pan troglodytes
RNFWILRLPPGSKGEAPKVSRSLENDGVCFTEQEWENLEDWQKELYRNVMESNYETLVSLKSCSIAQAGVQWHNLGSLQPL

SEQ ID NO: 2379 - protein, 81 aa, Pan troglodytes
RNFWILRLPPGSKGEAPKVPVTFDDVAVYFSELEWGKLEDWQKELYKHVMRGNYEMLVSLDYAISKPDILTRIERGEEPCL

SEQ ID NO: 2380 - protein, 81 aa, Pan troglodytes
RGDLLRNRNFWILRLPPGSKGESPKFSEQVWGKLEDWQKELCKHMMRGNCEMLVSLDYAISKSVVLSQIEQGKEPCNWCRP

SEQ ID NO: 2381 - protein, 81 aa, Pan troglodytes
MDMAQEPVTFRDVAIYFSREEWACLEPSQRTLYRDVMLDNFSSVAALAPDRTSSLAWNSGRSRGLKTGRDLSSRQCGGDPG

SEQ ID NO: 2382 - protein, 81 aa, Pan troglodytes
MLENYSHLVSVGYCITKPKVISKLEKGEEPWSLEDEFLNQRYPGYFKVDHIKGIQEQQEKPLWQEIFINDADKTLSKEGQK

SEQ ID NO: 2383 - protein, 81 aa, Pan troglodytes
MSVLSLPESVSFKDVTVDFSRDEWQQLDLAQKSLYREVMLENYFNLISVGCQVPKPEVIFSLEQEEPCMLDGEIPSQSRPD

SEQ ID NO: 2384 - protein, 81 aa, Pan troglodytes; identical to SEQ ID NO: 392

SEQ ID NO: 2385 - protein, 81 aa, Pan troglodytes
MMENYGNLVSLDVLNRDKDEKPTVKQEIEEIEEEVEPQGVIVTRIKSEIDQDPMGRETFELVGRLDKQRGIFLWEIPRESL

SEQ ID NO: 2386 - protein, 81 aa, Pan troglodytes
MASPSPPPESKGLLTFEDVAVFFTQEEWDYLDPAQRSLYKDVMMENYGNLVSLDVLNRDKDEKPTVKQEIEEIEEEVEPQG

SEQ ID NO: 2387 - protein, 81 aa, Pan troglodytes
MASPSPPPESKEWDYLDPAQRSLYKDVMMENYGNLVSLDVLNRDKDEKPTVKQEIEEIEEEVEPQGVIVTRIKSEIDQDPM

SEQ ID NO: 2388 - protein, 81 aa, Pan troglodytes
GKGKRPSQGCPSKIARSKQKETDGKVQKDDDQLENIQKSQNKLLREVAVKKKTQAKKNGSVLPGLGTTSPDCALYFSVEQL

SEQ ID NO: 2389 - protein, 81 aa, Pan troglodytes
QKSQNKLLREVAVKKKTQAKKNGSVLPGLGTTSPDCALYFSVEQLCFLRSLLTYIRWHQEEGPDHWPLTTWSLEPVALEDV

SEQ ID NO: 2390 - protein, 81 aa, Pan troglodytes
MAMSQKSLTFKDVFVDFTLEEWQQLDSAQKNLYRDVMLENYGHLVSVGHLVGKPDVIFRLGPGEESWMADGGTPVRTCAGE

SEQ ID NO: 2391 - protein, 81 aa, Pan troglodytes
MAMSQKSLTFKDVFVDFTLEEWQQLDSAQKNLYRDVMLENYGHLVSVGHLVGKPDVIFRLGPGEESWMADGGTPVRTCAVW

SEQ ID NO: 2392 - protein, 81 aa, Pan troglodytes
MAMSQKSLTFKDVFVDFTLEEWQQLDSAQKNLYRDVMLENYGHLVSVGHLVGKPDVIFRLGPGEESWMADGGTPVRTCAVE

SEQ ID NO: 2393 - protein, 81 aa, Pan troglodytes
NGDDTFAKRPRDGAKTSKKRSKAFDDIATYFSKKEWKKMKYSERISYVYMKRNYKAMTKLGFKVTLPPFMCNKQATDFQGN

SEQ ID NO: 2394 - protein, 81 aa, Pan troglodytes
MNGDDAFARRPRDDAQSEKLRKAFDDIAKYFSKEEWEKMKSSEKIVYYMLNYVMTKLGFKVTLPLLCSKRAADFHDDFNDR

SEQ ID NO: 2395 - protein, 81 aa, Pan troglodytes
KRIKHWKMASKLILPEPLSLLTFEDVAVYFSEEEWQLLNPLEKTLYNDVMQDIYETVISLGLKLKNDTGNDHPISVSTSEI

SEQ ID NO: 2396 - protein, 80 aa, Gorilla gorilla
MIMEDWTCKSQNRVPPSEDPALSQKGYLKKKNMAALCRTAESQNPMQVFQGFTSFKDVAVNFTRKNGENWTLLRESCIGM

SEQ ID NO: 2397 - protein, 81 aa, Gorilla gorilla
FQEKSTEEGEVAALRFTARSQETVTFKDVAMDFTPEEWGKLDPAQRDVMLENYSNLVSLWLPVSKPENYNLENGKEALKLE

SEQ ID NO: 2398 - protein, 81 aa, Gorilla gorilla
PWREERKCPLDLCPESKPEIQLSPSCPLIFSNQQALSQHVWLSHLSQLFSSLWTGNPLQLGKHYPEDRKQQQDPFCLSGKA

SEQ ID NO: 2399 - protein, 81 aa, Gorilla gorilla
MGARPHPNLLGSCCQHPKAFVAFRDVAVDFTQEEWRLLSPAQRTLHREVMLETYNHLVSLEIPSSKPKLIAQLERGEEPWR

SEQ ID NO: 2400 - protein, 81 aa, Gorilla gorilla
MLETYNHLVSLEIPSSKPKLIAQLERGEEPWREERKCPLDLCPESKPEIQLSPSCPLIFSNQQALSQHVWLSHVSQLFSSL

SEQ ID NO: 2401 - protein, 81 aa, Gorilla gorilla
GEEPWREERKCPLDLCPESKPEIQLSPSCPLIFSNQQALSQHVWLSHVSQLFSSLWAGNPLQLGKHYPEDPKQQQDPFCLS

SEQ ID NO: 2402 - protein, 81 aa, Gorilla gorilla
MLETYNHLVSLEIPSSKPKLIAQLERGEEPWREERKCPLDLCPDGALLCRQAGIQWCYIGSLQPLPPGFKQFPCLSLLSSW

SEQ ID NO: 2403 - protein, 81 aa, Gorilla gorilla
KLIAQLERGEEPWREERKCPLDLCPAESKPEIQLSPSCPLIFSNQQALSQHVWLSHVSQLFSSLWAGNPLQLGKHYPEDPK

SEQ ID NO: 2404 - protein, 81 aa, Gorilla gorilla
PWREERKCPLDLCPESKPEIQLSPSCPLIFSNQQALSQHVWLSHVSQLFSSLWAGNPLQLGKHYPEDPKQQQDPFCLSGKA

SEQ ID NO: 2405 - protein, 81 aa, Gorilla gorilla
WREERKCPLDLCPAESKPEIQLSPSCPLIFSNQQALSQHVWLSHVSQLFSSLWAGNPLQLGKHYPEDPKQQQDPFCLSGKA

SEQ ID NO: 2406 - protein, 81 aa, Gorilla gorilla
MLETYNHLVSLEIPSSKPKLIAQLERGEEPWREERKCPLDLCPDVVSLCCLGLSALARSRLTATSTSWVQAVLCLSLPISW

SEQ ID NO: 2407 - protein, 81 aa, Gorilla gorilla
MAVGLCKAMSQGLVTFRDVALDFSQEEWEWLKPSQKDLYRDVMLENYRNLVWLDWESWYEIEELSPKWFIDEDEISQEMVM

SEQ ID NO: 2408 - protein, 81 aa, Gorilla gorilla
MAVGLCKAMSQGLVTFRDVALDFSQEEWEWLKPSQKDLYRDVMLENYRNLVWLGDGCSCRSTLRTTVTAEASSSSSSIQAS

SEQ ID NO: 2409 - protein, 81 aa, Gorilla gorilla
MESVTFEDVAVEFIQEWALLDSARRSLCKYRMLDQCRTLASRGAGAVPEDAAGALHRREGDTMDSRGPASSPGAALVSGMH

SEQ ID NO: 2410 - protein, 81 aa, Gorilla gorilla
ASVSFQDVTVEFTQEEWQHLGPVERTLYRDVMLENYSLLVSVGYCITKPKVICTLEKGEEPWSLEDEFLNQRYPGYFKVDH

SEQ ID NO: 2411 - protein, 81 aa, Gorilla gorilla
MLENYSLLVSVGYCITKPKVICTLEKGEEPWSLEDEFLNQRYPGYFKVDHIKGIRKKQEKPLWQEIFINDADKTLSKEGQK

SEQ ID NO: 2412 - protein, 81 aa, Gorilla gorilla
APLPPRDPNGAGPEWREPGAVSFADVAVYFCREEWGCLRPAQRTLYRDVMRETYGHLSALGIGGKKPALISWVEEEAELWG

SEQ ID NO: 2413 - protein, 81 aa, Gorilla gorilla
APLPPRDPNGAGPEWRKPGAVSFADVAVYFSREEWGCLRPAQRALYRDVMRETYGHLGALGESPTCLPGPCASTGPAAPLG

SEQ ID NO: 2414 - protein, 81 aa, Gorilla gorilla
APLPPRDPNGAGPEWRKPGAVSFADVAVYFSREEWGCLRPAQRALYRDVMRETYGHLGALGVGGSKPALISWVEEKAELWD

SEQ ID NO: 2415 - protein, 81 aa, Gorilla gorilla
MAEEFVTLKDVGMDFTLGDWEQLGLEQGDTFWDTALDNCQDLFLLDPPRPNLTSHPDGGEDLEPLAGGSPEAPGPDVTETK

SEQ ID NO: 2416 - protein, 81 aa, Gorilla gorilla
MDFTLGDWEQLGLEQGDTFWDTALDNCQDLFLLDPPRPNLTSHPDGGEDLEPLAGGSPEAPGPDVTETKNSPLMEDFFEEG

SEQ ID NO: 2417 - protein, 81 aa, Gorilla gorilla
CFSQEERMAAGYLPRWSQELVTFEDVSVDFSQEEWELLEPAQKNLYREVMLENYRNVVSLEALKNQCTDVGIKEGPLSPAQ

SEQ ID NO: 2418 - protein, 81 aa, Gorilla gorilla
MLETFRNLASVDDETQFKASGSVSQQDIYGEKIPKESKIAAFTRNVSWASVLGKIWDSLSIEDQTTNQGRNLSRNHVLERL

SEQ ID NO: 2419 - protein, 81 aa, Gorilla gorilla
EKIPKESKIAAFTRNVSWASVLGKIWDSLSIEDQTTNQGRNLSRNHVLERLCESNDQCGEALSQIPHLNLYKKIPPGVKQY

SEQ ID NO: 2420 - protein, 81 aa, Gorilla gorilla
MDSVVFEDVAVDFTLEEWALLDSAQRDLYRDVMLETFRNLASVDDETQFKASGSVSQQDIYGEKIPKESKIAAFTRNVSWA

SEQ ID NO: 2421 - protein, 81 aa, Gorilla gorilla
MDTVVFEDVVVDFTLEEWPLLNPAQRKLYRDVMLETFKHLASVDNEAQLKASGSISQQATSGEKLSLKQKIEKFTRKNIWA

SEQ ID NO: 2422 - protein, 81 aa, Gorilla gorilla; identical to SEQ ID NO: 393

SEQ ID NO: 2423 - protein, 81 aa, Gorilla gorilla
GHTQGGELVNELLTSWLRGLVTFEDVAVEFTQEEWALLDPAQRTLYRDVMLENCRNLASLGCRVNKPSLISQLEQDKKVMT

SEQ ID NO: 2424 - protein, 81 aa, Gorilla gorilla
MGSIKEKMKAGSGTGKPQEPVTFKDVVVEFSKEEWGQLDSAVKNLYRNVMLENFRNLNSLRKAHLLSKPFESLKLESKKKR

SEQ ID NO: 2425 - protein, 81 aa, Gorilla gorilla
MAVTFEDVTIIFTWEEWKFLNSSQKRLYREVMWENYTNVMSVENWNESYKSQEEKFRYLEYENFSCWQGWWNAGAQMYENQ

SEQ ID NO: 2426 - protein, 81 aa, Gorilla gorilla
SRKNLSMEKEQKLIVQHSYIPVEEALPQYVGVIGQKDLLRDSMEEKYCGCNKCKEIYYWNSRCVFHKRNQPGENLYRCSIR

SEQ ID NO: 2427 - protein, 81 aa, Gorilla gorilla
MAATLLMAGSQAPVTFEDMAMYLTREEWRPLDAAQRDLYRDVMQENYGNVVSLDFEIRSENEVNPKQEISEDVQFGTTSER

SEQ ID NO: 2428 - protein, 81 aa, Gorilla gorilla
EEPWMAEKEGPGDPSSDLKSKIETIESTAKSAISQERLYHGIMMESFMRDDIIYSTLRKVSTYDDVLERHQETCVRDVRQA

SEQ ID NO: 2429 - protein, 81 aa, Gorilla gorilla
MISFQESVTFQDVAVDFTAEEWQLLDCAERTLYWDVMLENYRNLISVGCPITKTKVILKVEQGQEPWMVEGVNPHESSPES

SEQ ID NO: 2430 - protein, 81 aa, Gorilla gorilla
MISFQESVTFQDVAVDFTAEEWQLLDCAERTLYWDVMLENYRNLISVGCPITKTKVILKVEQGQEPWMVEGVNPHESSPGW

SEQ ID NO: 2431 - protein, 81 aa, Gorilla gorilla
FQFASDAHFSLKINVLLQESVTFQDVAVDFTAEEWQLLDCAERTLYWDVMLENYRNLISVGCPITKTKVILKVEQGQEPWM

SEQ ID NO: 2432 - protein, 81 aa, Gorilla gorilla
EDGPANMQKVRICSEGGWVPALFDEVAIYFSDEEWEVLTEQQKALYREVMRMNYETVLSLEFPFPKPDMITRLEGEEESQN

SEQ ID NO: 2433 - protein, 81 aa, Gorilla gorilla
MGLLAFRDVALEFSPEEWECLDPAQQSLYRDVMLENYRNLISLGLAMSKPELIICLEARKEPWNMNTEKTAKHSASSSYLT

SEQ ID NO: 2434 - protein, 81 aa, Gorilla gorilla
EARKEPWNMNTEKTAKHSASSSYLTEDILPEQGLQVSFQKVMLRRYERCCLEKLRLRNDWEIVVETGFHRVSQDGLDLLTS

SEQ ID NO: 2435 - protein, 81 aa, Gorilla gorilla
MGLLAFRDVALEFSPEEWECLDPAQQSLYRDVMLENYRNLISLGLAMSKPELIICLEARKEPWNMNTEKTAKHSVETRFRH

SEQ ID NO: 2436 - protein, 81 aa, Gorilla gorilla
ISLGLAMSKPELIICLEARKEPWNMNTEKTAKHSASSSYLTEDILPEQGLQVSFQKVMLRRYERCCLEKLRLRNDWEIVAM

SEQ ID NO: 2437 - protein, 81 aa, Gorilla gorilla
MGLLAFRDVALEFSPEEWECLDPAQQSLYRDVMLENYRNLISLGEDNFNMQFLFHSLAMSKPELIICLEARKEPWNMNTEK

SEQ ID NO: 2438 - protein, 81 aa, Gorilla gorilla
LFHSLAMSKPELIICLEARKEPWNMNTEKTAKHSASSSYLTEDILPEQGLQVSFQKVMLRRYERCCLEKLRLRNDWEIVAM

SEQ ID NO: 2439 - protein, 81 aa, Gorilla gorilla
RKEPWNMNTEKTAKHSASSSYLTEDILPEQGLQVSFQKVMLRRYERCCLEKLRLRNDWEIPCEDVLASPLPSAMIVSFLRP

SEQ ID NO: 2440 - protein, 81 aa, Gorilla gorilla
MDSVSFEDVAVAFTQEEWALLDPSQKNLYRDVMQEIFRNLASVGNKSEDQNILDDFKNPGRNLSSHVVERLFEIKEGSQYG

SEQ ID NO: 2441 - protein, 81 aa, Gorilla gorilla
MDSVAFEDVAVNFTQEEWALLDSSQKNLYREVMQETCSNLASVGSKWKDQNIEDHFEKPGKDIRNHMVQRLCESKEGGQCG

SEQ ID NO: 2442 - protein, 81 aa, Gorilla gorilla
RHFRRPEPCREPRASPTQDSVAFEDVAVNFTQEEWALLDSSQKNLYREVMQETCSNLASVGSKWKDQNIEDHFEKPGKDIR

SEQ ID NO: 2443 - protein, 81 aa, Gorilla gorilla
AEPLHPVCTCGRHFRRPEPCREPRASPTQDSVAFEDVAVNFTQEEWALLDSSQKNLYREVMQETCSNLASVEIIWYRDCVK

SEQ ID NO: 2444 - protein, 81 aa, Gorilla gorilla
NSFPQVILLPNPPKVLRLQGLLAFSDVVIEFSPEEWACLDPAQRNLYRDVMFENYRNLVSLAILCYSIQDLLPEQDMKDLC

SEQ ID NO: 2445 - protein, 81 aa, Gorilla gorilla
AQRNLYRDVMFENYRNLVSLAILCYSIQDLLPEQDMKDLCQKVTLTRHRSWGLDNLHLVKDWRTVNEGKGQKEYCNRLTQC

SEQ ID NO: 2446 - protein, 81 aa, Gorilla gorilla
MGLLAFSDVVIEFSPEEWACLDPAQRNLYRDVMFENYRNLVSLAILCYSIQDLLPEQDMKDLCQKVTLTRHRSWGLDNLHL

SEQ ID NO: 2447 - protein, 81 aa, Gorilla gorilla
QRNLYRDVMFENYRNLVSLAILCYSIQDLLPEQDMKDLCQKVTLTRHRSWGLDNLHLVKDWRTVNEGKGQKEYCNRLTQCS

SEQ ID NO: 2448 - protein, 81 aa, Gorilla gorilla
MAPRAQIQGPLTFGDVAVAFTRIEWRHLDAAQRALYRDVMLENYGNLVSVGLLSSKPKLITQLEQGAEPWTEMREAPSGTH

SEQ ID NO: 2449 - protein, 81 aa, Gorilla gorilla
RDVMLENYGNLVSVGLLSSKPKLITQLEQGAEPWTEMREAPSGTHAAQDCWLETKMSALKQSTSEGSVLGERTKSVMMEKG

SEQ ID NO: 2450 - protein, 81 aa, Gorilla gorilla
VMLENYSLLLSVGYCITKPEVVCKLEHGEVLWILEEESPSQSHLDCCIDDDLMEKRQENQDQHLQKVDSVNNKTLTMDRND

SEQ ID NO: 2451 - protein, 81 aa, Gorilla gorilla
MNKVDQKFQGSVSFKDVTVGFTQEEWQHLDPSQRALYRDVMLENYSNLVSVGYCAHKPEVIFRLQQGEEPWKLEEEFPSQS

SEQ ID NO: 2452 - protein, 81 aa, Gorilla gorilla
MANATRRESEVDQKFQGSVSFKDVTVGFTQEEWQHLDPSQRALYRDVMLENYSNLVSVGYCAHKPEVIFRLQQGEEPWKLE

SEQ ID NO: 2453 - protein, 81 aa, Gorilla gorilla
MSAVDQKFQGSVSFKDVTVGFTQEEWQHLDPSQRALYRDVMLENYSNLVSVGYCAHKPEVIFRLQQGEEPWKLEEEFPSQS

SEQ ID NO: 2454 - protein, 81 aa, Gorilla gorilla
HLDPSQRALYRDVMLENYSNLVSVGYCAHKPEVIFRLQQGEEPWKLEEEFPSQSFPEVWTADHLKERSQENQSKHLWEVVF

SEQ ID NO: 2455 - protein, 81 aa, Gorilla gorilla
MNKVEQKSQGSVSFKDVTVGFTQEEWQHLDPSQRALYRDVMLENYSNLVSVGYCVHKPEVIFRLQQGEEPWKLEEEFPSQS

SEQ ID NO: 2456 - protein, 81 aa, Gorilla gorilla
SNWMSSPLYSTEVEQKSQGSVSFKDVTVGFTQEEWQHLDPSQRALYRDVMLENYSNLVSVGYCVHKPEVIFRLQQGEEPWK

SEQ ID NO: 2457 - protein, 81 aa, Gorilla gorilla
SPSFQEHNKMNKVEQKSQGSVSFKDVTVGFTQEEWQHLDPSQRALYRDVMLENYSNLVSVGYCVHKPEVIFRLQQGEEPWK

SEQ ID NO: 2458 - protein, 81 aa, Gorilla gorilla
MNKFRGPVTLKDVIVEFTKEEWKLLTPAQRTLYKDVMLENYSHLVSVGYHVNKPNAVFKLKQGKEPWILEVEFPHRGFPED

SEQ ID NO: 2459 - protein, 81 aa, Gorilla gorilla
SNLVSVGYCITKPEVIFKIEQGEEPWILEKGFPSQCHPERKWKVDDVLESSQENEDDHFWELLFHNNKTLRFQLLGRKQFL

SEQ ID NO: 2460 - protein, 81 aa, Gorilla gorilla
MTLLTFRDVAIEFSLEEWKCLDLAQQNLYRDVMLENYRNLFSVGLTVSKPGLITCLEQRKEPWNVKRQEAADGHPAMSSCF

SEQ ID NO: 2461 - protein, 81 aa, Gorilla gorilla
SCFTQDLLPEQGIQDAFPKTILRGYGNCGLDNLYLRKDWESLDECKLQKDYNGLNQCSSTTHSKIFQYNKYVKIFDNFSNL

SEQ ID NO: 2462 - protein, 81 aa, Gorilla gorilla
SSCFTQDLLPEQGIQDAFPKTILRGYGNCGLDNLYLRKDWESLDECKLQKDYNGLNQCSSTTHSKIFQYNKYVKIFDNFSN

SEQ ID NO: 2463 - protein, 81 aa, Gorilla gorilla
VSVDKFTAMSSCFTQDLLPEQGIQDAFPKTILRGYGNCGLDNLYLRKDWESLDECKLQKDYNGLNQCSSTTHSKIFQYNKY

SEQ ID NO: 2464 - protein, 81 aa, Gorilla gorilla
VSKPGLITCLEQRKEPWNVKRQEAADGHPAMSSCFTQDLLPEQGIQDAFPKTILRGYGNCGLDNLYLRKDWESLDECKLQK

SEQ ID NO: 2465 - protein, 81 aa, Gorilla gorilla
PGLITCLEQRKEPWNVKRQEAADGHPEFHSITQAVVQWRHLSSLQPLPPGLEPSSHFSLLRTWNYRGTPAHPANFCVFNRD

SEQ ID NO: 2466 - protein, 81 aa, Gorilla gorilla
MHSLKKVTFEDVAIDFTQEEWAMMDTSKRKLYRDVMLENISHLVSLGYQISKSYIILQLEQGKELWQEGREFLQDQNPDRE

SEQ ID NO: 2467 - protein, 81 aa, Gorilla gorilla
INAEEERMIAVFLTTWLQEPMTFKDVAVEFTQEEWMMLDSAQRSLYRDVMLENYRNLTSVEYQLYRLTVISPLDQEEIRNM

SEQ ID NO: 2468 - protein, 81 aa, Gorilla gorilla
MLWSQPCLLLTLSYFQGLLSFKDISMEFTWDEWQLLDSTQKYLYRDVILENYHNLISVGYHGTKPDLIFKLEQGEDPWIIN

SEQ ID NO: 2469 - protein, 81 aa, Gorilla gorilla
MIQSQISFEDVAVDFTVEEWQLLNPTQKNLYRDVMLENYSNLVFLEVWLDNPKMWLRDNQDNLKSMERGHKYDVFGKIFNS

SEQ ID NO: 2470 - protein, 81 aa, Gorilla gorilla
MIQSQISFEDVAVDFTVEEWQLLNPTQKNLYRDVMLENYSNLVFLGFQILKPDAIFKLEQQDPWIIDQEILNQNFSEVWLD

SEQ ID NO: 2471 - protein, 81 aa, Gorilla gorilla
MKPRTLAISFEDVAVDFTVEEWQLLNPTQKNLYRDVMLENYSNLVFLEVWLDNPKMWLRDNQDNLKSMERGHKYDVFGKIF

SEQ ID NO: 2472 - protein, 81 aa, Gorilla gorilla
MKPRTLAISFEDVAVDFTVEEWQLLNPTQKNLYRDVMLENYSNLVFLGFQILKPDAIFKLEQQDPWIIDQEILNQNFSEVW

SEQ ID NO: 2473 - protein, 81 aa, Gorilla gorilla
EGRTRDRQMAAALLTAWSQMPVTFEDVALYLSREEWGRLDHTQQNFYRDVLQKKNGLSLGFPFSRPFWAPQAHGKGEASGS

SEQ ID NO: 2474 - protein, 81 aa, Gorilla gorilla
EGRTRDRQMAAALLTAWSQMPVTFEDVALYLSREEWGRLDHTQQNFYRDVLQKKNGLSLGAVEVGQRVQTSSVAALGNVKP

SEQ ID NO: 2475 - protein, 81 aa, Gorilla gorilla
LKEGRTGETTDTCFVSGVHGPVALGDIPFYFSREEWGTLDPAQRDLFWDIKRENSRNTTLGFRLKGQSEKSLLQEVVPVVP

SEQ ID NO: 2476 - protein, 81 aa, Gorilla gorilla
SRNTTLGFRLKGQSEKSLLQEVVPVVPGQTSSDVTVSWSPEEADAWESENRPRAALGPVVGARRGRPPTRRRQFRDLAAEK

SEQ ID NO: 2477 - protein, 81 aa, Gorilla gorilla
RPLVKLLPKGVQKEQETVCLYLKANPELVVFEDLNVFHCQEECVSLDPTQQLTSEKEDDSSVGEMMLLAVNGSNPEGEDPE

SEQ ID NO: 2478 - protein, 81 aa, Gorilla gorilla
PLVKLLPKGVQKEQETVCLYLKANPEELVVFEDLNVFHCQEECVSLDPTQQLTSEKEDDSSVGEMMLLAVNGSNPEGEDPE

SEQ ID NO: 2479 - protein, 81 aa, Gorilla gorilla
PLVKLLPKGVQKEQETVCLYLKANPEELVVFEDLNVFHCQEECVSLDPTQQLTSEKEDDSSVGEMMLLVNGSNPEGEDPER

SEQ ID NO: 2480 - protein, 81 aa, Gorilla gorilla
LFPPEGNVEDKEMTGPQLPESLEDVAMYISQEEWGRQDPSKRALSRDTVQESYENVDSLESHIPSQEVPGTQVGQGGKLWD

SEQ ID NO: 2481 - protein, 81 aa, Gorilla gorilla
MYFSQEEWELLDPTQKALYNDVMQENYETVISLALFVLPKPKVISCLEQGEEPWVQVSPEFKDSAGKSPTGLKLKNNTENR

SEQ ID NO: 2482 - protein, 81 aa, Gorilla gorilla
AVPTQQILAFPEQTNTKDWTVTPEHVLPESQSLLTFEEVAMYFSQEEWELLDPTQKALYNDVMQENYETVISLGQCSPFLP

SEQ ID NO: 2483 - protein, 81 aa, Gorilla gorilla
TCDNRAVSLCQQEWMCPGPAQRTLYRGATQRKDRHVSLATGVPWGYEETKTLLAILSSSQFYGKLQTCQQNSQIYRAMAEG

SEQ ID NO: 2484 - protein, 81 aa, Gorilla gorilla
QNTGLHDQETGAVVWTAGSQGPATCDNRAVSLCQQEWMCPGPAQRTLYRGATQRKDRHVSLATGVPWGYEETKTLLAILSS

SEQ ID NO: 2485 - protein, 81 aa, Gorilla gorilla
MASMPPTPEAQGPILFEDLAVYFSQEECVTLHPAQRSLSKDGTKESLEDAALMGEEGKPEINQQLNLESMELDELALEKYP

SEQ ID NO: 2486 - protein, 81 aa, Gorilla gorilla
WPERGPPAPRHQEMTSASPFLSAWSQVPVNLADVAVYLSGEEPRCLDPAQRDAPLENEGPGIQLEDGGDGREDAPVRMEWY

SEQ ID NO: 2487 - protein, 81 aa, Gorilla gorilla
WPERGPPAPRHQEMTSASPFLSAWSQVPVNLADVAVYLSGEEPRCLDPAQRDAPLENEGPGIQLEDGGDGREDAPVRMERE

SEQ ID NO: 2488 - protein, 81 aa, Gorilla gorilla
EPGSLHSGHQEQLNRKRERRPLPKNARPSAWVPALADEWNTLDQEVTTTRLPAGSQEPVKDVHVARGFSYRKNVHQIPAQR

SEQ ID NO: 2489 - protein, 81 aa, Gorilla gorilla
NTLDQEVTTTRLPAGSQEPVKDVHVARGFSYRKNVHQIPAQRDLYRDFRKENVGNVVSLGSAVSTSNKITRLEQRKEPWTL

SEQ ID NO: 2490 - protein, 81 aa, Gorilla gorilla
MGLLTFRDVAIEFSREEWEHLDSDQKLLYGDVMLENYGNLVSLGLAVSKPDLITFLEQRKEPWNVKSAETVAIQPEVKANT

SEQ ID NO: 2491 - protein, 81 aa, Gorilla gorilla
MGLLTFRDVAIEFSREEWEHLDSDQKLLYGDVMLENYGNLVSLGLAVSKPDLITFLEQRKEPWNVKSAETVAIQPVARFFV

SEQ ID NO: 2492 - protein, 81 aa, Gorilla gorilla
PDLITFLEQRKEPWNVKSAETVAIQPDIFSHDTQGLLRKKLIEASFQKVILDGYGSCGRQNLNLRKEWESEEKNQYNKSDT

SEQ ID NO: 2493 - protein, 81 aa, Gorilla gorilla
SVTFKDVSVDFTQEEWYHVDPAQRSLYRDVMLENYSHLVSLGYQVSKPEVIFKLEQGEEPWISEGEIQRPFYPAVYFNRKE

SEQ ID NO: 2494 - protein, 81 aa, Gorilla gorilla
MLENYGNVASLGFPLLKPAVISQLEGGGELGGPSPLAAGTGLQGLQTDIQTDNDLTKEMYEGKENVSFELQRDFSQETDFS

SEQ ID NO: 2495 - protein, 81 aa, Gorilla gorilla
MAAMHLTAWPQKSVTFEDVAVYFTQAEWDGLSPAQRALYRDVMLENYGNVASLGFPLLKPAVISQLEGGGELGGPSPLAAG

SEQ ID NO: 2496 - protein, 81 aa, Gorilla gorilla
MLENYGNVASLGFPLLKPAVISQLEGGGELGGPSPLAAGTGLQGLQTDGVSLCRPNWSAVARTWLTATSVSRVAILLPHPP

SEQ ID NO: 2497 - protein, 81 aa, Gorilla gorilla
MHLTAWPQKSVTFEDVAVYFTQAEWDGLSPAQRALYRDVMLENYGNVASLGFPLLKPAVISQLEGGGELGGPSPLAAGTGL

SEQ ID NO: 2498 - protein, 81 aa, Gorilla gorilla
MLENYGNVASLGFPLLKPAVISQLEGGVDIQTDNDLTKEMYEGKENVSFELQRDFSQETDFSEASLLEKQQEVHSAGNIKK

SEQ ID NO: 2499 - protein, 81 aa, Gorilla gorilla
SQLEGGVDIQTDNDLTKEMYEGKENVSFELQRDFSQETDFSEASLLEKQQEVHSAGNIKKEKSNTIDGTVKDETSPVEECF

SEQ ID NO: 2500 - protein, 81 aa, Gorilla gorilla
MAAMPLKARYQEMVTFEDVAVHFTKTEWTGLSPAQRALYRSVMLENFGNLTALGYPVPKPALISLLEGGDMAWGLEAQDDP

SEQ ID NO: 2501 - protein, 81 aa, Gorilla gorilla
MPLKARYQEMVTFEDVAVHFTKTEWTGLSPAQRALYRSVMLENFGNLTALGYPVPKPALISLLEGGDMAWGLEAQDDPPAE

SEQ ID NO: 2502 - protein, 81 aa, Gorilla gorilla
EQTQAAGMVAGCLINCYQDSVTFDDVAVDFTQEEWTLLDPSQRDLYRDVMLENYENLASVGHHLFKPSVIYWLEEEEELRA

SEQ ID NO: 2503 - protein, 81 aa, Gorilla gorilla
MAAPDLAHGGHVSRDSVCLHEEQTQAAGMVAGCLINCYQDSVTFDDVAVDFTQEEWTLLDPSQRDLYRDVMLENYENLASV

SEQ ID NO: 2504 - protein, 81 aa, Gorilla gorilla
EQTQAAGMVAGCLINCYQDSVTFDDVAVDFTQEEWTLLDPSQRDLYRDVMLENYENLASVEWRLKTKGPALRQDRSWFRTS

SEQ ID NO: 2505 - protein, 81 aa, Gorilla gorilla
MLENYENLASVGHHLFKPSVIYWLEEEEELRAGRRGVLQEWRLKTKGPALRQDRSWFRTSNETQTARSHNGGQLCDHTQCG

SEQ ID NO: 2506 - protein, 81 aa, Gorilla gorilla
SQEESPEGDTERTERKPMVKDAFKDISIYFTKEEWAEMGDWEKTRYRNVKRNYNALITIGLRATRPVFMCHRRQAIKLQVD

SEQ ID NO: 2507 - protein, 81 aa, Gorilla gorilla
VKRNYNALITIGLRATRPVFMCHRRQAIKLQVDDTEDSDEEWTPRQQVKPPWMAFRGEQSKHQKIVRCVRTSSLTAVLLMG

SEQ ID NO: 2508 - protein, 81 aa, Gorilla gorilla
LQGKYGNVTKEVIVLYLTLCKQCHQKNPVPKRGLAPKPMTFKDIDSTCQVEILDMQSSADGEFKFILYYQDHSTKFIILRP

SEQ ID NO: 2509 - protein, 81 aa, Gorilla gorilla
FSPGPKTVWSLWQQPVLFQEATAFENMTKDWNYLEGSQKDCYRDTMLDSYENTVPQGSFLQFSMMPQRAGNDPPGVSNASE

SEQ ID NO: 2510 - protein, 81 aa, Gorilla gorilla
ASQPARLEERLIRDQDLGASLLPAAPQEQWRHLDSTQKEQYWDLMLETYGKMVSGGARQENDKENLNLENHRDQELLHASC

SEQ ID NO: 2511 - protein, 81 aa, Gorilla gorilla
AASQPARLEERLIRDQDLGASLLPAAPQWRHLDSTQKEQYWDLMLETYGKMVSGGISHPKSDLTNSIEFGEELAGLYLHVS

SEQ ID NO: 2512 - protein, 81 aa, Gorilla gorilla
MELLTFRDVAIEFSPEEWKCLDPAQQNLYRDVMLENYRNLVSLAVYSYYNQGILPEQGIEDLFKKATLGRYGSCGLENICL

SEQ ID NO: 2513 - protein, 80 aa, Gorilla gorilla
MELLTFRDVAIEFSPEEWKCLDPAQQNLYRDVMLENYRNLVSLELHAERHQRTDGYFISLGEGQVYHAVMAIPASIRVWV

SEQ ID NO: 2514 - protein, 81 aa, Gorilla gorilla
GHTEGGELVNELLRSWLKGLVTFEDVAVEFTQEEWALLDPAQRTLYRDVMLENCRNLASLGNQVDKPSLISQLEQEDKVMT

SEQ ID NO: 2515 - protein, 81 aa, Gorilla gorilla
DLFACSGLEPHTPSVGSQESVTFQDVAVDFTEKEWPLLDSSQRKLYKDVMLENYSNLTSLGYQVGKPSLISHLEQEEEPRT

SEQ ID NO: 2516 - protein, 81 aa, Gorilla gorilla
DLFACSGLEPHTPSVGSQESVTFQDVAVDFTEKEWPLLDSSQRKLYKDVMLENYSNLTSLDWETPSKTKWSLLMEDIFGKE

SEQ ID NO: 2517 - protein, 81 aa, Gorilla gorilla
SSKDRSCPQNLDLFACSGLEPHTPSVGSQESVTFQDVAVDFTEKEWPLLDSSQRKLYKDVMLENYSNLTSLEILAPPFCCS

SEQ ID NO: 2518 - protein, 81 aa, Gorilla gorilla
QEKTVERVVADCLTNCYQDSVTFDDLAVDFTPEEWTLLDPTQRNLYRDVMLENYKNLATVGYQLFKPSLISWLEQEESRTV

SEQ ID NO: 2519 - protein, 81 aa, Gorilla gorilla
SRTESLVEFPEGVEPVVLDSVTFDDLAVDFTPEEWTLLDPTQRNLYRDVMLENYKNLATVGYQLFKPSLISWLEQEESRTV

SEQ ID NO: 2520 - protein, 81 aa, Gorilla gorilla
MAYCLTSCYQDSVTFEDTAVDFTQEEWTLLDPVQRNLYRDVMLENYENVAKVGFQLLKPSVISWLEEEVLRTLQQGVLQDW

SEQ ID NO: 2521 - protein, 81 aa, Gorilla gorilla
EKTPAGRIVADCLTNCYQDSVTFDDVAVDFTQEEWTLLDSTQRSLYSDVMLENYKNLATVGGQIIKPSLISWLEQEESRTV

SEQ ID NO: 2522 - protein, 81 aa, Gorilla gorilla
MDSVTFDDVAVDFTQEEWTLLDSTQRSLYSDVMLENYKNLATVGGQIIKPSLISWLEQEESRTVQGGVLRGWEMRLETQWS

SEQ ID NO: 2523 - protein, 81 aa, Gorilla gorilla
EKTKVERMVEDYLANGYQDSVTFDDVAVDFTPEEWALLDTTEKYLYRDVMLENYMNLASVEWEIQPRTKRSSLQQGFLKNQ

SEQ ID NO: 2524 - protein, 81 aa, Gorilla gorilla
FFSREPICPFEEKTKVERMVEDYLANGYQDSVTFDDVAVDFTPEEWALLDTTEKYLYRDVMLENYMNLASVDKRLQWMETL

SEQ ID NO: 2525 - protein, 81 aa, Gorilla gorilla
MDSVTFDDVAVEFTPEEWALLDTTQKYLYRDVMLENYMNLASVDFFFCLTSEWEIQPRTKRSSLQQGFLKNQIFTGIQMQT

SEQ ID NO: 2526 - protein, 81 aa, Gorilla gorilla
MDSSQHLVTFEDVAVDFTQEEWTLLDQAQRDLYRDVMLENYKNLIILAGSELCKLSLMSGLEQMEELRTGVTGVLQGEKQY

SEQ ID NO: 2527 - protein, 81 aa, Gorilla gorilla
MDSSQHLVTFEDVAVDFTQEEWTLLDQAQRDLYRDVMLENYKNLIILAGSELCKLSLMSGLEQMEELRTGVTGVLQELDLQ

SEQ ID NO: 2528 - protein, 81 aa, Gorilla gorilla
MDSSQHLVTFEDVAVDFTQEEWTLLDQAQRDLYRDVMLENYKNLIILGSELCKLSLMSGLEQMEELRTGVTGVLQELDLQL

SEQ ID NO: 2529 - protein, 81 aa, Gorilla gorilla
MDSVAFEDVAVNFTQEEWALLGPSQKSLYRNVMQETIRNLDCVEMKWEDQNIGDQCQNAKRNLRSHTCEIKDDSQCGETFG

SEQ ID NO: 2530 - protein, 81 aa, Gorilla gorilla
MDSVAFEDVAINFTCEEWALLGPSQKSLYRDVMQETIRNLDCIGMIWQNQDIEEDEYKDLRRNLRCHMVERSCEIKDDSQC

SEQ ID NO: 2531 - protein, 81 aa, Gorilla gorilla
MDPVAFKDVAVNFTQEEWALLDISQRKLYREVMLETFRNLTSIGKSWKDQNIEYEYQNPRRNFRSLIEEKVNEIKDDSHCG

SEQ ID NO: 2532 - protein, 81 aa, Gorilla gorilla
MMFQDPVAFKDVAVNFTQEEWALLDISQRKLYREVMLETFRNLTSIGKSWKDQNIEYEYQNPRRNFRSLIEEKVNEIKDDS

SEQ ID NO: 2533 - protein, 81 aa, Gorilla gorilla
MFQDPVAFKDVAVNFTQEEWALLDISQRKLYREVMLETFRNLTSIGKSWKDQNIEYEYQNPRRNFRSLIEEKVNEIKDDSH

SEQ ID NO: 2534 - protein, 81 aa, Gorilla gorilla
MFQDPVAFKDVAVNFTQEEWALLDISQKNLYREVMLETFWNLTSIGKKWKDQNIEYEYQNPRRNFRSVIEEKVNEIKQDSH

SEQ ID NO: 2535 - protein, 81 aa, Gorilla gorilla
MPCCSHRRCREDPGTSESQEMEEWALLDISQRKLYREVMLETFRNLTSIGKSWKDQNIEYEYQNPRRNFRSLIEEKVNEIK

SEQ ID NO: 2536 - protein, 81 aa, Gorilla gorilla
RSCREDPGTSESREMMFQDPVAFEDVAVNFTQEEWTLLDISQKNLFREVMLETFRNLTSIGKKWNDQNIEYEYQDPRRSFR

SEQ ID NO: 2537 - protein, 81 aa, Gorilla gorilla
CSHRSCREDPGTSESREMDPVAFEDVAVNFTQEEWTLLDISQKNLFREVMLETFRNLTSIGKKWNDQNIEYEYQDPRRSFR

SEQ ID NO: 2538 - protein, 81 aa, Gorilla gorilla
PNYFPEMSTSNTILGMFQDPVAFEDVAVNFTQEEWTLLDISQKNLFREVMLETFRNLTSIGKKWNDQNIEYEYQDPRRSFR

SEQ ID NO: 2539 - protein, 81 aa, Gorilla gorilla
SSNPNYFPEMSTSNTILGDPVAFEDVAVNFTQEEWTLLDISQKNLFREVMLETFRNLTSIGKKWNDQNIEYEYQDPRRSFR

SEQ ID NO: 2540 - protein, 81 aa, Gorilla gorilla
MFQDPVAFEDVAVNFTQEEWTLLDISQKNLFREVMLETFRNLTSIGKKWNDQNIEYEYQDPRRSFRSLIEEKVNEIKEDSH

SEQ ID NO: 2541 - protein, 81 aa, Gorilla gorilla
CSHRSCREDPGTSESREMDPVAFEDVAVNFTQEEWALLDISQRKLYREVMLETFRNLTSEGKKWKDQNIEYEYQNPRRNFR

SEQ ID NO: 2542 - protein, 81 aa, Gorilla gorilla
MPCCSHRSCREDPGTSESREMRPESSDCKLRPMRNLQREVIESSHQAQWLTPVIPALWEAKADGASQMFQDPVAFEDVAVN

SEQ ID NO: 2543 - protein, 81 aa, Gorilla gorilla
NLQREVIESSHQAQWLTPVIPALWEAKADGASQMFQDPVAFEDVAVNFTQEEWALLDISQRKLYREVMLETFRNLTSEGVS

SEQ ID NO: 2544 - protein, 81 aa, Gorilla gorilla
MDPVAFEDVAVNFTQEEWALLDISQRKLYREVMLETFRNLTSEGKKWKDQNIEYEYQNPRRNFRSLIEEKVNEIKEDSHCG

SEQ ID NO: 2545 - protein, 81 aa, Gorilla gorilla
PPVLSLSPILLYACEMFQDPVAFEDVAVNFTQEEWALLDISQRKLYREVMLETFRNLTSEGKKWKDQNIEYEYQNPRRNFR

SEQ ID NO: 2546 - protein, 81 aa, Gorilla gorilla
MMFQDSVAFKDVAVTFTQEEWALLDPSQKNLYRDVMQETFRNLASIGKKWKHQNIYVEYENLRRNLRIVGERLFESKEGHQ

SEQ ID NO: 2547 - protein, 81 aa, Gorilla gorilla
MDSVAFKDVAVTFTQEEWALLDPSQKNLYRDVMQETFRNLASIGKKWKHQNIYVEYENLRRNLRIVGERLFESKEGHQHGE

SEQ ID NO: 2548 - protein, 81 aa, Gorilla gorilla
MLVLSILLYTCEMFQDSVAFKDVAVTFTQEEWALLDPSQKNLYRDVMQETFRNLASIGKKWKHQNIYVEYENLRRNLRIVG

SEQ ID NO: 2549 - protein, 81 aa, Gorilla gorilla
MDSVAFEDVAVNPQEEWSLLDPSQKNLYREVMQETLRNLASIGEKLKDQNIEDQYKNPRNNLRSLLGKRVDENTEENHCGE

SEQ ID NO: 2550 - protein, 81 aa, Gorilla gorilla
MDSVAFEDVAVSFTQEEWALLDPSQKNLYRDVMQETFKNLTSVGKTWKVQNIEDEYKNPRRNLRRSFTLVAQAGVQRRDLG

SEQ ID NO: 2551 - protein, 81 aa, Gorilla gorilla
MDSVVFEDVDVNFTQEEWALLDPSQKNLYRDVMQETFRNLASVGKKWKDQKIEDEYKNPRRNLSLRKWSWSLYPRQTLGLD

SEQ ID NO: 2552 - protein, 81 aa, Gorilla gorilla
DSVVFEDVDVNFTQEEWALLDPSQKNLYRDVMQETFRNLASVGKKWKDQKIEDEYKNPRRNLSLRKWSWSLYPRQTLGLDS

SEQ ID NO: 2553 - protein, 81 aa, Gorilla gorilla
MDSVVFEDVDVNFTQEEWALLDPSQKNLYRDVMQETFRNLASVGKKWKDQKIEDEYKNPRRNLRGLTGERLLESKKDHQHG

SEQ ID NO: 2554 - protein, 81 aa, Gorilla gorilla
MDSVAFEDVDVNFTQEEWALLDPSQKNLYRDVMWETMRNLASVGKKWKDQNIKDHYKHRGRNLRSHMLERLYQTKDGSQRG

SEQ ID NO: 2555 - protein, 81 aa, Gorilla gorilla
MDSAAFEDVAVNFTQEEWALLDPWQKKLYRDVMLETYRNLASVGKKCEEHNIEDQSKNQERSLRHIRSHTGHKPYECQDYE

SEQ ID NO: 2556 - protein, 81 aa, Gorilla gorilla
TLPRGQPEVLEWGLPKDQDSVAFEDVAVNFTHEEWALLGPSQKNLYRDVMRETIRNLNCIGMKWENQNIDDQYQNLRRNPR

SEQ ID NO: 2557 - protein, 81 aa, Gorilla gorilla
KNLYRDVMRETIRNLNCIGMKWENQNIDDQYQNLRRNPRLSETWLQNFILIHYGHLVALSDGGLLQFSTGQGLPVTQAGVQ

SEQ ID NO: 2558 - protein, 81 aa, Gorilla gorilla
MDSVAFEDVAVNFTHEEWALLGPSQKNLYRDVMRETIRNLNCIGMKWENQNIDDQYQNLRRNPRCDVVERFGKSKDGSQCG

SEQ ID NO: 2559 - protein, 81 aa, Gorilla gorilla
MDAVAFEDVAVNFTQEEWALLGPSQKNLYRYVMQETIRNLDCIRMIWEEQNTEDQYKNPRRNLRCHMVERFSESKDSSQCG

SEQ ID NO: 2560 - protein, 81 aa, Gorilla gorilla
HTHKQRGKAFSYHHSFQSRGRPHTGKKRYECKECGKTFSSRRNLRRHMVVQGGNRPYKFPIEDMRECTLGRNRMNVSSVLK

SEQ ID NO: 2561 - protein, 81 aa, Gorilla gorilla
RNDFFLPDSQTNEERKQYDSVAFEDVAVNFTQEEWALLGPSQKSLYRDVMWETIRNLDCIGMKWEDTNIEDQHKNPRRSLR

SEQ ID NO: 2562 - protein, 81 aa, Gorilla gorilla
MASVALEDVAVNFTREEWALLGPCQKNLYKDVMQETIRNLDCVGMKWKDQNIEDQYRYPRKNLRCRVLERFVESKGGSQCG

SEQ ID NO: 2563 - protein, 81 aa, Gorilla gorilla
ASVALEDVAVNFTREEWALLGPCQKNLYKDVMQETIRNLDCVGMKWKDQNIEDQYRYPRKNLRCRVLERFVESKGGSQCGE

SEQ ID NO: 2564 - protein, 81 aa, Gorilla gorilla
SDQRRRSKEARTPGSRDADSVVFEDVAVNFTQEEWALLGPSQKKLYRDVMQETFVNLASIGENWEEKNIEDHKNQGRKLRS

SEQ ID NO: 2565 - protein, 81 aa, Gorilla gorilla
VLQMQNSEHHGQSIKTQTDSISLEDVAVNFTLEEWALLDPGQRNIYRDVMRATFKNLACIGEKWKDQDIEDEHKNQGRNIR

SEQ ID NO: 2566 - protein, 81 aa, Gorilla gorilla
MDSISLEDVAVNFTLEEWALLDPGQRNIYRDVMRATFKNLACIGEKWKDQDIEDEHKNQGRNIRSPMVEALCENKEDCPCG

SEQ ID NO: 2567 - protein, 81 aa, Gorilla gorilla
MDSVAFEDVAVNFTQEEWALLSPSQKNLYRDVTLETFRNLASVGIQWKDQDIENLYQNLGIKLRSLVERLCGRKEGSEHRE

SEQ ID NO: 2568 - protein, 81 aa, Gorilla gorilla
MDSVSFEDVAVNFTLEEWALLDSSQKKLYEDVMQETFKNLVCLGKKWEDQDIEDDHRNQGRNRRCHMVERLCESRKGSKCG

SEQ ID NO: 2569 - protein, 81 aa, Gorilla gorilla
MGPLQFRDVAIEFSLEEWHCLDAAQRNLYRDVMLENYRNLIFLGIVVSKPNLITCLEQGKKPLTMKRHEMIAKPPVMCSHF

SEQ ID NO: 2570 - protein, 81 aa, Gorilla gorilla
LRRYEKCRHDNLQLKKGCESVDECPVHKRGYNGLKQCLTTTQRKIFQCDEYVKFLHKFSNSNKHKIRDTGKKPFKCIEYGK

SEQ ID NO: 2571 - protein, 81 aa, Gorilla gorilla
MGPLQFRDVAIEFSLEEWHCLDAAQRNLYRDVMLENYRNLIFLGIVVSKPNLITCLEQGKKPLTMKRHEMIAKPPGQARWL

SEQ ID NO: 2572 - protein, 81 aa, Gorilla gorilla
MGPLQFRDVAIEFSLEEWHCLDAAQRNLYRDVMLENYRNLIFLGIVVSKPNLITCLEQGKKPLTMKRHEMIAKPPDGVLVF

SEQ ID NO: 2573 - protein, 81 aa, Gorilla gorilla
MGPLQFRDVAIEFSLEEWHCLDAAQRNLYRDVMLENYRNLIFLVMCSHFAQDLWSEQSIKDSFQKVILRRYEKCRHDNLQL

SEQ ID NO: 2574 - protein, 81 aa, Gorilla gorilla
MGPLQFRDVAIEFSLEEWHCLDAAQRNLYRDVMLENYRNLIFLGIVVSKPNLITCLEQGKKPLTMKRHEMIAKPPETGFHR

SEQ ID NO: 2575 - protein, 81 aa, Gorilla gorilla
LRRYEKCRHDNLQLKKGCKSMGEHKVHKGGYNGLNQCLTTTQKEIFQCDKYGKVFHKFSNSNTYKTRHTGINLFKCIECGK

SEQ ID NO: 2576 - protein, 81 aa, Gorilla gorilla
MGPLQFKDVAIEFSLEEWHCLDTAQRNLYRDVMLENYRNLVFLGIVVSKPDLIARLEQGKKPLTMKRHEMVANPSGPGVVV

SEQ ID NO: 2577 - protein, 81 aa, Gorilla gorilla
MGPLQFKDVAIEFSLEEWHCLDTAQRNLYRDVMLENYRNLVFLGIVVSKPDLIARLEQGKKPLTMKRHEMVANPSVICSHF

SEQ ID NO: 2578 - protein, 81 aa, Gorilla gorilla
MGPLQFKDVAIEFSLEEWHCLDTAQRNLYRDVMLENYRNLVFLGIVVSKPDLIARLEQGKKPLTMKRHEMVANPSDEVNLC

SEQ ID NO: 2579 - protein, 81 aa, Gorilla gorilla
MGPLQFKDVAIEFSLEEWHCLDTAQRNLYRDVMLENYRNLVFLGIVVSKPDLIARLEQGKKPLTMKRHEMVANPSGARLLF

SEQ ID NO: 2580 - protein, 81 aa, Gorilla gorilla
MAGSQELLTFRDVTIEFSLEEWEFLNPAQQSLYRKVMLENYRNLVSLGLTVSKPELISCLEQRQEPWNVKRHETIAKPPAM

SEQ ID NO: 2581 - protein, 81 aa, Gorilla gorilla
EQGMQDSFQKVILRRYGSCGLEDLHLRKDGENVGECKDQKEIYNGLNQCLSTLPSKIFPYNKCVKVFSKSSNLNRENRRHT

SEQ ID NO: 2582 - protein, 81 aa, Gorilla gorilla
MGPLEFRDVAIEFSLEEWHCLDTAQRNLYRDVMLENYRNLIFLGIVVTKPDLITCLEQGKKPFTVKRHEMIAKPPDGVHFL

SEQ ID NO: 2583 - protein, 81 aa, Gorilla gorilla
MGPLEFRDVAIEFSLEEWHCLDTAQRNLYRDVMLENYRNLIFLGIVVTKPDLITCLEQGKKPFTVKRHEMIAKPPVMCFHF

SEQ ID NO: 2584 - protein, 81 aa, Gorilla gorilla
MAESGPLEFRDVAIEFSLEEWHCLDTAQRNLYRDVMLENYRNLIFLGIVVTKPDLITCLEQGKKPFTVKRHEMIAKPPVMC

SEQ ID NO: 2585 - protein, 81 aa, Gorilla gorilla
MPGPLRSLEMESLQFRDVAVEFSLEEWHCLDTAQRNLYRDVMLENYRHLVFLGIIVSKPDLITCLEQGIKPLTMKRHEMIA

SEQ ID NO: 2586 - protein, 81 aa, Gorilla gorilla
MGPLQFRDVAIEFSLEEWHCLDTAQQNLYRDVMLENYRNLVFLGIVVSKPDFITCLEQGKKPLTMKKHEMVANPSVTCSHF

SEQ ID NO: 2587 - protein, 81 aa, Gorilla gorilla
MGPLQFRDVAIEFSLEEWHCLDTAQQNLYRDVMLENYRNLVFLGIVVSKPDFITCLEQGKKPLTMKKHEMVANPSETGFHH

SEQ ID NO: 2588 - protein, 81 aa, Gorilla gorilla
MGPLQFRDVAIEFSLEEWHCLDTAQRNLYRDVMLENYRNLIFLGITVSKPDLITCLEQGKKPLTMKRNEMMAKPSVMCSHF

SEQ ID NO: 2589 - protein, 81 aa, Gorilla gorilla
MGPLQFRDVAIEFSLEEWHCLDTAQRNLYRDVMLENYRNLIFLGITVSKPDLITCLEQGKKPLTMKRNEMMAKPSVSFLQV

SEQ ID NO: 2590 - protein, 81 aa, Gorilla gorilla
MGPLTFRDVAIEFSLKEWQCLDTAQRNLYRNVMLENYRNLVFLGIAVSKPDLITCLEQGKEAWSMKRHEIMVAKPTVMCSH

SEQ ID NO: 2591 - protein, 81 aa, Gorilla gorilla
MGPLTFRDVAIEFSLKEWQCLDTAQRNLYRNVMLENYRNLVFLDLITCLEQGKEAWSMKRHEIMVAKPTVMCSHFDQDLWP

SEQ ID NO: 2592 - protein, 81 aa, Gorilla gorilla
MGPLTFRDVAIEFSLKEWQCLDTAQRNLYRNVMLENYRNLVFLGIAVSKPDLITCLEQGKEAWSMKRHEIMVAKPTESYSV

SEQ ID NO: 2593 - protein, 81 aa, Gorilla gorilla
MGPLTFRDVAIEFSLKEWQCLDTAQRNLYRNVMLENYRNLVFLGIAVSKPDLITCLEQGKEAWSMKRHEIMVAKPTGEVSR

SEQ ID NO: 2594 - protein, 81 aa, Gorilla gorilla
MGPLTFRDVAIEFSLKEWQCLDTAQRNLYRNVMLENYRNLVFLGIAVSKPDLITCLEQGKEAWSMKRHEIMVAKPTGCLSK

SEQ ID NO: 2595 - protein, 81 aa, Gorilla gorilla
ASGCPGADRNLLVYSFYEKGPLTFRDVAIEFSLEEWQCLDTAQQDLYRKVMLENYRNLVFLAGIAVSKPDLITCLEQGKEP

SEQ ID NO: 2596 - protein, 81 aa, Gorilla gorilla
SGCPGADRNLLVYSFYEKGPLTFRDVAIEFSLEEWQCLDTAQQDLYRKVMLENYRNLVFLGIAVSKPDLITCLEQGKEPWS

SEQ ID NO: 2597 - protein, 81 aa, Gorilla gorilla
MNVMLENYKNLVFLGIAVSKQDQITSLEQEKEPWNMKICEMVDESPGQVWWLTPVIPALWEARAGGLLEPRSLRPAWSTWK

SEQ ID NO: 2598 - protein, 81 aa, Gorilla gorilla
MNVMLENYKNLVFLAGIAVSKQDQITSLEQEKEPWNMKICEMVDESPAMCSYFTRDLWPEQDIKDSFQQVILRRHGKCEHE

SEQ ID NO: 2599 - protein, 81 aa, Gorilla gorilla
MNVMLENYKNLVFLGIAVSKQDQITSLEQEKEPWNMKICEMVDESPGYMCRMSYVFLFYQRPLARARHKRFFSTSDTEKTW

SEQ ID NO: 2600 - protein, 81 aa, Gorilla gorilla
MNVMLENYKNLVFLGIAVSKQDQITSLEQEKEPWNMKICEMVDESPAMCSYFTRDLWPEQDIKDSFQQVILRRHGKCEHEN

SEQ ID NO: 2601 - protein, 81 aa, Gorilla gorilla
SRCPGAERNLLVYSYFEKETLTFRDVAIEFSLEEWECLNPAQQNLYMNVMLENYKNLVFLGVAVSKQDPVTCLEQEKEPWN

SEQ ID NO: 2602 - protein, 81 aa, Gorilla gorilla
ILRRYGKCEHENLQLRKGSTSVDEYKVHKEGYNELNQCLTTTQRKIFPCDKYVKVFHKFLNANRHKTRHTGKKPFKCKKCG

SEQ ID NO: 2603 - protein, 81 aa, Gorilla gorilla
LRRYGKCEHENLQLRKGSTSVDEYKVHKEGYNELNQCLTTTQRKIFPCDKYVKVFHKFLNANRHKTRHTGKKPFKCKKCGK

SEQ ID NO: 2604 - protein, 81 aa, Gorilla gorilla
ASRCPGAERNLLVYSYFEKETLTFRDVAIEFSLEEWECLNPAQQNLYMNVMLENYKNLVFLAGVAVSKQDPVTCLEQEKEP

SEQ ID NO: 2605 - protein, 81 aa, Gorilla gorilla
MGPLTFMDVAIEFSLEEWQCLDTAQQNLYRNVMLENYRNLVFLGIAVSNLDLITCLEQGKEPWNMKRHEMVAKPPAMCSHF

SEQ ID NO: 2606 - protein, 81 aa, Gorilla gorilla
SGYPGAERNLLEYSYFEKGPLTFRDVVIEFSQEEWQFLDTAQQDLYRKVMLENFRNLVFLGIDVSKPDLITCLEQGKDPWN

SEQ ID NO: 2607 - protein, 81 aa, Gorilla gorilla
TPGPPESLEMGPLTFRDVAIEFSLEEWQCLDTAQQDLYRKVMLENYRNLAFLAGIAVSMPDLVTCLQQGKDPWNVKRQSTV

SEQ ID NO: 2608 - protein, 81 aa, Gorilla gorilla
TPGPPESLEMGPLTFRDVAIEFSLEEWQCLDTAQQDLYRKVMLENYRNLAFLGIAVSMPDLVTCLQQGKDPWNVKRQSTVV

SEQ ID NO: 2609 - protein, 81 aa, Gorilla gorilla
EFSLEEWQCLDTAQQDLYRKVMLENYRNLAFLAGIAVSMPDLVTCLQQGKDPWNVKRQSTVVKPPGGDCSIFLMEHQGDVT

SEQ ID NO: 2610 - protein, 81 aa, Gorilla gorilla
MGPLTFTDVAIEFSLEEWQCLDTAQQNLYRNVMLENYRNLVFLGIAVSKPDLITCLEKEKEPCNMKRHEMVDEPPVVCSHF

SEQ ID NO: 2611 - protein, 81 aa, Gorilla gorilla
MGPLTFTDVAIEFSLEEWQCLDTAQQNLYRNVMLENYRNLVFLGIAVSKPDLITCLEKEKEPCNMKRHEMVDEPPDGVSLL

SEQ ID NO: 2612 - protein, 81 aa, Gorilla gorilla
RRYDKRGHENLQLRKGYKTVGDCKLYKGGYNGLNQCLTLTQSKMYHCDIYVKVFYAFSNADRYKTRHTGKEPFQCKKCGKS

SEQ ID NO: 2613 - protein, 81 aa, Gorilla gorilla
ASGRPGAERSLLVQSYFEKGPLTFRDVAIEFSLEEWQCLDSAQQGLYRKVMLENYRNLVFLAGIALTKPDLITCLEQGKEP

SEQ ID NO: 2614 - protein, 81 aa, Gorilla gorilla; identical to SEQ ID NO: 394

SEQ ID NO: 2615 - protein, 81 aa, Gorilla gorilla
SGRPGAERSLLVQSYFEKGPLTFRDVAIEFSLEEWQCLDSAQQGLYRKVMLENYRNLVFLGIALTKPDLITCLEQGKEPWN

SEQ ID NO: 2616 - protein, 81 aa, Gorilla gorilla
MPGHPGSWEMGPLTFMDVAIEFCLEEWQCLDTAQQNLYRNVMLENYRNLVFLGIAVSKPDLITCLEQEKEPWEPMRRHEMV

SEQ ID NO: 2617 - protein, 81 aa, Gorilla gorilla
MDVAIEFCLEEWQCLDTAQQNLYRNVMLENYRNLVFLGIAVSKPDLITCLEQEKEPWEPMRRHEMVAKPPVMCSHFTQDFW

SEQ ID NO: 2618 - protein, 81 aa, Gorilla gorilla
MGPLTFMDVAIEFCLEEWQCLDTAQQNLYRNVMLENYRNLVFLGIAVSKPDLITCLEQEKEPWEPMRRHEMVAKPPVMCSH

SEQ ID NO: 2619 - protein, 81 aa, Gorilla gorilla
MDVAIEFCLEEWQCLDTAQQNLYRNVMLENYRNLVFLGIAVSKPDLITCLEQEKEPWEPMRRHEMVAKPPVSFLRPSPETD

SEQ ID NO: 2620 - protein, 81 aa, Gorilla gorilla
MDVAIEFCLEEWQCLDTAQQNLYRNVMLENYRNLVFLGIAVSKPDLITCLEQEKEPWEPMRRHEMVAKPPGGIVSLLNVFF

SEQ ID NO: 2621 - protein, 81 aa, Gorilla gorilla
MGSLTFRDVAIEFSLEEWQCLDSTQQNLYRNVMLENYRNLVFLGIAAFKPDLIIFLEEGKEPWNMKRHERVEESPVICSHF

SEQ ID NO: 2622 - protein, 81 aa, Gorilla gorilla
MGSLTFRDVAIEFSLEEWQCLDSTQQNLYRNVMLENYRNLVFLGIAAFKPDLIIFLEEGKEPWNMKRHERVEESPGMVGSS

SEQ ID NO: 2623 - protein, 81 aa, Gorilla gorilla
MPGTQLILYDGSLTFRDVAIEFSLEEWQCLDSTQQNLYRNVMLENYRNLVFLGIAAFKPDLIIFLEEGKEPWNMKRHERVE

SEQ ID NO: 2624 - protein, 81 aa, Gorilla gorilla
MGPLTIRDVTVEFSLEEWHCLDTAQQNLYRDVMLENYRNLVFLGIAVSKPDLITCLEQGKEPCNMKRHEMVAKPPDGVLLF

SEQ ID NO: 2625 - protein, 81 aa, Gorilla gorilla
MGPLTIRDVTVEFSLEEWHCLDTAQQNLYRDVMLENYRNLVFLGIAVSKPDLITCLEQGKEPCNMKRHEMVAKPPVICSHI

SEQ ID NO: 2626 - protein, 81 aa, Gorilla gorilla
MLENYRNLVFLGIAAFKPDLIIFLEQGKEPWNMKRHEMVEEPPVICSHFSQEFWPEQDIEDSFQKMILRRYDKCGHENLHL

SEQ ID NO: 2627 - protein, 81 aa, Gorilla gorilla; identical to SEQ ID NO: 395

SEQ ID NO: 2628 - protein, 81 aa, Gorilla gorilla
MGVLTFRDVAIEFSLEEWHCLDTAPQNLYRNVTLENYRNLVFLGIAASKPDLITCLEQGKEPWNVKRHEMVAEPPVVYSYF

SEQ ID NO: 2629 - protein, 81 aa, Gorilla gorilla
MGSLTFRDVTIEFSLEEWQCLDTAQQNLYRNVMLENYRNMVFLGIAVSKLDLITCLKQGKEPWNMKRHEMVTKPPVISSHF

SEQ ID NO: 2630 - protein, 81 aa, Gorilla gorilla
SEKCTRLILYDLKIALKNGSLTFRDVTIEFSLEEWQCLDTAQQNLYRNVMLENYRNMVFLGIAVSKLDLITCLKQGKEPWN

SEQ ID NO: 2631 - protein, 81 aa, Gorilla gorilla; identical to SEQ ID NO: 396

SEQ ID NO: 2632 - protein, 81 aa, Gorilla gorilla; identical to SEQ ID NO: 397

SEQ ID NO: 2633 - protein, 81 aa, Gorilla gorilla; identical to SEQ ID NO: 398

SEQ ID NO: 2634 - protein, 81 aa, Gorilla gorilla
MGPLTFMDVAIEFSVEEWQCLDTAQQNLYRNVMLENYRNLVFLGIAVSKPDLITCLEQGKEPWNMERHEMVAKHPGMCCYF

SEQ ID NO: 2635 - protein, 81 aa, Gorilla gorilla
MDVAIEFSVEEWQCLDTAQQNLYRNVMLENYRNLVFLGIAVSKPDLITCLEQGKEPWNMERHEMVAKHPGMCCYFAQDLWP

SEQ ID NO: 2636 - protein, 81 aa, Gorilla gorilla
MGLLTFRDVAIEFSLEEWQCLDTAQRNLYKNVILENYRNLVFLGIAVSKQDLITCLEQEKEPLTVKRHEMVNEPPESHPVI

SEQ ID NO: 2637 - protein, 81 aa, Gorilla gorilla
MGLLTFRDVAIEFSLEEWQHLDIAQQNLYRNVMLENYRNLAFLGIAVSKPDLITCLEQGKEPWNMKRHEMVDEPPGMCPHF

SEQ ID NO: 2638 - protein, 81 aa, Gorilla gorilla
MSQVTFSDVAIDFSHEEWACLDTAQRDLYKDVMVQNYENLVSVAGLSVTKPYVIMLLEDGKEPWMMEKKLSKDWESRWENK

SEQ ID NO: 2639 - protein, 81 aa, Gorilla gorilla
MSQVTFSDVAIDFSHEEWACLDTAQRDLYKDVMVQNYENLVSVAGLSVTKPYVIMLLEDGKEPWMMEKKLSKAYPFPLSHS

SEQ ID NO: 2640 - protein, 81 aa, Gorilla gorilla
MSQVTFSDVAIDFSHEEWACLDTAQRDLYKDVMVQNYENLVSVGLSVTKPYVIMLLEDGKEPWMMEKKLSKAYPFPLSHSV

SEQ ID NO: 2641 - protein, 81 aa, Gorilla gorilla
MSQVTFSDVAIDFSHEEWACLDTAQRDLYKDVMVQNYENLVSVGLSVTKPYVIMLLEDGKEPWMMEKKLSKDWESRWENKE

SEQ ID NO: 2642 - protein, 81 aa, Gorilla gorilla
EELVGQNHGMEGEACTGGDVTFSDVAIDFSHEEWACLDTAQRDLYKDVMVQNYENLVSVGLSVTKPYVIMLLEDGKEPWMM

SEQ ID NO: 2643 - protein, 81 aa, Gorilla gorilla
SNEELVGQNHGMEGEACTGEDVTFNDVAIDFTHEEWGWLNSAQRDLYKDVMVQNYENLVSVAGLSVTKPYVITLLEDGKEP

SEQ ID NO: 2644 - protein, 81 aa, Gorilla gorilla
MPQVTFNDVAIDFTHEEWGWLNSAQRDLYKDVMVQNYENLVSVAGLSVTKPYVITLLEDGKEPWMMEKKLSKGMIPDWESR

SEQ ID NO: 2645 - protein, 81 aa, Gorilla gorilla
MPQVTFNDVAIDFTHEEWGWLNSAQRDLYKDVMVQNYENLVSVGLSVTKPYVITLLEDGKEPWMMEKKLSKGMIPDWESRW

SEQ ID NO: 2646 - protein, 81 aa, Gorilla gorilla
MPQVTFNDVAIDFTHEEWGWLNSAQRDLYKDVMVQNYENLVSVAGLSVTKPYVITLLEDGKEPWMMEKKLSKDWESRWENK

SEQ ID NO: 2647 - protein, 81 aa, Gorilla gorilla
NEELVGQNHGMEGEACTGEDVTFNDVAIDFTHEEWGWLNSAQRDLYKDVMVQNYENLVSVGLSVTKPYVITLLEDGKEPWM

SEQ ID NO: 2648 - protein, 81 aa, Gorilla gorilla
MTESQGTVTFKDVAIDFTQEEWKRLDPAQRKLYRNVMLENYNNLITVGHPFTKPDVIFKLEQEEEPWVMEEEVLRRHWQGE

SEQ ID NO: 2649 - protein, 81 aa, Gorilla gorilla
TSAGPIPSQKEEEMTESQGTVTFKDVAIDFTQEEWKRLDPAQRKLYRNVMLENYNNLITVGHPFTKPDVIFKLEQEEEPWV

SEQ ID NO: 2650 - protein, 81 aa, Gorilla gorilla
EMTESQGTVTFKDVAIDFTQEEWKRLDPAQRKLYRNVMLENYNNLITVGHPFTKPDVIFKLEQEEEPWVMEEEVLRRHWQG

SEQ ID NO: 2651 - protein, 81 aa, Gorilla gorilla
LVSLGLCFSKPSVILLLEQGKAPWMVKRELTKGLCSGWEPICETEELTPKQDFYEEHQSQKIIETLTSYNLEYSSLREEWK

SEQ ID NO: 2652 - protein, 81 aa, Gorilla gorilla
PICETEELTPKQDFYEEHQSQKIIETLTSYNLEYSSLREEWKCEGCFERQPGNQKACFKEEIITHEEPLVDEREQEYKSWG

SEQ ID NO: 2653 - protein, 81 aa, Gorilla gorilla
EPICETEELTPKQDFYEEHQSQKIIETLTSYNLEYSSLREEWKCEGCFERQPGNQKACFKEEIITHEEPLVDEREQEYKSW

SEQ ID NO: 2654 - protein, 81 aa, Gorilla gorilla
QGKAPWMVKRELTKGLCSGWEPICETEELTPKQDFYEEHQSQKIIETLTSYNLEYSSLREEWKCEGCFERQPGNQKACFKE

SEQ ID NO: 2655 - protein, 81 aa, Gorilla gorilla
MIEYQIPVSFKDVVVGFTQEEWHRLSPAQRALYRDVMLETYSNLVSVGYEGTKPDVILRLEQEEAPWIGEAACPGCHCWED

SEQ ID NO: 2656 - protein, 81 aa, Gorilla gorilla
MIEYQIPVSFKDVVVGFTQEEWHRLSPAQRALYRDVMLETYSNLVSVGYEGTKPDVILRLEQEEAPWIGEAACPGCHCWGI

SEQ ID NO: 2657 - protein, 81 aa, Gorilla gorilla
VVVGFTQEEWHRLSPAQRALYRDVMLETYSNLVSVGYEGTKPDVILRLEQEEAPWIGEAACPGCHCWGISKLWSTNWSPAL

SEQ ID NO: 2658 - protein, 81 aa, Gorilla gorilla
MIEYQIPVSFKDVVVGFTQEEWHRLSPAQRALYRDVMLETYSNLVSVGYEGTKPDVILRLEQEEAPWIGEAACPGCHCWGK

SEQ ID NO: 2659 - protein, 81 aa, Gorilla gorilla
EWHRLSPAQRALYRDVMLETYSNLVSVGYEGTKPDVILRLEQEEAPWIGEAACPGCHCWGKCDKSSKRGTEGGWHLWNFVQ

SEQ ID NO: 2660 - protein, 81 aa, Gorilla gorilla
EWHRLSPAQRALYRDVMLETYSNLVSVGYEGTKPDVILRLEQEEAPWIGEAACPGCHCWEDIWRVNIQRKRRQDMLLRQGA

SEQ ID NO: 2661 - protein, 81 aa, Gorilla gorilla
IPVSFKDVVVGFTQEEWHRLSPAQRALYRDVMLETYSNLVSVGYEGTKPDVILRLEQEEAPWIGEAACPGCHCWGKCDKSS

SEQ ID NO: 2662 - protein, 81 aa, Gorilla gorilla
WHRLSPAQRALYRDVMLETYSNLVSVGYEGTKPDVILRLEQEEAPWIGEAACPGCHCWGKCDKSSKRGTEGGWHLWNFVQH

SEQ ID NO: 2663 - protein, 81 aa, Gorilla gorilla
MAHALVTFRDVAIDFSQKEWECLDTTQRKLYRDVMLENYNNLVSLGLLSRHKTKKLSSEKDIHEISLSKGSIIEKSKTLRL

SEQ ID NO: 2664 - protein, 81 aa, Gorilla gorilla
MPHLLVTFRDVAIDFSQEEWECLDPAQRDLYRDVMLENYSNLISLEPARTHKEQHNLPVPKAGSVNLAAGFGHSRSQTGCG

SEQ ID NO: 2665 - protein, 81 aa, Gorilla gorilla
MAYGSITFGDVAIDFSHQEWEYLNLVQKTLYQEVMMENYDNLVSLAGHSVSKPDLITLLEQGKEPWTIVREETRGECTDLD

SEQ ID NO: 2666 - protein, 81 aa, Gorilla gorilla
MAYGSITFGDVAIDFSHQEWEYLNLVQKTLYQEVMMENYDNLVSLGHSVSKPDLITLLEQGKEPWTIVREETRGECTDLDS

SEQ ID NO: 2667 - protein, 81 aa, Gorilla gorilla
MAYGSITFGDVAIDFSHQEWEYLNLVQKTLYQEVMMENYDNLVSLGHSVSKPDLITLLEQGKEPWTIVREETRGECTAELQ

SEQ ID NO: 2668 - protein, 81 aa, Gorilla gorilla
CNWERPLKFCPTKYMKFQELVTFRDVAIDFSRQEWEYLDPNQRDLYRDVMLENYRNLVSLGGRSISKPVVVDLLERGKEPW

SEQ ID NO: 2669 - protein, 81 aa, Gorilla gorilla
HQVGLIRSYNSKTMTCFQELVTFRDVAIDFSRQEWEYLDPNQRDLYRDVMLENYRNLVSLGGRSISKPVVVDLLERGKEPW

SEQ ID NO: 2670 - protein, 81 aa, Gorilla gorilla
HQVGLIRSYNSKTMTCFQELVTFRDVAIDFSRQEWEYLDPNQRDLYRDVMLENYRNLVSLEMRSRCVARAGLKLLVSSDPP

SEQ ID NO: 2671 - protein, 81 aa, Gorilla gorilla
EPHQVGLIRSYNSKTMTCELVTFRDVAIDFSRQEWEYLDPNQRDLYRDVMLENYRNLVSLGGRSISKPVVVDLLERGKEPW

SEQ ID NO: 2672 - protein, 81 aa, Gorilla gorilla
TCNWERPLKFCPTKYMKFQELVTFRDVAIDFSRQEWEYLDPNQRDLYRDVMLENYRNLVSLGGRSISKPVVVDLLERGKEP

SEQ ID NO: 2673 - protein, 81 aa, Gorilla gorilla
MAHGLVTFRDVAIDFSQEEWEFLDPAQRDLYRDVMWENYSNFISLGPSISKPDVITLLDEERKEPGMVVREGTRRYCPDLE

SEQ ID NO: 2674 - protein, 81 aa, Gorilla gorilla
MAHGLVTFRDVAIDFSQEEWEFLDPAQRDLYRDVMWENYSNFISLAGPSISKPDVITLLDEERKEPGMVVREGTRRYCPGE

SEQ ID NO: 2675 - protein, 81 aa, Gorilla gorilla
MPEVEFPDQFFTVLTMDHELVTLRDVVINFSQEEWEYLDSAQRNLYWDVMMENYSNLLSLDLESRNETKQLSVGKDIIQNT

SEQ ID NO: 2676 - protein, 81 aa, Gorilla gorilla
MMENYSNLLSLDLESRNETKQLSVGKDIIQNTGSQWEVMESSKLCGLEGSIFRNDWQSKSKIEVQGPEVGYFSQMKIISEN

SEQ ID NO: 2677 - protein, 81 aa, Gorilla gorilla
TVLTMDHELVTLRDVVINFSQEEWEYLDSAQRNLYWDVMMENYSNLLSLDLESRNETKQLSVGKDIIQNTGSQWEVMESSK

SEQ ID NO: 2678 - protein, 81 aa, Gorilla gorilla
FHMAKPDMIRKLEQGEELWTQRIFPSYSYLEEDGKTEDVLVKFKEYQDRHSRPLIFINHKKLIKERSNIYGKTFTLGKNRI

SEQ ID NO: 2679 - protein, 81 aa, Gorilla gorilla
GFHMAKPDMIRKLEQGEELWTQRIFPSYSYLEDGKTEDVLVKFKEYQDRHSRPLIFINHKKLIKERSNIYGKTFTLGKNRI

SEQ ID NO: 2680 - protein, 81 aa, Gorilla gorilla
MNMEGLVMFQDLSIDFSQEEWECLDAAQKDLYRDVMMENYSSLVSLGLSIPKPDVISLLEQGKEPWMVSRDVLGGWCRGLE

SEQ ID NO: 2681 - protein, 81 aa, Gorilla gorilla
MNMEGLVMFQDLSIDFSQEEWECLDAAQKDLYRDVMMENYSSLVSLDSEFRCKTKDSCLPKEIYEVTSPQWVRMEKCHSLV

SEQ ID NO: 2682 - protein, 81 aa, Gorilla gorilla
MAHLLMFRDVAVDFSQEEWECLDLEQRDLYRDVMLENYSNMVSLGLCIYQPEAFSLLEKGKEPWKILRDETRGPCPDMQSR

SEQ ID NO: 2683 - protein, 81 aa, Gorilla gorilla
TELSQWEMSDRLENCDLEESNSRDYLEAKGKMEKQQENQKEYFRQGMIIYDKMSIFNQHTYLSQHSRCHSTEKPYKCKECG

SEQ ID NO: 2684 - protein, 81 aa, Gorilla gorilla
LAPEDHGSSYEGSVSFRDVAIDFSREEWRHLDPSQRNLYRDVMLETYSHLLSVGYQVPEAEVVMLEQGKEPWALQGERPRQ

SEQ ID NO: 2685 - protein, 81 aa, Gorilla gorilla
REEWRHLDPSQRNLYRDVMLETYSHLLSVGYQVPEAEVVMLEQGKEPWALQGERPRQSCPVTHRLTLPSTMTKSFLDLTRS

SEQ ID NO: 2686 - protein, 81 aa, Gorilla gorilla
SPQKSSALAPEDHGSSYEGSVSFRDVAIDFSREEWQHLDLSQRNLYRDVMLETYSHLLSVGFVSLGSPWARSSSRLQPISS

SEQ ID NO: 2687 - protein, 81 aa, Gorilla gorilla
SPQKSSALAPEDHGSSYEGSVSFRDVAIDFSREEWRHLDPSQRNLYRDVMLETYSHLLSVGYQVPEAEVVMLEQGKEPWAL

SEQ ID NO: 2688 - protein, 81 aa, Gorilla gorilla
SPQKSSALAPEDHGSSYEGSVSFRDVAIDFSREEWQHLDLSQRNLYRDVMLETYSHLLSVGEKLWDHNQHRKIIGYKPASS

SEQ ID NO: 2689 - protein, 81 aa, Gorilla gorilla
MQLNEEINKGSVSFRDVAIDFSREEWQHLDLSQRNLYRDVMLETYSHLLSVGEKLWDHNQHRKIIGYKPASSQDQKIYSGE

SEQ ID NO: 2690 - protein, 81 aa, Gorilla gorilla
EETQGELTSSCGSKTMANVSLAFRDVSIDLSQEEWECLDAVQRDLYKDVMLENYSNLVSLGYTIPKPDVITLLEQEKEPWI

SEQ ID NO: 2691 - protein, 81 aa, Gorilla gorilla
MQVDPPLHGPPNDFLIFQIIPLHSLSIMPRFLWILCFSMEETQGELTSSCGSKTMANVSLAFRDVSIDLSQEEWECLDAVQ

SEQ ID NO: 2692 - protein, 81 aa, Gorilla gorilla
MVHGSVTFRDVAIDFSQEEWECLQPDQRTLYRDVMLENYSHLISLGSCISKPDVVTLLEQEKEPWIVVSKETSRWYPDLES

SEQ ID NO: 2693 - protein, 81 aa, Gorilla gorilla
MVHGSVTFRDVAIDFSQEEWECLQPDQRTLYRDVMLENYSHLISLAGSCISKPDVVTLLEQEKEPWIVIWSQNMDLRKYLQ

SEQ ID NO: 2694 - protein, 81 aa, Gorilla gorilla
MLENYSHLISLGSSISKPGVITLLEQEKEPWMVVRKETSRWYPDLESKYGPEKVSPENDTSEVNLPKHVIKQISTTLGVEA

SEQ ID NO: 2695 - protein, 81 aa, Gorilla gorilla
GRSPRKIDQFCNSSNMVHGSVTFRDVAIDFSQEEWECLQPDQRTLYRDVMLENYSHLISLGSSISKPGVITLLEQEKEPWM

SEQ ID NO: 2696 - protein, 81 aa, Gorilla gorilla
MVHGSVTFRDVAIDFSQEEWECLQPDQRTLYRDVMLENYSHLISLGSSISKPGVITLLEQEKEPWMVVRKETSRWYPDLES

SEQ ID NO: 2697 - protein, 81 aa, Gorilla gorilla
MVHGSVTFRDVAIDFSQEEWECLQPDQRTLYRDVMLENYSHLISLAGSSISKPGVITLLEQEKEPWMVVRKETSRWYPDLE

SEQ ID NO: 2698 - protein, 81 aa, Gorilla gorilla
EESHGALISSCNSRTMTDGLVTFRDVAIDFSQEEWECLDPAQRDLYVDVMLENYSNLVSLDLESTTYETKKIFSENDIFEI

SEQ ID NO: 2699 - protein, 81 aa, Gorilla gorilla
ESCSGFSGFFASPIEESHGALISSCNSRTMTDGLVTFRDVAIDFSQEEWECLDPAQRDLYVDVMLENYSNLVSLGKVICLK

SEQ ID NO: 2700 - protein, 81 aa, Gorilla gorilla
TAQVPLTFSDVAIDFSQEEWEYLNSDQRDLYRDVMLENYTNLVSLDDFTTESDKLSSEKRNYEVNAYHQETWKINKTFNLM

SEQ ID NO: 2701 - protein, 81 aa, Gorilla gorilla
FQVPLTFSDVAIDFSQEEWEYLNSDQRDLYRDVMLENYTNLVSLDDFTTESDKLSSEKRNYEVNAYHQETWKINKTFNLMR

SEQ ID NO: 2702 - protein, 81 aa, Gorilla gorilla
MTKSKEAVTFKDVAVVFSEEELQLLDLAQRKLYRDVMLENFRNVVSVGHQSTPDGLPQLEREEKLWMMKMATQRENSSGAK

SEQ ID NO: 2703 - protein, 81 aa, Gorilla gorilla
MLENFRNVVSVGHQSTPDGLPQLEREEKLWMMKMATQRENSSGAKNLKEMETLQEVGLRYLPHEELFCSQIWQQITRELIK

SEQ ID NO: 2704 - protein, 81 aa, Gorilla gorilla
HSGLCKFPEVEGKMTTFKEAVTFKDVAVVFTEEELGLLDPAQRKLYRDVMLENFRNLLSVGNQPFHQDTFHFLRKEKFWMM

SEQ ID NO: 2705 - protein, 81 aa, Gorilla gorilla
LRKEKFWMMKTTSQREGNSGGKIQIEMETVPEAGPHEEWSCQQIWEQIASDLTRSQNSIRNSSQFFKEGDVPCQIEAGLSI

SEQ ID NO: 2706 - protein, 81 aa, Gorilla gorilla
AQRKLYRDVMLENFRNLLSVGNQPFHQDTFHFLRKEKFWMMKTTSQREGNSGGKIQIEMETVPEAGPHEEWSCQQIWEQIA

SEQ ID NO: 2707 - protein, 81 aa, Gorilla gorilla
MTTFKEAVTFKDVAVVFTEGELGLLDPAQRKLYRDVMLENFRNLLSVGHQPFHQDTCHFLREEKFWMMGTATQREGNSGGK

SEQ ID NO: 2708 - protein, 81 aa, Gorilla gorilla
FKDVAVVFTEGELGLLDPAQRKLYRDVMLENFRNLLSVGHQPFHQDTCHFLREEKFWMMGTATQREGNSGGKIQTELESVP

SEQ ID NO: 2709 - protein, 81 aa, Gorilla gorilla
LREEKFWMMGTATQREGNSGGKIQTELESVPEAGAHEEWSCQQIWEQIAKDLTRSQDSIINNSQFFENGDVPSQVEAGLPT

SEQ ID NO: 2710 - protein, 81 aa, Gorilla gorilla
MIKRSKVLVFCSKIMEEAVTFKDVAVVFTEGELGLLDPAQRKLYRDVMLENFRNLLSVGHQPFHQDTCHFLREEKFWMMGT

SEQ ID NO: 2711 - protein, 81 aa, Gorilla gorilla
VTTFKEAVTFKDVAVFFTEEELGLLDPAQRKLYQDVMLENFTNLLSVGHQPFHPFHFLREEKFWMMETATQREGNSGSKTV

SEQ ID NO: 2712 - protein, 81 aa, Gorilla gorilla
VTTFKEAVTFKDVAVFFTEEELGLLDPAQRKLYQDVMLENFTNLLSVGHQPFHPFHFLREEKFWMMETATQREGNSGKKQA

SEQ ID NO: 2713 - protein, 81 aa, Gorilla gorilla
MIDSGEKKPGRRAEEAVTFKDVAVIFTEEELGLLDPAQRKLYRDVMLENFRNLLSVGHQPFHGDTFHFLREEKFWVMGKTN

SEQ ID NO: 2714 - protein, 81 aa, Gorilla gorilla
GRRAEEAVTFKDVAVIFTEEELGLLDPAQRKLYRDVMLENFRNLLSVGHQPFHGDTFHFLREEKFWVMGKTNQREGNSGPL

SEQ ID NO: 2715 - protein, 81 aa, Gorilla gorilla
HSGLCKFPKVGGKMTMSKEAVTFKDVAVIFTEEELGLLDLAQRKLYRDVMLENFRNLLSVGHQPFHQDTFHFLREEKFWMM

SEQ ID NO: 2716 - protein, 81 aa, Gorilla gorilla
MTMSKEAVTFKDVAVIFTEEELGLLDLAQRKLYRDVMLENFRNLLSVGHQPFHQDTFHFLREEKFWMMDIATQREGNSGGK

SEQ ID NO: 2717 - protein, 81 aa, Gorilla gorilla
MTMSKEAVTFKDVAVIFTEEELGLLDLAQRKLYRDVMLENFRNLLSVGHQPFHQDTFHFLREEKFWMMDIATQREGNSGKK

SEQ ID NO: 2718 - protein, 81 aa, Gorilla gorilla
TFKDVAVIFTEEELGLLDLAQRKLYRDVMLENFRNLLSVGHQPFHQDTFHFLREEKFWMMDIATQREGNSGKKHATVCPCL

SEQ ID NO: 2719 - protein, 81 aa, Gorilla gorilla
MTMSKEAVTFKDVAVIFTEEELGLLDLAQRKLYRDVMLENFRNLLSVGHQPFHQDTFHFLREEKFWMMDIATQREGNSGGS

SEQ ID NO: 2720 - protein, 81 aa, Gorilla gorilla
DVAVIFTEEELGLLDLAQRKLYRDVMLENFRNLLSVGHQPFHQDTFHFLREEKFWMMDIATQREGNSGGSVQASECRNRSK

SEQ ID NO: 2721 - protein, 81 aa, Gorilla gorilla
MLENFRNLLSVGHQPFHQDTFHFLREEKFWMMDIATQREGNSGGKIQPEMKTFPEAGPHEGWSCQQIWEEIASDLTRPQDS

SEQ ID NO: 2722 - protein, 81 aa, Gorilla gorilla
MTMFKEAVTFKDVAVVFTEEELGLLDVSQRKLYRDVMLENFRNLLSVGHQPSHRDTFHFQREEKFWIMETATQREGNSGGK

SEQ ID NO: 2723 - protein, 81 aa, Gorilla gorilla
REEKFWIMETATQREGNSGGKIQTELESVPETGPHEEWSCQQIWEQTASELTRPQDSISSSQFSTQGVVPSQVDAELSIIH

SEQ ID NO: 2724 - protein, 81 aa, Gorilla gorilla
RSNLNRHSMVHMQEKSFRCDTCSNSFGQRSALNSHCMDHTKEKLYKCEECGRSFTCRQDLCKHQMDHTGDKPYNCNVCGKG

SEQ ID NO: 2725 - protein, 80 aa, Gorilla gorilla
MTTFKEAMTFKDVAVVFTEEELGLLDLAQRKLYRDVMLENFRNLLSVGHQAFHRDTFHFLREEKIWMMKTAIQREGNSET

SEQ ID NO: 2726 - protein, 81 aa, Gorilla gorilla
MTMLKEAVTFKDVAVVFTEEELRLLDLAQRKLYREVMLENFRNLLSVGHQSLHRDTFYFLKEEKFWMMETATQREGNLGGK

SEQ ID NO: 2727 - protein, 81 aa, Gorilla gorilla
DLAQRKLYREVMLENFRNLLSVGHQSLHRDTFYFLKEEKFWMMETATQREGNLGGKIQTEMETVSESGTHEGLFSHQTWEQ

SEQ ID NO: 2728 - protein, 81 aa, Gorilla gorilla
RNLLSVGHQSLHRDTFYFLKEEKFWMMETATQREGNLGGKIQTEMETVSESGTHEGLFSHQTWEQISSDLTRFQDSMVNSF

SEQ ID NO: 2729 - protein, 81 aa, Gorilla gorilla
MTMLKEAVTFKDVAVVFTEEELRLLDLAQRKLYREVMLENFRNLLSVGHQSLHRDTFYFLKEEKFWMMETATQREGNLGPA

SEQ ID NO: 2730 - protein, 81 aa, Gorilla gorilla
KDVAVVFTEEELRLLDLAQRKLYREVMLENFRNLLSVGHQSLHRDTFYFLKEEKFWMMETATQREGNLGPAFQIPIKTEGF

SEQ ID NO: 2731 - protein, 81 aa, Gorilla gorilla
MTTFKEGLTFKDVAVVFTEEELGLLDPVQRNLYQDVMLENFRNLLSVGHHPFKHDVFLLEKEKKLDMMKTATQRKGKSADK

SEQ ID NO: 2732 - protein, 81 aa, Gorilla gorilla
MTTFKEGLTFKDVAVVFTEEELGLLDPVQRNLYQDVMLENFRNLLSVGHHPFKHDVFLLEKEKKLDMMKTATQRKGKSDKI

SEQ ID NO: 2733 - protein, 81 aa, Gorilla gorilla
MNMFKEAVTFKDVAVAFTEEELGLLGPAQRKLYRDVMVENFRNLLSVGHQPFKQDTSPIERNEQLWIMTTATRRQGNLGEK

SEQ ID NO: 2734 - protein, 81 aa, Gorilla gorilla
VGHQPFKQDTSPIERNEQLWIMTTATRRQGNLGEKNQSKLITVQDRESEEELSCWQIWQQIANDLTRCQDSMINNSQCHKQ

SEQ ID NO: 2735 - protein, 81 aa, Gorilla gorilla
MNMFKEAVTFKDVAVAFTEEELGLLGPAQRKLYRDVMVENFRNLLSVGHQPFKQDTSPIERNEQLWIMTTATRRQGNLGKN

SEQ ID NO: 2736 - protein, 81 aa, Gorilla gorilla
MNMFKEAVTFKDVAVAFTEEELGLLGPAQRKLYRDVMVENFRNLLSVGHQPFKQDTSPIERNEQLWIMTTATRRQGNLDTL

SEQ ID NO: 2737 - protein, 81 aa, Gorilla gorilla
MVENFRNLLSVGHQPFKQDTSPIERNEQLWIMTTATRRQGNLGEKNQSKLITVQDRESEEELSCWQIWQQIANDLTRCQDS

SEQ ID NO: 2738 - protein, 81 aa, Gorilla gorilla
RNEQLWIMTTATRRQGNLGEKNQSKLITVQDRESEEELSCWQIWQQIANDLTRCQDSMINNSQCHKQGDFPCQVGAELSIQ

SEQ ID NO: 2739 - protein, 81 aa, Gorilla gorilla
IERNEQLWIMTTATRRQGNLGEKNQSKLITVQDRESEEELSCWQIWQQIANDLTRCQDSMINNSQCHKQGDFPCQVGAELS

SEQ ID NO: 2740 - protein, 81 aa, Gorilla gorilla
MTKFQEAVTFKDVAVAFTEEELGLLDSAQRKLYRDVMLENFRNLVSVGHQSFKPDVISQLEREEKLWMKELQTQRGKHSET

SEQ ID NO: 2741 - protein, 81 aa, Gorilla gorilla
MTKFQEAVTFKDVAVAFTEEELGLLDSAQRKLYRDVMLENFRNLVSVGHQSFKPDVISQLEREEKLWMKELQTQRGKHSVW

SEQ ID NO: 2742 - protein, 81 aa, Gorilla gorilla
KFQEAVTFKDVAVAFTEEELGLLDSAQRKLYRDVMLENFRNLVSVGHQSFKPDVISQLEREEKLWMKELQTQRGKHSVWTL

SEQ ID NO: 2743 - protein, 81 aa, Gorilla gorilla
MTKFQEAVTFKDVAVAFTEEELGLLDSAQRKLYRDVMLENFRNLVSVGHQSFKPDVISQLEREEKLWMKELQTQRGKHSGF

SEQ ID NO: 2744 - protein, 81 aa, Gorilla gorilla
AVTFKDVAVAFTEEELGLLDSAQRKLYRDVMLENFRNLVSVGHQSFKPDVISQLEREEKLWMKELQTQRGKHSGFLCCVFS

SEQ ID NO: 2745 - protein, 81 aa, Gorilla gorilla
MTKFQEAVTFKDVAVAFTEEELGLLDSAQRKLYRDVMLENFRNLVSVGHQSFKPDVISQLEREEKLWMKELQTQRGKHSGD

SEQ ID NO: 2746 - protein, 81 aa, Gorilla gorilla
MTKFQEAVTFKDVAVAFTEEELGLLDSAQRKLYRDVMLENFRNLVSVGHQSFKPDVISQLEREEKLWMKELQTQRGDRNQN

SEQ ID NO: 2747 - protein, 81 aa, Gorilla gorilla
RTLPFPRRRRGKMTKFQEAVTFKDVAVAFTEEELGLLDSAQRKLYRDVMLENFRNLVSVGHQSFKPDVISQLEREEKLWMK

SEQ ID NO: 2748 - protein, 81 aa, Gorilla gorilla
GPRSLPFSRKRKRKMTKFQEMVTFKDVAVVFTEEELGLLDSVQRKLYRDVMLENFRNLLLVAHQPFKPDLISQLEREEKLL

SEQ ID NO: 2749 - protein, 81 aa, Gorilla gorilla
MIKFQIQGLHVQERVTFKDVAVVFTKEELALLDKAQINLYQDVMLENFRNLMSVRDGIKNNILNLQAKGLSYLSQEVLHCW

SEQ ID NO: 2750 - protein, 81 aa, Gorilla gorilla
IIIKVEGEDTGSLTIPCQEGVNFKIVTVDFTQEEQGTWNPAQRTLDRDVILENHRDLVSWDLATAVEKKDSASKQRIFDEE

SEQ ID NO: 2751 - protein, 81 aa, Gorilla gorilla
SMEEQDEKPPEPLKACAQEGVNFKIVTVDFTQEEQGTWNPAQRTLDRDVILENHRDLVSWDLATAVEKKDSASKQRIFDEE

SEQ ID NO: 2752 - protein, 81 aa, Gorilla gorilla
MSQDLVTFADVAVNFTKEEWTLLDPAQRNLYRDVMLENSRNLAFIDWATPCKTKDATPQPDILPKRTFPEANRVCLTSISS

SEQ ID NO: 2753 - protein, 81 aa, Gorilla gorilla
PSSASQVAETTGTRPHSRDLVTFADVAVNFTKEEWTLLDPAQRNLYRDVMLENSRNLAFIDWATPCKTKDATPQPDILPKR

SEQ ID NO: 2754 - protein, 81 aa, Gorilla gorilla
LSQKPQVLGPEEQDGSCEASVSFEDVTVDFSREEWQQLDPAQRCLYRDVMLELYSHLFSVGYHIPNPEVIFRMLKEKEPRV

SEQ ID NO: 2755 - protein, 81 aa, Gorilla gorilla
NATIVMSVRREQGSSSGEGSLSFEDVAVGFTREEWQFLDQSQKVLYKEVMLENYSNLVSIGYQGTKPDSLFKLEQGEPPGI

SEQ ID NO: 2756 - protein, 81 aa, Gorilla gorilla
MTKAQESLTLKDVAVDFTWEEWQLLGPAQKHLYRDVMLENYSNLVSVGYQAGKPDALTKLEQGEPLWTLEDEIHSPAHPEI

SEQ ID NO: 2757 - protein, 81 aa, Gorilla gorilla
MLENYSNLVSVGYQASKPDALFKLEQGEPWTVENEIHSQICPEIKKVDNHLQMHSQKQRCLKRVEQCHKRNAFGNIIRQKK

SEQ ID NO: 2758 - protein, 81 aa, Gorilla gorilla
YSNLVSVGYQASKPDALFKLEQGEPWTVENEIHSQICPEIKKVDNHLQMHSQKQRCLKRVEQCHKRNAFGNIIRQKKSDFP

SEQ ID NO: 2759 - protein, 81 aa, Gorilla gorilla
MIQAQESITLEDVAVDFTWEEWQLLGAAQKDLYRDVMLENYSNLVAVGYQASKPDALFKLEQGEQPWTIEDGIHSGACSDI

SEQ ID NO: 2760 - protein, 81 aa, Gorilla gorilla
FAYMSCLVKHKRIHTREKEEAAKVENPPAERHSSLHTSDVMQEKNSANGVTTQVPSVAPQTSLNISGLLANRNVVLVGQPV

SEQ ID NO: 2761 - protein, 81 aa, Gorilla gorilla
MMQAQESLTLEDVAVDFTWEEWQFLSPAQKDLYRDVMLENYRNLVAVGYQASKPDALSKLEREEETCTTEDEIYSRICSDS

SEQ ID NO: 2762 - protein, 81 aa, Gorilla gorilla
MMQAQESLTLEDVAVDFTWEEWQFLSPAQKDLYRDVMLENYRNLVAVGYQASKPDALSKLEREEETCTTEDEIYSRICSEI

SEQ ID NO: 2763 - protein, 81 aa, Gorilla gorilla
MRPEPTKFWEESLTLEDVAVDFTWEEWQFLSPAQKDLYRDVMLENYRNLVAVGYQASKPDALSKLEREEETCTTEDEIYSR

SEQ ID NO: 2764 - protein, 81 aa, Gorilla gorilla
MESLTLEDVAVDFTWEEWQFLSPAQKDLYRDVMLENYRNLVAVGYQASKPDALSKLEREEETCTTEDEIYSRICSDSGGAS

SEQ ID NO: 2765 - protein, 81 aa, Gorilla gorilla
MIKTQESLTLEDVAVEFSWEEWQLLDTAQKNLYRDVMVENYNHLVSLGYQTSKPDVLSKLEHGQEPWITDAKIQNKNCPGI

SEQ ID NO: 2766 - protein, 80 aa, Gorilla gorilla
MIKTQESLTLEDVAVEFSWEEWQLLDTAQKNLYRDVMVENYNHLVSLGYQTSKPDVLSKLEHGQEPWITDAKIQNKNCPD

SEQ ID NO: 2767 - protein, 81 aa, Gorilla gorilla
MINAQELLTLEDVTVEFTWEEWQLLGPFQKNLYRDVMLEIYSNLLSMGYQVSKPDALSKLERGEEPWTMEDERHSRICPEN

SEQ ID NO: 2768 - protein, 81 aa, Gorilla gorilla
MINAQELLTLEDVTVEFTWEEWQLLGPFQKNLYRDVMLEIYSNLLSMGYQVSKPDALSKLERGEEPWTMEDERHSRICPGT

SEQ ID NO: 2769 - protein, 81 aa, Gorilla gorilla
MALPQGSLTFRDVAVEFSQEEWKCLDPVQKALYRDVMLENYRNLGFLGLCLPDLNIISMLEQGKEPWTVVSQVKIARNPNC

SEQ ID NO: 2770 - protein, 81 aa, Gorilla gorilla
EAQERKKKEKEPGMALPQGSLTFRDVAVEFSQEEWKCLDPVQKALYRDVMLENYRNLGFLGLCLPDLNIISMLEQGKEPWT

SEQ ID NO: 2771 - protein, 81 aa, Gorilla gorilla
MALPQGSLTFRDVAVEFSQEEWKCLDPVQKALYRDVMLENYRNLGFLAGLCLPDLNIISMLEQGKEPWTVVSQVKIARNPN

SEQ ID NO: 2772 - protein, 81 aa, Gorilla gorilla
MATQGHLTFKDVAIEFSQEEWKCLEPVQKALYKDVMLENYRNLVFLGISPKCVIKELPPTENSNTGERFQTVALERHQSYD

SEQ ID NO: 2773 - protein, 81 aa, Gorilla gorilla
AQKRKKRKEKESGMALTQGPLTFRDVAIEFSQEEWKSLDPVQKALYWDVMLENYRNLVFLGILPKCMTKELPPIGNTTQEA

SEQ ID NO: 2774 - protein, 81 aa, Gorilla gorilla
AQKRKKRKEKESGMALTQGPLTFRDVAIEFSQEEWKSLDPVQKALYWDVMLENYRNLVFLGILPKCMTKELPPIGNSNTGE

SEQ ID NO: 2775 - protein, 81 aa, Gorilla gorilla
MAQLRRGHLTFRDVAIEFSQEEWKCLDPVQKALYRDVMLENYRNLVSLGICLPDLSIISMMKQRTEPWTVENEMKVAKNPD

SEQ ID NO: 2776 - protein, 81 aa, Gorilla gorilla
EGEAQKRNAEESGIPLTQGHLTFRDVAIEFSQEEWKCLDPVQKALYRDVMLENYRNLVSLGICLPDLSIISMMKQRTEPWT

SEQ ID NO: 2777 - protein, 81 aa, Gorilla gorilla
MLENYRNLVSLGICLPDLSIISMMKQRTEPWTVENEMKVAKNPDRWEDIKDINTGRSCAVRSKAGNKPITNQLGLTFQLPL

SEQ ID NO: 2778 - protein, 81 aa, Gorilla gorilla
MGHLTFRDVAIEFSQEEWKCLDPVQKALYRDVMLENYRNLVSLGICLPDLSIISMMKQRTEPWTVENEMKVAKNPDRWEDI

SEQ ID NO: 2779 - protein, 81 aa, Gorilla gorilla
PWSGESEVKIAKNSDGRECIKGVNTGWGAMAQSWLTAASTSWVQAILLTQPPEQLGLQGAAMHWEAMQKTNQLKNNLEYPF

SEQ ID NO: 2780 - protein, 81 aa, Gorilla gorilla
DEEAQKRKAKESGMALPQGHLTFMDVAIEFSQEEWKSLHPGQRALYRDVMLENYRNLVFLGICLPDLSIISMLKQRREPLT

SEQ ID NO: 2781 - protein, 81 aa, Gorilla gorilla
DEEAQKRKAKESGMALPQGHLTFMDVAIEFSQEEWKSLHPGQRALYRDVMLENYRNLVFLGRSCVLGSNAENKPIKNQLGL

SEQ ID NO: 2782 - protein, 81 aa, Gorilla gorilla
MLRRGHLTFRDVAIEFSQEEWKCLDPAQRTLYREVMLENYRNLVFLGICLPDLSVISMLEQRRDPRNLQSEVKIANNPGGR

SEQ ID NO: 2783 - protein, 81 aa, Gorilla gorilla
MLRRGHLTFRDVAIEFSQEEWKCLDPAQRTLYREVMLENYRNLVFLGICLPDLSVISMLEQRRDPRNLQSEVKIANNPGSC

SEQ ID NO: 2784 - protein, 81 aa, Gorilla gorilla
KEATPKRKEKKSGMALTQGPLKFMDVAIEFSQEEWKCLDPAQRTLYRDVMLENYRNLVSLGICLPDLSVTSMLEQKRDPWT

SEQ ID NO: 2785 - protein, 81 aa, Gorilla gorilla
LYRDVMLENYRNLVSLGICLPDLSVTSMLEQKRDPWTLQSEEKIANDPDGRECIKGVNTDSPLLQCITSVPCVFCTTSMIY

SEQ ID NO: 2786 - protein, 81 aa, Gorilla gorilla
MALTQGQLSFSDVAIEFSQEEWKCLDPGQKALYRDVMLENYRNLISLDFSLLAWDARVFRVEAWRASGGAEEPTGPNFVGN

SEQ ID NO: 2787 - protein, 81 aa, Gorilla gorilla
EEAAQKRKGKEPGMALPQGRLTFRDVAIEFSLAEWKFLNPAQRALYREVMLENYRNLEAVDISSKCTMKEVLSTGQGNREV

SEQ ID NO: 2788 - protein, 81 aa, Gorilla gorilla
EEAAQKRKGKEPGMALPQGRLTFRDVAIEFSLAEWKFLNPAQRALYREVMLENYRNLEAVDISSKRMMKEVLSTGQGNREV

SEQ ID NO: 2789 - protein, 81 aa, Gorilla gorilla
HEEAAQKRKGKEPGMALPQGRLTFRDVAIEFSLAEWKFLNPAQRALYREVMLENYRNLEAVDISSKRMMKEVLSTGQGNRE

SEQ ID NO: 2790 - protein, 81 aa, Gorilla gorilla
MALPQGLLTFRDVTIEFSQEEWKCLDPAQRALYRDVMLENYRNLVSLDTSSKCMMKMFSSTGQGNTEVFHTRTLQIHASHH

SEQ ID NO: 2791 - protein, 81 aa, Gorilla gorilla
KTRKRKRKAKESGMALPQGLLTFRDVTIEFSQEEWKCLDPAQRALYRDVMLENYRNLVSLDTSSKCMMKMFSSTGQGNTEV

SEQ ID NO: 2792 - protein, 81 aa, Gorilla gorilla
MVLPQGLLTFRDVAIEFSQEEWKCLDPAQRTLYRDVMLENYRNLVSLGIFSKCEIKELPPKKESNTGEIFQTVMLERHESR

SEQ ID NO: 2793 - protein, 81 aa, Gorilla gorilla
DPAQRTLYRDVMLENYRNLVSLGIFSKCEIKELPPKKESNTGEIFQTVMLERHESRDIQDFCFRETQKNVHDSQCLWKHDE

SEQ ID NO: 2794 - protein, 81 aa, Gorilla gorilla
AIEFSQEEWKCLDPAQRTLYRDVMLENYRNLVSLGIFSKCEIKELPPKKESNTGEIFQTVMLERHESRDIQDFCFRETQKN

SEQ ID NO: 2795 - protein, 81 aa, Gorilla gorilla
EEAAQKRKGKEPGMALPQGRLTFRDVAIEFSLAEWKFLNPAQRALYREVMLENYRNLESVDISSKRLMKEVLSTGQGNREV

SEQ ID NO: 2796 - protein, 81 aa, Gorilla gorilla
EEAAQKRKGKEPGMALPQGRLTFRDVAIEFSLAEWKFLNPAQRALYREVMLENYRNLESVESHFVTQAGVQWCDPGSLQPL

SEQ ID NO: 2797 - protein, 80 aa, Gorilla gorilla
MLHEEAAQKRKGKEPGMALPQGRLTFRDVAIEFSLAEWKFLNPAQRALYREVMLENYRNLESVEMGFHCVSQDGLNLMTS

SEQ ID NO: 2798 - protein, 81 aa, Gorilla gorilla
EEATQKRKGKEPGMALPQGRLTFRDVAIEFSLAEWKCLNPAQRALYREVMLENYRNLEAVDISSKRMMKEVLSTGQGNTEV

SEQ ID NO: 2799 - protein, 81 aa, Gorilla gorilla
MALPQGRLTFRDVAIEFSLAEWKCLNPAQRALYREVMLENYRNLEAVDISSKRMMKEVLSTGQGNTEVIHTGTLQRHQSYH

SEQ ID NO: 2800 - protein, 81 aa, Gorilla gorilla
MALPQGLLTFSDVAIEFSQEEWKCLDPAQRTLYRDVMLENYRNLVSLDISSKCMMKTFFSTGQGNTEVFHTGTLQRQASHH

SEQ ID NO: 2801 - protein, 81 aa, Gorilla gorilla
MALPQGLLTFSDVAIEFSQEEWKCLDPAQRTLYRDVMLENYRNLVSLEFRSVTQAKVQWCHLSSLQPPLPRFKQFSCLSLP

SEQ ID NO: 2802 - protein, 81 aa, Gorilla gorilla
WKCLDPAQRTLYRDVMLENYRNLVSLEFRSVTQAKVQWCHLSSLQPPLPRFKQFSCLSLPSSWDYRYLFQMHDEDILLNRA

SEQ ID NO: 2803 - protein, 81 aa, Gorilla gorilla
MALPQGLLTFRDVAIEFSQEEWKCLDPAQRTLYRDVMLENYRNLISLDISSKCMLKTLSSTGQDNTEVFHTGTLHRQASHH

SEQ ID NO: 2804 - protein, 81 aa, Gorilla gorilla
MALPQGLLTFRDVAIEFSQEEWKCLDPAQRTLYRDVMLENYRNLISLEFWSVTPAKVQWCHLGSLQPLLPRFKQFSCLSLP

SEQ ID NO: 2805 - protein, 81 aa, Gorilla gorilla
KCLDPAQRTLYRDVMLENYRNLISLEFWSVTPAKVQWCHLGSLQPLLPRFKQFSCLSLPSTCDYRYLFQMHVEDVVINRAR

SEQ ID NO: 2806 - protein, 81 aa, Gorilla gorilla
LEFWSVTPAKVQWCHLGSLQPLLPRFKQFSCLSLPSTCDYRYLFQMHVEDVVINRARQYRSVPHRDIAQTSKSSHWRILFP

SEQ ID NO: 2807 - protein, 81 aa, Gorilla gorilla
MALPQGLLTFRDVAIEFSQEEWKCLDPAQRTLYRDVMLENYRNLISLVRRSEVCCTDIWAEVIVADISSKCMLKTLSSTGQ

SEQ ID NO: 2808 - protein, 81 aa, Gorilla gorilla
MALSQGLLTFRDVAIEFSQEEWKCLGPAQRTLYRDVMLENYRNLVSLGLISRDLCYLRKTPRRQRKGARDGSSSGMLDFQR

SEQ ID NO: 2809 - protein, 81 aa, Gorilla gorilla
MALSQGLLTFRDVAIEFSQEEWKCLGPAQRTLYRDVMLENYRNLVSLDISSKCMMRTLSSTGQGNTEVIHTGTLQRQASYH

SEQ ID NO: 2810 - protein, 81 aa, Gorilla gorilla
MALSQGLLTFRDVAIEFSQEEWKCLGPAQRTLYRDVMLENYRNLVSLGQGNTEVIHTGTLQRQASYHIGAFCSQEIEKDIH

SEQ ID NO: 2811 - protein, 81 aa, Gorilla gorilla
MALPQGLLTFRDVAIEFSQEEWKCLDPAQRTLYRDVMLENYRNLVSLDISSKCIMKEFSSIGKGNTEVIHTGTLQRLASHH

SEQ ID NO: 2812 - protein, 81 aa, Gorilla gorilla
EEATKKSKEKEPGMALPQGRLTFRDVAIEFSLEEWKCLNPVQRALYRAVMLENYRNLEFVDISSKCMMKVFSSTAQGNREV

SEQ ID NO: 2813 - protein, 81 aa, Gorilla gorilla
TGSTDRHDQRHAGNKPIKGQLGSSFHSHLPEHIFQPEWEIGNQVEKSIINASLILTSQRISCSPKTHISNNYGNNSLHSSL

SEQ ID NO: 2814 - protein, 81 aa, Gorilla gorilla
EEATKKSKEKEPGMALPQGRLTFRDVAIEFSLEEWKCLNPVQRALYRAVMLENYRNLEFVDSSLKSMMEFSSTGHGNTGEV

SEQ ID NO: 2815 - protein, 81 aa, Gorilla gorilla
EEATKKSKEKEPGMALPQGRLTFRDVAIEFSLEEWKCLNPVQRALYRAVMLENYRNLEFVGEENVPPGMRNLHLSIFALSG

SEQ ID NO: 2816 - protein, 81 aa, Gorilla gorilla
MALTQVRLTFRDVAIEFSQEEWKCLDPAQRILYRDVMLENYWNLVSLGLCHFDMNIISMLEEGKEPWTVKSCVKIARKPRM

SEQ ID NO: 2817 - protein, 81 aa, Gorilla gorilla
LTFRDVAIEFSQDEWKCLNSTQRTLYRDVMLENYRNLVSLDLSRNCVIKELAPQQEGNPGEVFHTVTLEQHEKHDIEEFCF

SEQ ID NO: 2818 - protein, 81 aa, Gorilla gorilla
LTFRDVAIEFSQDEWKCLNSTQRTLYRDVMLENYRNLVSLEYYPMWEHRKEPWTIESQVQIARKPKGWEWIKGVKTGWSAM

SEQ ID NO: 2819 - protein, 81 aa, Gorilla gorilla
MLVRLVSTSQPQLTFRDVAIEFSQDEWKCLNSTQRTLYRDVMLENYRNLVSLDLSRNCVIKELAPQQEGNPGEVFHTVTLE

SEQ ID NO: 2820 - protein, 81 aa, Gorilla gorilla
MALPQGQLTFKDVAIEFSQEEWTCLDPAQKTLYRDVMLENYRNLVSLDISCKCVNTDLPPKGKNDMGEAFYTVKLERLESC

SEQ ID NO: 2821 - protein, 81 aa, Gorilla gorilla
MALSQGRLTFRDVAIEFSQEEWKCLDSAQRALYRDVMLENYRNLVSLGISPSEMSITSMLGQGKEPWTVESEVKITKTSNS

SEQ ID NO: 2822 - protein, 81 aa, Gorilla gorilla
RALYRDVMLENYRNLLSLDEDNIPPENDISVGFTSKGLSPKENNKEELYHLVISERKESHGINNFDLKEVWENMPKFDSLW

SEQ ID NO: 2823 - protein, 80 aa, Gorilla gorilla
MALSQGLFTFKDVAIEFSQEEWECLDPAQRALYRDVMLENYRNLLSLDEDNIPPENAFYSVRELRETLVFLIPYSSKICL

SEQ ID NO: 2824 - protein, 81 aa, Gorilla gorilla
MALSQGLLTFRDVAIEFSQEEWKCLDPAQRTLYRDVMLENYRNLVSLDISSKCMMKEVSSTAQGNTEVIHTGTLQRHEHHH

SEQ ID NO: 2825 - protein, 81 aa, Gorilla gorilla
MALPQGLLTFRDVAIEFSQEEWKCLDPAQRTLYRDVMLENYRNLVSLGSCCVVEVGLDLLVSRHPPWPPKKLGLQAPTPVP

SEQ ID NO: 2826 - protein, 81 aa, Gorilla gorilla
MALPQGLLTFRDVAIEFSQEEWKCLDPAQRTLYRDVMLENYRNLVSLDISSKCTMKEFLSTAQGNREVFHAGTSQRHESHH

SEQ ID NO: 2827 - protein, 81 aa, Gorilla gorilla
MALPQGLLTFRDVAIEFSQEEWKCLDPAQRTLYRDVMLENYRNLVSLDISSKCMMKEVSSTAQGNREVIHTGTLQRHESHH

SEQ ID NO: 2828 - protein, 81 aa, Gorilla gorilla
MALPQGLLTFRDVAIEFSQEEWKCLDPAQRTLYRDVMLENYRNLVSLDTGFLLFCLADLKLLPSGDPSTSASETAAITDIS

SEQ ID NO: 2829 - protein, 81 aa, Gorilla gorilla
MAQGLVTFADVAIDFSQEEWACLNSAQRDLYWDVMLENYSNLVSLDLESAYENKSLPTEKNIHEIRASKRNSDRRSKSLGR

SEQ ID NO: 2830 - protein, 81 aa, Gorilla gorilla
DTKELFPKQHVYEVESPQWEIMESLTSYGLECSSFQDDWECRNQFDRQQGNPDRHFHQMIIRHEEMPTFDQHASLTFYQKI

SEQ ID NO: 2831 - protein, 81 aa, Gorilla gorilla
MSKDLVTFGDVAVNFSQEEWEWLNPAQRNLYRKVMLENYRSLVSLGVSVSKPDVISLLEQGKEPWMVKKEGTRGPCPGWEY

SEQ ID NO: 2832 - protein, 81 aa, Gorilla gorilla
ITHKEILPEVQNKAYNKSWQTFHQDTIFDIQQSFPTKEKAHKHEPQKKSYRKKSVEMKHRKVYVEKKLLKCNDCEKVFNQS

SEQ ID NO: 2833 - protein, 81 aa, Gorilla gorilla
ILTGEERMPSARGKSKSKAPITFGDLAIYFSQEEWEWLSPIQKDLYEDVMLENYRNLVSLGLSFRRPNVITLLEKGKAPWM

SEQ ID NO: 2834 - protein, 81 aa, Gorilla gorilla
RPEEKAKMNVEVVKVMPQDLVTFKDVAIDFSQEEWQWMNPAQKRLYRSMMLENYQSLVSLGLCISKPYVISLLEQGREPWE

SEQ ID NO: 2835 - protein, 81 aa, Gorilla gorilla
NKKLEAVGTGIGPKTMSQGLVTFGDVAVDFSQEEWEWLNPIQRNLYRKVMLENYRNLASLGLCVSKPDVISSLEQGKEPWT

SEQ ID NO: 2836 - protein, 81 aa, Gorilla gorilla
MAAQLLTDDALESVTFRDVTVDFTQEEWQQLEPAQKDLYRDVMLENYRNLVSLDWETRPEMKELDPKNDILEDKLSVVGVA

SEQ ID NO: 2837 - protein, 81 aa, Gorilla gorilla
AGSQFLDFKHLGTFLVFEELVTFEDVFVDFSPEELSSLSAAQRNLYREVMLENYRNLVSLGHQFSKPDIISRLEEEESHAM

SEQ ID NO: 2838 - protein, 81 aa, Gorilla gorilla
MNNSQGRVTFEDVTVNFTQGEWQWLNPEQRNLYRDVMLENYSNLVSVGQEETTKPDVILRLEQGKEPWLVEEEVLGSGRAE

SEQ ID NO: 2839 - protein, 81 aa, Gorilla gorilla
MAMALTDPAQVSVTFDDVAVTFTQEEWGQLDLAQRTLYQEVMLENCGLLVSLGCPVPRAELIYHLEHEQEPWTRKEDLSQG

SEQ ID NO: 2840 - protein, 81 aa, Gorilla gorilla
MAASAQVSVTFEDVAVTFTQEEWGQLDAAQRTLYQEVMLETWGLLMSLGCPLFKPELIYQLDHRQELWMVTKDLSQSSYPG

SEQ ID NO: 2841 - protein, 81 aa, Gorilla gorilla
MAAAVLMDRVQSCVTFEDVFVYFSREEWELLEEAQRFLYRDVMLENFALVATLGFWCEAEHEAPSEQSVFVEGVSQVRTAE

SEQ ID NO: 2842 - protein, 81 aa, Gorilla gorilla
MLMDAGQDYMVFEDVAIHFSQEEWGILNDVQRHLHSDVMLENFALLSSVGCWHGAKDEEAPSKQCVSVGVSLVTTLKPALS

SEQ ID NO: 2843 - protein, 81 aa, Gorilla gorilla
MNLTEDYMVFEDVAIHFSQEEWGILNDVQRHLHSDVMLENFALLSSVGCWHGAKDEEAPSKQCVSVGVSLVTTLKPALSTQ

SEQ ID NO: 2844 - protein, 81 aa, Gorilla gorilla
MNLTQDCMVFEDVAIYFSQEEWGILNDAQRHLHSNVMLENFTLLSSVGCWHGAKDEEVPSKQCVSVRVLQVTTALSTLKAQ

SEQ ID NO: 2845 - protein, 81 aa, Gorilla gorilla
MGPAQVPMNSEVIVDPIQGQVNFEDVFVYFSQEEWVLLDEAQRLLYRDVMLENFALMASLGCWHGMEDEEIPFEQSFSIGM

SEQ ID NO: 2846 - protein, 81 aa, Gorilla gorilla
MAAAALRDPAQQGYVTFEDVAVYFSQEEWRLLDDAQRLLYCNVMLENFTLLASLGLASSKTHEITQLESWEEPFMPAWEVV

SEQ ID NO: 2847 - protein, 81 aa, Gorilla gorilla
MAAAALRDPAQGYVTFEDVAVYFSQEEWRLLDDAQRLLYCNVMLENFTLLASLGLASSKTHEITQLESWEEPFMPAWEVVT

SEQ ID NO: 2848 - protein, 81 aa, Gorilla gorilla
DPAQVPVAAELLTDHEEQGYVTFEDVAVYFSQEEWRLLDDAQRLLYCNVMLENFTLLASLGKVLTPHPSILSWAWLFLLFL

SEQ ID NO: 2849 - protein, 81 aa, Gorilla gorilla
MAAAALRDPAQGYVTFEDVAVYFSQEEWRLLDDAQRLLYCNVMLENFTLLASLGKVLTPHPSILSWAWLFLLFLGRGVFFP

SEQ ID NO: 2850 - protein, 81 aa, Gorilla gorilla
DPAQVPVAAELLTDHEEQGYVTFEDVAVYFSQEEWRLLDDAQRLLYCNVMLENFTLLASLGLASSKTHEITQLESWEEPFM

SEQ ID NO: 2851 - protein, 81 aa, Gorilla gorilla
RDPAQVPVAAELLTDHEEGYVTFEDVAVYFSQEEWRLLDDAQRLLYCNVMLENFTLLASLGLASSKTHEITQLESWEEPFM

SEQ ID NO: 2852 - protein, 81 aa, Gorilla gorilla
DPAQVPVAAELLTDHEEQGYVTFEDVAVYFSQEEWRLLDDAQRLLYCNVMLENFTLLASLGCWHGAEAEEAPEQIASVGLL

SEQ ID NO: 2853 - protein, 81 aa, Gorilla gorilla
RDPAQVPVAAELLTDHEEGYVTFEDVAVYFSQEEWRLLDDAQRLLYCNVMLENFTLLASLGKVLTPHPSILSWAWLFLLFL

SEQ ID NO: 2854 - protein, 81 aa, Gorilla gorilla
MAAAALRDPAQQGYVTFEDVAVYFSQEEWRLLDDAQRLLYCNVMLENFTLLASLGCWHGAEAEEAPEQIASVGLLSSNVQQ

SEQ ID NO: 2855 - protein, 81 aa, Gorilla gorilla
MAAAALRDPAQGYVTFEDVAVYFSQEEWRLLDDTQRLLYRNVMLENFTLLASLGLASSKTHEITQLESWEEPFMPAWEVVT

SEQ ID NO: 2856 - protein, 81 aa, Gorilla gorilla
MAAAALRDPAQQGYVTFEDVAVYFSQEEWRLLDDTQRLLYRNVMLENFTLLASLGLASSKTHEITQLESWEEPFMPAWEVV

SEQ ID NO: 2857 - protein, 81 aa, Gorilla gorilla
MAEAALVNMPQGHVTFEDIAVYFSQEEWGLLDESQRCLYHDVMLENFSLMASVGCLHGIEAEEAPSEQTVSAQGVSQARTP

SEQ ID NO: 2858 - protein, 81 aa, Gorilla gorilla
VNMPQIPMVTEEFVKPSQGHVTFEDIAVYFSQEEWGLLDESQRCLYHDVMLENFSLMASVGCLHGIEAEEAPSEQTVSAQG

SEQ ID NO: 2859 - protein, 81 aa, Gorilla gorilla
LVNMPQIPMVTEEFVKPSQGHVTFEDIAVYFSQEEWGLLDESQRCLYHDVMLENFSLMASVAGLSQSNHKDSCSQQKVPVS

SEQ ID NO: 2860 - protein, 81 aa, Gorilla gorilla
MQGHVTFEDIAVYFSQEEWGLLDESQRCLYHDVMLENFSLMASVGCLHGIEAEEAPSEQTVSAQGVSQARTPKLGPSIPNA

SEQ ID NO: 2861 - protein, 81 aa, Gorilla gorilla
MLVTFKDVAVTFTREEWRQLDLAQRTLYREVMLETCGLLVSLGHRVPKPELVHLLEHGQELWIVKRGLSHATCAGDRAQVH

SEQ ID NO: 2862 - protein, 81 aa, Gorilla gorilla
RDSTSVPMTAEAKLMGFTQGCVTFEDVAIYFSQEEWGLLDEAQRLLYRDVMLENFALITALVCWHGMEDEETPEQSVSVEG

SEQ ID NO: 2863 - protein, 81 aa, Gorilla gorilla
MAAALRAPTRQGFVAFEDVAIYFSQEEWELLDEMQRLLYRDVMLENFAVMASLGCWCGAVDEGAPSAESVSVEELSQGRTP

SEQ ID NO: 2864 - protein, 81 aa, Gorilla gorilla
VQLRPQTRMATALMDPASGSVTFEDVAVYFSWEEWDLLDEAQKHLYFDVMLENFALTSSLGLTSSWSHVVAQLGLGEVPSV

SEQ ID NO: 2865 - protein, 81 aa, Gorilla gorilla
MDPASVPIATEVLFKLTEGSVTFEDVAVYFSWEEWDLLDEAQKHLYFDVMLENFALTSSLGCWCGVEHEETPSEQRISGER

SEQ ID NO: 2866 - protein, 81 aa, Gorilla gorilla
VQLRPQTRMATALMDPASGSVTFEDVAVYFSWEEWDLLDEAQKHLYFDVMLENFALTSSLGCWCGVEHEETPSEQRISGER

SEQ ID NO: 2867 - protein, 81 aa, Gorilla gorilla
MDPASVPIATEVLFKLTEGSVTFEDVAVYFSWEEWDLLDEAQKHLYFDVMLENFALTSSLGLTSSWSHVVAQLGLGEVPSV

SEQ ID NO: 2868 - protein, 81 aa, Gorilla gorilla
SPPSPRSSMAAVTLRDSAQGMTFEDVAIYFSQEEWELLDESQRFLYCDVMLENFAHVTSLGYCHGMENEAIASEQSVSIQV

SEQ ID NO: 2869 - protein, 81 aa, Gorilla gorilla
MAAVTLRDSAQGTVTFEDVAVNFSQEEWSLLSEAQRCLYHDVMLENLTLISSLGCWYGAKDETPSKQTLSIQQESPLRTHW

SEQ ID NO: 2870 - protein, 81 aa, Gorilla gorilla
MAAATLRTPAQGTVTFEDVAVHFSWEEWGLLDEAQRCLYRDVMLENLALLTSLDVHHQKQHLGEKHFRSNVGRALFVKTCT

SEQ ID NO: 2871 - protein, 81 aa, Gorilla gorilla
PAAVRAHGSMAELTDSARGCVVFEDVFVYFSREEWELLDDAQRLLYHDVMLENFALLASLGIAFSRSRAVMKLERGEEPWV

SEQ ID NO: 2872 - protein, 81 aa, Gorilla gorilla
MAAAAPRPPAQGTVTFEDVAVNFSQEEWSLLSEAQRCLYHDVMLENLTLISSLGCWYGAKDETPSKQTLSIQQESPLRTHW

SEQ ID NO: 2873 - protein, 81 aa, Gorilla gorilla
MAAAAALRAPAQSSVTFEDVAVNFSLEEWSLLNEAQGCLYHDVMLETLTLISSLGGVPPHRLFPTGACGPQVPSSRIRPSA

SEQ ID NO: 2874 - protein, 81 aa, Gorilla gorilla
MAAAAPRRPTQGTVTFEDVAVKFTQEEWNLLSEAQRCLYHDVTLENLALMSSLGCWCGVEDEAAPSKQSIYIQRETQVRTP

SEQ ID NO: 2875 - protein, 81 aa, Gorilla gorilla
MAVAATLRLSAQGTVTFEDVAVKFTQEEWNLLSEAQRCLYHDVTLENLALMSSLGCWCGVEDEAAPSKQSIYIQRETQVRT

SEQ ID NO: 2876 - protein, 81 aa, Gorilla gorilla
MAAAAPRRPTQGTVTFEDVAVNFSQEEWCLLSEVQRCLYRDVMLENLALISSLGCWCGSKDEEAPCKQSISVQRESQSRTP

SEQ ID NO: 2877 - protein, 81 aa, Gorilla gorilla
MAAAAPRRPTQQGTVTFEDVAVNFSQEEWCLLSEVQRCLYRDVMLENLALISSLGCWCGSKDEEAPCKQSISVQRESQSRT

SEQ ID NO: 2878 - protein, 81 aa, Gorilla gorilla
MAAAAKLRLSAQGTVTFEDVAVNFTWEEWNLLSEAQRCLYRDVTLENLALISSLDPALDGSADNTQTGNLGQSVLPSHPEQ

SEQ ID NO: 2879 - protein, 81 aa, Gorilla gorilla
WCDHGLPQPPPTGDILIQGTVTFEDVAVNFTWEEWNLLSEAQRCLYRDVTLENLALISSLDPALDGSADNTQTGNLGQSVL

SEQ ID NO: 2880 - protein, 81 aa, Gorilla gorilla
MAAAAKLRLSAQGTVTFEDVAVNFTWEEWNLLSEAQRCLYRDVTLENLALISSLGMTFLHVCQALDSTSGDPPTSASQRAG

SEQ ID NO: 2881 - protein, 81 aa, Gorilla gorilla
MAAAAKLRLSAQGTVTFEDVAVNFTWEEWNLLSEAQRCLYRDVTLENLALISSLGCWCGVEDEAAPSKQSIYIQRETQVRT

SEQ ID NO: 2882 - protein, 81 aa, Gorilla gorilla
MAAAAPRRPTQGTVTFEDVAVNFSQEEWCLLSEAQRCLYRDVMLENLALISSLGCWCGSKDEEAPCKQSISIVLCHLCQFL

SEQ ID NO: 2883 - protein, 81 aa, Gorilla gorilla
MQSTVAFEDVAVNFSQEEWSLLSEVQRCLYHDVMLENWVLISSLGCWCGSEDEEAPSKKSISIQRVSQVSTPGAGVSPKKA

SEQ ID NO: 2884 - protein, 81 aa, Gorilla gorilla
HRMTWDYIAIGSHENSVQSTVAFEDVAVNFSQEEWSLLSEVQRCLYHDVMLENWVLISSLGCWCGSEDEEAPSKKSISIQR

SEQ ID NO: 2885 - protein, 81 aa, Gorilla gorilla
MQSTVAFEDVAVNFSQEEWSLLSEVQRCLYHDVMLENWVLISSLGCWCGSEDEEAPSKKSISIQRVSQSLHLSAQAGVARS

SEQ ID NO: 2886 - protein, 81 aa, Gorilla gorilla
MQQSTVAFEDVAVNFSQEEWSLLSEVQRCLYHDVMLENWVLISSLGCWCGSEDEEAPSKKSISIQRVSQVSTPGAGVSPKK

SEQ ID NO: 2887 - protein, 81 aa, Gorilla gorilla
MAAAELTAPAQGIVTFEDVAVYFSWKEWGLLDEAQKCLYHDVMLENLTLTTSLGGSGAGDEEAPYQRSTSPQRVSQVRIPK

SEQ ID NO: 2888 - protein, 81 aa, Gorilla gorilla
RRRSVGCWCRGLCLAVRREQVTFEDVVVDFSQEEWGQLKPAQRTLYHDVMLDTFRLLVSVGHWLPKPNVISLLEQEAELWA

SEQ ID NO: 2889 - protein, 81 aa, Gorilla gorilla
MTPGVRVSTDPEQVTFEDVVVDFSQEEWGQLKPAQRTLYHDVMLDTFRLLVSVGHWLPKPNVISLLEQEAELWAVDSGLPQ

SEQ ID NO: 2890 - protein, 81 aa, Gorilla gorilla
MTPGVRVSTDPEQVTFEDVVVDFSQEEWGQLKPAQRTLYHDVMLDTFRLLVSVERLLWRRQDNCLGCLSCDQDQQKRQGHW

SEQ ID NO: 2891 - protein, 81 aa, Gorilla gorilla
QAEKQEDAAICPVTVLPEEPVTFQDVAVDFSREEWGLLGPTQRTEYRDVMLETFGHLVSVGWETTLENKELAPNSDIPEEE

SEQ ID NO: 2892 - protein, 81 aa, Gorilla gorilla
MEACSMLVPPQASVCFEDVAMAFTQEEWEQLDLAQRTLYREVTLETWEHIVSLGLFLSKSDVISQLEQEEDLCRAEQEAPR

SEQ ID NO: 2893 - protein, 81 aa, Gorilla gorilla
EDVAMAFTQEEWEQLDLAQRTLYREVTLETWEHIVSLGLFLSKSDVISQLEQEEDLCRAEQEAPRDGVSLLLPRLECNGTI

SEQ ID NO: 2894 - protein, 81 aa, Gorilla gorilla
EDVAMAFTQEEWEQLDLAQRTLYREVTLETWEHIVSLGLFLSKSDVISQLEQEEDLCRAEQEAPRGTRPSKKQRRYRARRI

SEQ ID NO: 2895 - protein, 81 aa, Gorilla gorilla
MEACSMLVPPQASVCFEDVAMAFTQEEWEQLDLAQRTLYREVTLETWEHIVSLDWKATLEENRLNSEKDRAREELSHHVEV

SEQ ID NO: 2896 - protein, 81 aa, Gorilla gorilla
GPAQHTSWPCGSAVPTLKSMVTFEDVAVYFSQEEWELLDAAQRHLYHSVMLENLELVTSLGCWHGVEGEEAHPEQNVSVEV

SEQ ID NO: 2897 - protein, 81 aa, Gorilla gorilla
PTLKSMVTFEDVAVYFSQEEWELLDAAQRHLYHSVMLENLELVTSLGNALSQHDVFTCSGEADLPNCFPNWLHHFTPLSAV

SEQ ID NO: 2898 - protein, 81 aa, Gorilla gorilla; identical to SEQ ID NO: 399

SEQ ID NO: 2899 - protein, 81 aa, Gorilla gorilla
MTFEDVAVYFSQEEWGLLDTAQRALYRHVMLENFTLVTSLGLSTSRPRVVIQLERGEEPWVPSGKDMTLARNTYGRLNSGE

SEQ ID NO: 2900 - protein, 81 aa, Gorilla gorilla
PLAVQSPEGHHGHQEPASTSFQPPRIQEEWGLLDRSQKELYWDVMLEKYGTVVSLGLPPHQPEAQAQSELGMLLTGTGVCR

SEQ ID NO: 2901 - protein, 81 aa, Gorilla gorilla
LPSNDTDCPQKKEGKAQIVVPVTFRDVTVIFTEAEWKRLSPEQRNLYKEVMLENYRNLLSLAEPKPEFYTCSSCLLALSCQ

SEQ ID NO: 2902 - protein, 81 aa, Gorilla gorilla
PSNDTDCPQKKEGKAQIVVPVTFRDVTVIFTEAEWKRLSPEQRNLYKEVMLENYRNLLSLDGVSLLLPRLECSRALCLPGS

SEQ ID NO: 2903 - protein, 81 aa, Gorilla gorilla
AKGLPSNDTDCPQKKEGKAQIVVPVTFRDVTVIFTEAEWKRLSPEQRNLYKEVMLENYRNLLSLGQEIETILANTVKSHLY

SEQ ID NO: 2904 - protein, 81 aa, Gorilla gorilla
MLENYSNLVSVGYHVSKPDVIFKLEQGEEPWIVEEFSNQNYPDVDDALEKNNEIQDKHLTQTVFFSNKTLITERENVFVKT

SEQ ID NO: 2905 - protein, 81 aa, Gorilla gorilla
MAAVSPTTRCQESVTFEDVAVVFTDEEWSHLVPIQRDLYKEVMLENYNSIVSLGLPVPQPDVIFQMKRGDKPWMVDLHGSE

SEQ ID NO: 2906 - protein, 81 aa, Gorilla gorilla
EEAAQKRKQKEPGMALPQGHLTVRDVAIEFSLEEWKCLDPTQRALYRAVMLENYRNLHSVDISSKCMMKKFSSTGQGNTEV

SEQ ID NO: 2907 - protein, 81 aa, Gorilla gorilla
MLQTVWFQGLSRNLLFQEPVTFEDVAVYFTQNEWASLHPTQRALYREVMLENYANVTSLYPTAGGFPLDTERTEKVPGALS

SEQ ID NO: 2908 - protein, 81 aa, Gorilla gorilla
MLQTVWFQGLSRNLLFQEPVTFEDVAVYFTQNEWASLHPTQRALYREVMLENYANVTSLSAFPFPKPDLIFQLEQGEAAWG

SEQ ID NO: 2909 - protein, 81 aa, Gorilla gorilla
MLQTVWFQEPVTFEDVAVYFTQNEWASLHPTQRALYREVMLENYANVTSLSAFPFPKPDLIFQLEQGEAAWGPDPWTLAGG

SEQ ID NO: 2910 - protein, 81 aa, Gorilla gorilla
MFQTAWRQEPVTFEDVAVYFTQNEWASLDSVQRALYREVMLENYANVASLAFPFITPVLVSQLEQGELPWGLNPWEPMGRE

SEQ ID NO: 2911 - protein, 81 aa, Gorilla gorilla
EGCPGDQVTPTRSLTAQLQETMTFKDVEVTFSQDEWGWLDSAQRNLYRDVMLENYRNMASLVGPFTRPALISWLEAREPWG

SEQ ID NO: 2912 - protein, 81 aa, Gorilla gorilla
AGQSDTPAAQMPAIFPREGCPGDQVTPTRSLTAQLQETMTFKDVEVTFSQDEWGWLDSAQRNLYRDVMLENYRNMASLGKY

SEQ ID NO: 2913 - protein, 81 aa, Gorilla gorilla
MVRPQDTVAYEDLSEDYTQKKWKGLALSQRALHWNMMLENDRSMASLAGRNMMESSELTPKQKIFKGSESSNSTSGGLFGV

SEQ ID NO: 2914 - protein, 81 aa, Gorilla gorilla
MVRPQDTVAYEDLSEDYTQKKWKGLALSQRALHWNMMLENDRSMASLGRNMMESSELTPKQKIFKGSESSNSTSGGLFGVV

SEQ ID NO: 2915 - protein, 81 aa, Gorilla gorilla
YNSSLMVHQRTHTGEKPYKCNSCGKAFSDSSQLTVHQRVHTGKNLMNVLSVGKPLVSVPLLITTSELMLERSPQVWLGHLL

SEQ ID NO: 2916 - protein, 81 aa, Gorilla gorilla
VGNSGDQAGATVLRMVRPQDTVAYEDLSVDYTQKKWKGLTLSQRALQWNMMPENHYSMASLAGENVMKGSELTPKQEIFKG

SEQ ID NO: 2917 - protein, 81 aa, Gorilla gorilla
DFAQCASPVPTLPQVGNSGDQAGATVLRMVRPQDTVAYEDLSVDYTQKKWKGLTLSQRALQWNMMPENHYSMASLGWSTMA

SEQ ID NO: 2918 - protein, 81 aa, Gorilla gorilla
GNSGDQAGATVLRMVRPQDTVAYEDLSVDYTQKKWKGLTLSQRALQWNMMPENHYSMASLGENVMKGSELTPKQEIFKGSE

SEQ ID NO: 2919 - protein, 81 aa, Gorilla gorilla
TLPQVGNSGDQAGATVLRMVRPQDTVAYEDLSVDYTQKKWKGLTLSQRALQWNMMPENHYSMASLDGETGTEEELIPKHHS

SEQ ID NO: 2920 - protein, 81 aa, Gorilla gorilla
EALPAKDSAWPWEEKPRYLGPVTFEDVAVLFTEAEWKRLSLEQRNLYKEVMLENLGNLVSLVLELGSPRSGLLPLDLDLWL

SEQ ID NO: 2921 - protein, 80 aa, Gorilla gorilla
MWAPREQLLGWATEALPAKDSAWPWEEKPRYLGPVTFEDVAVLFTEAEWKRLSLEQRNLYKEVMLENLGNLVSLVLSYQI

SEQ ID NO: 2922 - protein, 81 aa, Gorilla gorilla
EALPAKDSAWPWEEKPRYLGPVTFEDVAVLFTEAEWKRLSLEQRNLYKEVMLENLGNLVSLAESKPEVHTCPSCPLAFGSQ

SEQ ID NO: 2923 - protein, 81 aa, Gorilla gorilla
ALPAKDSAWPWEEKPRYLGPVTFEDVAVLFTEAEWKRLSLEQRNLYKEVMLENLGNLVSLESKPEVHTCPSCPLAFGSQQF

SEQ ID NO: 2924 - protein, 81 aa, Gorilla gorilla
VSSVLWVFQELQETNKSLDLVSFEEVAVHFTWEEWQDLDDAQRTLYGDVMLETYSSLVSLGHCITKPEMIFKLEQGAEPWI

SEQ ID NO: 2925 - protein, 81 aa, Gorilla gorilla
MFPVSSGCQELQETNKSLDLVSFEEVAVHFTWEEWQDLDDAQRTLYGDVMLETYSSLVSLGHCITKPEMIFKLEQGAEPWI

SEQ ID NO: 2926 - protein, 81 aa, Gorilla gorilla
SIKVFTRGRNPINVANVEKPSVRSQSSLYIIEPIPEKNLMNVMSVGKPCQKSNLSTHQGTHSGEKPYECDECRKTFYDKTV

SEQ ID NO: 2927 - protein, 81 aa, Gorilla gorilla
MDLLTFRDVAIEFSPEEWKCLDPAQQNLYRDVMLENYRNLVSLGFVISNPDLVTCLEQIKEPCNLKIHETAARPPAIYSPF

SEQ ID NO: 2928 - protein, 81 aa, Gorilla gorilla
MDLLTFRDVAIEFSPEEWKCLDPAQQNLYRDVMLENYRNLVSLGFVISNPDLVTCLEQIKEPCNLKIHETAARPPVVQHFW

SEQ ID NO: 2929 - protein, 81 aa, Gorilla gorilla
MELLTFKDVAIEFSPEEWKCLDPSQQNLYRDVMLENYRNLVSLGVTISNPDLVTCLEQRKEPYNLKIHETAASPPAVCSHF

SEQ ID NO: 2930 - protein, 81 aa, Gorilla gorilla
MELLTFKDVAIEFSPEEWKCLDPSQQNLYRDVMLENYRNLVSLGVTISNPDLVTCLEQRKEPYNLKIHETAASPPGHYRKR

SEQ ID NO: 2931 - protein, 81 aa, Gorilla gorilla
MLENYRNLVSLGVTISNPDLVTCLEQRKEPYNLKIHETAASPPAVCSHFTPNLWTVQGIEDSFHKLIPKGHEKRGHENLRK

SEQ ID NO: 2932 - protein, 81 aa, Gorilla gorilla
MELLTFRDVAIEFSPEEWKCLDPAQQNVYRDVMLENYRNLVSLGGLPRRTLYELLRSVYILLLLRSILYGSLRHNCRIVLQ

SEQ ID NO: 2933 - protein, 81 aa, Gorilla gorilla
MELLTFRDVAIEFSPEEWKCLDPAQQNLYRDVMLENYRNLVSLGVAISNPDLVIYLEQRKEPYKVKIHETVAKHPAVCSHF

SEQ ID NO: 2934 - protein, 81 aa, Gorilla gorilla
ELLTFRDVAIEFSPEEWKCLDPAQQNLYRDVMLENYRNLVSLGVAISNPDLVIYLEQRKEPYKVKIHETVAKHPAVCSHFT

SEQ ID NO: 2935 - protein, 81 aa, Gorilla gorilla
MELLTFRDVAIEFSPEEWKCLDPDQQNLYRDVMLENYRNLVSLGVAISNPDLVTCLEQRKEPYNVKIHKIVARPPAVCSHS

SEQ ID NO: 2936 - protein, 81 aa, Gorilla gorilla
ADTSSSGLLEEQKMMKSQGLVSFKDVAVDFTQEEWQQLDPSQRTLYRDVMLENYSHLVSMGYPVSKPDVISKLEQGEEPWI

SEQ ID NO: 2937 - protein, 81 aa, Gorilla gorilla
MAAGQREARPQVSLTFEDVAVLFTRDEWRKLAPSQRNLYRDVMLENYRNLLSLGLPFTKPQVISLLQQGEDPWEVEKEGSG

SEQ ID NO: 2938 - protein, 81 aa, Gorilla gorilla
MAAGQREARPQVSLTFEDVAVLFTRDEWRKLAPSQRNLYRDVMLENYRNLLSLGLSFTKPKVISLLQQGEDPWELEKDSSG

SEQ ID NO: 2939 - protein, 81 aa, Gorilla gorilla
GRGCVGRRCSRSCWERFQESVTFKDVSIDFSWEEWIQADSAQRMTVYGEVMLENYRNPVSLAGNHLSKPNGTSQLEREELS

SEQ ID NO: 2940 - protein, 81 aa, Gorilla gorilla
GRGCVGRRCSRSCWERFQESVTFKDVSIDFSWEEWIQADSAQRMTVYGEVMLENYRNPVSLGNHLSKPNGTSQLEREELSL

SEQ ID NO: 2941 - protein, 81 aa, Gorilla gorilla
MAVDLLSAQERVTFRDVAVFFSQDEWLHLDSAQRALYREVMLENYSILVSLGIPFSMPKLIHQLQQGEDPCMVEREVPSDT

SEQ ID NO: 2942 - protein, 81 aa, Gorilla gorilla
MGIDGLPGCGCGLHQKEWKLLSSAQRTLYREVMLENYSHLVSLGIAFSKPKLIEQLEQGDEPWREENKHLLDLCPEPRTEF

SEQ ID NO: 2943 - protein, 81 aa, Gorilla gorilla
GSSGDQEMTATLLTAGFQTLEKIEDMAVSLIREEWLLDPSQKDLSRDNRPENFRNVFSLGGETRSENRELASKQVISTGIQ

SEQ ID NO: 2944 - protein, 81 aa, Gorilla gorilla
GGCCREDAMVASRLTPGSQGLLKMEDVALTLTPGWTQLDSSQVNLYRDEKQENHSSLVSLGGEIQTKSRDLPPVKKLPEKE

SEQ ID NO: 2945 - protein, 81 aa, Gorilla gorilla
GGCCREDAVVASRLTPESQGLLKVEDVALTLTPEWTQQDSSQGNLCRDEKQENHGSLVSLGDEKQTKSRDLPPAEELPEKE

SEQ ID NO: 2946 - protein, 81 aa, Gorilla gorilla
ATLQEAMKRDCWREARVKKKPVTFEDVAVNFSQEEWDCLDASQRVLYQDVMSETFKNLTSVARIFLHKPELITKLEQEEEQ

SEQ ID NO: 2947 - protein, 81 aa, Gorilla gorilla
EQLKPIEPRDCWREARVKKKPVTFEDVAVNFSQEEWDCLDASQRVLYQDVMSETFKNLTSVARIFLHKPELITKLEQEEEQ

SEQ ID NO: 2948 - protein, 81 aa, Gorilla gorilla
MAAGEPRSLLFFQKPVTFEDVAVNFSQEEWDCLDASQRVLYQDVMSETFKNLTSVARIFLHKPELITKLEQEEEQWRETRV

SEQ ID NO: 2949 - protein, 81 aa, Gorilla gorilla
MNTLQGPVSFKDVAVDFTQEEWQQLDPDEKITYRDVKACKVDDLIERIQENEDKHSSRSARRPCGPRCCCCCCCSRPPRSP

SEQ ID NO: 2950 - protein, 81 aa, Gorilla gorilla
MNTLQGPVSFKDVAVDFTQEEWQQLDPDEKITYRDVKACKVDDLIERIQENEDKHSRQAACINSKTLTEEKENTFSQIYME

SEQ ID NO: 2951 - protein, 81 aa, Gorilla gorilla
MNKSLGSVSFKDVAVDFTQEEWQQLDPEQKITYRDVMLENYSNLVSVGYHIIKPDVISKLEQGEEPWIVEGEFLLQSYPDE

SEQ ID NO: 2952 - protein, 81 aa, Gorilla gorilla
GLLTFRDIAIEFSLAEWQCLDHAQQNLYRDVMLENYRNLVSLGITVSPDLITCLEQNKEPQNIKRNEMVAKHPVTCSHFTQ

SEQ ID NO: 2953 - protein, 81 aa, Gorilla gorilla
MAKRPGPPGSREMGLLTFRDIAIEFSLEEWQCLDCAQRNLYRDVMLENYRNLVSLGIAVSKPDLITCLEQNKESQNIKRNE

SEQ ID NO: 2954 - protein, 81 aa, Gorilla gorilla
MAKRPGPPGSRKMGLLTFRDIAIEFSLAEWQCLDRAQQNLYRDVMLENYRNLVSLGMIVSKPDLIACLEQNKEPQNIKRNE

SEQ ID NO: 2955 - protein, 81 aa, Gorilla gorilla
MAKRPGSPGSRKMGLLTFRDVVIEFSLEEWQCLDHTQQNLYRDVMLENYRNLVSLGIAVSKPDLITCLEQNKEPWNKKRNE

SEQ ID NO: 2956 - protein, 81 aa, Gorilla gorilla
MPGPPGSLEMGPLTFRDVAIEFSLEEWQCLDTAQRNLYRKVMFENYRNLVFLGIAVSKPHLITCLEQGKEPWNRKRQEMVA

SEQ ID NO: 2957 - protein, 81 aa, Gorilla gorilla
MGPLTFMDMAIEFSLEECQCLDTAQRNVYRHVMLENYRNVVFLDLITCLEQGKEPWNMKRHEMVVAKHSGLCSRFAQDLWL

SEQ ID NO: 2958 - protein, 81 aa, Gorilla gorilla
MGPLTFMDMAIEFSLEECQCLDTAQRNVYRHVMLENYRNVVFLAVALTFDLSGLNILSFQSILPFVSALYVMGNRNQCLQK

SEQ ID NO: 2959 - protein, 81 aa, Gorilla gorilla
MGPLTFMDMAIEFSLEECQCLDTAQRNVYRHVMLENYRNVVFLGLCSRFAQDLWLEQNIKDSFQKVTLSRYGKYGHKNLQL

SEQ ID NO: 2960 - protein, 81 aa, Gorilla gorilla
MGPLTFMDMAIEFSLEECQCLDTAQRNVYRHVMLENYRNVVFLDLITCLEQGKEPWNMKRHEMVVAKHSAVALTFDLSGLN

SEQ ID NO: 2961 - protein, 81 aa, Gorilla gorilla
MDMAIEFSLEECQCLDTAQRNVYRHVMLENYRNVVFLGLCSRFAQDLWLEQNIKDSFQKVTLSRYGKYGHKNLQLRKGCKS

SEQ ID NO: 2962 - protein, 81 aa, Gorilla gorilla
MGPLTFMDMAIEFSLEECQCLDTAQRNVYRHVMLENYRNVVFLGIAISKPDLITCLEQGKEPWNMKRHEMVVAKHSDTLPL

SEQ ID NO: 2963 - protein, 81 aa, Gorilla gorilla
MGPLTFMDMAIEFSLEECQCLDTAQRNVYRHVMLENYRNVVFLGIAISKPDLITCLEQGKEPWNMKRHEMVVAKHSGLCSR

SEQ ID NO: 2964 - protein, 81 aa, Gorilla gorilla
DSLGDEMLAAALLKAKSQELVTFEDVAVYFIRKEWKRLEPAQRDLYRDVMLENYGNVFSLDIHVSLTTQKVMLAWLTGTLS

SEQ ID NO: 2965 - protein, 81 aa, Gorilla gorilla
GPGLPAMNPRDQEMAAGFFTAGSQGLGPFKDMALAFPEEEWRHVTPAQIDCFGEYVEPQDCRVSPGGGSKEKEAKPPQEDL

SEQ ID NO: 2966 - protein, 81 aa, Gorilla gorilla
GEEAVAVVRALQRALDGTSSQGMVTFEDMAVSLTWEEWERLDPARRDFCRESAQKDSGSTVPPSLESRVENKELIPMQQIL

SEQ ID NO: 2967 - protein, 81 aa, Gorilla gorilla
MAEPPRLPLTFEDVAIYFSEQEWQDLEAWQKELYKHVMRSNYETLVSLDDGLPKPELISWIEHGGEPFRKWRESQKSGNII

SEQ ID NO: 2968 - protein, 81 aa, Gorilla gorilla
MAEPASVTVTFDDVALYFSEQEWEILEKWQKQMYKQEMKTNYETLDSLGYAFSKPDLITWMEEGRMLLISEQGCLDKTRRT

SEQ ID NO: 2969 - protein, 81 aa, Gorilla gorilla
QEMKTNYETLDSLGYAFSKPDLITWMEEGRMLLISEQGCLDKTRRTTSPPTDEQLNMKNTGKLLCFDDEGTPRAKEESCRL

SEQ ID NO: 2970 - protein, 81 aa, Gorilla gorilla
GGGCRLCRNSGPCRSWIGVTVTFDDVALYFSEQEWEILEKWQKQMYKQEMKTNYETLDSLGYAFSKPDLITWMEEGRMLLI

SEQ ID NO: 2971 - protein, 81 aa, Gorilla gorilla
EMKTNYETLDSLGYAFSKPDLITWMEEGRMLLISEQGCLDKTRRTTSPPTDEQLNMKNTGKLLCFDDEGTPRAKEESCRLN

SEQ ID NO: 2972 - protein, 81 aa, Gorilla gorilla
SLGYAFSKPDLITWMEEGRMLLISEQGCLDKTRRTTSPPTDEQLNMKNTGKLLCFDDEGTPRAKEESCRLNGPQKQDLCAA

SEQ ID NO: 2973 - protein, 81 aa, Gorilla gorilla
KKLASCEKTVTELGTQLEGKWAVLGTLLQEYGLLQRRLENLENLLRNRNFWILRLPPGIKGDIPKVPVAFDDVSIYFSTPE

SEQ ID NO: 2974 - protein, 81 aa, Gorilla gorilla
RNFWVLRLPPGSKGEAPKVPVTFVDIAVYFSEDEWKNLDEWQKELYNNLVKENYKTLISLDAEGSVPKPDAPVQAEPREEP

SEQ ID NO: 2975 - protein, 81 aa, Gorilla gorilla
KKLADCEKTAVEFGNHMESKWAVLGTLLQEYGLLQRRLENLENLLRNRNFWVLRLPPGSKGEAPKAGVPVTFVDIAVYFSE

SEQ ID NO: 2976 - protein, 81 aa, Gorilla gorilla
FWVLRLPPGSKGEAPKAGVPVTFVDIAVYFSEDEWKNLDEWQKELYNNLVKENYKTLISLDAEGSVPKPDAPVQAEPREEP

SEQ ID NO: 2977 - protein, 81 aa, Gorilla gorilla
KKLADCEKMAVEFGNQLEGKWAVLGTLLQEYGLLQRRLENMENLLRNRNFWILRLPPGSKGEAPKVSRSLENDGVCFTEQE

SEQ ID NO: 2978 - protein, 81 aa, Gorilla gorilla
NFWILRLPPGSKGEAPKVSRSLENDGVCFTEQEWENLEDWQKELYRNVMESNYETLVSLNRVLLYCPGWSAVQWHDLGSLQ

SEQ ID NO: 2979 - protein, 81 aa, Gorilla gorilla
PGGAHPAGGVMIKQELQYTQEGPADPPGEFSCIAEEQAFLSPEQTELWGGQGSSVLLETGPGDSTLEEPVGSRDPSSSRTV

SEQ ID NO: 2980 - protein, 81 aa, Gorilla gorilla
GPGGAHPGGVMIKQELQYTQEGPADPPGEFSCIAEEQAFLSPEQTELWGGQGSSVLLETGPGDSTLEEPVGSRDPSSSRTV

SEQ ID NO: 2981 - protein, 81 aa, Gorilla gorilla
YGLLQRRLENMENLLRNRNFWILRLPPGSKGEAPKVSRSLENDGVCFTEQEWENLEDWQKELYRNVMESNYETLVSLSSSD

SEQ ID NO: 2982 - protein, 81 aa, Gorilla gorilla
LEEEGPGGAHPAGGVMIKQELQYTQEGPADPPGEFSCIAEEQAFLSPEQTELWGGQGSSVLLETGPGDSTLEEPVGSRDPS

SEQ ID NO: 2983 - protein, 81 aa, Gorilla gorilla
MRENYETLVSVGTAELLPLSAFLSPSEPGRAVGGGSHADEGQEPAGCEDPQGGQPRHSLHLTALVQLVKEIPEFLFGEVKG

SEQ ID NO: 2984 - protein, 81 aa, Gorilla gorilla
MPSPDSMTFEDIIVDFTQEEWALLDTSQRKLFQDVMLENISHLVSIGKQLCKSVVLSQLEQVEKLSTQRISLLQGREFGIK

SEQ ID NO: 2985 - protein, 81 aa, Gorilla gorilla
DFTQEEWALLDTSQRKLFQDVMLENISHLVSIGKQLCKSVVLSQLEQVEKLSTQRISLLQGREFGIKHQEIPFIQHIYQKG

SEQ ID NO: 2986 - protein, 81 aa, Gorilla gorilla
STQRISLLQGREFGIKHQEIPFIQHIYQKGTSTISTMRSHTQEDPFLCNDLGEDFTQHIALTQNVITYMRKKHFVSKKFGK

SEQ ID NO: 2987 - protein, 81 aa, Gorilla gorilla
GIKHQEIPFIQHIYQKGTSTISTMRSHTQEDPFLCNDLGEDFTQHIALTQNVITYMRKKHFESGRSSEHQSVVTATSIKTW

SEQ ID NO: 2988 - protein, 81 aa, Gorilla gorilla
SVVLSQLEQVEKLSTQRISLLQGREFGIKHQEIPFIQHIYQKGTSTISTMRSHTQEDPFLCNDLGEDFTQHIALTQNVITY

SEQ ID NO: 2989 - protein, 81 aa, Gorilla gorilla
MDMAQEPVTFRDVAIYFSREEWACLEPSQRALYRDVMLDNFSSVAALGFCSPRPDLVSRLEQWEEPWVEDWERPELQAVQR

SEQ ID NO: 2990 - protein, 81 aa, Gorilla gorilla
MDMAQEPVTFRDVAIYFSREEWACLEPSQRALYRDVMLDNFSSVAALAPDQTSSLAWNSGRSRGLKIGRDLSSRQCRGDPG

SEQ ID NO: 2991 - protein, 81 aa, Gorilla gorilla
MAATFQLPGHQAMPLTFQDVAVYFSQAEGRQLGPQQRALYRDVMLENYGNVASLGFPVPKPELISQLEQGKELWVLNLLGA

SEQ ID NO: 2992 - protein, 81 aa, Gorilla gorilla
AAHAHRMAATFQLPGHQAMPLTFQDVAVYFSQAEGRQLGPQQRALYRDVMLENYGNVASLGFPVPKPELISQLEQGKELWV

SEQ ID NO: 2993 - protein, 81 aa, Gorilla gorilla
RKPNPQAMAALFLSAPHQAKVTFEDVAVYLSREEWGRLGPAQRGLYRDVMLETYGNLVSLGVGPAGPKPGVISQLERGDEP

SEQ ID NO: 2994 - protein, 81 aa, Gorilla gorilla
MAALFLSAPHQAKVTFEDVAVYLSREEWGRLGPAQRGLYRDVMLETYGNLVSLGVGPAGPKPGVISQLERGDEPWVLDVQG

SEQ ID NO: 2995 - protein, 81 aa, Gorilla gorilla
MAALFLSAPHQAKVTFEDVAVYLSREEWGRLGPAQRGLYRDVMLETYGNLVSLALGIRTEYKELTSQETFGEEDPQGSEPV

SEQ ID NO: 2996 - protein, 81 aa, Gorilla gorilla
LRKPNPQAMAALFLSAPHQAKVTFEDVAVYLSREEWGRLGPAQRGLYRDVMLETYGNLVSLALGIRTEYKELTSQETFGEE

SEQ ID NO: 2997 - protein, 81 aa, Gorilla gorilla
MAMALPMPGPQEAVVFEDVAVYFTRIEWSCLAPDQQALYRDVMLENYGNLASLGFLVAKPALISLLEQGEEPGALILQVAE

SEQ ID NO: 2998 - protein, 81 aa, Gorilla gorilla
MAMALPMPGPQEAVVFEDVAVYFTRIEWSCLAPDQQALYRDVMLENYGNLASLALISLLEQGEEPGALILQVAEQSVAKAS

SEQ ID NO: 2999 - protein, 81 aa, Gorilla gorilla
LASLALISLLEQGEEPGALILQVAEQSVAKASLCTDSRMEAGIMESPLQRKLSRQAGLPGTVWGCLPWGHPAGGHPAPPHP

SEQ ID NO: 3000 - protein, 81 aa, Gorilla gorilla
MGFLGCWCVSFQEVVTFGDVAVHFSREEWQCLDPGQRALYREVMLENHSSVAGLAGFLVFKPELISRLEQGEEPWVLDLQG

SEQ ID NO: 3001 - protein, 81 aa, Gorilla gorilla
MAPGLLTTRKEALMAFRDVAVAFTQKEWKLLSSAQRTLYREVMLENYSHLVSLGIAFSKPKLIEQLEQGDEPWREENKHLL

SEQ ID NO: 3002 - protein, 81 aa, Gorilla gorilla
ENYSHLVSLGIAFSKPKLIEQLEQGDEPWREENKHLLDLCPGEWEALCKRGCRAVRSSAGKEGGAIFEVLGGSSSSGLLGH

SEQ ID NO: 3003 - protein, 81 aa, Gorilla gorilla
MNTFQASVSFQDVTVEFTQEEWQHMGPVERTLYRDVMLENYSHLVSVGYCFTKPELIFTLEQGEDPWLLEKEKGFLSRNSP

SEQ ID NO: 3004 - protein, 81 aa, Gorilla gorilla
MASPSPPPESKEEWDYLDPAQRSLYKDVMMENYGNLVSLGLTLLPRLVCSDANTACCSLNLLGLSDQSSHLSYLSSWDYRC

SEQ ID NO: 3005 - protein, 81 aa, Gorilla gorilla
ENSKEDKMVTVCPNTESCESITLKDIAVNFSRGEWKKLEPFQKELYKEVLLENLRNLEFLDFPVSKLELISQLKWVELPWL

SEQ ID NO: 3006 - protein, 81 aa, Gorilla gorilla
DRRRSAGTTKEAGRPLEMAVSEPEASAAEWKQLDPAQSNLDNDVMLENYSNQASMGCQAPKPDMISKLEKGEAPWLGKGKR

SEQ ID NO: 3007 - protein, 81 aa, Gorilla gorilla
RRRSAGTTKEAGRPLEMAVSEPEASAAKEWKQLDPAQSNLDNDVMLENYSNQASMGCQAPKPDMISKLEKGEAPWLGKGKR

SEQ ID NO: 3008 - protein, 81 aa, Gorilla gorilla
EAGRPLEMAVSEPEASAAVSVTFKHVTMAFTQKEWKQLDPAQSNLDNDVMLENYSNQASMGCQAPKPDMISKLEKGEAPWL

SEQ ID NO: 3009 - protein, 81 aa, Gorilla gorilla
MAAGLLTAGPRGSTFFSSVTVAFAQEGWRCLVSTPRDRFKEGIPGKSRSLVLLGLPVSQPGMNSQLEQREGAWMLEGEDLR

SEQ ID NO: 3010 - protein, 81 aa, Gorilla gorilla
ENTGEEGMAAGLLTAGPRGSTFFSSVTVAFAQEGWRCLVSTPRDRFKEGIPGKSRSLVLLGLPVSQPGMNSQLEQREGAWM

SEQ ID NO: 3011 - protein, 81 aa, Gorilla gorilla
MAMSQESLTFKDVFVDFTLEEWQQLDSAQKNLYRDVMLENYSHLVSVGYLVEKPDVIFRLGPGEESWMADGGTPVRTCAEV

SEQ ID NO: 3012 - protein, 81 aa, Gorilla gorilla
MAMSQESLTFKDVFVDFTLEEWQQLDSAQKNLYRDVMLENYSHLVSVGYLVEKPDVIFRLGPGEESWMADGGTPVRTCAGE

SEQ ID NO: 3013 - protein, 81 aa, Gorilla gorilla
VEKPDVIFRLGPGEESWMADGGTPVRTCAGEDRPGESGRGKETRLVGESLASGMCSGALLRALDLWTCLGSDERNCCHVQM

SEQ ID NO: 3014 - protein, 81 aa, Gorilla gorilla
MAMSQESLTFKDVFVDFTLEEWQQLDSAQKNLYRDVMLENYSHLVSVGYLVEKPDVIFRLGPGEESWMADGGTPVRTCAGT

SEQ ID NO: 3015 - protein, 81 aa, Gorilla gorilla
MAMSQESLTFKDVFVDFTLEEWQQLDSAQKNLYRDVMLENYSHLVSVGHLVEKPDMIFRLGPGEESWMADGGTPVQTCAGE

SEQ ID NO: 3016 - protein, 81 aa, Gorilla gorilla
MAMSQESLTFKDVFVDFTLEEWQQLDSAQKNLYRDVMLENYSHLVSVGHLVEKPDMIFRLGPGEESWMADGGTPVQTCAVW

SEQ ID NO: 3017 - protein, 81 aa, Gorilla gorilla
MAMSQESLTFKDVFVDFTLEEWQQLDSAQKNLYRDVMLENYSHLVSVGHLVEKPDMIFRLGPGEESWMADGGTPVQTCAEV

SEQ ID NO: 3018 - protein, 81 aa, Gorilla gorilla
MAMSQESLTFKDVFVDFTLEEWQQLDSAQKNLYRDVMLENYSHLVSVGHLVEKPDMIFRLGPGEESWMADGGTPVQTCAVF

SEQ ID NO: 3019 - protein, 81 aa, Gorilla gorilla
MAMSQESLTFKDVFVDFTLEEWQQLDSAQKNLYRDVMLENYSHLVSVGHLVEKPDMIFRLGPGEESWMADGGTPVQTCAVE

SEQ ID NO: 3020 - protein, 81 aa, Gorilla gorilla
MAKPQGLVTFEDVAVDFTQEEWQYLNPPQRTLYRDVMLETYSNLVFVGQQVTKPNLILKLEVEECPAEGKIPFWNFPEVCH

SEQ ID NO: 3021 - protein, 81 aa, Gorilla gorilla
MIESQEPVTFEDVAVDFTQEEWQQLNPAQKTLHRDVMLETYNHLVSVGCSDIKPDVIFKVEHGKDPWIIESELSRWIYPGI

SEQ ID NO: 3022 - protein, 81 aa, Gorilla gorilla
MIESQEPVTFEDVAVDFTQEEWQQLNPAQKTLHRDVMLETYNHLVSVGCSDIKPDVIFKVEHGKDPWIIESELSRWIYPDR

SEQ ID NO: 3023 - protein, 81 aa, Gorilla gorilla
MVEGEEEWQQLNPAQKTLHRDVMLETYNHLVSVGCSDIKPDVIFKVEHGKDPWIIESELSRWIYPDRVKGLESSQQIISGE

SEQ ID NO: 3024 - protein, 80 aa, Gorilla gorilla
MIESQEPVTFEDVAVDFTQEEWQQLNPAQKTLHRDVMLETYNHLVSVGCSDIKPDVIFKVEHGKDPWIIESELSRWIYPE

SEQ ID NO: 3025 - protein, 81 aa, Gorilla gorilla
MIESQEPVTFEDVAVDFTQEEWQQLNPAQKTLHRDVMLETYNHLVSVGCSDIKPDVIFKVEHGKDPWIIESELSRWIYPDN

SEQ ID NO: 3026 - protein, 81 aa, Gorilla gorilla
MIESQEEWQQLNPAQKTLHRDVMLETYNHLVSVGCSDIKPDVIFKVEHGKDPWIIESELSRWIYPDRVKGLESSQQIISGE

SEQ ID NO: 3027 - protein, 81 aa, Gorilla gorilla
KVGREPASSIKALLCGRGEARAFDDIAKYFSEKEWEKMKAWEKIIYVYMKRKYEAMTKLGFKATLPPFMCNKRVADFQGND

SEQ ID NO: 3028 - protein, 81 aa, Gorilla gorilla
GDDAFVRRPRVGSQIPEKIQKAFDDIAKYFSEKEWEKMKAWEKIIYVYMKRKYEAMTKLGFKATLPPFMCNKRVADFQGND

SEQ ID NO: 3029 - protein, 81 aa, Gorilla gorilla
RDHTFAKRPRDDAKTSEKRSKALDDIATYFSKKEWEEMKYSEKISYVYMKRNYKAMTKLGFNVTLPPFMCNKQATDFQGND

SEQ ID NO: 3030 - protein, 81 aa, Gorilla gorilla
GDDAFARRPRAGAQIPEKIQKAFDDIAKYFSKKEWEKMKSSEKIIYVYMKRKYEAMTKLGFKATLSPFMHNTGATDLQEND

SEQ ID NO: 3031 - protein, 81 aa, Gorilla gorilla
GDDAFARRPMVGAQIPEKIQKAFDDIAKYFSKEEWEKMKASEKIFYVYMKRKYEAMTKLGFKATLPPFMCNKRAEDFQGND

SEQ ID NO: 3032 - protein, 81 aa, Gorilla gorilla
GDDAFARRPRDDAQISEKLRKAFDDIAKYFSKKEWEKMKSSEKIIYVYMKLNYEVMTKLGFKVTLPPFMCSKRAADFHGND

SEQ ID NO: 3033 - protein, 81 aa, Gorilla gorilla
KRIKHWKMASKLILPESLSLLTFEDVAVYFSEEEWKLLNPLEKTLYNDVMQDIYETVISLGLKLKNDTGNDHPISVSTSEI

SEQ ID NO: 3034 - protein, 81 aa, Gorilla gorilla
ALVLVEFLQREPDGTKNESLLTFEDVAVYFSEEEWKLLNPLEKTLYNDVMQDIYETVISLGLKLKNDTGNDHPISVSTSEI

SEQ ID NO: 3035 - protein, 81 aa, Pongo abelii
FPVSSGCFQELQETNKSLGLVSFEDVAVHFTWEEWQDLDDVQRTLYWDVMLETYSSLVSLGHCITKPEMIFKLEQGAEPWI

SEQ ID NO: 3036 - protein, 81 aa, Pongo abelii
MHSLKKVTFEDVAIDFTQEEWAMMDTSKRKLYRDVMLENISHLVSLGYQISKSCITLQLEQGKELWQEGREFLPDQNPDRE

SEQ ID NO: 3037 - protein, 81 aa, Pongo abelii
FPVSSGCFQELQETNKSLGLVSFEDVAVHFTWEEWQDLDDVQRTLYRDVMLETCSSLVSLGHCITKPEMIFKLEQGAEPWI

SEQ ID NO: 3038 - protein, 81 aa, Pongo abelii
MFPVSSGCFQELQETNKSLVSFEDVAVHFTWEEWQDLDDVQRTLYRDVMLETCSSLVSLGHCITKPEMIFKLEQGAEPWIV

SEQ ID NO: 3039 - protein, 81 aa, Pongo abelii
MIKFQERVTFKDVAVVFTNEELALLDKAQINLYQDVMLENFRNLISVRDGIKNNILNLQEKGLNYLSQEVLHCWQIWKQRI

SEQ ID NO: 3040 - protein, 81 aa, Pongo abelii
MIKFQIKGIHVQERVTFKDVAVVFTNEELALLDKAQINLYQDVMLENFRNLISVRDGIKNNILNLQEKGLNYLSQEVLHCW

SEQ ID NO: 3041 - protein, 81 aa, Pongo abelii
ASGCPGADRNLLVYSVYEKGPLTFRDVAIEFSLEEWQCLDTAQQDLYRKVMLENYRNLVFLAGIAVSKPDLITCLEQGKEP

SEQ ID NO: 3042 - protein, 81 aa, Pongo abelii
SGCPGADRNLLVYSVYEKGPLTFRDVAIEFSLEEWQCLDTAQQDLYRKVMLENYRNLVFLGIAVSKPDLITCLEQGKEPWN

SEQ ID NO: 3043 - protein, 81 aa, Pongo abelii
LQEENVRDTQQVTTLQLPPNRVSPFKDMILCFSEEDWSLLDPAQTGFYGEFIIGEDYGVSMPPNDLAAQPDLSQGEENEPR

SEQ ID NO: 3044 - protein, 81 aa, Pongo abelii
LGSGGKKAQIISVLSQIYVNRVSPFKDMILCFSEEDWSLLDPAQTGFYGEFIIGEDYGVSMPPNDLAAQPDLSQGEENEPR

SEQ ID NO: 3045 - protein, 81 aa, Pongo abelii
MAGSQGLLIFRDVAIEFSPEEWSYLDPAQQNLYRDVMLENYRNLVSLGIAVSKPDLITCLEQRNEPWDVKKHETVARHPAV

SEQ ID NO: 3046 - protein, 81 aa, Pongo abelii
RHFRRPEPCREPGASPTQDSVAFEDVAVNFTQEEWALLDSSQKNLYREVMQETCRNLASVGSKWKDQNIEDHFEKPGKDIR

SEQ ID NO: 3047 - protein, 81 aa, Pongo abelii
MDSVAFEDVAVNFTQEEWALLDSSQKNLYREVMQETCRNLASVGSKWKDQNIEDHFEKPGKDIRNHMVQRLCESKEGGQYG

SEQ ID NO: 3048 - protein, 81 aa, Pongo abelii
AEPLHPVCTCGRHFRRPEPCREPGASPTQDSVAFEDVAVNFTQEEWALLDSSQKNLYREVMQETCRNLASVEIIWYRDCVK

SEQ ID NO: 3049 - protein, 81 aa, Pongo abelii
MGLLAFRDVALEFSAEEWECLDLAQRSLYRDVMLENYRNLFSLGLAMSKPELIICLEARKEPWNVNTEKTAKHSALSSYLT

SEQ ID NO: 3050 - protein, 81 aa, Pongo abelii
EARKEPWNVNTEKTAKHSALSSYLTEDILPEQGLQVSFQKVMLRRYERCCLEKLHLRNDWEIVVETGFHRVSQDDLDLLTS

SEQ ID NO: 3051 - protein, 81 aa, Pongo abelii
MDSVSFEDVAVAFTQEEWALLDPSQKNLYRDVMQEIFRNLASVGNKSEDQNIQDDFKNPGRNLSSHVVERLFAIKEGSQYG

SEQ ID NO: 3052 - protein, 81 aa, Pongo abelii
MGLLAFRDVALEFSAEEWECLDLAQRSLYRDVMLENYRNLFSLGEDNFNMQFLFHSLAMSKPELIICLEARKEPWNVNTEK

SEQ ID NO: 3053 - protein, 81 aa, Pongo abelii
RKEPWNVNTEKTAKHSALSSYLTEDILPEQGLQVSFQKVMLRRYERCCLEKLHLRNDWEIPCEDVLASPLPSAMIVSFLRP

SEQ ID NO: 3054 - protein, 81 aa, Pongo abelii
FSLGLAMSKPELIICLEARKEPWNVNTEKTAKHSALSSYLTEDILPEQGLQVSFQKVMLRRYERCCLEKLHLRNDWEIVAM

SEQ ID NO: 3055 - protein, 81 aa, Pongo abelii
LFHSLAMSKPELIICLEARKEPWNVNTEKTAKHSALSSYLTEDILPEQGLQVSFQKVMLRRYERCCLEKLHLRNDWEIVAM

SEQ ID NO: 3056 - protein, 81 aa, Pongo abelii
KGTGSYIAKMPGHPENRKTGLLAFSDVVIEFSPEEWACLDPAQRNLYRNVMFENYRNLVSLAILSYSIQDLLPEQDMKDLC

SEQ ID NO: 3057 - protein, 81 aa, Pongo abelii
QRNLYRNVMFENYRNLVSLAILSYSIQDLLPEQDMKDLCQKVTLTRHRSWGLDNLHLVKDWRTVNEERVLLVLREVRNPEW

SEQ ID NO: 3058 - protein, 81 aa, Pongo abelii
ILSYSIQDLLPEQDMKDLCQKVTLTRHRSWGLDNLHLVKDWRTVNEERVLLVLREVRNPEWRDQLKPWQKNMDCEDFMDIY

SEQ ID NO: 3059 - protein, 81 aa, Pongo abelii
NSFPQVILLPNPPKVFRLQGLLAFSDVVIEFSPEEWACLDPAQRNLYRNVMFENYRNLVSLAILSYSIQDLLPEQDMKDLC

SEQ ID NO: 3060 - protein, 81 aa, Pongo abelii
AQRNLYRNVMFENYRNLVSLAILSYSIQDLLPEQDMKDLCQKVTLTRHRSWGLDNLHLVKDWRTVNEGKGQKEYYNRLTQC

SEQ ID NO: 3061 - protein, 81 aa, Pongo abelii
EDSPADMQKVRICSEGGWVPALFDEVAIYFSDEEWEVLTEQQKALYREVMRMNYETVLSLEFPFPKPDMITRLEGEEESQN

SEQ ID NO: 3062 - protein, 81 aa, Pongo abelii
MINFQESVTFQDVAVDFTVEEWQLLDCAERTLYWDVMLENYRNLISVGFPITKTKVILKVEQGQEPWMVEGVNPHQSSPES

SEQ ID NO: 3063 - protein, 81 aa, Pongo abelii
MINFQESVTFQDVAVDFTVEEWQLLDCAERTLYWDVMLENYRNLISVGFPITKTKVILKVEQGQEPWMVEGVNPHQSSPGW

SEQ ID NO: 3064 - protein, 81 aa, Pongo abelii
EEPWMAEKEGPGDPSSDSKSKMETTESTAKSAISQERLYHGIMMERFMRDDILYSTLRKVSTYDDVLERHQETCVRDVRQA

SEQ ID NO: 3065 - protein, 81 aa, Pongo abelii
GESLESRVTLGSLTAESQELLTFKDVSVDFTQEEWGQLAPAHRNLYREVMLENYGNLVSVGYQLSKPGVISQLEKGEEPWL

SEQ ID NO: 3066 - protein, 81 aa, Pongo abelii
GESLESRVTLGSLTAESQELLTFKDVSVDFTQEEWGQLAPAHRNLYREVMLENYGNLVSVDLESKTKTKESALQNGISWEE

SEQ ID NO: 3067 - protein, 81 aa, Pongo abelii
QGESLESRVTLGSLTAESQELLTFKDVSVDFTQEEWGQLAPAHRNLYREVMLENYGNLVSVAGYQLSKPGVISQLEKGEEP

SEQ ID NO: 3068 - protein, 81 aa, Pongo abelii
SNLVSVGYCITKPEVIFKIEQGEEPWILEKGFPSQCHPERKWKVDDMLESSQENEDDHFWELLFHNNKTLRFQLLGIKQFL

SEQ ID NO: 3069 - protein, 81 aa, Pongo abelii
MSKFQGPVTLKDVIVEFTKEEWKLLTPAQRTLYKDVMLENYSHLVSVGYHVNKPNAVFKLKQGKQPWILEVEFPHRGFPED

SEQ ID NO: 3070 - protein, 81 aa, Pongo abelii
SNWMSSPLYSTEVEQKFQGSVSFKDVTVGFTQEEWQHLDPSQRALYRDVMLENYSNLVSVGYCVHKPEVIFRLEQGEEPWK

SEQ ID NO: 3071 - protein, 81 aa, Pongo abelii
MANATGSGVEQKFQGSVSFKDVTVGFTQEEWQHLDPSQRALYRDVMLENYSNLVSVGYCVHKPEVIFRLEQGEEPWKLEEE

SEQ ID NO: 3072 - protein, 81 aa, Pongo abelii
MNKVEQKFQGSVSFKDVTVGFTQEEWQHLDPSQRALYRDVMLENYSNLVSVGYCVHKPEVIFRLEQGEEPWKLEEEFPSQS

SEQ ID NO: 3073 - protein, 81 aa, Pongo abelii
DVMLENYSLLLSVGYCITKPEVVCKLERGEVLWILEEESPSQSHLDCCIDDDLMEKRQENQDQHLQKVDFVNNKTLTMDRN

SEQ ID NO: 3074 - protein, 81 aa, Pongo abelii
RDVMLENYGNLVSVGLLSSKPKLITQLEQGAEPWTEVREAPSGTHTVQDYWFETKMSALKQSTSEGSVLGERTKTVMMEKG

SEQ ID NO: 3075 - protein, 81 aa, Pongo abelii
MTLLTFRDVAIEFSLEEWKCLDLAQQNLYRDVMLENYRNLFSIGLTVSKPGLITCLEQRKEPWNVKRQEAVDGHPAVSSHF

SEQ ID NO: 3076 - protein, 81 aa, Pongo abelii
SHFTQDLLPEQGIQDAFPKTILRGYGNCGLDNLYLRKDWESLDECKLQKDYNGLNQCSSTTHSKIFQCNKYVKIFDNFSNL

SEQ ID NO: 3077 - protein, 81 aa, Pongo abelii
MTLLTFRDVAIEFSLEEWKCLDLAQQNLYRDVMLENYRNLFSIGLTVSKPGLITCLEQRKEPWNVKRQEAVDGHPEMGFHH

SEQ ID NO: 3078 - protein, 81 aa, Pongo abelii
MAGAQTLLTFRDVAIEFSLEEWKCLDLAQQNLYRDVMLENYRNLFSIGLTVSKPGLITCLEQRKEPWNVKRQEAVDGHPAV

SEQ ID NO: 3079 - protein, 81 aa, Pongo abelii
MAGAQTLLTFRDVAIEFSLEEWKCLDLAQQNLYRDVMLENYRNLFSIGLTVSKPGLITCLEQRKEPWNVKRQEAVDGHPEM

SEQ ID NO: 3080 - protein, 81 aa, Pongo abelii
SSHFTQDLLPEQGIQDAFPKTILRGYGNCGLDNLYLRKDWESLDECKLQKDYNGLNQCSSTTHSKIFQCNKYVKIFDNFSN

SEQ ID NO: 3081 - protein, 81 aa, Pongo abelii
MAGAQTLLTFRDVAIEFSLEEWKCLDLAQQNLYRDVMLENYRNLFSIGLTVSKPGLITCLEQRKEPWNVKRQEAVDGHPDI

SEQ ID NO: 3082 - protein, 81 aa, Pongo abelii
MAGAQTLLTFRDVAIEFSLEEWKCLDLAQQNLYRDVMLENYRNLFSIGLTVSKPGLITCLEQRKEPWNVKRQEAVDGHPAL

SEQ ID NO: 3083 - protein, 81 aa, Pongo abelii
MTLLTFRDVAIEFSLEEWKCLDLAQQNLYRDVMLENYRNLFSIGLTVSKPGLITCLEQRKEPWNVKRQEAVDGHPGWCSGV

SEQ ID NO: 3084 - protein, 81 aa, Pongo abelii
VSLDKFTAVSSHFTQDLLPEQGIQDAFPKTILRGYGNCGLDNLYLRKDWESLDECKLQKDYNGLNQCSSTTHSKIFQCNKY

SEQ ID NO: 3085 - protein, 81 aa, Pongo abelii
MTLLTFRDVAIEFSLEEWKCLDLAQQNLYRDVMLENYRNLFSIGLTVSKPGLITCLEQRKEPWNVKRQEAVDGHPGWSAVV

SEQ ID NO: 3086 - protein, 81 aa, Pongo abelii
VSKPGLITCLEQRKEPWNVKRQEAVDGHPAVSSHFTQDLLPEQGIQDAFPKTILRGYGNCGLDNLYLRKDWESLDECKLQK

SEQ ID NO: 3087 - protein, 81 aa, Pongo abelii
MPWAEKNLLVYSSSKETLLTFRDVAIEFSLEEWKCLDLAQQNLYRDVMLENYRNLFSIGLTVSKPGLITCLEQRKEPWNVK

SEQ ID NO: 3088 - protein, 80 aa, Pongo abelii
MTLLTFRDVAIEFSLEEWKCLDLAQQNLYRDVMLENYRNLFSIGLTVSKPGLITCLEQRKEPWNVKRQEAVDGHPASTNV

SEQ ID NO: 3089 - protein, 81 aa, Pongo abelii
MTLLTFRDVAIEFSLEEWKCLDLAQQNLYRDVMLENYRNLFSIGLTVSKPGLITCLEQRKEPWNVKRQEAVDGHPEFHSVT

SEQ ID NO: 3090 - protein, 81 aa, Pongo abelii
PGLITCLEQRKEPWNVKRQEAVDGHPEFHSVTRAVVQWRHLSSLQPLPPGLEPSSHFSLLRTWNYRCTPPHPANFCIFNRD

SEQ ID NO: 3091 - protein, 81 aa, Pongo abelii
MAGAQTLLTFRDVAIEFSLEEWKCLDLAQQNLYRDVMLENYRNLFSIGLTVSKPGLITCLEQRKEPWNVKRQEAVDGHPGP

SEQ ID NO: 3092 - protein, 81 aa, Pongo abelii
MAVTFEDVTIIFTWEEWKFLDSSQKRLYREVMWENYTNVMSVENWNESYKSQEEKFRYLEYENFSCWQGWWNAGAQMYKNQ

SEQ ID NO: 3093 - protein, 81 aa, Pongo abelii
SRKNLSMEKEQKLIVQHSYIPVEEALPQYVGVICQKDLLRDSTEEKYCGCNKCKEIYYWNSRCVFHKRNQPGENLYQCSIR

SEQ ID NO: 3094 - protein, 81 aa, Pongo abelii
QMGSIKEKMKAGSPTGKPQEPVTFKDVVVEFSKEEWGQLDSAVKNLYRNVMLENFRNLNSLRKAHLLSKPFESLKLESRKK

SEQ ID NO: 3095 - protein, 81 aa, Pongo abelii
MIQSQISFEDVAVDFTLEEWQLLNPTQKNLYRDVMLENYSNLVFLEVWLDNPKMWLRDNQDNLKNMERGHKYDVFGKIFNS

SEQ ID NO: 3096 - protein, 81 aa, Pongo abelii
MIQSQISFEDVAVDFTLEEWQLLNPTQKNLYRDVMLENYSNLVFLGFQILKPDAVFKLEQQDPWIIDQEILKQNFSEVWLD

SEQ ID NO: 3097 - protein, 81 aa, Pongo abelii
MSQGLVTFRDVAIDFSQEEWKWLQPAQRDLYRCVMLENYGHLVSLGLSISKPDVVSLLEQGKEPWLGKREVKRDLFSVSES

SEQ ID NO: 3098 - protein, 81 aa, Pongo abelii
MLENYGHLVSLGLSISKPDVVSLLEQGKEPWLGKREVKRDLFSVSESSGEIKDFSAKNVIYDDSSQYLIMERILSQGPVYS

SEQ ID NO: 3099 - protein, 81 aa, Pongo abelii
MSQGLVTFRDVAIDFSQEEWKWLQPAQRDLYRCVMLENYGHLVSLAGLSISKPDVVSLLEQGKEPWLGKREVKRDLFSVRV

SEQ ID NO: 3100 - protein, 81 aa, Pongo abelii
MSQGLVTFRDVAIDFSQEEWKWLQPAQRDLYRCVMLENYGHLVSLGLSISKPDVVSLLEQGKEPWLGKREVKRDLFSVLKE

SEQ ID NO: 3101 - protein, 81 aa, Pongo abelii
REFVGMCAGHANICLSFQGLVTFRDVAIDFSQEEWKWLQPAQRDLYRCVMLENYGHLVSLGLSISKPDVVSLLEQGKEPWL

SEQ ID NO: 3102 - protein, 81 aa, Pongo abelii
RNAEEERMIAVFLTTWLQEPMTFKDVAVEFTQEEWMLLDSAQRSLYRDVMLENYRNLTSVEYQLCGLTVTSPLDQEEIRNM

SEQ ID NO: 3103 - protein, 81 aa, Pongo abelii
MDAKSLTAWSQTLVTFKDVFVDFTREEWKLLDTAQQIVYRNVMLENYKNLVSLGYQLTKPDVIIRLEKGEEPWLVERGIHQ

SEQ ID NO: 3104 - protein, 81 aa, Pongo abelii
VLEWLFVSQEQPKITKSWGPLSFMDVFVDFTWEEWQLLDPAQKCLYRSVMLENYSNLVSLGYQHTKPDIIFKLEQGEELCM

SEQ ID NO: 3105 - protein, 81 aa, Pongo abelii
MDVFVDFTWEEWQLLDPAQKCLYRSVMLENYSNLVSLGYQHTKPDIIFKLEQGEELCMVQAQVPNQSCPNTVWKIDDLMDW

SEQ ID NO: 3106 - protein, 81 aa, Pongo abelii
KQKSRRTEKVLEWLFVSQEQPKITKSWEWQLLDPAQKCLYRSVMLENYSNLVSLGYQHTKPDIIFKLEQGEELCMVQAQVP

SEQ ID NO: 3107 - protein, 81 aa, Pongo abelii
SFMDVFVDFTWEEWQLLDPAQKCLYRSVMLENYSNLVSLGYQHTKPDIIFKLEQGEELCMVQAQVPNQSCPILKAGKSKAK

SEQ ID NO: 3108 - protein, 81 aa, Pongo abelii
SGDPSSEGTSGSGSVSIRKPASEMQLQVQSQQEELEQLKKDLSSQKELVRLLQQTVRSSQYDKYFTSSRLCEGVPKDMLEL

SEQ ID NO: 3109 - protein, 81 aa, Pongo abelii
SSGDPSSEGTSGSGSVSIRKPASEMQLQVQSQQEELEQLKKDLSSQKELVRLLQQTVRSSQYDKYFTSSRLCEGVPKDMLE

SEQ ID NO: 3110 - protein, 81 aa, Pongo abelii
MLVAAAAERNKDPILHVLRQYLDPAQRGVRVLEVASGSGQHVAHFARAFPLAEWQPSDVDQRCLDRNPEWGLRDTALLEDL

SEQ ID NO: 3111 - protein, 81 aa, Pongo abelii
VLRQYLDPAQRGVRVLEVASGSGQHVAHFARAFPLAEWQPSDVDQRCLDRNPEWGLRDTALLEDLGKASGLLLERMVDMPA

SEQ ID NO: 3112 - protein, 81 aa, Pongo abelii
RGVRVLEVASGSGQHVAHFARAFPLAEWQPSDVDQRCLDRNPEWGLRDTALLEDLGKASGLLLERMVDMPANNKCLIFRKN

SEQ ID NO: 3113 - protein, 81 aa, Pongo abelii
EGRTRDRQMAAALLTAWSQMPVTFEDVALYLSREEWGRLDHTQQNFYRDVLQKKNGLSLGAVEVGQRVPTSSVAALGDVKP

SEQ ID NO: 3114 - protein, 81 aa, Pongo abelii
LKEGRTRETTDTCFVSGVHGPVALGDIPFYFSREEWGTLDPAQRDLFWDIKRENSRNTTLGLGLKGQSEKSRLQEVVPVVP

SEQ ID NO: 3115 - protein, 81 aa, Pongo abelii
NTTLGLGLKGQSEKSRLQEVVPVVPGQTGSYVTVSWSPEEAEAWESENRPRAALGPVVGARRGRPPTRRRQFRDLAAEKPH

SEQ ID NO: 3116 - protein, 81 aa, Pongo abelii
RPLVKLLPKGVQKEQETVSLYLKANPELVVFEDLNVFHCQEECVSLDPTQQLTSEKEDDSSVGEMMLLAVNGSNPEGEDPE

SEQ ID NO: 3117 - protein, 81 aa, Pongo abelii
PLVKLLPKGVQKEQETVSLYLKANPEELVVFEDLNVFHCQEECVSLDPTQQLTSEKEDDSSVGEMMLLAVNGSNPEGEDPE

SEQ ID NO: 3118 - protein, 81 aa, Pongo abelii
PLVKLLPKGVQKEQETVSLYLKANPEELVVFEDLNVFHCQEECVSLDPTQQLTSEKEDDSSVGEMMLLVNGSNPEGEDPER

SEQ ID NO: 3119 - protein, 81 aa, Pongo abelii
QTNTKDWTVTPERVLPESQSLLTFEEVAMYFSQEEWELLDPTQKALYNDVMQENYETVISLALFVLPKPKVISCLEQGEEP

SEQ ID NO: 3120 - protein, 81 aa, Pongo abelii; identical to SEQ ID NO: 400

SEQ ID NO: 3121 - protein, 81 aa, Pongo abelii
TCDNRAVSLCQQEWMCPGPAQRALYRGATQRKDRHVSRATGVPWGYEETKTLLAILSSSQFYGKLQTCQQNSQIYRAMAEG

SEQ ID NO: 3122 - protein, 81 aa, Pongo abelii
QNTGLHDQETGAVVWTAGSQGPATCDNRAVSLCQQEWMCPGPAQRALYRGATQRKDRHVSRATGVPWGYEETKTLLAILSS

SEQ ID NO: 3123 - protein, 81 aa, Pongo abelii
MASMPPTPEAQGPILFEDLAVYFSQEECVTLHPAQRSLSKDATKECLEDVALMGEEGKPEINQQLSLDCMELDELALEKYP

SEQ ID NO: 3124 - protein, 81 aa, Pongo abelii
WPERGPPAPRHQEMASASPFLSAWSQVPVNLEDMAVYLSGEEPGCLDPAQRDAPLENEGRGIQLEDGGDGREDAPVRMEWY

SEQ ID NO: 3125 - protein, 81 aa, Pongo abelii
EAGSLHSGHQEQLNRKREHRPLPKNARPSPWVPALADEWNTLDQEVTTTRLPARSQEPVKDVHVARGFSYKKSVHQIPAHR

SEQ ID NO: 3126 - protein, 81 aa, Pongo abelii
NTLDQEVTTTRLPARSQEPVKDVHVARGFSYKKSVHQIPAHRDLYRDFRKENVGNVVSLGSAVSTSNKITRLEQRKEPWTV

SEQ ID NO: 3127 - protein, 81 aa, Pongo abelii
APLPPRDPNRAGPEWRKPGAVSFADVAVYFSREEWGCLRPAQRALYWDVMREIYGHLGALGVGGSKPALMSWVEEEAELWD

SEQ ID NO: 3128 - protein, 81 aa, Pongo abelii
LRPAQRALYWDVMREIYGHLGALGVGGSKPALMSWVEEEAELWDPAAQDPEVAKCPTEADPDSRNKEEERQREGTGALEKP

SEQ ID NO: 3129 - protein, 81 aa, Pongo abelii
APLPPRDPNRAGPEWRKPGAVSFADVAVYFSREEWGCLRPAQRALYWDVMREIYGHLGALGENPTCSPGPCAPTGPAVPLG

SEQ ID NO: 3130 - protein, 81 aa, Pongo abelii
APLPPRDPNGAGPEWGEPGAVSFADVAVYFCREEWGCLRPAQRALYRDVMRETYGHLSALGIGGNKPALISWVEEEAELWD

SEQ ID NO: 3131 - protein, 81 aa, Pongo abelii
LRPAQRALYRDVMRETYGHLSALGIGGNKPALISWVEEEAELWDPAAQDPEVAKCQTEADPADSRNKEEERQREGTGALEK

SEQ ID NO: 3132 - protein, 81 aa, Pongo abelii
LRPAQRALYRDVMRETYGHLSALGIGGNKPALISWVEEEAELWDPAAQDPEVAKCQTEADPDSRNKEEERQREGTGALEKP

SEQ ID NO: 3133 - protein, 81 aa, Pongo abelii
APLLAPRPGETRPGCRKPGAVSFADVAVYFSPEEWGCLRPAQRALYRDVMRETYGHLGALGFPGPKPALISWMEQESEAWS

SEQ ID NO: 3134 - protein, 81 aa, Pongo abelii
PAHVPGEAGPRRTRESRPGAVSFADVAVYFSPEEWGCLRPAQRALYRDVMRETFGHLGALGFSGPKPAFISWVEGEVEAWS

SEQ ID NO: 3135 - protein, 81 aa, Pongo abelii
PSQGPGEARPSRKRGRRPRALKFVDVAVYFSPEEWGCLRPAQRALYRDVMRETYGHLGALGCAGPKPALISWLERNTDDWE

SEQ ID NO: 3136 - protein, 81 aa, Pongo abelii
MGLLTFRDVAIEFSREEWEHLDSDQKLLYGDVMLENYRNLVSLGLVVSKPDLITFLEQRKEPWNVKSEETVAIQPDIFSHD

SEQ ID NO: 3137 - protein, 81 aa, Pongo abelii
MGLLTFRDVAIEFSREEWEHLDSDQKLLYGDVMLENYRNLVSLGLVVSKPDLITFLEQRKEPWNVKSEETVAIQPEVKVNT

SEQ ID NO: 3138 - protein, 81 aa, Pongo abelii
EVTEHLTGWAPAPVPSVEGLLTFRDVAIEFSREEWEHLDSDQKLLYGDVMLENYRNLVSLGLVVSKPDLITFLEQRKEPWN

SEQ ID NO: 3139 - protein, 81 aa, Pongo abelii
PDLITFLEQRKEPWNVKSEETVAIQPDIFSHDSQGLLRKKLIEASFQKVILDGYGSCGPQNLNLRKEWENEEKNQYNKSDT

SEQ ID NO: 3140 - protein, 81 aa, Pongo abelii
KPDLITFLEQRKEPWNVKSEETVAIQPDIFSHDSQGLLRKKLIEASFQKVILDGYGSCGPQNLNLRKEWENEGKKILHKEA

SEQ ID NO: 3141 - protein, 81 aa, Pongo abelii
MGLLTFRDVAVEFSLEEWEHLEPAQKNLYQDVMLENYRNLVSLGLVVSKPDLITFLEQRKEPWNVKSEETVAIQPDVFLHY

SEQ ID NO: 3142 - protein, 81 aa, Pongo abelii
MLENYRNLVSLGLVVSKPDLITFLEQRKEPWNVKSEETVAIQPDVFLHYNKDLLTEHCTEASFQKVISRRHGSCDLENLHL

SEQ ID NO: 3143 - protein, 81 aa, Pongo abelii
MAPRPPTAAPQESVTFKDVSVDFTQEEWYHVDPAQRSLYRDVMLENYSHLVSLGYQVSKPEVIFKLEKGEEPWISEGEIQR

SEQ ID NO: 3144 - protein, 81 aa, Pongo abelii
SVTFKDVSVDFTQEEWYHVDPAQRSLYRDVMLENYSHLVSLGYQVSKPEVIFKLEKGEEPWISEGEIQRPFYPAVYFNRKE

SEQ ID NO: 3145 - protein, 81 aa, Pongo abelii
ESVTFKDVSVDFTQEEWYHVDPAQRSLYRDVMLENYSHLVSLGYQVSKPEVIFKLEKGEEPWISEGEIQRPFYPGFVCLLP

SEQ ID NO: 3146 - protein, 81 aa, Pongo abelii
MAAMPLKARYEEMVTFEDVAVHFTKTEWTGLSPAQRALYRSVMLENFGNLTALGYPVPKPALISLLEGGDMAWGLEAQDDP

SEQ ID NO: 3147 - protein, 80 aa, Pongo abelii
VTFEDVAVHFTKTEWTGLSPAQRALYRSVMLENFGNLTALGYPVPKPALISLLEGGDMAWGLEAQDDPLAEMTKNVCKGR

SEQ ID NO: 3148 - protein, 81 aa, Pongo abelii
MVTFEDVAVHFTKTEWTGLSPAQRALYRSVMLENFGNLTALGYPVPKPALISLLEGGDMAWGLEAQDDPLAEMTKNVCKVI

SEQ ID NO: 3149 - protein, 81 aa, Pongo abelii
MLENYGNVASLGFPLLKPAVISQLEGGGELGGPSPLAAGRGLQGLRTDIQTDNDLTKEMYERKENVSFELQRDFSQETDFS

SEQ ID NO: 3150 - protein, 81 aa, Pongo abelii
MLENYGNVASLGFPLLKPAVISQLEGGGELGGPSPLAAGRGLQGLRTDGVSLCRPNWSAVARTWLTATSVSRVRAILLPHP

SEQ ID NO: 3151 - protein, 81 aa, Pongo abelii
MLENYGNVASLGFPLLKPAVISQLEGGVDIQTDNDLTKEMYERKENVSFELQRDFSQETDFSEASLLEKQQEVYSAGNIKK

SEQ ID NO: 3152 - protein, 81 aa, Pongo abelii
QLEGGVDIQTDNDLTKEMYERKENVSFELQRDFSQETDFSEASLLEKQQEVYSAGNIKKEKSSTIDGTVKDETSPVEECFF

SEQ ID NO: 3153 - protein, 81 aa, Pongo abelii
MHLTAWPQKSVTFEDVAVYFTQAEWDGLSPAQRTLYRDVMLENYGNVASLGFPLLKPAVISQLEGGGELGGPSPLAAGRGL

SEQ ID NO: 3154 - protein, 81 aa, Pongo abelii
MDVMLENYSNLLSVEVWKADDQMERDHRNPDEQARQFLILKNQTPIEERGDLFGRALNLNTDFVSLRQVPYKYDLYEKTLK

SEQ ID NO: 3155 - protein, 81 aa, Pongo abelii
EQTQAAGMVAGCLINCYQDSVTFDDVAVDFTQEEWTLLDPSQRDLYRDVMLENYENLASVGHHLFKPSVIYWLEEEEEMRA

SEQ ID NO: 3156 - protein, 81 aa, Pongo abelii
MAAPDLAHGGHVPRDSICLHEEQTQAAGMVAGCLINCYQDSVTFDDVAVDFTQEEWTLLDPSQRDLYRDVMLENYENLASV

SEQ ID NO: 3157 - protein, 81 aa, Pongo abelii
EQTQAAGMVAGCLINCYQDSVTFDDVAVDFTQEEWTLLDPSQRDLYRDVMLENYENLASVEWRLKTKGPALRQDRSWFRAS

SEQ ID NO: 3158 - protein, 81 aa, Pongo abelii
MLENYENLASVGHHLFKPSVIYWLEEEEEMRAGWRVLQEWRLKTKGPALRQDRSWFRASNETQTARSHNGGQLCDRTQRGE

SEQ ID NO: 3159 - protein, 81 aa, Pongo abelii
VLFQEATAFEDMTKDWNYLEGSQKDCYRDTMLDSYENTVPQGSFLKFSMMPQRAGNDPPGVSNASEMEMEISNMREKFLMS

SEQ ID NO: 3160 - protein, 81 aa, Pongo abelii
LQGKYGNVTKEVIVLYLTLCKQCHQKNPVPKRGLAPKPMTFKDIDSTCQVEILDMQSSADGEFKFILYYQDHLTKFIILRP

SEQ ID NO: 3161 - protein, 81 aa, Pongo abelii
MVPVAEPVLFQEATAFEDMTKDWNYLEGSQKDCYRDTMLDSYENTVPQGSFLKFSMMPQRAGNDPPGVSNASEMEMEISNM

SEQ ID NO: 3162 - protein, 81 aa, Pongo abelii
ASQPARLEERLIRDQDLGASLLPAAPQEQWRHLDSTQKEQYWDLMLETYGKMVSGAGISHPKSDLTNSIEFGDEPAGLYLH

SEQ ID NO: 3163 - protein, 81 aa, Pongo abelii
ASQPARLEERLIRDQDLGASLLPAAPQEQWRHLDSTQKEQYWDLMLETYGKMVSGGISHPKSDLTNSIEFGDEPAGLYLHV

SEQ ID NO: 3164 - protein, 81 aa, Pongo abelii
AASQPARLEERLIRDQDLGASLLPAAPQWRHLDSTQKEQYWDLMLETYGKMVSGGISHPKSDLTNSIEFGDEPAGLYLHVN

SEQ ID NO: 3165 - protein, 81 aa, Pongo abelii
FQEKSTEEGEVAALRLTARSQEKVTFKDVAMDFTPEEWGKLDPAQRDVMLENYRNLVSLWLPVSKPENYNLENGKEPLKLE

SEQ ID NO: 3166 - protein, 81 aa, Pongo abelii
EGEVAALRLTARSQEKVTFKDVAMDFTPEEWGKLDPAQRDVMLENYRNLVSLWLPVSKPENYNLENGKEPLKLERRAPKSS

SEQ ID NO: 3167 - protein, 81 aa, Pongo abelii
MELLTFRDVAIEFSPEEWKCLDPAQQNLYRDVMLENYRNLVSLAAYSYYNQGILPEQGIEDSFKKATLGRYGSCGLENICL

SEQ ID NO: 3168 - protein, 81 aa, Pongo abelii
CFSEEERMAAGYLPRWSQELVTFEDVSVDFSQEEWELLDPAQKNLYREVMLENYRNVVSLEDMKNQCTDGGIKEGPLSPAQ

SEQ ID NO: 3169 - protein, 81 aa, Pongo abelii
MVTCAHLGRRARLPAAQPSACPGTCFSEEERMAAGYLPRWSQELVTFEDVSVDFSQEEWELLDPAQKNLYREVMLENYRNV

SEQ ID NO: 3170 - protein, 81 aa, Pongo abelii
MDSVVFEDVAVDFTMEEWALLDSAQRDLYRDVMLETFENLASVDDETQFKASGSVSQQDIYGEKIPKKSKIAAFTRNVSLA

SEQ ID NO: 3171 - protein, 81 aa, Pongo abelii
MDTVVFEDVVVDFTLEEWALLNPAQRKLYRDVMLETFKRLASVDNEAQLKANGSISQQDTSGEKLSLKQKIEKFTGKNIWA

SEQ ID NO: 3172 - protein, 81 aa, Pongo abelii
MDSVVFEDVAVDFTMEEWALLDSAQRNLYRDVMLETFRNLASVGCEMWERTNGSVSQQDMYGEEKSKKQTIPNFTGNNSCA

SEQ ID NO: 3173 - protein, 81 aa, Pongo abelii
MDSVVFEDVAVDFTMEEWALLDSAQRNLYRDVMLETFRNLASVDDETQFKANGSVSQQDMYGEEKSKKQTIPNFTGNNSCA

SEQ ID NO: 3174 - protein, 81 aa, Pongo abelii
MDSVVFEEVAVNFTPEEWALLDHAQRSLYRDVMLETCRNLASLDCCIYVRTSGSSSQRDVFGNGISNDEEIVKFTRSDSWS

SEQ ID NO: 3175 - protein, 81 aa, Pongo abelii
GHTEGGELVNELLTSWLKGLVTFEDVAVEFTQEEWALLDPAQRTLYRDVMLENFRNLASSLGNQVDKPSLISQLEQEDKVM

SEQ ID NO: 3176 - protein, 81 aa, Pongo abelii
GHTKGGELVNELLTSWLQGLVTFEDVAVEFTQEEWALLDPAQRTLYRDVMLENCRNLASLGCRVNKPSLISQLEQDKKVMT

SEQ ID NO: 3177 - protein, 81 aa, Pongo abelii
SSPFPASQQKGHTKGGELVNELLTSWLQGLVTFEDVAVEFTQEEWALLDPAQRTLYRDVMLENCRNLASLALVCSRSLAMP

SEQ ID NO: 3178 - protein, 81 aa, Pongo abelii
MAAGWLTAWSQNSVTFQEVAVDFSQEEWALLDPAQKNLYKDVMLENFRNLASVGYQLCRHSLISKVDQEQLKTDERGILQG

SEQ ID NO: 3179 - protein, 81 aa, Pongo abelii
SALQQDFWKIQTSNGIQMDLVTFDSVAVEFTQEEWTLLDPTQRNLYSDVMLENYKNLSSVGYQLFKPSLISWLEEEEELST

SEQ ID NO: 3180 - protein, 81 aa, Pongo abelii
EKTPAGRIVADCLTNCYQDSVTFDDVAVDFTQEEWTLLDSTQRSLYSDVMLENYKNLATVGGQIIKPSLISWLEQEESKTV

SEQ ID NO: 3181 - protein, 81 aa, Pongo abelii
MDSVTFDDVAVDFTQEEWTLLDSTQRSLYSDVMLENYKNLATVGGQIIKPSLISWLEQEESKTVQGGVLQGWETQLETQWS

SEQ ID NO: 3182 - protein, 81 aa, Pongo abelii
MAAVDFSHGHYLSGDPVCLHEEKTPAGRIVADCLTNCYQDSVTFDDVAVDFTQEEWTLLDSTQRSLYSDVMLENYKNLATV

SEQ ID NO: 3183 - protein, 81 aa, Pongo abelii
EKTEVERMVEDYLANGYQDSVTFDDVAVDFTPEEWALLDTTEKYLYRDVMLENYMNLASVEWEMQPRTKRSSLQQGFLKNQ

SEQ ID NO: 3184 - protein, 81 aa, Pongo abelii
FFSREPICPFEEKTEVERMVEDYLANGYQDSVTFDDVAVDFTPEEWALLDTTEKYLYRDVMLENYMNLASVDKRLQWMETL

SEQ ID NO: 3185 - protein, 81 aa, Pongo abelii
LDSVTFDDVAVEFTPEEWALLDTTQKYLYRDVMLENYMNLASVDFFFCLTSEWEIQPRTKRSSLQQGFLKNQIFTGIQMQT

SEQ ID NO: 3186 - protein, 81 aa, Pongo abelii
LASVDFFFCLTSEWEIQPRTKRSSLQQGFLKNQIFTGIQMQTRSYSGWKLCENCGEVFSEQFCLKTHMRAQNGGNTSEGNC

SEQ ID NO: 3187 - protein, 81 aa, Pongo abelii
MDFSQHLVTFEDVAVDFTQEEWTLLDQTQRDLYRDVMLENYKNLIILAGSELCKPSLMSGLEQMEELRTGVTGVLQGEKQY

SEQ ID NO: 3188 - protein, 81 aa, Pongo abelii
MDFSQHLVTFEDVAVDFTQEEWTLLDQTQRDLYRDVMLENYKNLIILAGSELCKPSLMSGLEQMEELRTGVTGVLQELDLQ

SEQ ID NO: 3189 - protein, 81 aa, Pongo abelii
MDFSQHLVTFEDVAVDFTQEEWTLLDQTQRDLYRDVMLENYKNLIILGSELCKPSLMSGLEQMEELRTGVTGVLQELDLQL

SEQ ID NO: 3190 - protein, 81 aa, Pongo abelii
MDSVAFEDVAVNFTLEEWALLDPSQKNLYRDVMRETFRNLASIGKQWEDQNIEDPFKIPRRNISHIPERLCESKESGQGEE

SEQ ID NO: 3191 - protein, 81 aa, Pongo abelii
MDSVAFEDVAVNFTQEEWALLGPSQKSLYRNVMQETIRNLDCIEMKCEDQNIGDQCQNPRRNLRSHTCEIKDDSQYGETFG

SEQ ID NO: 3192 - protein, 81 aa, Pongo abelii
MDPVAFDDVAVNFTQEEWALLDISQRKLYREVMLETFRNLTSIGKRWKDQNIEYEYQNPRRNFRSVIEKKVNEIKEDSHCG

SEQ ID NO: 3193 - protein, 81 aa, Pongo abelii
MMFQDPVAFDDVAVNFTQEEWALLDISQRKLYREVMLETFRNLTSIGKRWKDQNIEYEYQNPRRNFRSVIEKKVNEIKEDS

SEQ ID NO: 3194 - protein, 81 aa, Pongo abelii
MFQDPVAFDDVAVNFTQEEWALLDISQRKLYREVMLETFRNLTSIGKRWKDQNIEYEYQNPRRNFRSVIEKKVNEIKEDSH

SEQ ID NO: 3195 - protein, 81 aa, Pongo abelii
MFQDPVAFKDVAVNFTQEEWALLDISQKNLYREVMLETFRNLTSTGKKWKDQNIEYEYQNPRRNFRSVIEERVNEIKEDSH

SEQ ID NO: 3196 - protein, 81 aa, Pongo abelii
VLSLSPILLYTCGMFQDPVAFKDVAVNFTQEEWALLDISQKNLYREVMLETFRNLTSTGKKWKDQNIEYEYQNPRRNFRSV

SEQ ID NO: 3197 - protein, 81 aa, Pongo abelii
CSHRSCREDPGTSESQEMDPVAFDDVAVNFTQEEWALLDISQRKLYREVMLETFRNLTSIGKSWKDQNIEYEYQNPRRKFR

SEQ ID NO: 3198 - protein, 81 aa, Pongo abelii
MPCCSHRSCREDPGTSESQEMEEWALLDISQRKLYREVMLETFRNLTSIGKSWKDQNIEYEYQNPRRKFRSVIEKKVNEIK

SEQ ID NO: 3199 - protein, 81 aa, Pongo abelii
RSCREDPGTSESREMMFQDPVAFEDVAVNFTQEEWTLLDISQKNLFREVMLETFWNLTSIGKKWKDQNIEYEYQNPRRSFR

SEQ ID NO: 3200 - protein, 81 aa, Pongo abelii
CSHRSCREDPGTSESREMDPVAFEDVAVNFTQEEWTLLDISQKNLFREVMLETFWNLTSIGKKWKDQNIEYEYQNPRRSFR

SEQ ID NO: 3201 - protein, 81 aa, Pongo abelii
MFQDPVAFEDVAVNFTQEEWTLLDISQKNLFREVMLETFWNLTSIGKKWKDQNIEYEYQNPRRSFRSLIEEKVSEIKDNSH

SEQ ID NO: 3202 - protein, 81 aa, Pongo abelii
CSHRSCREDPGTSESREMDPVAFEDVAVKFTQEEWALLDISQRKLYRELMLETFRNLTSIGKKWKDQNIEYEYKNPRRSFR

SEQ ID NO: 3203 - protein, 81 aa, Pongo abelii
MPCCSHRSCREDPGTSESREMRPESTDCKLRPMRNLQKEVIESSHQAQWLTPVIPALWEAEADGSSQMFQDPVAFEDVAVK

SEQ ID NO: 3204 - protein, 81 aa, Pongo abelii
NLQKEVIESSHQAQWLTPVIPALWEAEADGSSQMFQDPVAFEDVAVKFTQEEWALLDISQRKLYRELMLETFRNLTSIGVS

SEQ ID NO: 3205 - protein, 81 aa, Pongo abelii
DPVAFEDVAVNFTQEEWTLLDISQKNLFREVMLETFWNLTSIGKKWKDQNIEYEYQNPRRSFRSLIEEKPYECKDCGKAFS

SEQ ID NO: 3206 - protein, 81 aa, Pongo abelii
MDPVAFEDVAVKFTQEEWALLDISQRKLYRELMLETFRNLTSIGKKWKDQNIEYEYKNPRRSFRSLIEGNVNEIKEDSHCG

SEQ ID NO: 3207 - protein, 81 aa, Pongo abelii
MMFQDPVAFEDVAVKFTQEEWALLDISQRKLYRELMLETFRNLTSIGKKWKDQNIEYEYKNPRRSFRSLIEGNVNEIKEDS

SEQ ID NO: 3208 - protein, 81 aa, Pongo abelii
PPVLSLSPILLYTCEMFQDPVAFEDVAVKFTQEEWALLDISQRKLYRELMLETFRNLTSIGKKWKDQNIEYEYKNPRRSFR

SEQ ID NO: 3209 - protein, 81 aa, Pongo abelii
MMFQDSVAFEDVAVTFTQEEWALLDPSQKNLYRDVMQETFRNLASIGKKWKAQNIYVEYENLRRNLRIVGERLFESKEGHQ

SEQ ID NO: 3210 - protein, 81 aa, Pongo abelii
MDSVAFEDVAVTFTQEEWALLDPSQKNLYRDVMQETFRNLASIGKKWKAQNIYVEYENLRRNLRIVGERLFESKEGHQHGE

SEQ ID NO: 3211 - protein, 81 aa, Pongo abelii
LLVLSILLYTCEMFQDSVAFEDVAVTFTQEEWALLDPSQKNLYRDVMQETFRNLASIGKKWKAQNIYVEYENLRRNLRIVG

SEQ ID NO: 3212 - protein, 81 aa, Pongo abelii
MDSVAFEDVAVNFTQGEWALLDPSQKNLYREVMQESLRNLASIGKKWNNQYIEDEHQNPRRNLRRLIGERLSESKESHQHG

SEQ ID NO: 3213 - protein, 81 aa, Pongo abelii
MDLVAFEDVAVNFTQEEWSLLDPSQKNLYREVMQETLRNLASIGEKWKDQNIEDQYKNPRNNLRSLLGERVDENTEENRCG

SEQ ID NO: 3214 - protein, 81 aa, Pongo abelii
MNSVAFEDVAVSFTQEEWALLDPSQKSLYRDVMQETFKNLTSVGKTWKVQNIEDEFKNPRRNLRRSFTLVAQAGVQWRDLG

SEQ ID NO: 3215 - protein, 81 aa, Pongo abelii
MMFQNSVAFEDVAVSFTQEEWALLDPSQKSLYRDVMQETFKNLTSVGKTWKVQNIEDEFKNPRRNLSLMREKLCESKESHH

SEQ ID NO: 3216 - protein, 81 aa, Pongo abelii
MNSVAFEDVAVSFTQEEWALLDPSQKSLYRDVMQETFKNLTSVGKTWKVQNIEDEFKNPRRNLSLMREKLCESKESHHCGE

SEQ ID NO: 3217 - protein, 81 aa, Pongo abelii
MDSVAFEDVDVNFTQDEWALLDPSQKNLYRDVMQETFRNLASVGKKWKDQKIEDEYKNPRRNLRGLMGERLLEILESGVGS

SEQ ID NO: 3218 - protein, 81 aa, Pongo abelii
MDSVAFEDVDVNFTQDEWALLDPSQKNLYRDVMQETFRNLASVGKKWKDQKIEDEYKNPRRNLRGLMGERLLESKKDHQHG

SEQ ID NO: 3219 - protein, 81 aa, Pongo abelii
MDSVAFEDVDVNFTQEEWALLDPSQKNLYRDVMWETMRNLASVGKKWKDQNIKDHYKHRGRNLRSHMLERLYQTKDSSQRG

SEQ ID NO: 3220 - protein, 81 aa, Pongo abelii
SLRRGQPEVLGWGLPKDQDSVAFEDVAVNFTHEEWALLGPSQKNLYRDVMRETIRNLNFIGMKWENQNIDDQYQNLRRNSR

SEQ ID NO: 3221 - protein, 81 aa, Pongo abelii
KNLYRDVMRETIRNLNFIGMKWENQNIDDQYQNLRRNSRLSETWLQNFILIHYGHLVALSDGGLLQFSTGQGLPVTQARVQ

SEQ ID NO: 3222 - protein, 81 aa, Pongo abelii
MDSVAFEDVAVNFTHEEWALLGPSQKNLYRDVMRETIRNLNFIGMKWENQNIDDQYQNLRRNSRCDVVERFGKSKDGSQCG

SEQ ID NO: 3223 - protein, 81 aa, Pongo abelii
MDVVAFEDVAVNFTQEEWALLGPSQKNLYRYVMQETIRNLDCIRMIWEEQNTEDQYKNPRRNLRCHMVERFSESKDSSQCG

SEQ ID NO: 3224 - protein, 81 aa, Pongo abelii
RNYFFLPDSQTNEERKQYDSVAFEDVAVNFTREEWALLGPSQKSLYRDVLWETIRNLDCIGMKWEDTNIEDQHKNPRRSLR

SEQ ID NO: 3225 - protein, 81 aa, Pongo abelii
MASVALEDVAVNFTREEWALLGPCQKNLYKDVMQETIRNLDCVGMKWKDQNIEDQYRYPRKNLRCRMLERFVESKDGSQCG

SEQ ID NO: 3226 - protein, 81 aa, Pongo abelii
ASVALEDVAVNFTQEEWALLGPCQKNLYKDVMQETIRNLDCVGMKWKDQNIEDQYRYPRKNLRCRMLERFVESKHGSQCGE

SEQ ID NO: 3227 - protein, 81 aa, Pongo abelii
MDSVVFEDVAVNFTQEEWALLGPSQKKLYRDVMQETFVNLASIGENWEEKNIEDHKNQGRKLRSHMVERLCERKQGSQSGE

SEQ ID NO: 3228 - protein, 81 aa, Pongo abelii
SDQRRHSKEARTPGSQDTDSVVFEDVAVNFTQEEWALLGPSQKKLYRDVMQETFVNLASIGENWEEKNIEDHKNQGRKLRS

SEQ ID NO: 3229 - protein, 81 aa, Pongo abelii
MDSVASEDVAVNFTLEEWALLDPSQKKLYRDVMRETFRNLACVGKKWEDQSIEDWYKNQGRILSNHMEEGLNESKEYDQCG

SEQ ID NO: 3230 - protein, 81 aa, Pongo abelii
VLQMQNSEHHGQSIKTQTDSISLEDVAVNFTLEEWALLDPGQRNIYRDVMRATFKNLACIGEKWKDQDIEDDHKNQGKNLR

SEQ ID NO: 3231 - protein, 81 aa, Pongo abelii
MDSISLEDVAVNFTLEEWALLDPGQRNIYRDVMRATFKNLACIGEKWKDQDIEDDHKNQGKNLRGPVVEALCENKEDRLCG

SEQ ID NO: 3232 - protein, 81 aa, Pongo abelii
MDSVAFKDVSVSFSQEEWALLAPSQKKLYRDVMQETFKNLASIGEKWEDPNVEDQHKNQGRNLRSHMGERLCEGKEGSQCA

SEQ ID NO: 3233 - protein, 81 aa, Pongo abelii
MESVTFEDVAVEFIQEWALLDSARRSLCRYRMLDQCRTLASRGTPPCKPSCVSQLGPRAEPRATEQGILHATGVAWESQLK

SEQ ID NO: 3234 - protein, 81 aa, Pongo abelii
MQDLLEEASSRDMQMGPGLFLRMQLVPSIEERETPLTREDWPALQEPPWSPGCMGLKAAVQIQRVVIPVPTLSHCNPWVAR

SEQ ID NO: 3235 - protein, 81 aa, Pongo abelii
MESVTFEDVAVEFIQEWALLDSARRSLCRYRMLDQCRTLASRGAGAVPEDAAGALHRREGDTIDSRGLASSPGATLVSRMH

SEQ ID NO: 3236 - protein, 81 aa, Pongo abelii
MGPLQFRDVAIEFSLEEWHCLDTTQRNLYRDVMLENYRNLVFLGIVVSKPDLITCLEQGKKPLTMKRHEMIAKPPVMCSHF

SEQ ID NO: 3237 - protein, 81 aa, Pongo abelii
QRRYEKCRHDNLQLKKGCESVDECPMHKRGYNGLKQCLTSTQRKIFQCDEYVKFLHKFSNSNKHKRRDTGKKPFKCIEYGK

SEQ ID NO: 3238 - protein, 81 aa, Pongo abelii
MGPLQFRDVAIEFSLEEWHCLDTTQRNLYRDVMLENYRNLVFLGIVVSKPDLITCLEQGKKPLTMKRHEMIAKPPGQAQWL

SEQ ID NO: 3239 - protein, 81 aa, Pongo abelii
MGPLQFRDVAIEFSLEEWHCLDTTQRNLYRDVMLENYRNLVFLGIVVSKPDLITCLEQGKKPLTMKRHEMIAKPPDGVLLF

SEQ ID NO: 3240 - protein, 81 aa, Pongo abelii
MGPLQFRDVAIEFSLEEWHCLDTTQRNLYRDVMLENYRNLVFLVMCSHFALDLWSEQSIKDSFQKVIQRRYEKCRHDNLQL

SEQ ID NO: 3241 - protein, 81 aa, Pongo abelii
MGPLQFRDVAIEFSLEEWHCLDTTQRNLYRDVMLENYRNLVFLGIVVSKPDLITCLEQGKKPLTMKRHEMIAKPPETVFHR

SEQ ID NO: 3242 - protein, 81 aa, Pongo abelii
MERLQFRDVAIEFSLEEWHCLDTAQRNLYRNVMLENYRHLIFLGIIVSKPDLITCLEYGKNPLTMRREMIAKPPGNKSLFC

SEQ ID NO: 3243 - protein, 81 aa, Pongo abelii
QVLGEPQLNPGTPGSLEMGPLQFRDVAIEFSLEEWHCLDTAQRNLYRDVMLENYRNFVFLGIVVSKPDLVTCLEQGKKPLT

SEQ ID NO: 3244 - protein, 81 aa, Pongo abelii
LRRYEKCRRDNLQLKKGCKSVGEHKVHKGGYNGLNQCLTTTQKKIFQCDKYGKVFHKVSNSNTYKTRHTGINLFKCIICGK

SEQ ID NO: 3245 - protein, 81 aa, Pongo abelii
MGPLQFRDVAIEFSLEEWHCLDTAQRNLYRDVMLENYRNFVFLGIVVSKPDLVTCLEQGKKPLTMKRHEMIAKPPVMSSHF

SEQ ID NO: 3246 - protein, 81 aa, Pongo abelii
MGPLQFRDVAIEFSLEEWHCLDTAQRNLYRNVMLENYSNLVFLGIVVSKPDLITRLEQGKKPLTMKRHEMVANPSGPGVAV

SEQ ID NO: 3247 - protein, 81 aa, Pongo abelii
MGPLQFRDVAIEFSLEEWHCLDTAQRNLYRNVMLENYSNLVFLGIVVSKPDLITRLEQGKKPLTMKRHEMVANPSVICSHF

SEQ ID NO: 3248 - protein, 81 aa, Pongo abelii
MGPLQFRDVAIEFSLEEWHCLDTAQRNLYRNVMLENYSNLVFLGIVVSKPDLITRLEQGKKPLTMKRHEMVANPSDGVNLC

SEQ ID NO: 3249 - protein, 81 aa, Pongo abelii
MGPLQFRDVAIEFSLEEWHCLDTAQRNLYRNVMLENYSNLVFLGIVVSKPDLITRLEQGKKPLTMKRHEMVANPSGARLLS

SEQ ID NO: 3250 - protein, 81 aa, Pongo abelii
MELLTFRDVTIEFSLEEWEFLKPAQQNLYRKVMLENYRNLVSLGLTVSKPELISCLEQRQEPWNVKRHETIAKPPGTYRVG

SEQ ID NO: 3251 - protein, 81 aa, Pongo abelii
MLENYRNLVSLGLTVSKPELISCLEQRQEPWNVKRHETIAKPPAISSHYIEDFLPEQGMKDSFQKVILRRYASCGLEDLHL

SEQ ID NO: 3252 - protein, 81 aa, Pongo abelii
MELLTFRDVTIEFSLEEWEFLKPAQQNLYRKVMLENYRNLVSLGLTVSKPELISCLEQRQEPWNVKRHETIAKPPAISSHY

SEQ ID NO: 3253 - protein, 81 aa, Pongo abelii
MAGSQELLTFRDVTIEFSLEEWEFLKPAQQNLYRKVMLENYRNLVSLGLTVSKPELISCLEQRQEPWNVKRHETIAKPPAI

SEQ ID NO: 3254 - protein, 81 aa, Pongo abelii
MFCFVFQELLTFRDVTIEFSLEEWEFLKPAQQNLYRKVMLENYRNLVSLGLTVSKPELISCLEQRQEPWNVKRHETIAKPP

SEQ ID NO: 3255 - protein, 81 aa, Pongo abelii
MELLTFRDVTIEFSLEEWEFLKPAQQNLYRKVMLENYRNLVSLGLTVSKPELISCLEQRQEPWNVKRHETIAKPPDYSLTI

SEQ ID NO: 3256 - protein, 81 aa, Pongo abelii
MAGSQELLTFRDVTIEFSLEEWEFLKPAQQNLYRKVMLENYRNLVSLGLTVSKPELISCLEQRQEPWNVKRHETIAKPPDT

SEQ ID NO: 3257 - protein, 81 aa, Pongo abelii
MPGPPRSLEMGPLQFRDVAIEFSLEEWHCLDTTQRNLYRDVMLENYRNLVFLGIVVSKPDLITCLEQGIKPLTMKRHEMIA

SEQ ID NO: 3258 - protein, 81 aa, Pongo abelii
MGPLQFRDVAIEFSLEEWHCLDTTQRNLYRDVMLENYRNLVFLGIVVSKPDLITCLEQGIKPLTMKRHEMIANTPDKPSTF

SEQ ID NO: 3259 - protein, 81 aa, Pongo abelii
MGPLLFRDVAIEFSLEEWHCLDTAQWNLFRDVMLENYRNLVFLGIVVSKADLTTHLEQKKRPFTMRRHEMVANPSVMHSHF

SEQ ID NO: 3260 - protein, 81 aa, Pongo abelii
MQSQGPLQFRDVAIEFSLEESHCLDTEQRNLYKDVMLENYRNLIFLGITVSKPDLITCLEQGKKPLTMKRNEMIANPPVMC

SEQ ID NO: 3261 - protein, 81 aa, Pongo abelii
MGPLQFRDVAIEFSLEESHCLDTEQRNLYKDVMLENYRNLIFLGITVSKPDLITCLEQGKKPLTMKRNEMIANPPVMCSHF

SEQ ID NO: 3262 - protein, 81 aa, Pongo abelii
MGPLQFRDVAIEFSLEESHCLDTEQRNLYKDVMLENYRNLIFLGITVSKPDLITCLEQGKKPLTMKRNEMIANPPVSFLQL

SEQ ID NO: 3263 - protein, 81 aa, Pongo abelii
MGSLTFRDVAIEFCLEEWQCLDTAQRNLYRNVMLENYRNLVFLGIAVSKPDLITCLEQGKEAWSMKRHEIMVAKPTVMCSH

SEQ ID NO: 3264 - protein, 81 aa, Pongo abelii
MGSLTFRDVAIEFCLEEWQCLDTAQRNLYRNVMLENYRNLVFLDLITCLEQGKEAWSMKRHEIMVAKPTVMCSHFAQDLWP

SEQ ID NO: 3265 - protein, 81 aa, Pongo abelii
MGSLTFRDVAIEFCLEEWQCLDTAQRNLYRNVMLENYRNLVFLGIAVSKPDLITCLEQGKEAWSMKRHEIMVAKPTESYSV

SEQ ID NO: 3266 - protein, 81 aa, Pongo abelii
MGSLTFRDVAIEFCLEEWQCLDTAQRNLYRNVMLENYRNLVFLGIAVSKPDLITCLEQGKEAWSMKRHEIMVAKPTDGVSL

SEQ ID NO: 3267 - protein, 81 aa, Pongo abelii
MGSLTFRDVAIEFCLEEWQCLDTAQRNLYRNVMLENYRNLVFLGIAVSKPDLITCLEQGKEAWSMKRHEIMVAKPTGGLSK

SEQ ID NO: 3268 - protein, 81 aa, Pongo abelii
MNVMLENYKNLVFLGIAVSKQDPMTSLEQKEPWNMKRHEMVDESPGQVWWLTPVIPALWEARAGGLLEPRSLRLAWSTWKN

SEQ ID NO: 3269 - protein, 81 aa, Pongo abelii
MNVMLENYKNLVFLGIAVSKQDPMTSLEQKEPWNMKRHEMVDESPGYMCRMCSYVFLFYQRPLARARHKRFFSTSDTEKIR

SEQ ID NO: 3270 - protein, 81 aa, Pongo abelii
MNVMLENYKNLVFLAGIAVSKQDPMTSLEQKEPWNMKRHEMVDESPAMCSYFTKDLWPEQDIKDSFQQVILRRYGKCEHEN

SEQ ID NO: 3271 - protein, 81 aa, Pongo abelii
MNVMLENYKNLVFLGIAVSKQDPMTSLEQKEPWNMKRHEMVDESPAMCSYFTKDLWPEQDIKDSFQQVILRRYGKCEHENL

SEQ ID NO: 3272 - protein, 81 aa, Pongo abelii
SGCPGAERNLLVYSYFEKETLTFRDVAIEFSLEEWECLNPAQQNLYMNVMLENYKNLVFLGIAVSKQDPVTCLEQEKEPWN

SEQ ID NO: 3273 - protein, 81 aa, Pongo abelii
SRVQVILLPQPPELGLQETLTFRDVAIEFSLEEWECLNPAQQNLYMNVMLENYKNLVFLGIAVSKQDPVTCLEQEKEPWNM

SEQ ID NO: 3274 - protein, 81 aa, Pongo abelii
ASGCPGAERNLLVYSYFEKETLTFRDVAIEFSLEEWECLNPAQQNLYMNVMLENYKNLVFLAGIAVSKQDPVTCLEQEKEP

SEQ ID NO: 3275 - protein, 81 aa, Pongo abelii
MGPLTFMDVAIEFSLEEWQCLDTAQQNLYRNVMLENYSNLVFLGIAVSNLDLITCLEQGKEPWNMKRHEMVAKPPAMCSHF

SEQ ID NO: 3276 - protein, 81 aa, Pongo abelii
MGPLTFMDVAIEFSLEEWQCLDTAQQNLYRNVMLENYSNLVFLGIAVSNLDLITCLEQGKEPWNMKRHEMVAKPPVIFLQV

SEQ ID NO: 3277 - protein, 81 aa, Pongo abelii
SGYPGAERNLLEYSYFEKGPLTFRDVVIEFSQEEWQCLDRDQQDLYRKVMLENFRNLVFLGIDVSKPDLITCLEQGKDPWN

SEQ ID NO: 3278 - protein, 81 aa, Pongo abelii
TPGPPESLEMGPLTFRDVAIEFSQEEWQCLDTAQQDLYRKVMLENYRNLVFLAGIAVSKPDLVTCLEQGKDPWNMKRHSMV

SEQ ID NO: 3279 - protein, 81 aa, Pongo abelii
MGPLTFRDVAIEFSQEEWQCLDTAQQDLYRKVMLENYRNLVFLGIAVSKPDLVTCLEQGKDPWNMKRHSMVVKPPVICSHF

SEQ ID NO: 3280 - protein, 81 aa, Pongo abelii
TPGPPESLEMGPLTFRDVAIEFSQEEWQCLDTAQQDLYRKVMLENYRNLVFLGIAVSKPDLVTCLEQGKDPWNMKRHSMVV

SEQ ID NO: 3281 - protein, 81 aa, Pongo abelii
EFSQEEWQCLDTAQQDLYRKVMLENYRNLVFLAGIAVSKPDLVTCLEQGKDPWNMKRHSMVVKPPGGDCSIFPMEHQGDVT

SEQ ID NO: 3282 - protein, 81 aa, Pongo abelii
MGPLTFTDVAIEFSLEEWQCLDTAQQNLYRNVMLENYRNLVFLGIAVSKPDLITCLEKEKESCNMKRHEMVDEPPVVCSHF

SEQ ID NO: 3283 - protein, 81 aa, Pongo abelii
MGPLTFTDVAIEFSLEEWQCLDTAQQNLYRNVMLENYRNLVFLGIAVSKPDLITCLEKEKESCNMKRHEMVDEPPDGVLLL

SEQ ID NO: 3284 - protein, 81 aa, Pongo abelii
RRYDKRGHENLQLRKGYKTVGDCKLYKGGYNGLNQCLTLTQSKMYHCDIYVKVFYAFSNADRYKTRHTGKKPFQCKKCGKS

SEQ ID NO: 3285 - protein, 81 aa, Pongo abelii
ASGCPEAERSLLVQSYFEKGPLTFRDVAIEFSLEEWQCLDTDQQGLYRKVMLENYRNLVFLAGIALTKPDLITCLEQGKEP

SEQ ID NO: 3286 - protein, 81 aa, Pongo abelii
SGCPEAERSLLVQSYFEKGPLTFRDVAIEFSLEEWQCLDTDQQGLYRKVMLENYRNLVFLGIALTKPDLITCLEQGKEPWN

SEQ ID NO: 3287 - protein, 81 aa, Pongo abelii
MDVAIEFCLEEWQCLDTAQQNLYRNVMLENYRNLVFLGIAVSKPDLITCLEQEKETWEPMRRHEMVAKPPVMCSHFTQDFW

SEQ ID NO: 3288 - protein, 81 aa, Pongo abelii
MPGHPGSWEMGPLTFMDVAIEFCLEEWQCLDTAQQNLYRNVMLENYRNLVFLGIAVSKPDLITCLEQEKETWEPMRRHEMV

SEQ ID NO: 3289 - protein, 81 aa, Pongo abelii
MGPLTFMDVAIEFCLEEWQCLDTAQQNLYRNVMLENYRNLVFLGIAVSKPDLITCLEQEKETWEPMRRHEMVAKPPVMCSH

SEQ ID NO: 3290 - protein, 81 aa, Pongo abelii
MPGHPGSWEMGPLTFMDVAIEFCLEEWQCLDTAQQNLYRNVMLENYRNLVFLGIAVSKPDLITCLEQEKETWEPMRRHEML

SEQ ID NO: 3291 - protein, 81 aa, Pongo abelii
FMDVAIEFCLEEWQCLDTAQQNLYRNVMLENYRNLVFLGIAVSKPDLITCLEQEKETWEPMRRHEMLCVLILPKTFGQSSI

SEQ ID NO: 3292 - protein, 81 aa, Pongo abelii
MDVAIEFCLEEWQCLDTAQQNLYRNVMLENYRNLVFLGIAVSKPDLITCLEQEKETWEPMRRHEMVAKPPGGIVSLLNVFF

SEQ ID NO: 3293 - protein, 81 aa, Pongo abelii
IEFCLEEWQCLDTAQQNLYRNVMLENYRNLVFLGIAVSKPDLITCLEQEKETWEPMRRHEMVAKPPGGIVSLLNVFFYVQK

SEQ ID NO: 3294 - protein, 81 aa, Pongo abelii
MGSLTFRDVAIQFSLEEWQCLDSTQQNLYRNVMLENYRNLVFLGIAAFKPDLIIFLEQGKEPWNMKRHKMVEEPPDRVSHC

SEQ ID NO: 3295 - protein, 81 aa, Pongo abelii
MGSLTFRDVAIEFSLEEWQCLDSTQQNLYRNVMLENYRNLVFLGIAAFKPDLIIFLEEGKEPWNMKRHKMVEESPGRQSLA

SEQ ID NO: 3296 - protein, 81 aa, Pongo abelii
MGSLTFRDVAIEFSLEEWQCLDSTQQNLYRNVMLENYRNLVFLGIAAFKPDLIIFLEEGKEPWNMKRHKMVEESPDRVLHC

SEQ ID NO: 3297 - protein, 81 aa, Pongo abelii
MGSLTFRDVAIEFSLEEWQCLDSTQQNLYRNVMLENYRNLVFLGIAAFKPDLIIFLEEGKEPWNMKRHKMVEESPGMVGSS

SEQ ID NO: 3298 - protein, 81 aa, Pongo abelii
MGSLTFRDVAIEFSLEEWQCLDSTQQNLYRNVMLENYRNLVFLGIAAFKPDLIIFLEEGKEPWNMKRHKMVEESPVICSHF

SEQ ID NO: 3299 - protein, 81 aa, Pongo abelii
MGPLTIRDVTVEFSLEEWQCLDTVQQNLYRDVMLENYRNLVFLGIAVSKPDLITCLEQGKEPWNMKRHEMVAKPPGSHSVS

SEQ ID NO: 3300 - protein, 81 aa, Pongo abelii
MGPLTIRDVTVEFSLEEWQCLDTVQQNLYRDVMLENYRNLVFLGIAVSKPDLITCLEQGKEPWNMKRHEMVAKPPDGVSLF

SEQ ID NO: 3301 - protein, 81 aa, Pongo abelii
MGPLTIRDVTVEFSLEEWQCLDTVQQNLYRDVMLENYRNLVFLGIAVSKPDLITCLEQGKEPWNMKRHEMVAKPPVMNSCW

SEQ ID NO: 3302 - protein, 81 aa, Pongo abelii
MGPLTIRDVTVEFSLEEWQCLDTVQQNLYRDVMLENYRNLVFLGIAVSKPDLITCLEQGKEPWNMKRHEMVAKPPAFYLMG

SEQ ID NO: 3303 - protein, 81 aa, Pongo abelii
MLENYRNLVFLGIAAFKPDLIIFLEQGKEPWNMKRHEMVEEPPVICSHFAQDLWPEQDIEDSVQKMILRRYERCGHENLHL

SEQ ID NO: 3304 - protein, 81 aa, Pongo abelii
MGSLTFRDVAIELCLEEWQCLDSTQQNLYRNVMLENYRNLVFLGIAAFKPDLIIFLEQGKEPWNMKRHEMVEEPPVICSHF

SEQ ID NO: 3305 - protein, 81 aa, Pongo abelii
MPGAPGSLEMGPLTFRDVTIEFSLEEWQCLDMAQQNLYRDVMLENYRNLVFLGIAVFKPDLITCLKQGKEPWNMKRHEMVT

SEQ ID NO: 3306 - protein, 81 aa, Pongo abelii
MLENYRNLVFLGIAASKPDLITCLEQGKEPWNVKRHEMVAEPPVVWSYFAQDLWPKQGIKNYFQKVILRRYKKCGRENLQL

SEQ ID NO: 3307 - protein, 81 aa, Pongo abelii
MPGPLGSLEMEVLTFRDVAIEFSLEEWQCQDTAQQNLYRNMMLENYRNLVFLGIAASKPDLITCLEQGKEPWNVKRHEMVA

SEQ ID NO: 3308 - protein, 81 aa, Pongo abelii
GIGRSTAKTLGPPGSLEMEVLTFRDVAIELCLEEWQCLDTAQRNLYRKMMLENYRNLVFLGIAASKPDLITCLEQGKEPWN

SEQ ID NO: 3309 - protein, 81 aa, Pongo abelii
MGSLTFRDVTIEFSLEEWQCLDTAQQNLYRDVMLENYRNMVFLGITVSKLDLITCLKQGKEPWNMKRHEMVTKPPVISSHF

SEQ ID NO: 3310 - protein, 81 aa, Pongo abelii
MGSLTFRDVAIQFSLEEWQCLDTAQQNLYRNVMLENYRNLAFLGIAAPKPDLIIFLEQGKEPWNMKRHEMVEELPVTRSHF

SEQ ID NO: 3311 - protein, 81 aa, Pongo abelii
MGALTFRDVAIEFSLEEWQCLDTEQQNLYRNVMLDNYRNLVFLGIAISKPDLITCLEQGKEPWNVKTHDMVAEPPVICSYI

SEQ ID NO: 3312 - protein, 81 aa, Pongo abelii
MGPLTFMDVAIEFSLEEWQCLDTAQQNLYRNVMLENYRNLVFLGIAVSKPDLITCLEQGKEPWNMERHEMVAKPPGMCCYF

SEQ ID NO: 3313 - protein, 81 aa, Pongo abelii
MDVAIEFSLEEWQCLDTAQQNLYRNVMLENYRNLVFLGIAVSKPDLITCLEQGKEPWNMERHEMVAKPPGMCCYFAQDLWP

SEQ ID NO: 3314 - protein, 81 aa, Pongo abelii
TPGTPGSLEMGLLTFRDVAIEFSLEEWQCLDTAQQNLYRNVMLENYRNLAFLGIAVSKPDLITCLEQGKEPWNMKQHEMVD

SEQ ID NO: 3315 - protein, 81 aa, Pongo abelii
MGLLTFRDVAIEFSLEEWQCLDTAQQNLYRNVMLENYRNLAFLGIAVSKPDLITCLEQGKEPWNMKQHEMVDEPPGICPHF

SEQ ID NO: 3316 - protein, 81 aa, Pongo abelii
MGLLTFRDVAIEFSLEEWQCLDTAQRNLYKNVILENYRNLVFLGIAVSKQDLITCLEQEKEPLTVKRHEMVDEPPVMCSHF

SEQ ID NO: 3317 - protein, 81 aa, Pongo abelii
MGLLTFRDVAIEFSLEEWQCLDTAQRNLYKNVILENYRNLVFLGIAVSKQDLITCLEQEKEPLTVKRHEMVDEPPAIDKHP

SEQ ID NO: 3318 - protein, 81 aa, Pongo abelii
MGLLTFRDVAIEFSLEEWQCLDTAQRNLYKNVILENYRNLVFLGIAVSKQDLITCLEQEKEPLTVKRHEMVDEPPESRPVV

SEQ ID NO: 3319 - protein, 81 aa, Pongo abelii
MEPLKFRDVAIEFSLEEWQCLDTIQQNLYRNVMLENYRNLVFLGIAVSKPDLITCLEQEKEPWTRKRHRMVAEPPVICSHF

SEQ ID NO: 3320 - protein, 81 aa, Pongo abelii
MGLLTFRDVAIEFSLEEWQCLDTAQKNLYRNVMLENYRNLAFLGIAVSKPDLIICLEKEKELWNMKRHEMVDEPPDVSLCH

SEQ ID NO: 3321 - protein, 81 aa, Pongo abelii
MGLLTFRDVAIEFSLEEWQCLDTAQKNLYRNVMLENYRNLAFLGIAVSKPDLIICLEKEKELWNMKRHEMVDEPPGLAVSN

SEQ ID NO: 3322 - protein, 81 aa, Pongo abelii
MGLLTFRDVAIEFSLEEWQCLDTAQKNLYRNVMLENYRNLAFLGIAVSKPDLIICLEKEKELWNMKRHEMVDEPPGICPHF

SEQ ID NO: 3323 - protein, 81 aa, Pongo abelii
MLENYRNLAFLGIAVSKPDLITSLEQGKEPWNMKRHEMVDEPSGIYPHFAQDLWPEQGMEDSFQKAILRRYEKYGHENLQL

SEQ ID NO: 3324 - protein, 81 aa, Pongo abelii
MPGPPRSLEMGLLTFMDVAIEFSLEEWQHLDIAQQNLYRNVMLENYRNLAFLGIAVSKPDLITSLEQGKEPWNMKRHEMVD

SEQ ID NO: 3325 - protein, 81 aa, Pongo abelii
MSQVTFSDVAIDFSHEEWACLDSAQRDLYKDVMVQNYENLVSVAGLSITKPYVIMLLEDGKEPWMMEKKLSKDWESRWENE

SEQ ID NO: 3326 - protein, 81 aa, Pongo abelii
MSQVTFSDVAIDFSHEEWACLDSAQRDLYKDVMVQNYENLVSVAGLSITKPYVIMLLEDGKEPWMMEKKLSKVYPFPLSHS

SEQ ID NO: 3327 - protein, 81 aa, Pongo abelii
MSQVTFSDVAIDFSHEEWACLDSAQRDLYKDVMVQNYENLVSVGLSITKPYVIMLLEDGKEPWMMEKKLSKVYPFPLSHSV

SEQ ID NO: 3328 - protein, 81 aa, Pongo abelii
MSQVTFSDVAIDFSHEEWACLDSAQRDLYKDVMVQNYENLVSVGLSITKPYVIMLLEDGKEPWMMEKKLSKDWESRWENEE

SEQ ID NO: 3329 - protein, 81 aa, Pongo abelii
EELVGQNHGMEGEACTGGDVTFSDVAIDFSHEEWACLDSAQRDLYKDVMVQNYENLVSVGLSITKPYVIMLLEDGKEPWMM

SEQ ID NO: 3330 - protein, 81 aa, Pongo abelii
NEELVGQNHGMEGEACTGGDVTFSDVAIDFSHEEWACLDSAQRDLYKDVMVQNYENLVSVGLSITKPYVIMLLEDGKEPWM

SEQ ID NO: 3331 - protein, 81 aa, Pongo abelii
SNEELVGQNHGMEGEACTGGDVTFSDVAIDFSHEEWACLDSAQRDLYKDVMVQNYENLVSVAGLSITKPYVIMLLEDGKEP

SEQ ID NO: 3332 - protein, 81 aa, Pongo abelii
SNEELVGQNHGMEGEACTGEDVTFSDVAIDFSHEEWGWLNSAQRDLYKDVMVQNYENLVSVAGLSVTKPHVIMLLEDGKEP

SEQ ID NO: 3333 - protein, 81 aa, Pongo abelii
MPQVTFSDVAIDFSHEEWGWLNSAQRDLYKDVMVQNYENLVSVAGLSVTKPHVIMLLEDGKEPWMMEKKLSKGMIPDWESR

SEQ ID NO: 3334 - protein, 81 aa, Pongo abelii
MPQVTFSDVAIDFSHEEWGWLNSAQRDLYKDVMVQNYENLVSVGLSVTKPHVIMLLEDGKEPWMMEKKLSKGMIPDWESRW

SEQ ID NO: 3335 - protein, 81 aa, Pongo abelii
MPQVTFSDVAIDFSHEEWGWLNSAQRDLYKDVMVQNYENLVSVAGLSVTKPHVIMLLEDGKEPWMMEKKLSKDWESRWENK

SEQ ID NO: 3336 - protein, 81 aa, Pongo abelii
MAAPALALVSFEDVVVTFTGEEWGHLDLAQRTLYQEVMLETCRLLVSLGHPVPKPELIYLLEHGQELWTVKRGLSQSTCAG

SEQ ID NO: 3337 - protein, 81 aa, Pongo abelii
MAAPALALVSFEDVVVTFTGEEWGHLDLAQRTLYQEVMLETCRLLVSLGHPVPKPELIYLLEHGQELWTVKRGLSQSTCAA

SEQ ID NO: 3338 - protein, 81 aa, Pongo abelii
MAHKYVGLQFQGSVTFEDVAIAFSQQEWESLDSSQRGLYRDVMLENYRNLVSMAGHSLSKPHVIALLEQWKEPEVTVRKDG

SEQ ID NO: 3339 - protein, 81 aa, Pongo abelii
MAHKYVGLQFQGSVTFEDVAIAFSQQEWESLDSSQRGLYRDVMLENYRNLVSMGHSLSKPHVIALLEQWKEPEVTVRKDGR

SEQ ID NO: 3340 - protein, 81 aa, Pongo abelii
MAHFQGSVTFEDVAIAFSQQEWESLDSSQRGLYRDVMLENYRNLVSMAGHSLSKPHVIALLEQWKEPEVTVRKDGRRWCTD

SEQ ID NO: 3341 - protein, 81 aa, Pongo abelii
MAHFQGSVTFEDVAIAFSQQEWESLDSSQRGLYRDVMLENYRNLVSMGHSLSKPHVIALLEQWKEPEVTVRKDGRRWCTDL

SEQ ID NO: 3342 - protein, 81 aa, Pongo abelii
MAQGLVTFRDVAIEFSLEEWKCLEPAQRDLYREVTLENFGHLASLGLSISKPDVVSLLEQGKEPWMIANDVTGPWYPDLES

SEQ ID NO: 3343 - protein, 81 aa, Pongo abelii
MAHGSVTFRDVAIDFSQEEWEFLDPAQRDLYRDVMWENYSNFISLGPSISKPDVITLLDEERKEPEMVVREGTRRYCPDLE

SEQ ID NO: 3344 - protein, 81 aa, Pongo abelii
MAHGSVTFRDVAIDFSQEEWEFLDPAQRDLYRDVMWENYSNFISLGPSISKPDVITLLDEERKEPEMVVREGTRRYCPVFS

SEQ ID NO: 3345 - protein, 81 aa, Pongo abelii
MAHGSVTFRDVAIDFSQEEWEFLDPAQRDLYRDVMWENYSNFISLAGPSISKPDVITLLDEERKEPEMVVREGTRRYCPGE

SEQ ID NO: 3346 - protein, 81 aa, Pongo abelii
MALRSVMFSDVSIDFSPEEWEYLDLEQKDLYRDVMLENYSNLVSLGCFISKPDVISLLEQGKEPWKVVRKGRRQYPDLETK

SEQ ID NO: 3347 - protein, 81 aa, Pongo abelii
MAQESVMFSDVSVDFSQEEWECLNDDQRDLYRDVMLENYSNLVSMGHSVSKPNVISYLEQGKEPWLVDRELTRGQWPVLES

SEQ ID NO: 3348 - protein, 81 aa, Pongo abelii
MAQESVMFSDVSVDFSQEEWECLNDDQRDLYRDVMLENYSNLVSMAGHSVSKPNVISYLEQGKEPWLVDRELTRGQWPVLE

SEQ ID NO: 3349 - protein, 81 aa, Pongo abelii
MPEVEFPDQFFTVLTMDHELVTLRDVVINFSQEEWEYLDSAQRNLYWDVMMENYSNLLSLDLESRNETKHLSVGKDIIKNT

SEQ ID NO: 3350 - protein, 81 aa, Pongo abelii
MPEVEFPDQFFTVLTMDHELVTLRDVVINFSQEEWEYLDSAQRNLYWDVMMENYSNLLSLGRDTRDFFLSSHTRKNSHVKT

SEQ ID NO: 3351 - protein, 81 aa, Pongo abelii
MMENYSNLLSLDLESRNETKHLSVGKDIIKNTGSQWEVMESSKLHGLESSIFRNDWQSKSKIEVQGPEVGYFSQMKIISEN

SEQ ID NO: 3352 - protein, 81 aa, Pongo abelii
TVLTMDHELVTLRDVVINFSQEEWEYLDSAQRNLYWDVMMENYSNLLSLDLESRNETKHLSVGKDIIKNTGSQWEVMESSK

SEQ ID NO: 3353 - protein, 81 aa, Pongo abelii
MPLQGSVSFKDVTVDFTQEEWQQLDPAQKALYRDVMLENYCHFISVGFHMTKPDMIRKLEQGEELWTQRIFPSYSYLEEDG

SEQ ID NO: 3354 - protein, 81 aa, Pongo abelii
FHMTKPDMIRKLEQGEELWTQRIFPSYSYLEEDGKTEDVLVKFKEYQDRHSRPLIFINHKKLIKERSNIYGKTLTLGKNHI

SEQ ID NO: 3355 - protein, 81 aa, Pongo abelii
MSQGSVSFKDVTVDFTQEEWQQLDPAQKALYRDVMLENYCHFISVGFHMTKPDMIRKLEQGEELWTQRIFPSYSYLEEDGK

SEQ ID NO: 3356 - protein, 81 aa, Pongo abelii
MPLQGSVSFKDVTVDFTQEEWQQLDPAQKALYRDVMLENYCHFISVGFHMTKPDMIRKLEQGEELWTQRIFPSYSYLEDGK

SEQ ID NO: 3357 - protein, 81 aa, Pongo abelii
GFHMTKPDMIRKLEQGEELWTQRIFPSYSYLEDGKTEDVLVKFKEYQDRHSRPLIFINHKKLIKERSNIYGKTLTLGKNHI

SEQ ID NO: 3358 - protein, 81 aa, Pongo abelii
MAQGSVSFNDVTVDFTQEEWQHLDHAQKTLYMDVMLENYCHLISVGCHMTKPDVILKLERGEEPWTSFAGHICLEENWKAE

SEQ ID NO: 3359 - protein, 81 aa, Pongo abelii
MDVMLENYCHLISVGCHMTKPDVILKLERGEEPWTSFAGHICLEENWKAEDFLVKFKEHQEKYSRSVVSINHKKLVKEKSK

SEQ ID NO: 3360 - protein, 81 aa, Pongo abelii
MNMEGLVMFQDLSIDFSQEEWECLDTAQKDLYRDVMMENYSSLVSLGLSISKPDVISLLEQGKEPWMVSRDVLGGWCPDRL

SEQ ID NO: 3361 - protein, 81 aa, Pongo abelii
MNMEGLVMFQDLSIDFSQEEWECLDTAQKDLYRDVMMENYSSLVSLGLSISKPDVISLLEQGKEPWMVSRDVLGGWCPGLE

SEQ ID NO: 3362 - protein, 81 aa, Pongo abelii
MNMEGLVMFQDLSIDFSQEEWECLDTAQKDLYRDVMMENYSSLVSLDSKFRCKTKDSCLPKEIYEVISSQWVRMEKCHSLV

SEQ ID NO: 3363 - protein, 81 aa, Pongo abelii
MNMEGLVMFQDLSIDFSQEEWECLDTAQKDLYRDVMMENYSSLVSLGLSISKPDVISLLEQGKEPWMVSRDVLGGWCPDSK

SEQ ID NO: 3364 - protein, 81 aa, Pongo abelii
MAHLMMFRDVAVDFSQEEWECLDLEQRDLYRDVMLENYSNMVSLGLCIYQPEAFSLLEKGKDPWKILRDETRRPCPDMQSR

SEQ ID NO: 3365 - protein, 81 aa, Pongo abelii
HPEEEERMHDELLQAVSKGPVMFRDVSIDFSQEEWECLDSGQMNLYKEVMLENFSNLVSVGLSNSKPAVISLLEQGKEPWM

SEQ ID NO: 3366 - protein, 81 aa, Pongo abelii
YSQESALSEEEEDTTRPLETVTFKDVAVDLTQEEWEQMKPAQRNLYRDVMLENYSNLVTVGCQVTKPDVIFRLEQEEEPWV

SEQ ID NO: 3367 - protein, 81 aa, Pongo abelii
QEEWEQMKPAQRNLYRDVMLENYSNLVTVGCQVTKPDVIFRLEQEEEPWVMEEEMFGRHCPEPRRNCCASEVMEEMEFCSC

SEQ ID NO: 3368 - protein, 81 aa, Pongo abelii
MKPAQRNLYRDVMLENYSNLVTVGCQVTKPDVIFRLEQEEEPWVMEEEMFGRHCPEVWEVDGQIKKQQETLVRKVTSISKK

SEQ ID NO: 3369 - protein, 81 aa, Pongo abelii
YEKGCNPEENCCASEVMEEGLKFKDVVIYFSQKEWECLHSAQKDLYRDVMLENYGNLVLLGLSDTKPNVISLLEQKKEPWM

SEQ ID NO: 3370 - protein, 81 aa, Pongo abelii
MEEGLKFKDVVIYFSQKEWECLHSAQKDLYRDVMLENYGNLVLLGLSDTKPNVISLLEQKKEPWMIKRKETKEWCPDWEFG

SEQ ID NO: 3371 - protein, 81 aa, Pongo abelii
MARKLVMFRDVAIDFSQEEWECLDSAQRDLYRDVMLENYSNLVSLDLPSRCANKDLSPEKNTYETELSQWEMSDRLENCDL

SEQ ID NO: 3372 - protein, 81 aa, Pongo abelii
FRDVAIDFSQEEWECLDSAQRDLYRDVMLENYSNLVSLDLPSRCANKDLSPEKNTYETELSQWEMSDRLENCDLEESNSKD

SEQ ID NO: 3373 - protein, 81 aa, Pongo abelii
TELSQWEMSDRLENCDLEESNSKDYLEAKGKMEKQQENQKEYFRQGMIIYDKMSIFNQHTYLSQHSRCHSTEKPYKCKECG

SEQ ID NO: 3374 - protein, 81 aa, Pongo abelii
LAPDDHGSSYEGSVSFRDVAIDFSREEWRHLDPSQRNLYRDVMLETYSHLLSVGYQVPEAEVVMLEQGKEPWALQGERPRH

SEQ ID NO: 3375 - protein, 81 aa, Pongo abelii
REEWRHLDPSQRNLYRDVMLETYSHLLSVGYQVPEAEVVMLEQGKEPWALQGERPRHSCPVTHLPFPSTMTKSFLGLTRSQ

SEQ ID NO: 3376 - protein, 81 aa, Pongo abelii
SPQKSSALAPDDHGSSYEGSVSFRDVAINFSREEWQHLDLSQRNLYRDVMLETYSHLLSVGYQVPKPEVVMLEQGKEPWAL

SEQ ID NO: 3377 - protein, 81 aa, Pongo abelii
VAIDFSREEWRHLDPSQRNLYRDVMLETYSHLLSVGYQVPEAEVVMLEQGKEPWALQGERPRHSCPAQCRVNSHHLQESLG

SEQ ID NO: 3378 - protein, 81 aa, Pongo abelii
MQLNEEINKGSVSFRDVAINFSREEWQHLDLSQRNLYRDVMLETYSHLLSVGYQVPKPEVVMLEQGKEPWALQGERPRHSC

SEQ ID NO: 3379 - protein, 81 aa, Pongo abelii
REEWQHLDLSQRNLYRDVMLETYSHLLSVGYQVPKPEVVMLEQGKEPWALQGERPRHSCPGEKLWDHNQHRKIIGYKPASS

SEQ ID NO: 3380 - protein, 81 aa, Pongo abelii
NEEINKGSVSFRDVAINFSREEWQHLDLSQRNLYRDVMLETYSHLLSVGYQVPKPEVVMLEQGKEPWALQGERPRHSCPGE

SEQ ID NO: 3381 - protein, 81 aa, Pongo abelii
MAEGSVMFSDVSIDFSQEEWDCLDPVQRDLYRDVMLENYSNLVSMGKGICTSDSQFSSGMSASSTVNFSAAFEDFTLLSLK

SEQ ID NO: 3382 - protein, 81 aa, Pongo abelii
MLETYNHLVSLEIPSSKPKLIAQLERGEEPWREERKCPLDLCPESKPEIQLCLSRPLIFSSQQALSQHVWLSHLSQLFSSL

SEQ ID NO: 3383 - protein, 81 aa, Pongo abelii
GEEPWREERKCPLDLCPESKPEIQLCLSRPLIFSSQQALSQHVWLSHLSQLFSSLWAGNPLQLGKHYPEDQKQQQDPFCLS

SEQ ID NO: 3384 - protein, 81 aa, Pongo abelii
MLETYNHLVSLEIPSSKPKLIAQLERGEEPWREERKCPLDLCPDRALLCHQAGIQWHGISSLQPLPPGFKQFPCLSLLSSW

SEQ ID NO: 3385 - protein, 81 aa, Pongo abelii
MATGLLRAKKEEEWRLLSPAQRTLHREVMLETYNHLVSLEIPSSKPKLIAQLERGEEPWREERKCPLDLCPAESKPEIQLC

SEQ ID NO: 3386 - protein, 81 aa, Pongo abelii
KLIAQLERGEEPWREERKCPLDLCPAESKPEIQLCLSRPLIFSSQQALSQHVWLSHLSQLFSSLWAGNPLQLGKHYPEDQK

SEQ ID NO: 3387 - protein, 81 aa, Pongo abelii
EEPWREERKCPLDLCPESKPEIQLCLSRPLIFSSQQALSQHVWLSHLSQLFSSLWAGNPLQLGKHYPEDQKQQQDPFCLSG

SEQ ID NO: 3388 - protein, 81 aa, Pongo abelii
EPWREERKCPLDLCPAESKPEIQLCLSRPLIFSSQQALSQHVWLSHLSQLFSSLWAGNPLQLGKHYPEDQKQQQDPFCLSG

SEQ ID NO: 3389 - protein, 81 aa, Pongo abelii
MAVGLCKAMSQGLVTFRDVALDFSQEEWEWLKPSQKDLYRDVMLENYRNLVWLGDGCSCHSTLRTTATAEASSSSSSIQAS

SEQ ID NO: 3390 - protein, 81 aa, Pongo abelii
MTESQGTVTFKDVAIDFTQEEWKRLDPAQRNLYRNVMLENYNNLITVGYPFTKPDVIFKLEQEEEPWVMEEEVLRRHWQGE

SEQ ID NO: 3391 - protein, 81 aa, Pongo abelii
TSAGPIPSQKEEEMTESQGTVTFKDVAIDFTQEEWKRLDPAQRNLYRNVMLENYNNLITVGYPFTKPDVIFKLEQEEEPWV

SEQ ID NO: 3392 - protein, 81 aa, Pongo abelii
EMTESQGTVTFKDVAIDFTQEEWKRLDPAQRNLYRNVMLENYNNLITVGYPFTKPDVIFKLEQEEEPWVMEEEVLRRHWQG

SEQ ID NO: 3393 - protein, 81 aa, Pongo abelii
KSQEEERMAVGLLKAVYQELVTFRDVAVDFSQEEWDCLDSSQRHLYSNVMLENYRILVSLGLCFSKPSVILLLEQGKAPWM

SEQ ID NO: 3394 - protein, 81 aa, Pongo abelii
MAVGLLKAVYQELVTFRDVAVDFSQEEWDCLDSSQRHLYSNVMLENYRILVSLGLCFSKPSVILLLEQGKAPWMVKRELTK

SEQ ID NO: 3395 - protein, 81 aa, Pongo abelii
QGKAPWMVKRELTKGLCSGWEPVCETEELTPKQDFYEEHQSQKIIETLTSYNLEYSSLRKEWKCEGYFERQPGNQKVCFKE

SEQ ID NO: 3396 - protein, 81 aa, Pongo abelii
VVVGFTQEEWHRLSPAQRALYRDVMLETYSNLVSVGYEGTKPDVILRLEQEEAPWIGEAACPGCHCWGISKLWPTDWPPAL

SEQ ID NO: 3397 - protein, 81 aa, Pongo abelii
EWHRLSPAQRALYRDVMLETYSNLVSVGYEGTKPDVILRLEQEEAPWIGEAACPGCHCWEDIWQVNIQRKRRQDMLLRQGA

SEQ ID NO: 3398 - protein, 81 aa, Pongo abelii
EYRCQIFFQEQQKMIEYQIPVSFKDVVVGFTQEEWHRLSPAQRALYRDVMLETYSNLVSVGYEGTKPDVILRLEQEEAPWI

SEQ ID NO: 3399 - protein, 81 aa, Pongo abelii
EWHRLSPAQRALYRDVMLETYSNLVSVGYEGTKPDVILRLEQEEAPWIGEAACPGCHCWVAVPFYIPTSNAQGFQFLHNLT

SEQ ID NO: 3400 - protein, 81 aa, Pongo abelii
SFKDVVVGFTQEEWHRLSPAQRALYRDVMLETYSNLVSVGYEGTKPDVILRLEQEEAPWIGEAACPGCHCWDLTVLRELQP

SEQ ID NO: 3401 - protein, 81 aa, Pongo abelii
FKDVVVGFTQEEWHRLSPAQRALYRDVMLETYSNLVSVGYEGTKPDVILRLEQEEAPWIGEAACPGCHCWDLTVLRELQPR

SEQ ID NO: 3402 - protein, 81 aa, Pongo abelii
MAHALVTFRDVTIDFSQKEWECLDTTQRKLYRDVMLENYNNLVSLGYSGSKPDVITLLEQGKEPCVAARDVTGRQYPGLLS

SEQ ID NO: 3403 - protein, 81 aa, Pongo abelii
MAHALVTFRDVTIDFSQKEWECLDTTQRKLYRDVMLENYNNLVSLGLLSRHKTKKLSSEKDIHDISLSKGSKIEKSKTLHL

SEQ ID NO: 3404 - protein, 81 aa, Pongo abelii
MAHALVTFRDVTIDFSQKEWECLDTTQRKLYRDVMLENYNNLVSLAGYSGSKPDVITLLEQGKEPCVAARDVTGRQYPGLL

SEQ ID NO: 3405 - protein, 81 aa, Pongo abelii
MPHLLVTFRDVAIDFTQEEWECLDPAQRDLYRDVMLENYSNLISLEPARTHEEQHNLPVPKAGSVNLAAGFGHSRSQTGCG

SEQ ID NO: 3406 - protein, 81 aa, Pongo abelii
MPHLLVTFRDVAIDFTQEEWECLDPAQRDLYRDVMLENYSNLISLDLESSCATKKLSPEKEIYEMESLQWENMGNLINHHL

SEQ ID NO: 3407 - protein, 81 aa, Pongo abelii
MDLLFQLLVTFRDVAIDFTQEEWECLDPAQRDLYRDVMLENYSNLISLDLESSCATKKLSPEKEIYEMESLQWENMGNLIN

SEQ ID NO: 3408 - protein, 81 aa, Pongo abelii
LFQLLVTFRDVAIDFTQEEWECLDPAQRDLYRDVMLENYSNLISLDLESSCATKKLSPEKEIYEMESLQWENMGNLINHHL

SEQ ID NO: 3409 - protein, 81 aa, Pongo abelii
MTFRDAAIDFSKEEWECLGPAQRDLYRDVMLENYSNFVSLGLAISKPSVISLLEQGKEPWMAGKTGRYPDMLSRHQRIHKG

SEQ ID NO: 3410 - protein, 81 aa, Pongo abelii
MTFRDAAIDFSKEEWECLGPAQRDLYRDVMLENYSNFVSLGLAISKPSVISLLEQGKEPWMAGKTGRYPDMLSRYETKELR

SEQ ID NO: 3411 - protein, 81 aa, Pongo abelii
MACGSITFRDVAIDFSHQEWEYLNLVQKTLYQEVMMENYDNLVLLAGHSKSKPDLITLLEQGKEPWMIVREETRGECTDLD

SEQ ID NO: 3412 - protein, 81 aa, Pongo abelii
MACGSITFRDVAIDFSHQEWEYLNLVQKTLYQEVMMENYDNLVLLGHSKSKPDLITLLEQGKEPWMIVREETRGECTDLDS

SEQ ID NO: 3413 - protein, 81 aa, Pongo abelii
MACGSITFRDVAIDFSHQEWEYLNLVQKTLYQEVMMENYDNLVLLGHSKSKPDLITLLEQGKEPWMIVREETRGECTELQS

SEQ ID NO: 3414 - protein, 81 aa, Pongo abelii
HRVGLIRSYNSKTMTCFQELVTFRDVAIDFSRQEWEYLDPNQRDLYRDVMLENYRNLVSLGGHSISKPVVVDLLERGKEPW

SEQ ID NO: 3415 - protein, 81 aa, Pongo abelii
MLENYRNLVSLDLDLQCEIISYIEVPTYETDISSTQLQSIYKREKLYECKKCQKKFSSGYQLILHHRFHIIERPYECKECG

SEQ ID NO: 3416 - protein, 81 aa, Pongo abelii
HRVGLIRSYNSKTMTCFQELVTFRDVAIDFSRQEWEYLDPNQRDLYRDVMLENYRNLVSLEMRSRCVAQVGLKLLVSSDPP

SEQ ID NO: 3417 - protein, 81 aa, Pongo abelii
EPHRVGLIRSYNSKTMTCELVTFRDVAIDFSRQEWEYLDPNQRDLYRDVMLENYRNLVSLGGHSISKPVVVDLLERGKEPW

SEQ ID NO: 3418 - protein, 81 aa, Pongo abelii
EETQGELTSSCGSKTMANVSLAFRDVSIDLSQEEWECLDPVQRDLYKDVMLENYSNLVSLGYTIPKPDVITLLEQEKEPWI

SEQ ID NO: 3419 - protein, 81 aa, Pongo abelii
YKDVMLENYSNLVSLGYTIPKPDVITLLEQEKEPWIVMREGTRNWYTDLEYKYITKNLLSEKNVCKIYLSQLQTGEKSKNT

SEQ ID NO: 3420 - protein, 81 aa, Pongo abelii
LYKDVMLENYSNLVSLGYTIPKPDVITLLEQEKEPWIVMREGTRNWYTESRSVTQAGVQWHNLGSLQPPPPGFKQFFCLSL

SEQ ID NO: 3421 - protein, 81 aa, Pongo abelii
MQVDPPLHRPPNDFLIFQIIPLHSLSIMPWFLWILCFSMEETQGELTSSCGSKTMANVSLAFRDVSIDLSQEEWECLDPVQ

SEQ ID NO: 3422 - protein, 81 aa, Pongo abelii
MVHGSVTFRDVAIDFSQEEWECLQPNQRTLYRDVMLENYSHLISLGSSISKPDVITLLEQEKEPWIVVSKETSRWYPDLES

SEQ ID NO: 3423 - protein, 81 aa, Pongo abelii
MVHGSVTFRDVAIDFSQEEWECLQPNQRTLYRDVMLENYSHLISLAGSSISKPDVITLLEQEKEPWIVIWSQNMDLRKYLQ

SEQ ID NO: 3424 - protein, 81 aa, Pongo abelii
MLENYSHLISLGSSISKPDVITLLEQEKEPWMVVRKETSRRYPDLESKYGPEKVSSENDTSEVNLPKQVIKQISTTLGLEA

SEQ ID NO: 3425 - protein, 81 aa, Pongo abelii
GRSLRKIDQFCNSRNMVHGSVTFRDVAIDFSQEEWECLQPDQRTLYRDVMLENYSHLISLGSSISKPDVITLLEQEKEPWM

SEQ ID NO: 3426 - protein, 81 aa, Pongo abelii
KSCSGFSGFCASPIEESHGALISSCNSRTMTDGLVTFRDVAIDFSQEEWECLDPAQRDLYVDVMLENYSNLVSLGKVICLK

SEQ ID NO: 3427 - protein, 81 aa, Pongo abelii
MAQVPLTFSDVAIDFSQEEWEYLNSDQRDLYRDVMLENYTNLVSLDFDFTTESDKLSSEKRNYEVNAYHQETWKRNKTFNL

SEQ ID NO: 3428 - protein, 81 aa, Pongo abelii
FQVPLTFSDVAIDFSQEEWEYLNSDQRDLYRDVMLENYTNLVSLDFDFTTESDKLSSEKRNYEVNAYHQETWKRNKTFNLM

SEQ ID NO: 3429 - protein, 81 aa, Pongo abelii
MTKSKEAVTFKDVAVVFSEEELQLLDLAQRKLYRDVMLENFRNVVSVGHQSTPDGLPQLEREEKLWMMKMATQRDNSSGSK

SEQ ID NO: 3430 - protein, 81 aa, Pongo abelii
MLENFRNVVSVGHQSTPDGLPQLEREEKLWMMKMATQRDNSSGSKNLKEMETLQEVGLRYLPHEELFCSQIWQQITRELIK

SEQ ID NO: 3431 - protein, 81 aa, Pongo abelii
HSGLCKFPEVEGKMTTFKEAVTFKDVAVVFTEEELGLLDPAQRKLYRDVMLENFRNLLSVGNQQFHQDTFHFLRKEKFWMM

SEQ ID NO: 3432 - protein, 81 aa, Pongo abelii
LRKEKFWMMKTTSQREGNSEGKIQIEMETVPEAGPHEEWSCQQIWEQIASDLTRSQNSIRNSSQFFKEGDVPCQIEAGLSI

SEQ ID NO: 3433 - protein, 81 aa, Pongo abelii
AQRKLYRDVMLENFRNLLSVGNQQFHQDTFHFLRKEKFWMMKTTSQREGNSEGKIQIEMETVPEAGPHEEWSCQQIWEQIA

SEQ ID NO: 3434 - protein, 81 aa, Pongo abelii
MTTFKEAVTFKDVAVFFTEEELGLLDPAQRKLYRDVMLENFRNLLSMGHQPFHQDTFHFLKEETFWMMGTATQREGNSGGK

SEQ ID NO: 3435 - protein, 81 aa, Pongo abelii
LKEETFWMMGTATQREGNSGGKIQTELESVPEAGAHEEWSCQQIWEQIAKDLTRSQDSIINNSQFFENGDVPSQVEAGLPT

SEQ ID NO: 3436 - protein, 81 aa, Pongo abelii
MIKRSKVLVFCSKIMEEAVTFKDVAVFFTEEELGLLDPAQRKLYRDVMLENFRNLLSMGHQPFHQDTFHFLKEETFWMMGT

SEQ ID NO: 3437 - protein, 81 aa, Pongo abelii
DVMLENFRNLLSMGHQPFHQDTFHFLKEETFWMMGTATQREGNSGGKIQTELESVPEAGAHEEWSCQQIWEQIAKDLTRSQ

SEQ ID NO: 3438 - protein, 81 aa, Pongo abelii
SQFFEQGDVPSQVEAGLSIIHKGQKPSQNGKCKQSFSDVAIFDFPQQLHSGEKSHTCNECGKSFCYISALRIHQRVHLREK

SEQ ID NO: 3439 - protein, 81 aa, Pongo abelii
MIDSGEKKSGRRTKEAVTFKDVAVVFTEEELGLLDPAQRKLYRDVMLENFRNLLSVGHQPFHGDTFHFLREEKFWVMETTS

SEQ ID NO: 3440 - protein, 81 aa, Pongo abelii
GRRTKEAVTFKDVAVVFTEEELGLLDPAQRKLYRDVMLENFRNLLSVGHQPFHGDTFHFLREEKFWVMETTSQREGNSGPL

SEQ ID NO: 3441 - protein, 81 aa, Pongo abelii
RAKLYEAVTFKDVAVVFTEEELGLLDPAQRKLYRDVMLENFRNLLSVGGKIQTEMETVPEAGTREEFSCKQIWEQIASDLI

SEQ ID NO: 3442 - protein, 81 aa, Pongo abelii
HSGLCKFPKVGGKMTMSKEAVTFKDVAVVFTEEELGLLDLAQRKLYRDVMLENFRNLLSVGHQPFHRDTFYFLREEKFWMM

SEQ ID NO: 3443 - protein, 81 aa, Pongo abelii
MTMSKEAVTFKDVAVVFTEEELGLLDLAQRKLYRDVMLENFRNLLSVGHQPFHRDTFYFLREEKFWMMDIATQREGNSGGK

SEQ ID NO: 3444 - protein, 81 aa, Pongo abelii
MTMSKEAVTFKDVAVVFTEEELGLLDLAQRKLYRDVMLENFRNLLSVGHQPFHRDTFYFLREEKFWMMDIATQREGNSGKK

SEQ ID NO: 3445 - protein, 81 aa, Pongo abelii
TFKDVAVVFTEEELGLLDLAQRKLYRDVMLENFRNLLSVGHQPFHRDTFYFLREEKFWMMDIATQREGNSGKKYATVCPCL

SEQ ID NO: 3446 - protein, 81 aa, Pongo abelii
MTMSKEAVTFKDVAVVFTEEELGLLDLAQRKLYRDVMLENFRNLLSVGHQPFHRDTFYFLREEKFWMMDIATQREGNSGGS

SEQ ID NO: 3447 - protein, 81 aa, Pongo abelii
DVAVVFTEEELGLLDLAQRKLYRDVMLENFRNLLSVGHQPFHRDTFYFLREEKFWMMDIATQREGNSGGSVQASECRNWSK

SEQ ID NO: 3448 - protein, 81 aa, Pongo abelii
MLENFRNLLSVGHQPFHRDTFYFLREEKFWMMDIATQREGNSGGKIQPEMKTFPEAGPHEGWSCQQIWEEIASDLTRPLDS

SEQ ID NO: 3449 - protein, 81 aa, Pongo abelii
MTMFKEAVTFKDVAVVFTEEELGLLDLAQRKLYRDVMLENFRNLLSVGHQTSHRDAFHFRREEKFWMMETATQREGNSGGK

SEQ ID NO: 3450 - protein, 81 aa, Pongo abelii
RREEKFWMMETATQREGNSGGKIQTELESVPETGPHEEWSCQQIWEQTESELTRPQDSISSSQFSTQGDVPSQVDAGLSII

SEQ ID NO: 3451 - protein, 81 aa, Pongo abelii
MTTFKEAMTFKDVAVVFTEEELGLLDLAQRKLYRDVMLENFRNLLSVGHQAFHRDTFHFLKEEKIWMMKTATQREGNSGDK

SEQ ID NO: 3452 - protein, 81 aa, Pongo abelii
FLKEEKIWMMKTATQREGNSGDKIQTEMETVSEAGTNQEWSCQQIWEKIASDLTRSQDLVINSSQFSKEGDFPCQTEAGLS

SEQ ID NO: 3453 - protein, 81 aa, Pongo abelii
LLSVGHQAFHRDTFHFLKEEKIWMMKTATQREGNSGDKIQTEMETVSEAGTNQEWSCQQIWEKIASDLTRSQDLVINSSQF

SEQ ID NO: 3454 - protein, 80 aa, Pongo abelii
MTTFKEAMTFKDVAVVFTEEELGLLDLAQRKLYRDVMLENFRNLLSVGHQAFHRDTFHFLKEEKIWMMKTATQREGNSET

SEQ ID NO: 3455 - protein, 81 aa, Pongo abelii
MATLKEAVTFKDVAVVFTEEELRLLDLAQRKLYQEVMLENFRNLLSVGHQPLHRDTFHFLKEEKFWMMETATQREGNLGGK

SEQ ID NO: 3456 - protein, 81 aa, Pongo abelii
RNLLSVGHQPLHRDTFHFLKEEKFWMMETATQREGNLGGKIQTEMETVPESGAHEGLFSHQTWEQISSDLTRFQDSMVNSF

SEQ ID NO: 3457 - protein, 81 aa, Pongo abelii
MATLKEAVTFKDVAVVFTEEELRLLDLAQRKLYQEVMLENFRNLLSVGHQPLHRDTFHFLKEEKFWMMETATQREGNLGLA

SEQ ID NO: 3458 - protein, 81 aa, Pongo abelii
MTTFKEGLTFKDVAVVFTEEELGLLDPVQRNLYRDVMLENFRNLLSVGHHPFKHDVFPLEKEKKLDIMKTATQRKGKSADK

SEQ ID NO: 3459 - protein, 81 aa, Pongo abelii
MNMFKEAVTFKDVAVAFTEEELGLLGPAQRKLYRDVMVENFRNLLSVGHQPFKQDVSPIERNEQLWIVTTATRRQGNLGEK

SEQ ID NO: 3460 - protein, 81 aa, Pongo abelii
VGHQPFKQDVSPIERNEQLWIVTTATRRQGNLGEKNQSKLITVQDRESEEELSCWQIWQQIANDLTRCQDSMINNYQFHKQ

SEQ ID NO: 3461 - protein, 81 aa, Pongo abelii
MNMFKEAVTFKDVAVAFTEEELGLLGPAQRKLYRDVMVENFRNLLSVGHQPFKQDVSPIERNEQLWIVTTATRRQGNLGKN

SEQ ID NO: 3462 - protein, 81 aa, Pongo abelii
MNMFKEAVTFKDVAVAFTEEELGLLGPAQRKLYRDVMVENFRNLLSVGHQPFKQDVSPIERNEQLWIVTTATRRQGNLDTL

SEQ ID NO: 3463 - protein, 81 aa, Pongo abelii
MVENFRNLLSVGHQPFKQDVSPIERNEQLWIVTTATRRQGNLGEKNQSKLITVQDRESEEELSCWQIWQQIANDLTRCQDS

SEQ ID NO: 3464 - protein, 81 aa, Pongo abelii
TTATRRQGNLGEKNQSKLITVQDRESEEELSCWQIWQQIANDLTRCQDSMINNYQFHKQGDFPCQVGTELSIQISEDENYL

SEQ ID NO: 3465 - protein, 81 aa, Pongo abelii
IERNEQLWIVTTATRRQGNLGEKNQSKLITVQDRESEEELSCWQIWQQIANDLTRCQDSMINNYQFHKQGDFPCQVGTELS

SEQ ID NO: 3466 - protein, 81 aa, Pongo abelii
MNMFKEAVTFKDVAVAFTEEELGLLGPAQRKLYRDVMVENFRNLLSVGHQPFKQDVSPIERNEQLWIVTTATRRQGNLGYF

SEQ ID NO: 3467 - protein, 81 aa, Pongo abelii
SQNYDLPQKEQEKMTKFQEAVTFKDVAVVFSREELRLLDLTQRKLYRDVMVENFKNLVAVGHLPFQPDMVSQLEAEEKLWM

SEQ ID NO: 3468 - protein, 81 aa, Pongo abelii
SQNYDLPQKEQEKMTKFQEAVTFKDVAVVFSREELRLLDLTQRKLYRDVMVENFKNLVAVGSKHQNKMEALQKFALKYLSN

SEQ ID NO: 3469 - protein, 81 aa, Pongo abelii
MPSQNYDLPQKEQEKMTKFQEAVTFKDVAVVFSREELRLLDLTQRKLYRDVMVENFKNLVAVGHLPFQPDMVSQLEAEEKL

SEQ ID NO: 3470 - protein, 81 aa, Pongo abelii
PSQNYDLPQKEQEKMTKFQEAVTFKDVAVVFSREELRLLDLTQRKLYRDVMVENFKNLVAVGHLPFQPDMVSQLEAEEKLW

SEQ ID NO: 3471 - protein, 81 aa, Pongo abelii
MTKFREAVTFKDVAVAFTEEELGLLDSAQKKLYRDVMLENFRNLVSVGHQSFKPDMISQLEMEEKLWMKELQTQRGKDSET

SEQ ID NO: 3472 - protein, 81 aa, Pongo abelii
MTKFREAVTFKDVAVAFTEEELGLLDSAQKKLYRDVMLENFRNLVSVGHQSFKPDMISQLEMEEKLWMKELQTQRGKDSVW

SEQ ID NO: 3473 - protein, 81 aa, Pongo abelii
MTKFREAVTFKDVAVAFTEEELGLLDSAQKKLYRDVMLENFRNLVSVGHQSFKPDMISQLEMEEKLWMKELQTQRGKDSGF

SEQ ID NO: 3474 - protein, 81 aa, Pongo abelii
MTKFREAVTFKDVAVAFTEEELGLLDSAQKKLYRDVMLENFRNLVSVGHQSFKPDMISQLEMEEKLWMKELQTQRGKDSGD

SEQ ID NO: 3475 - protein, 81 aa, Pongo abelii
MTKFREAVTFKDVAVAFTEEELGLLDSAQKKLYRDVMLENFRNLVSVGHQSFKPDMISQLEMEEKLWMKELQTQRGDRNQN

SEQ ID NO: 3476 - protein, 81 aa, Pongo abelii
PRTLPFPRRRRGKMTKFREAVTFKDVAVAFTEEELGLLDSAQKKLYRDVMLENFRNLVSVGHQSFKPDMISQLEMEEKLWM

SEQ ID NO: 3477 - protein, 81 aa, Pongo abelii
MTKFQEMVTFKDVAVVFTREEVGLLDVAQRKLYQDVMLENFRNLLSVGYQPFKLDVVLQLGKEDKLWMMETEIQGDGCSGE

SEQ ID NO: 3478 - protein, 81 aa, Pongo abelii
MTKFQEMVTFKDVAVVFTREEVGLLDVAQRKLYQDVMLENFRNLLSVGYQPFKLDVVLQLGKEDKLWMMETEIQGDGCSGH

SEQ ID NO: 3479 - protein, 81 aa, Pongo abelii
FWRYNHVLPSQDPALPQKEQEKMTKFQEMVTFKDVAVVFTREEVGLLDVAQRKLYQDVMLENFRNLLSVGYQPFKLDVVLQ

SEQ ID NO: 3480 - protein, 81 aa, Pongo abelii
MTKFQEMVTFKDVAVVFTREEVGLLDVAQRKLYQDVMLENFRNLLSVGYQPFKLDVVLQLGKEDKLWMMETEIQGDGCSGL

SEQ ID NO: 3481 - protein, 81 aa, Pongo abelii
MCSCDPSLWTEEKVTFKDMAVVFTKEELALLDKPQINLYQDVMLENFRKLISRQGLTVLPRLVSNSLAQAILPPQPPKMLE

SEQ ID NO: 3482 - protein, 81 aa, Pongo abelii
VLPRLVSNSLAQAILPPQPPKMLEITDGVSSVTQAEVQWRNLSSLQALPFCVNIESFVKKIFFLPRRKVGEIQQKCFWIKT

SEQ ID NO: 3483 - protein, 81 aa, Pongo abelii
HSQASAVSQDREDKIMSQEPLSFKDVAVVFTEEELELLDSTQRQLYQDVMQENFRNLLSVGDKNGKDMEYIQDEELRFFSH

SEQ ID NO: 3484 - protein, 81 aa, Pongo abelii
HSQASAVSQDREDKIMSQEPLSFKDVAVVFTEEELELLDSTQRQLYQDVMQENFRNLLSVGERNPLGDKNGKDMEYIQDEE

SEQ ID NO: 3485 - protein, 81 aa, Pongo abelii
TLTSRHEKRALHSQASAVSQDREDKIMSQEPLSFKDVAVVFTEEELELLDSTQRQLYQDVMQENFRNLLSVGERNPLGNWN

SEQ ID NO: 3486 - protein, 81 aa, Pongo abelii
SMEEQDDKPPEPPKACAQEGVNFKIVTVDFTQEEQGTWNPAQRTLDRDVILENHRDLVSWDLATAVGKKDSTSKQRIFDEE

SEQ ID NO: 3487 - protein, 81 aa, Pongo abelii
MSQDLVTFTDVAVNFTKEEWTLLDPAQRNLYRDVMLENSRNLAFIDWATPCKTKDATPQPDILPKRTFPEANRVCLKSISS

SEQ ID NO: 3488 - protein, 81 aa, Pongo abelii
IRDEIDMGANRHQRNPFGKAFCEDGSFRAHNTHVRDKMCDFTQCENTSRNNSIHAVQMQSYTAETNKKDCQTGATSADAPN

SEQ ID NO: 3489 - protein, 81 aa, Pongo abelii
PSSASQVAKTTGNHPHSRDLVTFTDVAVNFTKEEWTLLDPAQRNLYRDVMLENSRNLAFIDWATPCKTKDATPQPDILPKR

SEQ ID NO: 3490 - protein, 81 aa, Pongo abelii
MAEEFVTLKDVGMDFTLGDWEQLGLEQGDMFWDTALDSCQDLFLLNPPRPNLTSHPDGDEDLEPLAGGSPEATGPDVTETK

SEQ ID NO: 3491 - protein, 81 aa, Pongo abelii
MDFTLGDWEQLGLEQGDMFWDTALDSCQDLFLLNPPRPNLTSHPDGDEDLEPLAGGSPEATGPDVTETKNSPLMEDFFEEG

SEQ ID NO: 3492 - protein, 81 aa, Pongo abelii
LSQKPQVLGPEEQDGSCEASVSFEDVTVDFSREEWQQLDPAQRRLYQDVMLELYSHLFSVGYHIPNPDVIFRMLKEKEPRV

SEQ ID NO: 3493 - protein, 81 aa, Pongo abelii
NATIVMSVRREQGSSSGEGSLSFEDVAVGFTREEWQFLDQSQKVLYKEVMLENYSNLVSVGYQGTKPDSLFKLEQGEPPWI

SEQ ID NO: 3494 - protein, 81 aa, Pongo abelii
NATIVMSVRREQGSSSGEGSLSFEDVAVGFTREEWQFLDQSQKVLYKEVMLENYSNLVSVGTKPDSLFKLEQGEPPWIVEG

SEQ ID NO: 3495 - protein, 81 aa, Pongo abelii
MTKAQESLTLKDVAVDFTWEEWQLLGPAQKRLYRDVMLENYSNLVSVGYQASKPDALTKLEQGEPLWTLEDEIHSPAHPEI

SEQ ID NO: 3496 - protein, 81 aa, Pongo abelii
MLENYSNLVSVGYQASKPDALFKLDQGEPWTVENEIHSQICPEIKKVDNHLQMHSQNQRCLKRVEQCHKHNAFGNIIHQRK

SEQ ID NO: 3497 - protein, 81 aa, Pongo abelii
YSNLVSVGYQASKPDALFKLDQGEPWTVENEIHSQICPEIKKVDNHLQMHSQNQRCLKRVEQCHKHNAFGNIIHQRKSDFP

SEQ ID NO: 3498 - protein, 81 aa, Pongo abelii
MIKSQESLTLEDVAVEFTWEEWQLLGPAQKDLYRDVMLENYSNLVSVGYQASKPDALFKLDQGEPWTVENEIHSQICPEIK

SEQ ID NO: 3499 - protein, 81 aa, Pongo abelii
MIQAQESITLEDVAVDFTWEEWQLLGAAQKDLYRDVMLENYSNLVAVGYQASKPDALFKLEQGEQPWTTEDGIHSGACSDM

SEQ ID NO: 3500 - protein, 81 aa, Pongo abelii
FAYMSCLVKHKRIHTREKQEAARVENPPAERHSSLHTSDVMQEKNSANGVTTQVPSVAPQTSLNISGLLANRNVVLVGQPV

SEQ ID NO: 3501 - protein, 81 aa, Pongo abelii
MLENYSNLVAVGYQASKPDALFKLEQGEQPWTTEDGIHSGACSDMWKVDHVLEHLQSESLVNRRKQCHEHDAFENIVHCSK

SEQ ID NO: 3502 - protein, 81 aa, Pongo abelii
RMQAQESLTLEDVAVDFTWEEWQFLSPAQKDLYRDVMLENYSNLVAVGFQASKQDALSKLERGEETCTTEDEIYSRICFDS

SEQ ID NO: 3503 - protein, 81 aa, Pongo abelii
RMQAQESLTLEDVAVDFTWEEWQFLSPAQKDLYRDVMLENYSNLVAVGFQASKQDALSKLERGEETCTTEDEIYSRICFEI

SEQ ID NO: 3504 - protein, 81 aa, Pongo abelii
MRPEQTKFWEESLTLEDVAVDFTWEEWQFLSPAQKDLYRDVMLENYSNLVAVGFQASKQDALSKLERGEETCTTEDEIYSR

SEQ ID NO: 3505 - protein, 81 aa, Pongo abelii
RMQAQESLTLEDVAVDFTWEEWQFLSPAQKDLYRDVMLENYSNLVAVGFQASKQDALSKLERGEETCTTEDEIYSRICFGR

SEQ ID NO: 3506 - protein, 81 aa, Pongo abelii
MESLTLEDVAVDFTWEEWQFLSPAQKDLYRDVMLENYSNLVAVGFQASKQDALSKLERGEETCTTEDEIYSRICFDSGGAS

SEQ ID NO: 3507 - protein, 81 aa, Pongo abelii
MQAQESLTLEDVAVDFTWEEWQFLSPAQKDLYRDVMLENYSNLVAVGFQASKQDALSKLERGEETCTTEDEIYSRICFDSG

SEQ ID NO: 3508 - protein, 81 aa, Pongo abelii
MINAQELLTLEDVTVEFTWEEWQLLDPFQKDLYRDVTLEIYSNLVSMGYQVSKPDALSKLEQGEEPWTMEDERHSRICPEN

SEQ ID NO: 3509 - protein, 81 aa, Pongo abelii
LVSMGYQVSKPDALSKLEQGEEPWTMEDERHSRICPENNKVDDHLQDHLENQWMLKSVEQYHEHNAFGNTASQTKSLCLFR

SEQ ID NO: 3510 - protein, 81 aa, Pongo abelii
MINAQELLTLEDVTVEFTWEEWQLLDPFQKDLYRDVTLEIYSNLVSMGYQVSKPDALSKLEQGEEPWTMEDERHSRICPGT

SEQ ID NO: 3511 - protein, 81 aa, Pongo abelii
MALPQGFLTFRDVAVEFSQEEWKCLDPVQKALYRDVMLENYRNLGFLGLCLPDLNIISMLEQGKEPWTVVSQVKIARNPNC

SEQ ID NO: 3512 - protein, 81 aa, Pongo abelii
MATQGHLTFKDVAIEFSQEEWKCLEPVQKALYKDVMLENYRNLVFLGISPKCVIKELPPTENSNTGERFQTVALERPQSYD

SEQ ID NO: 3513 - protein, 81 aa, Pongo abelii
MALPQGPLTFRDVAIEFSQEEWKSLDPVQKALYWDVMLENYRNLVFLGILPKCMTKELPPIGNSNTGEKCQTVTLERHECY

SEQ ID NO: 3514 - protein, 81 aa, Pongo abelii
LCIVQGPLTFRDVAIEFSQEEWKSLDPVQKALYWDVMLENYRNLVFLGILPKCMTKELPPIGNSNTGEKCQTVTLERHECY

SEQ ID NO: 3515 - protein, 81 aa, Pongo abelii
MALPQGPLTFRDVAIEFSQEEWKSLDPVQKALYWDVMLENYRNLVFLGKDNFALEVKICPCVFLYFLCCLSWEPFHYLTET

SEQ ID NO: 3516 - protein, 81 aa, Pongo abelii
MAQLRRGHLTFRDVAIEFSQEEWKCLDPVQKALYRDVMLENYRNLVSLGICLPDLSIFSMMKQRTESWTVENEMKVANNPD

SEQ ID NO: 3517 - protein, 81 aa, Pongo abelii
EGEAQKRKAEESGMPLTQGHLTFRDVAIEFSQEEWKCLDPVQKALYRDVMLENYRNLVSLGICLPDLSIFSMMKQRTESWT

SEQ ID NO: 3518 - protein, 81 aa, Pongo abelii
MLENYRNLVSLGICLPDLSIFSMMKQRTESWTVENEMKVANNPDRWEGIKDINTGRSCAVRSKAGNKPVTNQLGLTFQLPL

SEQ ID NO: 3519 - protein, 81 aa, Pongo abelii
MGHLTFRDVAIEFSQEEWKCLDPVQKALYRDVMLENYRNLVSLGICLPDLSIFSMMKQRTESWTVENEMKVANNPDRWEGI

SEQ ID NO: 3520 - protein, 81 aa, Pongo abelii
AQKRRKRKAKKSGMALPQGHLTFRDVAIEFSQAEWKCLDPSQRALYKDVMLENYRNLVSLGISLPDLNINSMLEQRREPWS

SEQ ID NO: 3521 - protein, 81 aa, Pongo abelii
AQKRRKRKAKKSGMALPQGHLTFRDVAIEFSQAEWKCLDPSQRALYKDVMLENYRNLVSLGSSYALGSNAEDKPIKKQLGV

SEQ ID NO: 3522 - protein, 81 aa, Pongo abelii
PWSGESEVKIAKNSDERECIQGVNTVWSAMAQSWLTATSTSWVQAILLTQRPEQLGLQGAAMHWEAMQKTNQLKNNLEYPF

SEQ ID NO: 3523 - protein, 81 aa, Pongo abelii
DEEAQKRKAKESGMALPQGHLTFMDVAIEFSQEEWKSLDPGQRALYRDVMLENYRNLVSLGICLPDRSIISMLRQRREPLV

SEQ ID NO: 3524 - protein, 81 aa, Pongo abelii
DEEAQKRKAKESGMALPQGHLTFMDVAIEFSQEEWKSLDPGQRALYRDVMLENYRNLVSLGRSCILGSNAENKPIKNQLGL

SEQ ID NO: 3525 - protein, 81 aa, Pongo abelii
MLRRGHLTFRDVAIEFSQEEWKCLDPAQRTLYREVMLENYRNLVFLGICLPDLSIISMLEQRRDPRNLQSEMKMANNPGGR

SEQ ID NO: 3526 - protein, 81 aa, Pongo abelii
MLRRGHLTFRDVAIEFSQEEWKCLDPAQRTLYREVMLENYRNLVFLGICLPDLSIISMLEQRRDPRNLQSEMKMANNPGSC

SEQ ID NO: 3527 - protein, 81 aa, Pongo abelii
MALTQGPLKFRDVAIEFSQEEWKCLDPAQRTLYRDVMLENYRNLVSLGICLPDLSVTSMLEQNKDPWTLQSEEKIANNPDG

SEQ ID NO: 3528 - protein, 81 aa, Pongo abelii
RDVAIEFSQEEWKCLDPAQRTLYRDVMLENYRNLVSLGICLPDLSVTSMLEQNKDPWTLQSEEKIANNPDGRECIKGVNTV

SEQ ID NO: 3529 - protein, 81 aa, Pongo abelii
QGSNSEEERKGVRNGPYSGPLKFRDVAIEFSQEEWKCLDPAQRTLYRDVMLENYRNLVSLGICLPDLSVTSMLEQNKDPWT

SEQ ID NO: 3530 - protein, 81 aa, Pongo abelii
LYRDVMLENYRNLVSLGICLPDLSVTSMLEQNKDPWTLQSEEKIANNPDGRECIKGVNTDSPLLQCITSVPCVFCTASMIY

SEQ ID NO: 3531 - protein, 81 aa, Pongo abelii
MALTQGQLSFRDVAIEFSQEEWKCLDPGQKALYRDVMLENYRNLVSLGICLPGLSVTSMLEQKRDPCTLQSEVKIANNPDG

SEQ ID NO: 3532 - protein, 81 aa, Pongo abelii
MALTQGQLSFRDVAIEFSQEEWKCLDPGQKALYRDVMLENYRNLVSLGEDNVPEACICSGICLPGLSVTSMLEQKRDPCTL

SEQ ID NO: 3533 - protein, 81 aa, Pongo abelii
MALTQGQLSFRDVAIEFSQEEWKCLDPGQKALYRDVMLENYRNLVSLDFSLLAWDARVFRVEAWRTSGGAEEPTSPNFGGN

SEQ ID NO: 3534 - protein, 81 aa, Pongo abelii
EEAAQKRKGKEPGMALPQGRLTFRDVAIEFSLAEWKYLNPAQRALYREVMLENYRNLEAVGLHTGEKSYKCEECDKVFSQK

SEQ ID NO: 3535 - protein, 81 aa, Pongo abelii
EEAAQKRKGKEPGMALPQGRLTFRDVAIEFSLSEWKFLNPAQRALYREVMLENYRNLEAVDISSKCMMKEVLSTGQGNSEV

SEQ ID NO: 3536 - protein, 81 aa, Pongo abelii
REEAAQKRKGKEPGMALPQGRLTFRDVAIEFSLSEWKFLNPAQRALYREVMLENYRNLEAVDISSKCMMKEVLSTGQGNSE

SEQ ID NO: 3537 - protein, 81 aa, Pongo abelii
ETWKRKRKAKESGMALPQGLLTFRDVSIEFSQEEWKCLDPAQRTLYRDVMLENYRNLVSLDISSKCMMQMFSSTGQGNTEV

SEQ ID NO: 3538 - protein, 81 aa, Pongo abelii
MALPQGLLTFRDVSIEFSQEEWKCLDPAQRTLYRDVMLENYRNLVSLDISSKCMMQMFSSTGQGNTEVIHTGTLQIHASHH

SEQ ID NO: 3539 - protein, 81 aa, Pongo abelii
TWKRKRKAKESGMALPQGLLTFRDVSIEFSQEEWKCLDPAQRTLYRDVMLENYRNLVSLDISSKCMMQMFSSTGQGNTEVI

SEQ ID NO: 3540 - protein, 81 aa, Pongo abelii
MALPQGLLTFRDVAIEFSQEEWKCLDPAQRTLYRDVMLENYRNLVSLGIFSKCEIKELPPKKESNTGEIFQTVMLERQESH

SEQ ID NO: 3541 - protein, 81 aa, Pongo abelii
DPAQRTLYRDVMLENYRNLVSLGIFSKCEIKELPPKKESNTGEIFQTVMLERQESHDIQDFCFRETQKNVHDSQCQWKHDE

SEQ ID NO: 3542 - protein, 81 aa, Pongo abelii
AIEFSQEEWKCLDPAQRTLYRDVMLENYRNLVSLGIFSKCEIKELPPKKESNTGEIFQTVMLERQESHDIQDFCFRETQKN

SEQ ID NO: 3543 - protein, 81 aa, Pongo abelii
MALPQGLLTFRDVAIEFSQEEWKCLDPAQRTLYRDVMLENYRNLVSLGHDLILILFFFFPSWSFSCCPSWSAMAQSWLTRT

SEQ ID NO: 3544 - protein, 81 aa, Pongo abelii
VSLGHDLILILFFFFPSWSFSCCPSWSAMAQSWLTRTSASRVQVILPPQPLKLELQVFFLNVRSRNYHQKKRVIQEKYSRQ

SEQ ID NO: 3545 - protein, 81 aa, Pongo abelii
MALPQGLLTFRDVAIEFSQEEWKCLDPAQRTLYRDVMLENYRNLVSLVGVSLVAQAGVQWHNLGSPELLPPGFKFSRLSLS

SEQ ID NO: 3546 - protein, 81 aa, Pongo abelii
EEAAQKRKGKEPSMALPQGRLTFRDVAIEFSLAEWKFLNPAQRALYREVMLENYRNLEAVDISSKCMKKEVLSTGQGNTEV

SEQ ID NO: 3547 - protein, 81 aa, Pongo abelii
EEAAQKRKGKEPSMALPQGRLTFRDVAIEFSLAEWKFLNPAQRALYREVMLENYRNLEAVESHFVTQAGVQWCDLGSLQPL

SEQ ID NO: 3548 - protein, 80 aa, Pongo abelii
VLREEAAQKRKGKEPSMALPQGRLTFRDVAIEFSLAEWKFLNPAQRALYREVMLENYRNLEAVETGFHRVSQDGLNLLTL

SEQ ID NO: 3549 - protein, 81 aa, Pongo abelii
EEAAQKRKGNEPGMALPQGRLTFRDVAIEFSLAEWKYLNPAQRALYREVMLENYRNLEAVDISKCMMKEVLSTGQDNTEVF

SEQ ID NO: 3550 - protein, 81 aa, Pongo abelii
MALPQGLLTFRDVAIEFSQEEWKCLDPAQRTLYRDVMLENYRNLVSLDISSKCMMKIFSTGQGNTEVFHTGTLQRQANHHV

SEQ ID NO: 3551 - protein, 81 aa, Pongo abelii
MALPQGLLTFRDVAIEFSQEEWKCLDPAQRTLYRDVMLENYRNLVSLEFRSVTQAKVQWCHLSSLQPPLPRFKQFSCLSLP

SEQ ID NO: 3552 - protein, 81 aa, Pongo abelii
WKCLDPAQRTLYRDVMLENYRNLVSLEFRSVTQAKVQWCHLSSLQPPLPRFKQFSCLSLPSSWDYRYLFQMHDEDILNRAR

SEQ ID NO: 3553 - protein, 81 aa, Pongo abelii
MALPQGLLTFRDVAIEFSQEEWKCLDPAQRTLYRDVMLENYRNLVSLDISSKCMLKTLSSTGQGNTEVFCAPTLHRQASHI

SEQ ID NO: 3554 - protein, 81 aa, Pongo abelii
MALPQGLLTFRDVAIEFSQEEWKCLDPAQRTLYRDVMLENYRNLVSLEFWSVTPAKVQWCHLGSLQPPLPRFKQFSCLSLP

SEQ ID NO: 3555 - protein, 81 aa, Pongo abelii
MALPQGLLTFRDVAIEFSQEEWKCLDPAQRTLYRDVMLENYRNLVSLVRRSEVCCIDIWAEVIVADISSKCMLKTLSSTGQ

SEQ ID NO: 3556 - protein, 81 aa, Pongo abelii
MALPQVLLTFRDVAIEFSQEEWKCLDPAQRTLYRDVMLENYRNLVSLDTSSKCMMNTLIDFQRLMLREEDIKKSKEKEPGM

SEQ ID NO: 3557 - protein, 81 aa, Pongo abelii
LDTSSKCMMNTLIDFQRLMLREEDIKKSKEKEPGMALPQGLLTFRDVAIEFSQEEWKCLDPAQRTLYRDVMLENYRNLVSL

SEQ ID NO: 3558 - protein, 81 aa, Pongo abelii
VLLTFRDVAIEFSQEEWKCLDPAQRTLYRDVMLENYRNLVSLDTSSKCMMNTLSSTGQGNTEVFHKGTLRRQASYHIGAFC

SEQ ID NO: 3559 - protein, 81 aa, Pongo abelii
VLLTFRDVAIEFSQEEWKCLDPAQRTLYRDVMLENYRNLVSLGQGNTEVFHKGTLRRQASYHIGAFCSQEIEKDIHDFVFQ

SEQ ID NO: 3560 - protein, 81 aa, Pongo abelii
MALPQGLLTFRDVAIEFSQEEWKCLDPAQRTLYRDVMLENYKNLVSLDISFKCMVKEFSSIGKGNTEVFHTRTLQRLASHH

SEQ ID NO: 3561 - protein, 81 aa, Pongo abelii
EEATKKNKEKEPGMALPQGCLTFRDVAIEFSLEEWKCLNPAQRALYRAVMLENYRNLEFVDISSKCMMKKFLSTGQGNAEV

SEQ ID NO: 3562 - protein, 81 aa, Pongo abelii
STDRHDQRHAGNKPIKNQLGLSFHLHLSELHVLQPEWKIGNQVEKSINNASLISTSQRISCRPKTHISNNYGNNSLYSSLL

SEQ ID NO: 3563 - protein, 81 aa, Pongo abelii
EEATKKNKEKEPGMALPQGCLTFRDVAIEFSLEEWKCLNPAQRALYRAVMLENYRNLEFVDSSLKSMMEFLSTGHGNTGGE

SEQ ID NO: 3564 - protein, 81 aa, Pongo abelii
EEATKKNKEKEPGMALPQGCLTFRDVAIEFSLEEWKCLNPAQRALYRAVMLENYRNLEFVGEENVPPDIRNLPLSILALPG

SEQ ID NO: 3565 - protein, 81 aa, Pongo abelii
MLENYWNLVSLGLCHFDMNIISMLEEGKEPWTVKSCVKIARKPRMRECVKGVVTDNPPKCTIKDLLPKEKSSTEAVFHTVV

SEQ ID NO: 3566 - protein, 81 aa, Pongo abelii
MALTQLTFRDVAIEFSQDEWKCLNSTQRTLYRDVMLENYRNLVSLDLSRNCVIKELAPQQESNTGEVFQTVTLEQHEKHDI

SEQ ID NO: 3567 - protein, 81 aa, Pongo abelii
MALTQLTFRDVAIEFSQDEWKCLNSTQRTLYRDVMLENYRNLVSLVYYPMWEHRKEPWTIESQVQIARKLKGWEWIKGVKT

SEQ ID NO: 3568 - protein, 81 aa, Pongo abelii
MDGDGLTFRDVAIEFSQDEWKCLNSTQRTLYRDVMLENYRNLVSLDLSRNCVIKELAPQQESNTGEVFQTVTLEQHEKHDI

SEQ ID NO: 3569 - protein, 81 aa, Pongo abelii
HEEETQKRRAKESGMALTQLTFRDVAIEFSQDEWKCLNSTQRTLYRDVMLENYRNLVSLDLSRNCVIKELAPQQESNTGEV

SEQ ID NO: 3570 - protein, 81 aa, Pongo abelii
TQRTLYRDVMLENYRNLVSLDLSRNCVIKELAPQQESNTGEVFQTVTLEQHEKHDIEEFCFREIKKKIHDFDCQWRDDERN

SEQ ID NO: 3571 - protein, 81 aa, Pongo abelii
MDGDGLTFRDVAIEFSQDEWKCLNSTQRTLYRDVMLENYRNLVSLVYYPMWEHRKEPWTIESQVQIARKLKGWEWIKGVKT

SEQ ID NO: 3572 - protein, 81 aa, Pongo abelii
MLENYRNLASLGISCFDLSIISMLEQGKEPFTVESQVQIARNPDGWEWIKAVITALSSEFVMKDLPHKGKSNTGEVFQTLM

SEQ ID NO: 3573 - protein, 81 aa, Pongo abelii
MALRQGQLTFRDVAIEFSQEEWTCLNPAQKTLYRDVMLENYRNLVSLDISCKCINKDLPPKGKNNMGEAFYTVKLERLESH

SEQ ID NO: 3574 - protein, 81 aa, Pongo abelii
ALYRDVMLENYRNLLSLDEDNIPPENDISVGFTSKGLSPKENNKEELYHLVILERKESHGINNFDLKEIWENMPQFDSLWD

SEQ ID NO: 3575 - protein, 81 aa, Pongo abelii
LYRDVMLENYRNLLSLDEDNIPPENDISVGFTSKGLSPKENNKEELYHLVILERKESHGINNFDLKEIWENMPQFDSLWDY

SEQ ID NO: 3576 - protein, 80 aa, Pongo abelii
MALSQGLFTFKDVAIEFSQEEWECLDPAQRALYRDVMLENYRNLLSLDEDNIPPENAFYSVQELRETLVFLISYSSKICL

SEQ ID NO: 3577 - protein, 81 aa, Pongo abelii
MALSQGLLTFRDVAIEFSQEEWKCLDPAQRTLYRDVMLENYRNLVSLDISSKCTMKEFSSTAQGNREVFHAGTLQRHESHH

SEQ ID NO: 3578 - protein, 81 aa, Pongo abelii
MALSQSLLTFRDVAIEFSQEEWKCLDPTQRMLYRDVMVENYRNLVSVGSCVSEDNGKAYNYSSLLRKHQLIHLGKKQYKCD

SEQ ID NO: 3579 - protein, 81 aa, Pongo abelii
MALPQGLLTFRDVAIEFSQEEWKCLDPAQRTLYRDVMLENYRNLVSLDISSKCMMKEVSSTAQGNTEVIHTGTLQRHERHH

SEQ ID NO: 3580 - protein, 81 aa, Pongo abelii
MAFSQGLLTFRDVAIEFSQEEWKCLDPAQRTLYRDVMLENYRNLVSLDMSSKCTMKEFLSTAQGNREVFHAGTLQRHESHH

SEQ ID NO: 3581 - protein, 81 aa, Pongo abelii
WACLNSAQRDLYWDVMLENYSNLVSLDLESAYENKSLPTEKNIHEIRASKRNSDRRSKSLGRNWICEGMLERPQRSRGRYV

SEQ ID NO: 3582 - protein, 81 aa, Pongo abelii
SAQRDLYWDVMLENYSNLVSLDLESAYENKSLPTEKNIHEIRASKRNSDRRSKSLGRNWICEGMLERPQRSRGRYVNQMII

SEQ ID NO: 3583 - protein, 81 aa, Pongo abelii
EEWACLNSAQRDLYWDVMLENYSNLVSLDLESAYENKSLPTEKNIHEIRASKRNSDRRSKSLGRNWICEGMLERPQRSRGR

SEQ ID NO: 3584 - protein, 81 aa, Pongo abelii
MSQGSVTFQDVAIDFSKEEWGFLNPAQRDLYTTVMLENYQNLVWLGLSISKSVISLLEKRKLPWIMGREEIRGPLPGMEEM

SEQ ID NO: 3585 - protein, 81 aa, Pongo abelii
DTKELSPKQHVYEVESPQWEIMESLTSYGLECSSFQDDWECRNQFDRQQGNPDRHFHQMIIRHEEMPTFDQHASLTFYQKI

SEQ ID NO: 3586 - protein, 81 aa, Pongo abelii
MSKDLVTFGDVAVSFSQEEWEWLNPAQRNLYRKVMLENYRSLVSLGVSVSKPDVISLLEQGKEPWMVKKEGTRGPCPDWEY

SEQ ID NO: 3587 - protein, 81 aa, Pongo abelii
ITHKEILPEVQNKEYNKSWQTFHQDTIFDIRQSFPTKEKAHKHEPQKKSYRKKSVEMKHRKIYVEKKLLKCNDCEKVFNQS

SEQ ID NO: 3588 - protein, 81 aa, Pongo abelii
MPSARGKSKSKAPVTFGDLAIYFSQEEWEWLSPIQKDLYEDVMLENYRNLVSLGLSFRRPNVITLLEKGKAPWMVEPVRRR

SEQ ID NO: 3589 - protein, 81 aa, Pongo abelii
MNVEVVKVMPQDLVTFKDVAIDFSQEEWQWMNPAQKCLYRSMMLENYQSLVSLGLCISKPYVISLLEQGREPWEMTSEMTR

SEQ ID NO: 3590 - protein, 81 aa, Pongo abelii
NKKTEAVGTRIEPKAMSQGLVTFGDVAVDFSQEEWEWLNPIQRNLYRKVMLENYRNLASLGLCVSKPDVISSLEQGKEPWT

SEQ ID NO: 3591 - protein, 81 aa, Pongo abelii
LEYSLLGEHWDYDAVFETQPGLVTIKNLAVDFPQKLHPAQKNFCKNGIWENHSDLGSAGHCVAKPDLVSLLEQKKESWMVK

SEQ ID NO: 3592 - protein, 81 aa, Pongo abelii
MAAQLLTDEALESVTFRDVTVDFTQEEWQQLEPAQKDLYRDVMLENYRNLVSLDWETRPEMKELDPKNDISEDKPSVVGVA

SEQ ID NO: 3593 - protein, 81 aa, Pongo abelii
RDSRAYESRSQDAESYQNVVDLAEDRKPHNTIQDNMENYRKLLSLGFLAQDSVPAEKRNTEMLDNLPSAASQFLDFKHLGT

SEQ ID NO: 3594 - protein, 81 aa, Pongo abelii
AASQFLDFKHLGTFLVFEELVTFEDVFVDFSPEELSSLSAAQRNLYREVMLENYWNLVSLGYQFSKPDIISRLEEEESRAM

SEQ ID NO: 3595 - protein, 81 aa, Pongo abelii
MNNSQGRVTFEDVTVNFTQGEWQRLNPEQRNLYRDVMLENYSNLISVGQEETTKPDVILRLEQGKEPWSVEEEVLRNGRPE

SEQ ID NO: 3596 - protein, 81 aa, Pongo abelii
MAAAVLTDRAQVSVTFDDVAVTFTKEEWGQLDLAQRTLYQEVMLENCGLLVSLGCPVPRPELIYHLEHEQEPWTRKEDLSQ

SEQ ID NO: 3597 - protein, 81 aa, Pongo abelii
MAMALTDPAQVSVTFDDVAVTFTQEEWGQLDLAQRTLYQEVMLENCGLLVSLGCPVPRPELIYHLEHEQETWTRKEDLSQG

SEQ ID NO: 3598 - protein, 81 aa, Pongo abelii
MAASAQVSVTFEDVAVTFTQEEWGQLDAAQRTLYQEVMLETCGLLVSLGCPLFKPELIYQLDHRQELWMVTKDLSQSSYPG

SEQ ID NO: 3599 - protein, 81 aa, Pongo abelii
MAAAVLMDRVQSCVTFEDVFVYFSREEWELLEEAQRFLYRDVMLENFALVATLGFWCEAENEAPSEQSVSVEGVSQVRTAE

SEQ ID NO: 3600 - protein, 81 aa, Pongo abelii
MAAAVLMDRVQSCVTFEDVFVYFSREEWELLEEAQRFLYRDVMLENFALVATLAFIFPVPCSGAVGGGRKPWVPDRAHITA

SEQ ID NO: 3601 - protein, 81 aa, Pongo abelii
MAEMNPAQGCVVFEDVAIYFSQEEWGHLDEAQRLLYRDVMLENLALLSSLGCCHGAEDEEAPLEPGVSVGVSQVMAPKPCL

SEQ ID NO: 3602 - protein, 81 aa, Pongo abelii
MYSSFPIWQGCVVFEDVAIYFSQEEWGHLDEAQRLLYRDVMLENLALLSSLGCCHGAEDEEAPLEPGVSVGVSQVMAPKPC

SEQ ID NO: 3603 - protein, 81 aa, Pongo abelii
VSVGVSQVMAPKPCLSTQKTQPCETCSSLLKDILRLAEHDGTHPEQGLYTCPAHLHQHQKEQIREKLSRGDGGRPTYVKNH

SEQ ID NO: 3604 - protein, 81 aa, Pongo abelii
MAEMNPAQGCVVFEDVAIYFSQEEWGHLDEAQRLLYRDVMLENLALLSSLGSWHGAEDEEAPSQQGFSVGVSEVTTSRPCL

SEQ ID NO: 3605 - protein, 81 aa, Pongo abelii
MNLTEARVVFEDVAIYFSQEEWGHLDEAQRLLYRDVMLENLALLSSLGSWHGAEDEEAPSQQGFSVGVSEVTTSRPCLSSQ

SEQ ID NO: 3606 - protein, 81 aa, Pongo abelii
MNLTEGPVMAEMDPTHARVVFEDVAIYFSQEEWGHLDEAQRLLYRDVMLENLALLSSLGSWHGAEDEEAPSQQGFSVGVSE

SEQ ID NO: 3607 - protein, 81 aa, Pongo abelii
MNLTEGPVMAEMDPTHARVVFEDVAIYFSQEEWGHLDEAQRLLYRDVMLENLALLSSLGKALTLAQCPGLGCVTPFYPKAA

SEQ ID NO: 3608 - protein, 81 aa, Pongo abelii
MAEMDPTHARVVFEDVAIYFSQEEWGHLDEAQRLLYRDVMLENLALLSSLGSWHGAEDEEAPSQQGFSVGVSEVTTSRPCL

SEQ ID NO: 3609 - protein, 81 aa, Pongo abelii
MNLTEGPVMAEMDPTHARVVFEDVAIYFSQEEWGHLDEAQRLLYRDVMLENLALLSSLGFIAVAAMLMDAGQDCMVFEDVA

SEQ ID NO: 3610 - protein, 81 aa, Pongo abelii
AIYFSQEEWGHLDEAQRLLYRDVMLENLALLSSLGFIAVAAMLMDAGQDCMVFEDVAIHFSQEEWGILNHVQRHLHSDVML

SEQ ID NO: 3611 - protein, 81 aa, Pongo abelii
MNLTEGPVMAEMDPTHDCMVFEDVAIHFSQEEWGILNHVQRHLHSDVMLENFALLSSVGCWHGAKDEEAPSKQCVSVGVSQ

SEQ ID NO: 3612 - protein, 81 aa, Pongo abelii
MLMDAGQDCMVFEDVAIHFSQEEWGILNHVQRHLHSDVMLENFALLSSVGCWHGAKDEEAPSKQCVSVGVSQVKTLKPALS

SEQ ID NO: 3613 - protein, 81 aa, Pongo abelii
MNLTEDCMVFEDVAIHFSQEEWGILNHVQRHLHSDVMLENFALLSSVGCWHGAKDEEAPSKQCVSVGVSQVKTLKPALSTQ

SEQ ID NO: 3614 - protein, 81 aa, Pongo abelii
MNLIEDCMVFEDVAIYFSQEEWGILNDAQRHLHSNVMLENFALLSSVGCWHGAKDEEVPSKQCVSVRVLQVTTPKPALSTL

SEQ ID NO: 3615 - protein, 81 aa, Pongo abelii
MGPAQVPMNSEVIVDPIQGQVNFEDVFVYFSQEEWVLLDEAQRLLYRDVMLENFALMASLGIPQTMAAFGLKYFLNDTGYT

SEQ ID NO: 3616 - protein, 81 aa, Pongo abelii
EHCSEVPMNSEVIVDPIQGQVNFEDVFVYFSQEEWVLLDEAQRLLYRDVMLENFALMASLGASLVMGSEPWVPDWVDMILA

SEQ ID NO: 3617 - protein, 81 aa, Pongo abelii
MGPAQVPMNSEVIVDPIQGQVNFEDVFVYFSQEEWVLLDEAQRLLYRDVMLENFALMASLGHTSFMSHIGASLVMGSEPWV

SEQ ID NO: 3618 - protein, 81 aa, Pongo abelii
MNSEVIVDPIQGQVNFEDVFVYFSQEEWVLLDEAQRLLYRDVMLENFALMASLGHTSFMSHIGASLVMGSEPWVPDWVDMI

SEQ ID NO: 3619 - protein, 81 aa, Pongo abelii
MAAAALRDPAQQGYVTFEDVAVYFSQEEWRLLDEAQRLLYCNVMLENFSLLASLGLASSKTHEITQLESWEEPFMPAWDVV

SEQ ID NO: 3620 - protein, 81 aa, Pongo abelii
DPAQVPVAAELLTDHEEQGYVTFEDVAVYFSQEEWRLLDEAQRLLYCNVMLENFSLLASLGLASSKTHEITQLESWEEPFM

SEQ ID NO: 3621 - protein, 81 aa, Pongo abelii
DPAQVPVAAELLTDHEEQGYVTFEDVAVYFSQEEWRLLDEAQRLLYCNVMLENFSLLASLGKVLTPHPSILSWARLFLLFL

SEQ ID NO: 3622 - protein, 81 aa, Pongo abelii
MAAAALRDPAQGYVTFEDVAVYFSQEEWRLLDEAQRLLYCNVMLENFSLLASLGKVLTPHPSILSWARLFLLFLGRGLFFP

SEQ ID NO: 3623 - protein, 81 aa, Pongo abelii
DPAQVPVAAELLTDHEEQGYVTFEDVAVYFSQEEWRLLDEAQRLLYCNVMLENFSLLASLGCWHGAEAKEAPEQSASVEVP

SEQ ID NO: 3624 - protein, 81 aa, Pongo abelii
RDPAQVPVAAELLTDHEEGYVTFEDVAVYFSQEEWRLLDEAQRLLYCNVMLENFSLLASLGKVLTPHPSILSWARLFLLFL

SEQ ID NO: 3625 - protein, 81 aa, Pongo abelii
MAAAALRDPAQQGYVTFEDVAVYFSQEEWRLLDEAQRLLYCNVMLENFSLLASLGCWHGAEAKEAPEQSASVEVPSSNVQQ

SEQ ID NO: 3626 - protein, 81 aa, Pongo abelii
RDPAQVPVAAELLTDHEEGYVTFEDVAVYFSQEEWRLLDEAQRLLYCNVMLENFSLLASLGLASSKTHEITQLESWEEPFM

SEQ ID NO: 3627 - protein, 81 aa, Pongo abelii
RDPAQVPVAAELLTDHEEGYVTFEDVAVYFSQEEWRLLDEAQRLLYCNVMLENFSLLASLGCWHGAEAKEAPEQSASVEVP

SEQ ID NO: 3628 - protein, 81 aa, Pongo abelii
MAAAALRDPAQGYVTFEDVAVYFSQEEWRLLDEAQRLLYCNVMLENFTLLASLGLASSKTHEITQLESWEKPFMPTWEVVT

SEQ ID NO: 3629 - protein, 81 aa, Pongo abelii
VYFSQEEWRLLDEAQRLLYCNVMLENFTLLASLGLASSKTHEITQLESWEKPFMPTWEVVTSATWRVPNRQPQLVPEQGRE

SEQ ID NO: 3630 - protein, 81 aa, Pongo abelii
MAAAALRDPAQQGYVTFEDVAVYFSQEEWRLLDEAQRLLYCNVMLENFTLLASLGLASSKTHEITQLESWEKPFMPTWEVV

SEQ ID NO: 3631 - protein, 81 aa, Pongo abelii
MAAAALVNTPQGHVTFEDIAVYFSQEEWGLLDEAQRCLYHDVMLENFLLMASVGCLHGIEAEEAPSEQTISAQGVSQARTP

SEQ ID NO: 3632 - protein, 81 aa, Pongo abelii
VNTPQIPMVTEEFVKPSQGHVTFEDIAVYFSQEEWGLLDEAQRCLYHDVMLENFLLMASVGCLHGIEAEEAPSEQTISAQG

SEQ ID NO: 3633 - protein, 81 aa, Pongo abelii
LVNTPQIPMVTEEFVKPSQGHVTFEDIAVYFSQEEWGLLDEAQRCLYHDVMLENFLLMASVAGLSQSNHKDSCSQQKVPVS

SEQ ID NO: 3634 - protein, 81 aa, Pongo abelii
MAETKDAPQMLVTFKDVAVTFTREEWRQLDLAQRTLYREVMLETCGLLVSLGHRVPKPELVHLLEHGQELWTVKRGLSHPT

SEQ ID NO: 3635 - protein, 81 aa, Pongo abelii
MLVTFKDVAVTFTREEWRQLDLAQRTLYREVMLETCGLLVSLGHRVPKPELVHLLEHGQELWTVKRGLSHPTCAGDRAQVH

SEQ ID NO: 3636 - protein, 81 aa, Pongo abelii
MAAALRAPTQQGFVAFEDVAIYFSQEEWELLDEMQRLLYRDVMLENFAVMASLGCWCGAEDEGAPSADSISVEELSQGRTP

SEQ ID NO: 3637 - protein, 81 aa, Pongo abelii
SPASASQAGTTGVRHHAQGSVTFEDVAVYFSWEEWDLLDETQKHLYFNVMLENFALTSSLGCWRGVEHEETPSEQRISVER

SEQ ID NO: 3638 - protein, 81 aa, Pongo abelii
DRGAQVPIATEVLFRLTQGSVTFEDVAVYFSWEEWDLLDETQKHLYFNVMLENFALTSSLGLTSSWSHVVAQLGLGEVPSV

SEQ ID NO: 3639 - protein, 81 aa, Pongo abelii
RDPASVPIATEVLFRLTQGSVTFEDVAVYFSWEEWDLLDETQKHLYFNVMLENFALTSSLGCWRGVEHEETPSEQRISVER

SEQ ID NO: 3640 - protein, 81 aa, Pongo abelii
MATVLRDPASGSVTFEDVAVYFSWEEWDLLDETQKHLYFNVMLENFALTSSLGCWRGVEHEETPSEQRISVERVPQFRTSK

SEQ ID NO: 3641 - protein, 81 aa, Pongo abelii
MTFEDVAIYFSQEEWELLDESQRFLYCDVMLENFAHVTSLGYCHGTENEAIASEQSVSIQVRTSKGNTLTQKTHLSEIKMC

SEQ ID NO: 3642 - protein, 81 aa, Pongo abelii
SPPSPRSSMAAVALRDSAQGMTFEDVAIYFSQEEWELLDESQRFLYCDVMLENFAHVTSLGYCHGTENEAIASEQSVSIQV

SEQ ID NO: 3643 - protein, 81 aa, Pongo abelii
MAAATLRTPAQGTVTFEDVAVHFSWEEWGLLDEAQRCLYRDVMLENLALLTSLDVHHQKQHLGEKHFRSNVGRAMFVKTCT

SEQ ID NO: 3644 - protein, 81 aa, Pongo abelii
PAAVRAHGPMAELTDSARGCVVFEDVFVYFSQEEWELLDDAQRLLYHDVMLENFALLASLGIAFSRSRAVMQLERGEEPWV

SEQ ID NO: 3645 - protein, 81 aa, Pongo abelii
MAAAALRPPAQGTVTFEDVAVNFSQEEWSLLSEAQRCLYHDVMLENLTLISSLGCWYGAKDETPSKQTLSIQQESPLRTHW

SEQ ID NO: 3646 - protein, 81 aa, Pongo abelii
MAAAAALRAPAQSSVTFEDVAVNFSLKEWSLLNEAQGCLYHDVMLETLTLISSLGGVPPHRLFPTGACGPQVPSSRIHPSP

SEQ ID NO: 3647 - protein, 81 aa, Pongo abelii
MAKAALRFPVQGTVTFEDVAVKFTQEEWNLLSEAQRCLYHDVTLENLALISSLGCWCGVEDEEAPSKQTIYIREIQVRTPM

SEQ ID NO: 3648 - protein, 81 aa, Pongo abelii
MAVAAPRRPAQGTVTFEDVAVKFTQEEWNLLSEAQRCLYRDVTLENLALMSSLGCWCGVEDEAAPSKRTIYIQREIQVRSP

SEQ ID NO: 3649 - protein, 81 aa, Pongo abelii
MAMAATLRLSAQGTVTFEDVAVKFTQEEWNLLSEAQRCLYRDVTLENLALMSSLGCWCGVEDEAAPSKRTIYIQREIQVRS

SEQ ID NO: 3650 - protein, 81 aa, Pongo abelii
MAVAAPRRPAQGTVTFEDVAVNFSQEEWSLLSEAQRCLYRDVMLENLALISSLSCWCGSKDEEVPCKQRISLQRESQSRTP

SEQ ID NO: 3651 - protein, 81 aa, Pongo abelii
MAVAAPRRPAQQGTVTFEDVAVNFSQEEWSLLSEAQRCLYRDVMLENLALISSLSCWCGSKDEEVPCKQRISLQRESQSRT

SEQ ID NO: 3652 - protein, 81 aa, Pongo abelii
MAAAATLRLSAQGTVTFEDVAVNFTWEEWNLLSEAQRCLYRDVTLENLALISSLDPALDGSADNTQTGNLGQSVLPAHPEQ

SEQ ID NO: 3653 - protein, 81 aa, Pongo abelii
WCDHGSPQPPPTGDILIQGTVTFEDVAVNFTWEEWNLLSEAQRCLYRDVTLENLALISSLDPALDGSADNTQTGNLGQSVL

SEQ ID NO: 3654 - protein, 81 aa, Pongo abelii
MAAAATLRLSAQGTVTFEDVAVNFTWEEWNLLSEAQRCLYRDVTLENLALISSLGMRFLHVCQALVSLPQVIHPPWPPKVL

SEQ ID NO: 3655 - protein, 81 aa, Pongo abelii
ATLRLSAQGTVTFEDVAVNFTWEEWNLLSEAQRCLYRDVTLENLALISSLGMRFLHVCQALVSLPQVIHPPWPPKVLGLQV

SEQ ID NO: 3656 - protein, 81 aa, Pongo abelii
LSAQGTVTFEDVAVNFTWEEWNLLSEAQRCLYRDVTLENLALISSLGMRFLHVCQALVSLPQVIPTLASQSAGITESHSVV

SEQ ID NO: 3657 - protein, 81 aa, Pongo abelii
DVAVNFTWEEWNLLSEAQRCLYRDVTLENLALISSLGMRFLHVCQALVSLPQVIPTLASQSAGITESHSVVQVRVRWHHLG

SEQ ID NO: 3658 - protein, 81 aa, Pongo abelii
MAAAATLRLSAQGTVTFEDVAVNFTWEEWNLLSEAQRCLYRDVTLENLALISSLGCWCGVEDEEAPSKQTIYIQRETQVRT

SEQ ID NO: 3659 - protein, 81 aa, Pongo abelii
MAASAPRHPTQQGTVTFEDVAVNFSQEEWSLLSEAQRCLYRDVMLENLALISSLSCWCGSKDEEVPCKQRISLQRESQSRT

SEQ ID NO: 3660 - protein, 81 aa, Pongo abelii
MAASAPRHPTQGTVTFEDVAVNFSQEEWSLLSEAQRCLYRDVMLENLALISSLSCWCGSKDEEVPCKQRISLQRESQSRTP

SEQ ID NO: 3661 - protein, 81 aa, Pongo abelii
VAVNFSQEEWCLLSEAQRCLYRDVMLENLALISSLDCPLYLCQFLDLSPCWRVCLDKPYLFLRPAALRCIKEWNVCALAKA

SEQ ID NO: 3662 - protein, 81 aa, Pongo abelii
MAAAARRHPTQQGTVTFEDVAVNFSQEEWCLLSEAQRCLYRDVMLENLALISSLGCWCGSKDEEAPCKQRISLQRESQSRT

SEQ ID NO: 3663 - protein, 81 aa, Pongo abelii
MAAAARRHPTQGTVTFEDVAVNFSQEEWCLLSEAQRCLYRDVMLENLALISSLGCWCGSKDEEAPCKQRISLQRESQSRTP

SEQ ID NO: 3664 - protein, 81 aa, Pongo abelii
MTWDCIAIGSHENSVQGTVAFEDVAVNFSQEEWSLLSEVQRCLYHDVMLENWVLISSLGCWCGSEDEEAPSKKSISIQRVS

SEQ ID NO: 3665 - protein, 81 aa, Pongo abelii
MQGTVAFEDVAVNFSQEEWSLLSEVQRCLYHDVMLENWVLISSLGCWCGSEDEEAPSKKSISIQRVSQSLRLSAQAGVARS

SEQ ID NO: 3666 - protein, 81 aa, Pongo abelii
GLHRMTWDCIAIGSHENSGTVAFEDVAVNFSQEEWSLLSEVQRCLYHDVMLENWVLISSLGCWCGSEDEEAPSKKSISIQR

SEQ ID NO: 3667 - protein, 81 aa, Pongo abelii
MAAAELRAPAQGIVTFEDVAVYFSWKEWGLLDEAQKCLYHDVMLENLTLTTSLGGSGAGDEEACYQQSTSPQRMSQVRIPK

SEQ ID NO: 3668 - protein, 81 aa, Pongo abelii
RRGSVGCRCRGLCLAVRREQVTFEDVVVDFSQEEWGQLKPAQRTLYRDVMLDTFRLLVSVGHWLPKPNVISLLEQEAELWA

SEQ ID NO: 3669 - protein, 81 aa, Pongo abelii
RFLWDGLWYCRGEDTEGHWECSCESLESLAVPVAFTPVKTPVQEQWQRNGFGENVSLNPDLSHQPMTPERQGPHTWGTCGK

SEQ ID NO: 3670 - protein, 81 aa, Pongo abelii
MTPGLRVSTDPEQVTFEDVVVDFSQEEWGQLKPAQRTLYRDVMLDTFRLLVSVGHWLPKPNVISLLEQEAELWAVDSGLPQ

SEQ ID NO: 3671 - protein, 81 aa, Pongo abelii
EEKQKEDAAICPVTVLSEEPVTFQDVAVDFSREEWGLLGPTQRTEYRDVMLETFGHLVSVGWETTLENKELAPNSDIPEEE

SEQ ID NO: 3672 - protein, 81 aa, Pongo abelii
MEARSTLVPPQASVCFEDVAMAFTQEEWEQLDLAQRTLYREVTLETWEHIVSLGLFLSKSDVISQLEQEEDLCRAEQEAPR

SEQ ID NO: 3673 - protein, 81 aa, Pongo abelii
FEDVAMAFTQEEWEQLDLAQRTLYREVTLETWEHIVSLGLFLSKSDVISQLEQEEDLCRAEQEAPRDGVSLLFPRLECNGT

SEQ ID NO: 3674 - protein, 81 aa, Pongo abelii
EDVAMAFTQEEWEQLDLAQRTLYREVTLETWEHIVSLGLFLSKSDVISQLEQEEDLCRAEQEAPRGTRPRKEQRGYRARRI

SEQ ID NO: 3675 - protein, 81 aa, Pongo abelii
QEEWEQLDLAQRTLYREVTLETWEHIVSLGLFLSKSDVISQLEQEEDLCRAEQEAPRGTGLSQVTGVVVDGSFRFQVWDFT

SEQ ID NO: 3676 - protein, 81 aa, Pongo abelii
DEGAAGVMSVGPPAARLQEPVTFRDVAVDFTQEEWGQLDPNQRILYRDVMLETFGHLLSIGPELPKPEVISQLEQGTELWV

SEQ ID NO: 3677 - protein, 81 aa, Pongo abelii
MAGEAEAQLDPSLQGLVMFEDVTVYFSRDEWGLLNVTQKGLYRDVMLENFALVSSLGLASSRSPVFTQLEDDEQSWVPSWV

SEQ ID NO: 3678 - protein, 81 aa, Pongo abelii
MAGEAEGLVMFEDVTVYFSRDEWGLLNVTQKGLYRDVMLENFALVSSLGLASSRSPVFTQLEDDEQSWVPSWVDVTPVSRA

SEQ ID NO: 3679 - protein, 81 aa, Pongo abelii
GPAQHTCWPCGSAVPTLKSLVTFEDVAVYFSQEEWELLDAAQRHLYHRVMLENLELVTSLGCWHGVEGEEAHPKQNVSVEV

SEQ ID NO: 3680 - protein, 81 aa, Pongo abelii
PTLKSLVTFEDVAVYFSQEEWELLDAAQRHLYHRVMLENLELVTSLGNALSQHVFTCSVGADLPNCFPNWLHHFTSLSAVY

SEQ ID NO: 3681 - protein, 81 aa, Pongo abelii
PLAAQSAEGHHGHQEPASTSFHPPRIQEEWGLLDRSQKELYWDAMLEKYGTVVSLGLPPHQPEAQAQSELGMLLTGTGVCR

SEQ ID NO: 3682 - protein, 81 aa, Pongo abelii
MGPQGARRQAFLAFGDVTVDFTQKEWRLLSPTQRALYREVTLENYSHLVSLGILHSKPELIRRLEQGEAPWGEERRRRPGP

SEQ ID NO: 3683 - protein, 81 aa, Pongo abelii
LPSNDTDWPQKKEGKAQIVVPVTFRDVTVIFTEAEWKRLSPEQRNLYKEVMLENYRNLLSLAEPKPEIYTCSSCLLAFSCQ

SEQ ID NO: 3684 - protein, 81 aa, Pongo abelii
AKGLPSNDTDWPQKKEGKAQIVVPVTFRDVTVIFTEAEWKRLSPEQRNLYKEVMLENYRNLLSLGQEIETILANIVKSRLY

SEQ ID NO: 3685 - protein, 81 aa, Pongo abelii
PSNDTDWPQKKEGKAQIVVPVTFRDVTVIFTEAEWKRLSPEQRNLYKEVMLENYRNLLSLDGVSLLLPRLECNGAISAHHN

SEQ ID NO: 3686 - protein, 81 aa, Pongo abelii
KNRENVETMKKLTQNHKAKGLPSNDTDWPQKKEGKAQIVVPVTFRDVTVIFTEAEWKRLSPEQRNLYKEVMLENYRNLLSL

SEQ ID NO: 3687 - protein, 81 aa, Pongo abelii
TQNHKAKGLPSNDTDWPQKKEGKAQIVVPVTFRDVTVIFTEAEWKRLSPEQRNLYKEVMLENYRNLLSLDGGQEQQDAAAY

SEQ ID NO: 3688 - protein, 81 aa, Pongo abelii
IENEKERPVSFQDLTVNFTQEEWQQLDPAQRLLYRDVMLENYSNLVSVGYHVSKPDVIFKLEQGEAPWIVEEFSNQNYPEV

SEQ ID NO: 3689 - protein, 81 aa, Pongo abelii
LKMKKFQRPVSFQDLTVNFTQEEWQQLDPAQRLLYRDVMLENYSNLVSVGYHVSKPDVIFKLEQGEAPWIVEEFSNQNYPE

SEQ ID NO: 3690 - protein, 81 aa, Pongo abelii
MLENYSNLVSVGYHVSKPDVIFKLEQGEAPWIVEEFSNQNYPEVDAALEKNKEIQDKHLTQTVFFSNKTLITERENVFGKT

SEQ ID NO: 3691 - protein, 81 aa, Pongo abelii
MEIPAPEPEKTESVSFKDVAVDFTQEEWGQLDSPQRALYRDVMLENYQNLLALGPPLHKPDVISHLERGEEPWSMQREVPG

SEQ ID NO: 3692 - protein, 81 aa, Pongo abelii
MEIPAPEPEKTESVSFKDVAVDFTQEEWGQLDSPQRALYRDVMLENYQNLLALEWELKAVPSQQQGICKEEPAQEPIMERP

SEQ ID NO: 3693 - protein, 81 aa, Pongo abelii
MTFEDVAVEFTQWEWGQLNPAQKDLYREVMLENFRNLAFLGLLVSKPYVICQLEERGEPFMVEREISTGAHSDWERRSKSK

SEQ ID NO: 3694 - protein, 81 aa, Pongo abelii
MAAVSPTTRCQESVTFEDVAVVFTDEEWSHLVPTQRDLYKEVMLENYNSIVSLDWETKPEIHDASNEKSEGSLRECLGRQS

SEQ ID NO: 3695 - protein, 81 aa, Pongo abelii
MAAVSPTTRCQESVTFEDVAVVFTDEEWSHLVPTQRDLYKEVMLENYNSIVSLGLPVPQPDVIFQLKRGDKPWMVDLHGSE

SEQ ID NO: 3696 - protein, 80 aa, Pongo abelii
MWAPREQLLGWATEALPAKDSAWPWEEKPRYLGPVTFEDVAVLFNEAEWKRLSLEQRNLYKEVMLENLRNLVSLVLFYQI

SEQ ID NO: 3697 - protein, 81 aa, Pongo abelii
EALPAKDSAWPWEEKPRYLGPVTFEDVAVLFNEAEWKRLSLEQRNLYKEVMLENLRNLVSLVLELGSPRLGLLPLDLNLDL

SEQ ID NO: 3698 - protein, 81 aa, Pongo abelii
EALPAKDSAWPWEEKPRYLGPVTFEDVAVLFNEAEWKRLSLEQRNLYKEVMLENLRNLVSLAESKPEVHTCPSCPLAFGSQ

SEQ ID NO: 3699 - protein, 81 aa, Pongo abelii
ALPAKDSAWPWEEKPRYLGPVTFEDVAVLFNEAEWKRLSLEQRNLYKEVMLENLRNLVSLESKPEVHTCPSCPLAFGSQQF

SEQ ID NO: 3700 - protein, 81 aa, Pongo abelii
MTRENWAHNALRQEGLVKGKDDTWKWATSFQGSSSSVWETSHLHFRQLRYHETSGPQEALSRLRELCRRWLRPEARTKAQI

SEQ ID NO: 3701 - protein, 81 aa, Pongo abelii
TLPQVGNSGDQAGATVLRMVRPQDTVVYEDLSVDYTQKKWKGLTLSQRALQWNMMPENDHSMASLDGETGTEEELIPKHHS

SEQ ID NO: 3702 - protein, 81 aa, Pongo abelii
DFAQCTSPVPTLPQVGNSGDQAGATVLRMVRPQDTVVYEDLSVDYTQKKWKGLTLSQRALQWNMMPENDHSMASLGWSTMA

SEQ ID NO: 3703 - protein, 81 aa, Pongo abelii
GNSGDQAGATVLRMVRPQDTVVYEDLSVDYTQKKWKGLTLSQRALQWNMMPENDHSMASLGENMMKGSELTPKQKIFKGSE

SEQ ID NO: 3704 - protein, 81 aa, Pongo abelii
VGNSGDQAGATVLRMVRPQDTVVYEDLSVDYTQKKWKGLTLSQRALQWNMMPENDHSMASLAGENMMKGSELTPKQKIFKG

SEQ ID NO: 3705 - protein, 81 aa, Pongo abelii
MVRPQDTVAYEDLSEDYTQKKWKGVALSQRALHWNMMLENDRSMTSLGRNMMESSELTPKQEIFKVSESSNSTSGGFFGVV

SEQ ID NO: 3706 - protein, 81 aa, Pongo abelii
MVRPQDTVAYEDLSEDYTQKKWKGVALSQRALHWNMMLENDRSMTSLAGRNMMESSELTPKQEIFKVSESSNSTSGGFFGV

SEQ ID NO: 3707 - protein, 81 aa, Pongo abelii
SQILELLVLEQFLSILPGELRVWVQLHNPESGEEAVALLEELQRDLDGTSWRDPGPAQSPDVHWMGTGALRSAQIWSLASP

SEQ ID NO: 3708 - protein, 81 aa, Pongo abelii
LAGQSDTPAAQMPALFQREGCPGDQVTPTRSLTAQLQETMTFKDVEVTFSQDEWGWLDSAQRNLYRDVMLENYRNMASLGK

SEQ ID NO: 3709 - protein, 81 aa, Pongo abelii
MMTAVSLTTRPQESVAFEDVAVYFTTKEWAIMVPAERALYRDVMLENYEAVAFVVSPTSKPALVSHLEQGKESCFTRPQGV

SEQ ID NO: 3710 - protein, 81 aa, Pongo abelii
MLQTVWFQGLSRNLLFQEPVTFEDVAVYFTQNEWASLHPTQRALYRGVMLENYANVTSLSAFPFPKPDLIFQLEQGEAAWG

SEQ ID NO: 3711 - protein, 81 aa, Pongo abelii
MLQTVWFQGLSRNLLFQEPVTFEDVAVYFTQNEWASLHPTQRALYRGVMLENYANVTSLYPTAGGFPLGTERTEKVPGALS

SEQ ID NO: 3712 - protein, 81 aa, Pongo abelii
EEAAQKRKEKEPGMALPQGHLTFRDVAIEFSLEEWKCLDTAQRALYRAVMLENYRNLHSVDISSKCMMKKFSSTGQGNIEV

SEQ ID NO: 3713 - protein, 81 aa, Pongo abelii
MELLTFRDVAIEFSPEEWKCLDPAQQNLYRDVMLENYRNLVSLAICSPFSQDLSPVQGVEDSFHKLILRRYEKCGHENLQL

SEQ ID NO: 3714 - protein, 81 aa, Pongo abelii
MELLTFRDVAIEFSPEEWKCLDPAQQNLYRDVMLENYRNLVSLGFVISNPDLVTCLEQIKEPCDLKIHETAAKPPAICSPF

SEQ ID NO: 3715 - protein, 81 aa, Pongo abelii
MELLTFRDVAIEFSPEEWKCLDPSQQNLYRDVMLENYRNLVSLGVTISNPDLVTCLEQRKEPYNVKINETAARPPAVCSHF

SEQ ID NO: 3716 - protein, 81 aa, Pongo abelii
RIHSGQKHYKCEECGKAFKWSSSLNEHKRIHAGEKPFSCEECGCVFTTSSDFAKHKRIHTGEKPYRCEECGKSFNRSTTLT

SEQ ID NO: 3717 - protein, 81 aa, Pongo abelii
MELLTFRDVAIEFSPEEWKCLDPSQQNLYRDVMLENYRNLVSLGVTISNPDLVTCLEQRKEPYNVKINETAARPPGHYRKR

SEQ ID NO: 3718 - protein, 81 aa, Pongo abelii
MLENYRNLVSLGVTISNPDLVTCLEQRKEPYNVKINETAARPPAVCSHFTQNLWTVQGIEDSFHKLIPKGHEKRGHENLRK

SEQ ID NO: 3719 - protein, 81 aa, Pongo abelii
IHSGQKHYKCEECGKAFKWSSSLNEHKRIHAGEKPFSCEECGCVFTTSSDFAKHKRIHTGEKPYRCEECGKSFNRSTTLTT

SEQ ID NO: 3720 - protein, 81 aa, Pongo abelii
MELLTFRDVAVEFSPEEWKCLDPAQQNLYRDVMLENYRNLVSLGVAISNPDLVIYLEQRKEPYKMKIHETVAKHPAMCSHF

SEQ ID NO: 3721 - protein, 81 aa, Pongo abelii
ELLTFRDVAVEFSPEEWKCLDPAQQNLYRDVMLENYRNLVSLGVAISNPDLVIYLEQRKEPYKMKIHETVAKHPAMCSHFT

SEQ ID NO: 3722 - protein, 81 aa, Pongo abelii
MELLTFRDVAVEFSPEEWKCLDPAQQNLYRDVMLENYRNLVSLGIAISNPDLVTCLEQRKEPYNVKIHKIVARPPAVCSHF

SEQ ID NO: 3723 - protein, 81 aa, Pongo abelii
SLGIAISNPDLVTCLEQRKEPYNVKIHKIVARPPAVCSHFTQDHWPVQGIEDSFHKLILRRYEKCGHDNLQLRKGCKSLNE

SEQ ID NO: 3724 - protein, 81 aa, Pongo abelii
LGIAISNPDLVTCLEQRKEPYNVKIHKIVARPPAVCSHFTQDHWPVQGIEDSFHKLILRRYEKCGHDNLQLRKGCKSLNEC

SEQ ID NO: 3725 - protein, 81 aa, Pongo abelii
MELLTFRDVAVEFSPEEWKCLDPAQQNLYRDVMLENYRNLVSLGIAISNPDLVTCLEQRKEPYNVKIHKIVARPPEFFHLY

SEQ ID NO: 3726 - protein, 81 aa, Pongo abelii
MEPLTFRDVAIEFSPEEWKCLDPAQQNLYRDVMLENYRNLVSLVSLLVSSCCVISHGLPRRNRATEKNDLLTTEEPVVKHR

SEQ ID NO: 3727 - protein, 81 aa, Pongo abelii
MLENYRNLVSLVISSSSSFAKHKRIHTGEKPFKCLECGKAFNISTTLTKHRRIHTGEKPYTCEVCGKAFRQSANLYVHRRI

SEQ ID NO: 3728 - protein, 81 aa, Pongo abelii
SQEESPEDDTERTERKPTVKDAFKDISIYFTKEEWAEMGDWEKTRYRNVKRNYNALITIGLRATRPAFMCHRRQAIKLQVD

SEQ ID NO: 3729 - protein, 81 aa, Pongo abelii
RKPTVKDAFKDISIYFTKEEWAEMGDWEKTRYRNVKRNYNALITIGLRATRPAFMCHRRQAIKLQVDDTEDSDEEWTPRQQ

SEQ ID NO: 3730 - protein, 81 aa, Pongo abelii
MMKSQGLVSFKDVAVDFTQEEWQQLDPSQRTLYRDVMLENYSHLVSMGYPVSKPDVISRLEQGEEPWIIKGDISNWIYPDD

SEQ ID NO: 3731 - protein, 81 aa, Pongo abelii
MLENYSHLVSMGYPVSKPDVISRLEQGEEPWIIKGDISNWIYPDDYQADGRQDRKSNLHNSQSCILGTVSFHHKILKGVTR

SEQ ID NO: 3732 - protein, 81 aa, Pongo abelii
ADPSSSGLLEEQKMMKSQGLVSFKDVAVDFTQEEWQQLDPSQRTLYRDVMLENYSHLVSMGYPVSKPDVISRLEQGEEPWI

SEQ ID NO: 3733 - protein, 81 aa, Pongo abelii
MLPIVQLYPQGLVSFKDVAVDFTQEEWQQLDPSQRTLYRDVMLENYSHLVSMGYPVSKPDVISRLEQGEEPWIIKGDISNW

SEQ ID NO: 3734 - protein, 81 aa, Pongo abelii
MAAGQREARPQVSLTFDDVAVLFTRDEWRKLAPSQRNLYRDVMLENYRNLVSLGLSFTKPKVISLLQQGEDPWKVEKDSSG

SEQ ID NO: 3735 - protein, 81 aa, Pongo abelii
MAAGQREARPQVSLTFEDVAVLFTWDEWRKLAPSQRNLYRDVMLENYRNLVSLGLSFTKPKVISLLQQGEDPWKVEKDSSG

SEQ ID NO: 3736 - protein, 81 aa, Pongo abelii
MAAWPLPLGARFQESVTFKDVSIDFSWEEWIQADSAQRMTVYEEVMLENYRNLVSLAGNHLSKPSGTSQLEREELSLTQKE

SEQ ID NO: 3737 - protein, 81 aa, Pongo abelii
SAQRMTVYEEVMLENYRNLVSLAGNHLSKPSGTSQLEREELSLTQKEPPEGGFRDFLGYCCQINLTFSPLIILSQSRGESI

SEQ ID NO: 3738 - protein, 81 aa, Pongo abelii
MAVSHLPMMVQELVTFKDVAVLFTQEEWGQLSPAQRALYRDVMLENYSNLVSLGLLGPKPDMFSQLEKREVWMPEDTPGGF

SEQ ID NO: 3739 - protein, 81 aa, Pongo abelii
MARRLLPAHVQESVTFRDVAVFFSQDEWLHLDSAQRALYREVMLENYSILVSLGILFSKPKVISQLEQGEDAWMVESGVPQ

SEQ ID NO: 3740 - protein, 81 aa, Pongo abelii
MAVDLLPAQEPVMFRDVAVFFSQDEWLHLDSAQRALYREVMLENYSSLVSLGIPFSMPKLIHQLQQGEDPCMMEREVPADT

SEQ ID NO: 3741 - protein, 81 aa, Pongo abelii
GSSGDQEMAATLLTAGFQTLEKIEDMAVSLIREEWLLDPSQKDLSRDNRPENFRNVFSLGGETRSENRELASKQVICTGIQ

SEQ ID NO: 3742 - protein, 81 aa, Pongo abelii
GGCCREDAVVASRLTPESQGLLKVEDVALTLTPEWTQQDSSQGNLCRNEKQENHGSLVSLGDEKQIKSRDLPPAEKLPEKE

SEQ ID NO: 3743 - protein, 81 aa, Pongo abelii
GSQGDLPQADITLMSQAQESVSFEDVAVNFTNREWQCLTYAQRHLYKDVMLENYGNMVSLGFPFPKPPLISHLEREVDPCV

SEQ ID NO: 3744 - protein, 81 aa, Pongo abelii
ATLQEAMKRDCWREAWVKKKPVTFEDVAVNFTQEEWDCLDASQRVLYQDVMSETFKNLTSVARIFLHKPELITKLEQEEEQ

SEQ ID NO: 3745 - protein, 81 aa, Pongo abelii
EQLKPIEPRDCWREAWVKKKPVTFEDVAVNFTQEEWDCLDASQRVLYQDVMSETFKNLTSVARIFLHKPELITKLEQEEEQ

SEQ ID NO: 3746 - protein, 81 aa, Pongo abelii
EEEEEDEDEDDLLMAGSQGLVTFEDVAVYFSLEEWERLEADQRGLYQEVMQENYGILVSLGYPIPKPDLIFRLEQGEEPWV

SEQ ID NO: 3747 - protein, 81 aa, Pongo abelii
MLENYSNLVSVGYHIIKPDVISKLEQGEEPWIVEGEFLLQSYPDEVWQTDDLKERIQEEENKPLRQTVFIETLIEEREYIS

SEQ ID NO: 3748 - protein, 81 aa, Pongo abelii
MFPPARGKELLSFEDVAMYFTREEWGHLSWGQKDLYRDVMLENYRNMVLLGFQFPKPEVICQLENWDEQWILDLPRAGNRK

SEQ ID NO: 3749 - protein, 81 aa, Pongo abelii
MELLSFEDVAMYFTREEWGHLSWGQKDLYRDVMLENYRNMVLLGFQFPKPEVICQLENWDEQWILDLPRAGNRKASGSACP

SEQ ID NO: 3750 - protein, 81 aa, Pongo abelii
EEAVAVVRALQRALDGTSPQGMVTFEDMAVSLTWEEWERLDPARRDFCRESVQKDSGSTVPPSPVKMKGRGCLLSSTRGSH

SEQ ID NO: 3751 - protein, 81 aa, Pongo abelii
EEAVAVVRALQRALDGTSPQGMVTFEDMAVSLTWEEWERLDPARRDFCRESVQKDSGSTVPPSLESRVENKELIPMQQILE

SEQ ID NO: 3752 - protein, 81 aa, Pongo abelii
LAGAPPVPQVPALPREGSPGDQAAALLTARYQEFVTFEDVAVHLTREEWGYLDPVQRDLYREVMLENYGNVVSLGTVGSWD

SEQ ID NO: 3753 - protein, 81 aa, Pongo abelii
MASALFTADSQAMVKIEDMAVSLILEEWGCQNLARRNLSRDNKQENYGSAFPQGGENRNENEESTSKAETAEDSASHGETA

SEQ ID NO: 3754 - protein, 81 aa, Pongo abelii
EGSPRDQAMASALFTADSQAMVKIEDMAVSLILEEWGCQNLARRNLSRDNKQENYGSAFPQGGENRNENEESTSKAETAED

SEQ ID NO: 3755 - protein, 81 aa, Pongo abelii
DSLGDEMLAAALLKAKSQELVTFEDVAVYFIRKEWKRLEPAQRDLYRDVMLENYGNVFSLDWTHVSLTTQKVMLAWLTGTL

SEQ ID NO: 3756 - protein, 81 aa, Pongo abelii
DSLGDEMLAAALLKAKSQELVTFEDVAVYFIRKEWKRLEPAQRDLYRDVMLENYGNVFSLDHETRTENDQEICEDTRSHGV

SEQ ID NO: 3757 - protein, 81 aa, Pongo abelii
MLAAALLKAKSQELVTFEDVAVYFIRKEWKRLEPAQRDLYRDVMLENYGNVFSLDHETRTENDQEICEDTRSHGVLLGRFQ

SEQ ID NO: 3758 - protein, 81 aa, Pongo abelii
VPAFSDKDSLGDEMLAAALLKAKSQELVTFEDVAVYFIRKEWKRLEPAQRDLYRDVMLENYGNVFSLDHETRTENDQEICE

SEQ ID NO: 3759 - protein, 81 aa, Pongo abelii
FIFLSVFDFVVLWCVLFQGPVSFKDAAVDFTQEEWRQLDPDEKITYGDVMLENYSHLVSMGYDITKPNVIIKLEQGEEPWI

SEQ ID NO: 3760 - protein, 81 aa, Pongo abelii
MAKRPGPPGSREMGLLTFRDIAIEFSLAEWQCLDHAQRNLYRDVMLENYRNLVSLGIAVSKPDLITCLEQNKEPRNIKRNE

SEQ ID NO: 3761 - protein, 81 aa, Pongo abelii
MAEPASVTVTFDDVALYFSEQEWEILEKWQKQMYKQEMKTNYETLDSLGYAFSKPDLITWMEQGRMLLISEHGCLAKTRRT

SEQ ID NO: 3762 - protein, 81 aa, Pongo abelii
KKLASCEKTVTELGNQLDGKWAVLGTLLQEYGLLQRRLENLENLLRNRNFWILRLPPGIKGDIPKVPVAFDDVSIYFSTPE

SEQ ID NO: 3763 - protein, 81 aa, Pongo abelii
RNFWVLRLPPGSKGEAPKVPVTFVDIAVYFSEDEWKNLDEWQKELYNNLVKENYKTLMSLDAEGSVPKPDAPAQAEPREEP

SEQ ID NO: 3764 - protein, 81 aa, Pongo abelii
KKLADCEKMAVEFGNQLEGKWALLGTLLQEYGLLQRRLENVENLLRNRNFWILRLPPGSKGEAPKVSRSLENDGVCFTEQE

SEQ ID NO: 3765 - protein, 81 aa, Pongo abelii
RNFWILRLPPGSKGEAPKVSRSLENDGVCFTEQEWENLEDWQKELYRNVMESNYETLVSLKRVLLCCPGWSAVTRSWLTAT

SEQ ID NO: 3766 - protein, 81 aa, Pongo abelii
RNFWILRLPPGSKGEAPKVSRSLENDGVCFTEQEWENLEDWQKELYRNVMESNYETLVSLKVLGQTEGEAELGTQMLGDLE

SEQ ID NO: 3767 - protein, 81 aa, Pongo abelii
PGGAHPAGGVMIKQELQYTQEGPADLPGEFSCIAEEQAFLSPEQTELWGGQGSSVLLETGPGDSTLEEPVGCRDPSSSRTV

SEQ ID NO: 3768 - protein, 81 aa, Pongo abelii
LEEEGPGGAHPAGGVMIKQELQYTQEGPADLPGEFSCIAEEQAFLSPEQTELWGGQGSSVLLETGPGDSTLEEPVGCRDPS

SEQ ID NO: 3769 - protein, 81 aa, Pongo abelii
MRENYETLVSVGTAELLPLSAFLSPSEPGRAVGGGSHADEGQEPAGCGGPQGGQPRHSLHLTALVQLVKEIPEFLFGEVKG

SEQ ID NO: 3770 - protein, 81 aa, Pongo abelii
MEPRESGKAPVTFDDITVYLLQEEWVLLSQQQKELCGSDKLVAPLGPTVANPELFCKFGRGPEPWLGSVQGQRSLLEHHPG

SEQ ID NO: 3771 - protein, 81 aa, Pongo abelii
QDPSAEGLSEEVPVVFEELPVVFEDVAVYFTREEWGMLDKWQKELYRDVMRMNYELLASLGPAAAKPDLISKLERRAAPWI

SEQ ID NO: 3772 - protein, 81 aa, Pongo abelii
MPSPDSMTFEDIVVDFTQEEWALLDTSQRKLFQDVMLENISHLVSIGKQLCKSVVLSHLEQVEKLSTQRISLLQGRQVDIK

SEQ ID NO: 3773 - protein, 81 aa, Pongo abelii
DFTQEEWALLDTSQRKLFQDVMLENISHLVSIGKQLCKSVVLSHLEQVEKLSTQRISLLQGRQVDIKHQEIPFIQHIYQKG

SEQ ID NO: 3774 - protein, 81 aa, Pongo abelii
TQRISLLQGRQVDIKHQEIPFIQHIYQKGTSTISTMRSHTQEDPFLCNDLGEDFTQHIALTQNVITYVRKKHFVSKKFGKT

SEQ ID NO: 3775 - protein, 81 aa, Pongo abelii
DIKHQEIPFIQHIYQKGTSTISTMRSHTQEDPFLCNDLGEDFTQHIALTQNVITYVRKKHFESGRSSEDRSVVTATSIKTL

SEQ ID NO: 3776 - protein, 81 aa, Pongo abelii
VVLSHLEQVEKLSTQRISLLQGRQVDIKHQEIPFIQHIYQKGTSTISTMRSHTQEDPFLCNDLGEDFTQHIALTQNVITYV

SEQ ID NO: 3777 - protein, 81 aa, Pongo abelii
MDVAQEPVTFRDVAIYFSREEWACLEPSQRALYRDVMLDNFSSVAALGFCSPRPDLVSRLEQWEEPWVEDRERPELQAVQR

SEQ ID NO: 3778 - protein, 81 aa, Pongo abelii
MDVAQEPVTFRDVAIYFSREEWACLEPSQRALYRDVMLDNFSSVAALAPDQTSSLAWNSGKSRGLKTGRDLSSRQCREGPS

SEQ ID NO: 3779 - protein, 81 aa, Pongo abelii
MDVAQEPVTFRDVAIYFSREEWACLEPSQRALYRDVMLDNFSSVAALEGFCSPRPDLVSRLEQWEEPWVEDRERPELQAVQ

SEQ ID NO: 3780 - protein, 81 aa, Pongo abelii
MAATLQFPGYQEMPLTFQDVAVYFSQAEGQQLGPQQRALYRDVMLENYGNVASLGFPIPKPELISQLEQGKELWVLNLLGA

SEQ ID NO: 3781 - protein, 81 aa, Pongo abelii
AAHAHRMAATLQFPGYQEMPLTFQDVAVYFSQAEGQQLGPQQRALYRDVMLENYGNVASLGFPIPKPELISQLEQGKELWV

SEQ ID NO: 3782 - protein, 81 aa, Pongo abelii
RKPNPQAMAALFLSAPPQAEVTFEDVAVYLSQEEWGRLGPAQRGLYRDVMLETYGNLVSLGVGPAGPKPGVISQLERGDEP

SEQ ID NO: 3783 - protein, 81 aa, Pongo abelii
MAALFLSAPPQAEVTFEDVAVYLSQEEWGRLGPAQRGLYRDVMLETYGNLVSLGVGPAGPKPGVISQLERGDEPWVLDVQG

SEQ ID NO: 3784 - protein, 81 aa, Pongo abelii
TTSPLWTTPGLQQSLSFQAEVTFEDVAVYLSQEEWGRLGPAQRGLYRDVMLETYGNLVSLGVGPAGPKPGVISQLERGDEP

SEQ ID NO: 3785 - protein, 81 aa, Pongo abelii
MAALFLSAPPQAEVTFEDVAVYLSQEEWGRLGPAQRGLYRDVMLETYGNLVSLALGTRTEYKELTSRETFGEEDPQGSEPV

SEQ ID NO: 3786 - protein, 81 aa, Pongo abelii
LRKPNPQAMAALFLSAPPQAEVTFEDVAVYLSQEEWGRLGPAQRGLYRDVMLETYGNLVSLALGTRTEYKELTSRETFGEE

SEQ ID NO: 3787 - protein, 81 aa, Pongo abelii
MAMALPKPGPQEAVVFEDVAVYFTRIEWSCLAPDQQALYRDVMLENYGNLASLGFLVAKPALISLLEQGEEPGALILQGAE

SEQ ID NO: 3788 - protein, 81 aa, Pongo abelii
MAMALPKPGPQEAVVFEDVAVYFTRIEWSCLAPDQQALYRDVMLENYGNLASLALISLLEQGEEPGALILQGAEQSVAKAS

SEQ ID NO: 3789 - protein, 81 aa, Pongo abelii
VMLENYGNLASLALISLLEQGEEPGALILQGAEQSVAKASLCTDSRMEAGIMESPLQRKLSTQAGLPGTVWGCLPPAPPHP

SEQ ID NO: 3790 - protein, 81 aa, Pongo abelii
MAAARLLPVPAGPQAKLTFEDVAVLLSDEWDRLCPAQRGLYRNVMMETYGNVVSLGLPGSKPDIISQLERGEDPWVLDRKG

SEQ ID NO: 3791 - protein, 81 aa, Pongo abelii
MAAARLLPVPAGPQPLSFQAKLTFEDVAVLLSDEWDRLCPAQRGLYRNVMMETYGNVVSLGLPGSKPDIISQLERGEDPWV

SEQ ID NO: 3792 - protein, 81 aa, Pongo abelii
MVSFEDVAVPLSQEEWDCLIPAQRGLYKDVMMETYGNLVSLGLQASKPDVISRLEQGDEPWTPHILRTWGSWSWRHKREDA

SEQ ID NO: 3793 - protein, 81 aa, Pongo abelii
MNMYQASVSFQDVTVEFTQEEWQHLGPVERTLYRDVMLENYSHLISVGYCITKPKVISKLEKGEEPWSLEDEFLNQRYPGY

SEQ ID NO: 3794 - protein, 81 aa, Pongo abelii
MLENYSHLISVGYCITKPKVISKLEKGEEPWSLEDEFLNQRYPGYFKVDHIKGIQEKQEKPLWQEIFINDADKTLSKEGQK

SEQ ID NO: 3795 - protein, 81 aa, Pongo abelii
MTKSLESVSFKDVTVDFSRDEWQQLDLAQKSLYREVMLENYFNLISVGCQVPKPEVIFSLEQEEPCMLDGEIPSQSLPDGD

SEQ ID NO: 3796 - protein, 81 aa, Pongo abelii
MSVVSPPESVSFKDVTVDFSRDEWQQLDLAQKSLYREVMLENYFNLISVGCQVPKPEVIFSLEQEEPCMLDGEIPSQSLPD

SEQ ID NO: 3797 - protein, 81 aa, Pongo abelii
MAPGLLTTRKEALMAFRDVAVAFTQKEWKLLSSAQRTLYREVMLENYSHLVSLGIAFSKPKLIEQLEQGDEPWREENEHLL

SEQ ID NO: 3798 - protein, 81 aa, Pongo abelii
ENYSHLVSLGIAFSKPKLIEQLEQGDEPWREENEHLLDLCPGEWEALGRQGCRAVRSSAGKEGGAVFEVLGGSSSSGLLGH

SEQ ID NO: 3799 - protein, 81 aa, Pongo abelii
PLRFSTLFQEQQKMNMSQASVSFKDVTIEFTQEEWQQMAPVQKNLYRDVMLENYSNLVSVGYCHFKPEVIFKLEQGEEPWF

SEQ ID NO: 3800 - protein, 81 aa, Pongo abelii
EFTQEEWQQMAPVQKNLYRDVMLENYSNLVSVGYCHFKPEVIFKLEQGEEPWFSEEEFSNQSHPSELLSSSRYNSAGVVRL

SEQ ID NO: 3801 - protein, 81 aa, Pongo abelii
MNTFQASVSFQDVTVEFSQEEWQHMGPVERTLYRDVMLENYSHLVSVGYCFTKPELIFTLEQGEDPWLLEKEKGFLSRNSP

SEQ ID NO: 3802 - protein, 81 aa, Pongo abelii
MASPSPPPESKEEWDYLDPAQRSLYKDVMMENYGNLVSLGLTLLPRLVCSDANTACCSLNLLGLNDQSSHLSYLGSWDYRC

SEQ ID NO: 3803 - protein, 81 aa, Pongo abelii
ENSKEDKMVAVCPNTESCESITLKDVSVNFSRGEWKKLEPFQKELYKEVLLENLRNLEFLDFPVSKLELISQLKWVELPWL

SEQ ID NO: 3804 - protein, 81 aa, Pongo abelii
DRRRSAGTTKEAGRPLEMAVSEPEASAAEWKQLDPAQRNLYNDVMLENYSNQASMGCQAPKPDMISKLEKGEAPWLGKGKR

SEQ ID NO: 3805 - protein, 81 aa, Pongo abelii
RRRSAGTTKEAGRPLEMAVSEPEASAAKEWKQLDPAQRNLYNDVMLENYSNQASMGCQAPKPDMISKLEKGEAPWLGKGKR

SEQ ID NO: 3806 - protein, 81 aa, Pongo abelii
EAGRPLEMAVSEPEASAAVSVTFKHVTMAFTQKEWKQLDPAQRNLYNDVMLENYSNQASMGCQAPKPDMISKLEKGEAPWL

SEQ ID NO: 3807 - protein, 81 aa, Pongo abelii
MAAGLLTAGPRGSTFFSSVTVAFAQEGWRCLVSTPQDRFKEGIPGKSRNLVLLGLPVSQPGMNSQLEQREGAWMLEGEDLR

SEQ ID NO: 3808 - protein, 81 aa, Pongo abelii
ENTGEEGMAAGLLTAGPRGSTFFSSVTVAFAQEGWRCLVSTPQDRFKEGIPGKSRNLVLLGLPVSQPGMNSQLEQREGAWM

SEQ ID NO: 3809 - protein, 81 aa, Pongo abelii
MSAVEQKFQGSVSFKDVTVGFTQEEWQHLDPSQRALYRDVMLENYSNLVSVGYCAHKPEVIFRLEQGEEPWRLEEEFPSWS

SEQ ID NO: 3810 - protein, 81 aa, Pongo abelii
MNKVEQKFQGSVSFKDVTVGFTQEEWQHLDPSQRALYRDVMLENYSNLVSVGYCAHKPEVIFRLEQGEEPWRLEEEFPSWS

SEQ ID NO: 3811 - protein, 81 aa, Pongo abelii
HLDPSQRALYRDVMLENYSNLVSVGYCAHKPEVIFRLEQGEEPWRLEEEFPSWSFPEVWTADHLKERSQENQSKHLWEVVF

SEQ ID NO: 3812 - protein, 81 aa, Pongo abelii
MANAIRKESKVEQKFQGSVSFKDVTVGFTQEEWQHLDPSQRALYRDVMLENYSNLVSVGYCAHKPEVIFRLEQGEEPWRLE

SEQ ID NO: 3813 - protein, 81 aa, Pongo abelii
MNTLQGPVSFKDVAVDFTQEEWQQLDPDEKITYRDVMLENYSHLVSVGYDITKPNVIIKLEQGEEPWIMEGEFPCQHSPEV

SEQ ID NO: 3814 - protein, 81 aa, Pongo abelii
MNTLQGPVSFKDVAVDFTQEEWQQLDPDEKITYRDVKVWKVDDLIERIQENEDKHSSRPARRPCGPCCCCCCCCSRSPRSP

SEQ ID NO: 3815 - protein, 81 aa, Pongo abelii
MNTLQGPVSFKDVAVDFTQEEWQQLDPDEKITYRDVKVWKVDDLIERIQENEDKHSRQAACINSKTLTEEKQNTFSQIYME

SEQ ID NO: 3816 - protein, 81 aa, Pongo abelii
GLLTFRDIAIEFSLEEWQCLDCAQQNLYRDVILENYRNLVSLGIAVSKPDLITCLGQNKESQHIKRNEMVAKHPVTRSHFT

SEQ ID NO: 3817 - protein, 81 aa, Pongo abelii
MEEKEMNDGSQMVRSQESLTFQDVAVDFTREEWDQLYPAQKNLYRDVMLENYRNLVALGYQLYKPEVIAQLELEEEWVIER

SEQ ID NO: 3818 - protein, 81 aa, Pongo abelii
GNMEEKEMNDGSQMVRSQESLTFQDVAVDFTREEWDQLYPAQKNLYRDVMLENYRNLVALGYQLYKPEVIAQLELEEEWVI

SEQ ID NO: 3819 - protein, 81 aa, Pongo abelii
MAKRPGSPGSREMRLLTFRDIAIEFSLVEWQYLDHAQQNLYRDVMLENYRNLVSLGIADSKPDLITFLEQNKESWNIKRNE

SEQ ID NO: 3820 - protein, 81 aa, Pongo abelii
MGVLTFRDVAVEFSPEEWECLDSAQQHLYRDVMLENYGNLFSLGLAIFKPDLMTCLEQRKEPWNVKRQKTVAKHPAGSLHF

SEQ ID NO: 3821 - protein, 81 aa, Pongo abelii
MAKRPGPPGSREMELLTFRDIAIEFSLEEWQCLDHAQQNLYRDVMLENYRNLVSLGITVSKPDLITCLEQNKEPRNIKRNE

SEQ ID NO: 3822 - protein, 81 aa, Pongo abelii
MAKRPGSPGSREMGLLTFRDVVIEFSLKEWQCLDHAQQNLYRDVMLENYRNLVSLGIAVSKPDLITCLEQNKEPWNIKRDE

SEQ ID NO: 3823 - protein, 81 aa, Pongo abelii
MGVLTFRDVAVEFSPEEWECLDSAQQRLYRDVMLENYGNLVSLGLAIFKPDLMTCLEQRKEPWNVKRQKTVAKHPAGSFHF

SEQ ID NO: 3824 - protein, 81 aa, Pongo abelii
MPGPPGSLEMGPLTFRDVAIEFSLEEWQCLDTAQRNLYRKVMFENYRNLVFLGIAVSKPHLITCLERGKEPWNRKRQEMVA

SEQ ID NO: 3825 - protein, 81 aa, Pongo abelii
MEPLTFKDVAIEFSLEEWQCLDTAQRDLYRNVLLENYRNLVFLVMSFHLAQDLWPEQNIKDSFQKVTLRRYGKCGYENLQL

SEQ ID NO: 3826 - protein, 81 aa, Pongo abelii
MEPLTFKDVAIEFSLEEWQCLDTAQRDLYRNVLLENYRNLVFLGIAVSKPYLITCLEQKKEPWNIKRHEMVAKPPVMSFHL

SEQ ID NO: 3827 - protein, 81 aa, Pongo abelii
MEPLTFKDVAIEFSLEEWQCLDTAQRDLYRNVLLENYRNLVFLGIAVSKPYLITCLEQKKEPWNIKRHEMVAKPPGASSVL

SEQ ID NO: 3828 - protein, 81 aa, Pongo abelii
MGPLTFMDVAIEFSLEEWQCLDTSQQNLYRHVMLENYRNLVFLDLITCLEQGKEPWNMKRHEMVVAKHSALCSHFAQDLWL

SEQ ID NO: 3829 - protein, 81 aa, Pongo abelii
MGPLTFMDVAIEFSLEEWQCLDTSQQNLYRHVMLENYRNLVFLAVAFTFDLSGLNILSFQSILPFISALYVMGNRNQCLQK

SEQ ID NO: 3830 - protein, 81 aa, Pongo abelii
MGPLTFMDVAIEFSLEEWQCLDTSQQNLYRHVMLENYRNLVFLALCSHFAQDLWLEQNIKDSFQKVTLSRYGKYGHKNLQL

SEQ ID NO: 3831 - protein, 81 aa, Pongo abelii
MGPLTFMDVAIEFSLEEWQCLDTSQQNLYRHVMLENYRNLVFLDLITCLEQGKEPWNMKRHEMVVAKHSAVAFTFDLSGLN

SEQ ID NO: 3832 - protein, 81 aa, Pongo abelii
MDVAIEFSLEEWQCLDTSQQNLYRHVMLENYRNLVFLALCSHFAQDLWLEQNIKDSFQKVTLSRYGKYGHKNLQLRNGCKS

SEQ ID NO: 3833 - protein, 81 aa, Pongo abelii
MGPLTFMDVAIEFSLEEWQCLDTSQQNLYRHVMLENYRNLVFLGIAISKPDLITCLEQGKEPWNMKRHEMVVAKHSDTLPF

SEQ ID NO: 3834 - protein, 81 aa, Pongo abelii
GIGRPTAKTPGLPGSLEMGPLTFRDVAIEFSLEEWQCLDTAQQNLYRNVMLENYRNLVFLGIAVSKPDLITCLEQGKEPCN

SEQ ID NO: 3835 - protein, 81 aa, Pongo abelii
MGPLTFMDVAIEFSLEEWQCLDTAQQNLYRHVMLENYRNLVFLAGIAVSKPDLITCLEQGKEPWNMKRHEMVAKHLVICLQ

SEQ ID NO: 3836 - protein, 81 aa, Pongo abelii
FSLEEWQCLDTAQQNLYRHVMLENYRNLVFLAGIAVSKPDLITCLEQGKEPWNMKRHEMVAKHLVICLQFHSESQRPLHGI

SEQ ID NO: 3837 - protein, 81 aa, Pongo abelii
MGPLTFRDVKIEFSLEEWQCLDTAQRNLYRDVMLENYRNLVFLGIAVSKPDLITWLEQGKEPWNMKRHEMVDKTPVMCSHF

SEQ ID NO: 3838 - protein, 81 aa, Pongo abelii
MAMSQESLTFKDVFVDFTLEEWQQLDSAQKNLYRDVMLENYSHLVSVGYLVAKPDVIFRLGPGEESWMADGGTPLRTCAEV

SEQ ID NO: 3839 - protein, 81 aa, Pongo abelii
MAMSQESLTFKDVFVDFTLEEWQQLDSAQKNLYRDVMLENYSHLVSVGYLVAKPDVIFRLGPGEESWMADGGTPLRTCAGE

SEQ ID NO: 3840 - protein, 81 aa, Pongo abelii
VAKPDVIFRLGPGEESWMADGGTPLRTCAGEDRPGESGRGKETRFVGEILASGMCSGALLRASDLWTCLGSDERNCCHVQM

SEQ ID NO: 3841 - protein, 81 aa, Pongo abelii
MAMSQESLTFKDVFVDFTLEEWQQLDSAQKNLYRDVMLENYSHLVSVGYLVAKPDVIFRLGPGEESWMADGGTPLRTCAGT

SEQ ID NO: 3842 - protein, 81 aa, Pongo abelii
MAMSQESLTFKDVFVDFTLEEWQQLDSAQKNLYRDVMLENYSHLVSVGYLVAKPDVIFRLGPGEESWMADGGTPVRTCAVW

SEQ ID NO: 3843 - protein, 81 aa, Pongo abelii
MAMSQESLTFKDVFVDFTLEEWQQLDSAQKNLYRDVMLENYSHLVSVGYLVAKPDVIFRLGPGEESWMADGGTPVRTCAEN

SEQ ID NO: 3844 - protein, 81 aa, Pongo abelii
MAMSQESLTFKDVFVDFTLEEWQQLDSAQKNLYRDVMLENYSHLVSVGYLVAKPDVIFRLGPGEESWMADGGTPVRTCAVE

SEQ ID NO: 3845 - protein, 81 aa, Pongo abelii
MNKDPIIVHLKGSVSFEDVAVDFTRQEWHRLDPAQRTMHKDVMLETYSNLASVGLCVAKPEMIFKLERGEELWILEEESSG

SEQ ID NO: 3846 - protein, 81 aa, Pongo abelii
SPPWSPALAAEGRGSSCEASVSFEDVTVDFSREEWQHLDPAQRRLYWDVTLENYSHLLSVGYQVPKSEAAFKLEQGEGPWT

SEQ ID NO: 3847 - protein, 81 aa, Pongo abelii
YPDLSPGPRGRRRIVSLQASVSFEDVTVDFSREEWQHLDPAQRRLYWDVTLENYSHLLSVGYQVPKSEAAFKLEQGEGPWT

SEQ ID NO: 3848 - protein, 81 aa, Pongo abelii
TLEGKAPHQSCSGEAIGKMQQQGIPGGIFFHCERFDQSIGEDSLCSILEELWQDNDQLEQCQENQNNLLSHVKEVLMVYLF

SEQ ID NO: 3849 - protein, 81 aa, Pongo abelii
AAHVSADHAALNRIVSLQASVSFEDVTVDFSREEWQHLDPAQRRLYWDVTLENYSHLLSVGYQVPKSEAAFKLEQGEGPWT

SEQ ID NO: 3850 - protein, 81 aa, Pongo abelii
LEGKAPHQSCSGEAIGKMQQQGIPGGIFFHCERFDQSIGEDSLCSILEELWQDNDQLEQCQENQNNLLSHVKVLIKERGYE

SEQ ID NO: 3851 - protein, 81 aa, Pongo abelii
MIESQEPVTFEDVAVDFTQEEWQQLNPAQKTLHRDVMLETYNHLVSMGCSGIKPDVIFKLEHGKDPWIIESELSRWTYPDR

SEQ ID NO: 3852 - protein, 81 aa, Pongo abelii
MVEGEEEWQQLNPAQKTLHRDVMLETYNHLVSMGCSGIKPDVIFKLEHGKDPWIIESELSRWTYPDRVKGLESSQEIISGE

SEQ ID NO: 3853 - protein, 80 aa, Pongo abelii
MIESQEPVTFEDVAVDFTQEEWQQLNPAQKTLHRDVMLETYNHLVSMGCSGIKPDVIFKLEHGKDPWIIESELSRWTYPE

SEQ ID NO: 3854 - protein, 81 aa, Pongo abelii
MIESQEEWQQLNPAQKTLHRDVMLETYNHLVSMGCSGIKPDVIFKLEHGKDPWIIESELSRWTYPDRVKGLESSQEIISGE

SEQ ID NO: 3855 - protein, 81 aa, Pongo abelii
NGDDAFAKRPRDDAKTSEKRSKAFDDIATYFSKKEWEKMKYSEKINYVYMKRNYETMTKLGFNVTLPPFMHNKQATDFQGN

SEQ ID NO: 3856 - protein, 81 aa, Pongo abelii
GDDAFARRPRAGAQIPEKIQKSFDDIAKYFSKKEWEKMKSSEKIIYVYMKRKYEAMTKLGFKATLPPFMCNTGATDLQGND

SEQ ID NO: 3857 - protein, 81 aa, Pongo abelii
GDDAFARRPTVGAQIPEKMQKAFDDIAKYFSKEEWEKMKASEKIIYVYMKRNYEAMTKLGFKATLPPFMRNKRAEDFQGND

SEQ ID NO: 3858 - protein, 81 aa, Pongo abelii
GDDAFARRPTVGAQIPEKMQKAFDDIAKYFSKEEWEKDESLEKIIYVYMKRNYEAMTKLGFKATLPPFMRNKRAEDFQGND

SEQ ID NO: 3859 - protein, 81 aa, Pongo abelii
KRTKHWKMASKLILPESLSLLTFEDVAVYFSEEEWQLLNPLEKTLYNDVMQDIYETVISLGLKLKNDTGNDHPISVSTSEI

SEQ ID NO: 3860 - protein, 81 aa, Hylobates moloch
MIESQEPVTFEDVAVDFTQEEWQQLNPAQKTLHRDVMLETYNHLVSVGCSGIKPDVIFKLEHGEDPWIIESELSRWIYPDR

SEQ ID NO: 3861 - protein, 80 aa, Hylobates moloch
MIESQEPVTFEDVAVDFTQEEWQQLNPAQKTLHRDVMLETYNHLVSVGCSGIKPDVIFKLEHGEDPWIIESELSRWIYPE

SEQ ID NO: 3862 - protein, 81 aa, Hylobates moloch
MVEGEEEWQQLNPAQKTLHRDVMLETYNHLVSVGCSGIKPDVIFKLEHGEDPWIIESELSRWIYPDRVKGLESSQQIISGE

SEQ ID NO: 3863 - protein, 81 aa, Hylobates moloch
MAAGQREARPQVSLTFEDVAVLFTRDEWRKLAPSQRNLYRDVMLENYRNLVSLGLPFTKPKVISLLQQGEDPWKVEKDSSG

SEQ ID NO: 3864 - protein, 81 aa, Hylobates moloch
VLPSGSRGFRAADSRAGKQKGFFLAPFFFSDLPSGDCTVLTESQKEDMAAGQREARPQVSLTFEDVAVLFTRDEWRKLAPS

SEQ ID NO: 3865 - protein, 81 aa, Hylobates moloch
TESQKEDMAAGQREARPQVSLTFEDVAVLFTRDEWRKLAPSQRNLYRDVMLENYRNLVSLGLPFTKPKVISLLQQGEDPWK

SEQ ID NO: 3866 - protein, 81 aa, Hylobates moloch
GEDTLARRPTVGAQIPEKVQKASDDIAKYFSKKEWEKMKATEKITYVYMKRKYEVMAKLGLKPTFPPFMRNTGATDLQGND

SEQ ID NO: 3867 - protein, 81 aa, Hylobates moloch
GHTEGGELVNKLLTSWLQGLVTFEDVAVEFTQEEWALLDPAQRTLYRDVMLENFRNLASSLGNQVDKPSLISQLEQEDKVM

SEQ ID NO: 3868 - protein, 81 aa, Hylobates moloch
MAKRPEPPGSREMGLLTFRDIAIEFSLEEWQCLDCAQRNLYRDVMLENYRNLVSLGIAVSKPDLITCLEQNKESQNIKRNE

SEQ ID NO: 3869 - protein, 81 aa, Hylobates moloch
MLENYRNLVSLGLVVSKPDLITFLEQRKEPWNVKSEETVAIQPDVFSHYNKDLLTEHCTEASFQKVISRRHGNCDLENLHL

SEQ ID NO: 3870 - protein, 81 aa, Hylobates moloch
PLAAQSPEGHHGHQEPASTSFHPPRMQEEWGLLDRSQKELYWDAMLEKYGTVVSLGLPPHQPEAQAQSELGMLLTGTGVCR

SEQ ID NO: 3871 - protein, 81 aa, Hylobates moloch
GPAQHTCWPCGSAVHTLKSLVTFEDVAVYFSQEEWELLDAAQRHLYHTVMLENLELVTSLGCWHGVEGEEAHPEQNVSVEV

SEQ ID NO: 3872 - protein, 81 aa, Hylobates moloch
HTLKSLVTFEDVAVYFSQEEWELLDAAQRHLYHTVMLENLELVTSLGNALSQHDVTCFVGADLPNCFPNWLHHFTSLSAVY

SEQ ID NO: 3873 - protein, 81 aa, Hylobates moloch
MAGEAEAQLDPSLQGLVMFEDVTVYFSREEWGLLNVTQKGLYRDVMLENFALVSSLGLAPSRSPVFTQLEDDEQSWVPNWV

SEQ ID NO: 3874 - protein, 81 aa, Hylobates moloch
MAGEAEGLVMFEDVTVYFSREEWGLLNVTQKGLYRDVMLENFALVSSLGLAPSRSPVFTQLEDDEQSWVPNWVDVTPVSRA

SEQ ID NO: 3875 - protein, 81 aa, Hylobates moloch
DEWAAGVMSVGPPAARLQEPVTFRDVAVDFTQEEWGQLDPTQRILYRDVMLETFGHLLSVGPELPKPEVISQLEQGTELWV

SEQ ID NO: 3876 - protein, 81 aa, Hylobates moloch
MEARSTLVPPQASVCFEDVAMAFTQEEWEQLDLAQRTLYREVTLETWEHIVSLGLFLSKSDVISQLEQEEGLCRAEQVAPR

SEQ ID NO: 3877 - protein, 81 aa, Hylobates moloch
EWEQLDLAQRTLYREVTLETWEHIVSLGLFLSKSDVISQLEQEEGLCRAEQVAPREKGMLPGTFLGLAIEDRFSLLEGCLI

SEQ ID NO: 3878 - protein, 81 aa, Hylobates moloch
EDVAMAFTQEEWEQLDLAQRTLYREVTLETWEHIVSLGLFLSKSDVISQLEQEEGLCRAEQVAPRGARPSKEQRGYRARRI

SEQ ID NO: 3879 - protein, 81 aa, Hylobates moloch
MEARSTLVPPQASVCFEDVAMAFTQEEWEQLDLAQRTLYREVTLETWEHIVSLDWKATLEENRLNSEKDRAREEVSHHVEV

SEQ ID NO: 3880 - protein, 81 aa, Hylobates moloch
EDVAMAFTQEEWEQLDLAQRTLYREVTLETWEHIVSLGLFLSKSDVISQLEQEEGLCRAEQVAPRDGVSPLLPRLECNGTI

SEQ ID NO: 3881 - protein, 81 aa, Hylobates moloch
EEKQKEDAAICPVTVLPEEPVTFQDVAVDFSREEWGLLGPTQRTEYRDVMLETFGHLVSVGWETTLENKELAPNSDIPEEE

SEQ ID NO: 3882 - protein, 81 aa, Hylobates moloch
MASRLPTAWSCEPVIFEDVTLGFTPEEWGLLDLKQKSLYREVMLENYRNLVSVEHQLSKPDVVSQLEEAEDFWPVERGIPQ

SEQ ID NO: 3883 - protein, 81 aa, Hylobates moloch
MASRLPTAWSCEPVIFEDVTLGFTPEEWGLLDLKQKSLYREVMLENYRNLVSVEYPELQLDPKLDPLPAESPLMNIEVVEV

SEQ ID NO: 3884 - protein, 81 aa, Hylobates moloch
ARRRSVGCRCCGLCLAVRREQVTFEDVVVEFSQEEWGQLKPAQRTLYRDVMLDTFRLLVSVAHWLLKLNVISLLEQEAELQ

SEQ ID NO: 3885 - protein, 81 aa, Hylobates moloch
MTPGLRVSTDPEQVTFEDVVVEFSQEEWGQLKPAQRTLYRDVMLDTFRLLVSVAHWLLKLNVISLLEQEAELQAVDSGLPQ

SEQ ID NO: 3886 - protein, 81 aa, Hylobates moloch
GRLEEGRRATGLPAAQVQEPVTFKDVAVDFTQEEWGQLDLVQRTLYRDVMLETYGHLLSVGNQIAKPEVISLLEQGEEPWS

SEQ ID NO: 3887 - protein, 81 aa, Hylobates moloch
MAAAELTAPARGIVTFEDVAVYFSWKEWGLLDEAQKCLYHDVMLENLALTTSLGGCGAGDEEAPYQQSTSPQRVSQVRIPN

SEQ ID NO: 3888 - protein, 81 aa, Hylobates moloch
MQHGTVAFEDVAVNFSQEEWSLLSEVQRCLYHDVMLENWVLISSLGCWCRSEDEEAPSKRSISIQRVSQVSTPRAGVSPKK

SEQ ID NO: 3889 - protein, 81 aa, Hylobates moloch
HRMTWDCIAIGSHENSVHGTVAFEDVAVNFSQEEWSLLSEVQRCLYHDVMLENWVLISSLGCWCRSEDEEAPSKRSISIQR

SEQ ID NO: 3890 - protein, 81 aa, Hylobates moloch
MQGTVAFEDVAVNFSQEEWSLLSEVQRCLYHDVMLENWVLISSLGCWCRSEDEEAPSKRSISIQRVSQVSTPRAGVSPKKA

SEQ ID NO: 3891 - protein, 81 aa, Hylobates moloch
MQGTVAFEDVAVNFSQEEWSLLSEVQRCLYHDVMLENWVLISSLGCWCRSEDEEAPSKRSISIQRVSQSLRLSAQAGVARS

SEQ ID NO: 3892 - protein, 81 aa, Hylobates moloch
ASTSRVAGTTGACHHAQHGTVAFEDVAVNFSQEEWSLLSEVQRCLYHDVMLENWVLISSLGCWCRSEDEEAPSKRSISIQR

SEQ ID NO: 3893 - protein, 81 aa, Hylobates moloch
MAAAAPRHPTQGTVTFEDVAVNFSQEEWCLLSEAQRCLYRDVMLENLALISSLGCWCGSKDEEAPCKQIISVQRESQSRTP

SEQ ID NO: 3894 - protein, 81 aa, Hylobates moloch
MAAAATLRLSAQGTVTFEDVAVNFTWEEWNLLSEAQRCLYRDVTLENLALISSLGCWCGVEDEAAPSKQNIYIQRETQVRT

SEQ ID NO: 3895 - protein, 81 aa, Hylobates moloch
MAAAATLRLSAQGTVTFEDVAVNFTWEEWNLLSEAQRCLYRDVTLENLALISSLDPALDGSADNTQTGNLQSVLPSHPEQK

SEQ ID NO: 3896 - protein, 81 aa, Hylobates moloch
MAAAATLRLSAQGTVTFEDVAVNFTWEEWNLLSEAQRCLYRDVTLENLALISSLGCWCGVEDEAAPSKQNIYIQRETQFLH

SEQ ID NO: 3897 - protein, 81 aa, Hylobates moloch
MAAAATLRLSAQGTVTFEDVAVNFTWEEWNLLSEAQRCLYRDVTLENLALISSLGMKFLHVCQALDLPQVIPTSASQSAGI

SEQ ID NO: 3898 - protein, 81 aa, Hylobates moloch
MAAAATLRLSAQGTVTFEDVAVNFTWEEWNLLSEAQRCLYRDVTLENLALISSLGCWCGVEDEAAPSKQNIYIQRETQDGV

SEQ ID NO: 3899 - protein, 81 aa, Hylobates moloch
MAAAAPRPQAQQGTVTFEDVAVNFSQEEWSLLSEAQRCLYRDVMLENLALISSLGCWCGSKDEEAPWDVFHFADHQETHHK

SEQ ID NO: 3900 - protein, 81 aa, Hylobates moloch
MAAAAPRPQAQQGTVTFEDVAVNFSQEEWSLLSEAQRCLYRDVMLENLALISSLGCWCGSKDEEAPCKQIISVQRESQSRT

SEQ ID NO: 3901 - protein, 81 aa, Hylobates moloch
MAAAAPRPQAQGTVTFEDVAVNFSQEEWSLLSEAQRCLYRDVMLENLALISSLGCWCGSKDEEAPWDVFHFADHQETHHKQ

SEQ ID NO: 3902 - protein, 81 aa, Hylobates moloch
MAAAAPRPQAQGTVTFEDVAVNFSQEEWSLLSEAQRCLYRDVMLENLALISSLGCWCGSKDEEAPCKQIISVQRESQSRTP

SEQ ID NO: 3903 - protein, 81 aa, Hylobates moloch
MAAAAPRCPAQGTVTFEDVAVNFTQEEWNLLSEAQRCLYRDVTLENLALMSSLGCWCGVEDEAAPSKQNIYIQRETQVRTP

SEQ ID NO: 3904 - protein, 81 aa, Hylobates moloch
MAAAAALRAHAQSSVTFEDVAVNFSLEEWSLNEAGCLYHDVMLQTLTLISSLGGVTPHTLFPTGACGPQVPSSRIRPSPGH

SEQ ID NO: 3905 - protein, 81 aa, Hylobates moloch
MAAAAALRAHAQSSVTFEDVAVNFSMEEWSLLNEAQRCLYRDVMLETLTLISSLGCWHGGEDEAAPSKQSTCIYIYKEQGG

SEQ ID NO: 3906 - protein, 81 aa, Hylobates moloch
MAAAALRFPVQGTVTFEDVAVNFTQEEWNLLSEAQRCLYRDVMLENLALISSLSCWCGVEDEAAPSKRSIYIQRETQVRTP

SEQ ID NO: 3907 - protein, 81 aa, Hylobates moloch
MAAAALRPPAQGTVTFEDVAVNFSQEEWSLLSEAQRCLYHDVMLENLTLISSLGCWYGAKDETPSKQTLSIQQESPLRTRQ

SEQ ID NO: 3908 - protein, 81 aa, Hylobates moloch
MAAVALRDSARGTVTFEDVAVNFSQEEWSLLSEAQRCLYHDVMLENLTLISSLGCWYGAKDETPSKQTLSIQQESPLRTRQ

SEQ ID NO: 3909 - protein, 81 aa, Hylobates moloch
PAAVRTHGPMAELTDSARGCVVFEDVFVYFSWEEWELLDDAQRLLYHDVMLENFALLASLGIAFSRSRAVMKLEQGEEPWV

SEQ ID NO: 3910 - protein, 81 aa, Hylobates moloch
SPPSPRSSMAAVALRDSARGMTFEDVAIYFSQEEWELLDESQRFLYCDVMLENFAHVTSLGYCHGAENEAIASEQSVSIQV

SEQ ID NO: 3911 - protein, 81 aa, Hylobates moloch
MTFEDVAIYFSQEEWELLDESQRFLYCDVMLENFAHVTSLGYCHGAENEAIASEQSVSIQVRTSKGNTPTQKTHLSEIKMG

SEQ ID NO: 3912 - protein, 81 aa, Hylobates moloch
RDPAPVPIATEVLFKLTGSVTFEDVAVYFSWEEWDLLDESQKHLYFDVMLENFALTSSLGCWRGVEHEETPSEQRISVERV

SEQ ID NO: 3913 - protein, 81 aa, Hylobates moloch
VQLRPQTRMATALRDPAPGSVTFEDVAVYFSWEEWDLLDESQKHLYFDVMLENFALTSSLGCWRGVEHEETPSEQRISVER

SEQ ID NO: 3914 - protein, 81 aa, Hylobates moloch
VQLRPQTRMATALRDPAPGSVTFEDVAVYFSWEEWDLLDESQKHLYFDVMLENFALTSSLGLTSSWCHVVAQLGLGEVPSV

SEQ ID NO: 3915 - protein, 81 aa, Hylobates moloch
MATALRDPAPGSVTFEDVAVYFSWEEWDLLDESQKHLYFDVMLENFALTSSLGCWRGVEHEETPSEQRISVERVPQFRTSK

SEQ ID NO: 3916 - protein, 81 aa, Hylobates moloch
RDPAPVPIATEVLFKLTGSVTFEDVAVYFSWEEWDLLDESQKHLYFDVMLENFALTSSLGLTSSWCHVVAQLGLGEVPSVL

SEQ ID NO: 3917 - protein, 81 aa, Hylobates moloch
MAAALRALTQQGFVAFEDVAIYFSQEEWELLDEMQRLLYRDVMLENFAVMASLGCWCGAEDEGAPSAESVSVEELSQGRTP

SEQ ID NO: 3918 - protein, 81 aa, Hylobates moloch
RAPTQVTVSPETHMDLTKGCVNFEDIAIYFSQDEWGLLDEAQRLLYLEVMLENFALVASLGCGHGTEDEETPSDQNVSVGV

SEQ ID NO: 3919 - protein, 81 aa, Hylobates moloch
MAAAALRAPTQGCVNFEDIAIYFSQDEWGLLDEAQRLLYLEVMLENFALVASLGCGHGTEDEETPSDQNVSVGVSQSKAGS

SEQ ID NO: 3920 - protein, 81 aa, Hylobates moloch
MAAAALRAPTQVTVSPETHMDLTKDEWGLLDEAQRLLYLEVMLENFALVASLGCGHGTEDEETPSDQNVSVGVSQSKAGSS

SEQ ID NO: 3921 - protein, 81 aa, Hylobates moloch
MDLTKGCVNFEDIAIYFSQDEWGLLDEAQRLLYLEVMLENFALVASLGCGHGTEDEETPSDQNVSVGVSQSKAGSSTQKTQ

SEQ ID NO: 3922 - protein, 81 aa, Hylobates moloch
MAETKDAAQMVTFKDVAVTFTREEWRQLDLAQRTLYREVMLETCGLLVSLGHQVPKPELVHLLEHGQELWTVKRGLSHPTC

SEQ ID NO: 3923 - protein, 81 aa, Hylobates moloch
MVTFKDVAVTFTREEWRQLDLAQRTLYREVMLETCGLLVSLGHQVPKPELVHLLEHGQELWTVKRGLSHPTCAGDRAQVHT

SEQ ID NO: 3924 - protein, 81 aa, Hylobates moloch
LVNTPQIPVVAEEFVKPSQGHVTFEDIAVYFSQEEWGLLDEAQRCLYHDVMLENFSLMASVAGLSQSNHKDSCLQQKVPVS

SEQ ID NO: 3925 - protein, 81 aa, Hylobates moloch
MAAAALVNTPQGHVTFEDIAVYFSQEEWGLLDEAQRCLYHDVMLENFSLMASVGCLHGIEAEEAPSEQTVSAQGASQARTP

SEQ ID NO: 3926 - protein, 81 aa, Hylobates moloch
VNTPQIPVVAEEFVKPSQGHVTFEDIAVYFSQEEWGLLDEAQRCLYHDVMLENFSLMASVGCLHGIEAEEAPSEQTVSAQG

SEQ ID NO: 3927 - protein, 81 aa, Hylobates moloch
MAAAALRDPAQQGYVTFEDVAVYFSQEEWRLLDEAQKLLYRNVMLENFSLLASLGLASSKTHEITQLESWEEPFMPAWEVV

SEQ ID NO: 3928 - protein, 81 aa, Hylobates moloch
MAAAALRDPAQGYVTFEDVAVYFSQEEWRLLDEAQKLLYRNVMLENFSLLASLGLASSKTHEITQLESWEEPFMPAWEVVT

SEQ ID NO: 3929 - protein, 81 aa, Hylobates moloch
MAAAALRDPAQGYVTFEDVAVYFSQEEWRLLDEAQKLLYRNVMLENFSLLASLGLASSKTHEITQLESWEEPFMPAWEAVT

SEQ ID NO: 3930 - protein, 81 aa, Hylobates moloch
RDPAQVPVTAELLTDHEDGYVTFEDVAVYFSQEEWRLLDEAQKLLYRNVMLENFSLLASLGLASSKTHEITQLESWEEPFM

SEQ ID NO: 3931 - protein, 81 aa, Hylobates moloch
MAAAALRDPAQGYVTFEDVAVYFSQEEWRLLDEAQKLLYRNVMLENFSLLASLGCWHGAEAEEAPEQSASVGLLSSNIQQH

SEQ ID NO: 3932 - protein, 81 aa, Hylobates moloch
MAAAALRDPAQQGYVTFEDVAVYFSQEEWRLLDEAQKLLYRNVMLENFSLLASLGLASSKTHEITQLESWEEPFMPAWEAV

SEQ ID NO: 3933 - protein, 81 aa, Hylobates moloch
RDPAQVPVTAELLTDHEQGYVTFEDVAVYFSQEEWRLLDEAQKLLYRNVMLENFSLLASLGLASSKTHEITQLESWEEPFM

SEQ ID NO: 3934 - protein, 81 aa, Hylobates moloch
LRDPAQVPVTAELLTDHEGYVTFEDVAVYFSQEEWRLLDEAQKLLYRNVMLENFSLLASLGCWHGAEAEEAPEQSASVGLL

SEQ ID NO: 3935 - protein, 81 aa, Hylobates moloch
MAAAALRDPAQQGYVTFEDVAVYFSQEEWRLLDEAQKLLYRNVMLENFSLLASLGCWHGAEAEEAPEQSASVGLLSSNIQQ

SEQ ID NO: 3936 - protein, 81 aa, Hylobates moloch
MAAAALRDPAQGYVTFEDVAVYFSQEEWRLLDEAQKLLYRNVMLENFSLLASLGKVLTPHPSILSWARLFFLLLGRCLFFP

SEQ ID NO: 3937 - protein, 81 aa, Hylobates moloch
MGPAQVPMNSEVIVDPIQGQVNFEDVFVYFSQEEWVLLDEAQRLLYRDVMLENFALMASLGHASFMSHIVASLVMGSEPWV

SEQ ID NO: 3938 - protein, 81 aa, Hylobates moloch
MNSEVIVDPIQGQVNFEDVFVYFSQEEWVLLDEAQRLLYRDVMLENFALMASLGHASFMSHIVASLVMGSEPWVPDWVDMT

SEQ ID NO: 3939 - protein, 81 aa, Hylobates moloch
MAAAEPMGPAQVPMNSEVIVDPIQGQVNFEDVFVYFSQEEWVLLDEAQRLLYRDVMLENFALMASLERQAMSTRTVLRHPT

SEQ ID NO: 3940 - protein, 81 aa, Hylobates moloch
AAAEPMGPAQVPMNSEVIVDPIQGQVNFEDVFVYFSQEEWVLLDEAQRLLYRDVMLENFALMASLERQAMSTRTVLRHPTG

SEQ ID NO: 3941 - protein, 81 aa, Hylobates moloch
MNLTEDCMVFEDVAIYFSQEEWEILNDAQRHLHSNVMLENLALLSSVGCWHGAKDEEVPSKQCVSVRVLQVTTPKPALSTL

SEQ ID NO: 3942 - protein, 81 aa, Hylobates moloch
MNLTESQGAALQDCMVFEDVAIYFSQEEWEILNDAQRHLHSNVMLENLALLSSVGCWHGAKDEEVPSKQCVSVRVLQVTTP

SEQ ID NO: 3943 - protein, 81 aa, Hylobates moloch
MLMDAGQDCMVFEDVAIHFSQEEWGILNDVQRHLHSDVMLENFALLSSVGCWHGAKDEEAPSKQCVSVGVSQVTTLKPALS

SEQ ID NO: 3944 - protein, 81 aa, Hylobates moloch
MNLTEDCMVFEDVAIHFSQEEWGILNDVQRHLHSDVMLENFALLSSVGCWHGAKDEEAPSKQCVSVGVSQVTTLKPALSTQ

SEQ ID NO: 3945 - protein, 81 aa, Hylobates moloch
MNLTEGPVMAEMDPTQDCMVFEDVAIHFSQEEWGILNDVQRHLHSDVMLENFALLSSVGCWHGAKDEEAPSKQCVSVGVSQ

SEQ ID NO: 3946 - protein, 81 aa, Hylobates moloch
MNLTEGPVMAEMDPTQGRVVFEDVAIYFSQEEWGHLDEAQRLLYRDVMLENLALLSSLGFIAVAAMLMDAGQDCMVFEDVA

SEQ ID NO: 3947 - protein, 81 aa, Hylobates moloch
AIYFSQEEWGHLDEAQRLLYRDVMLENLALLSSLGFIAVAAMLMDAGQDCMVFEDVAIHFSQEEWGILNDVQRHLHSDVML

SEQ ID NO: 3948 - protein, 81 aa, Hylobates moloch
QAGGHKGSPVMAEMDPTQGRVVFEDVAIYFSQEEWGHLDEAQRLLYRDVMLENLALLSSLGSWHGAEDEEAPSQQGFSVGV

SEQ ID NO: 3949 - protein, 81 aa, Hylobates moloch
LDFGHDDSQMSQDGYVTQAGGHKGSPVMAEMDPTQGRVVFEDVAIYFSQEEWGHLDEAQRLLYRDVMLENLALLSSLAFLF

SEQ ID NO: 3950 - protein, 81 aa, Hylobates moloch
LLYRDVMLENLALLSSLGSWHGAEDEEAPSQQGFSVGVSEVTTSKPCLSSQKVHPSETCGPTFKDILCLVEHDGIHPEQDI

SEQ ID NO: 3951 - protein, 81 aa, Hylobates moloch
QAGGHKGSPVMAEMDPTQGRVVFEDVAIYFSQEEWGHLDEAQRLLYRDVMLENLALLSSLGKALTLAQYPGLGCVTPFYPK

SEQ ID NO: 3952 - protein, 81 aa, Hylobates moloch
MAEMNPAQGRVVFEDVAIYFSQEEWGHLDEDQRLLYRDVMLENLALLSSLGSWHGAEDEEAPSQQGFSVGVSEVTTSKPCL

SEQ ID NO: 3953 - protein, 81 aa, Hylobates moloch
QEEWGHLDEDQRLLYRDVMLENLALLSSLGSWHGAEDEEAPSQQGFSVGVSEVTTSKPCLSSQKVHPSETCGPTFKDILCL

SEQ ID NO: 3954 - protein, 81 aa, Hylobates moloch
MAEMNPAQGRVVFEDVAIYFSQEEWGHLDEDQRLLYRDVMLENLALLSSLGCCHGAEDEEAPLEPGVSVGVSQVMAPKPCL

SEQ ID NO: 3955 - protein, 81 aa, Hylobates moloch
MYSSFPIWQGRVVFEDVAIYFSQEEWGHLDEDQRLLYRDVMLENLALLSSLGCCHGAEDEEAPLEPGVSVGVSQVMAPKPC

SEQ ID NO: 3956 - protein, 81 aa, Hylobates moloch
VSVGVSQVMAPKPCLSTWKTQPCETCSSLLKDILRLAEHDGTHPEQGLYTCPAHLHQHQKEQIREKLSRADGGRPTFVKNH

SEQ ID NO: 3957 - protein, 81 aa, Hylobates moloch
MAAAVLMDRVQSCVTFEDVFVYFSREEWELLEEAQRFLYRDVMLENFALVATLAFIFPVPCSCAVGGGRPWVPDRADITAA

SEQ ID NO: 3958 - protein, 81 aa, Hylobates moloch
MADSAQVSVTFEDVAVTFTQEEWGQLDAAQRTLYQEVMLETCGLLVSLGCPLFKPELIYQLDHRQELWMVIKDLSQSSYPG

SEQ ID NO: 3959 - protein, 81 aa, Hylobates moloch
MADSAQVSVTFEDVAVTFTQEEWGQLDAAQRTLYQEVMLETCGLLVSLGDNTKPKTTEPTFSHLALPEEVLLQERLTQGAS

SEQ ID NO: 3960 - protein, 81 aa, Hylobates moloch
MAMALTDPVQVSVTFDDVAVTFTQEEWGQLDLAQRTLYQEVMLENCGLLVSLGCPVPRPELIYHLEHGQEPWTRKEDLSQG

SEQ ID NO: 3961 - protein, 81 aa, Hylobates moloch
MAAAVLTDRAQVSVTFDDVAVTFTKEEWGQLDLAQRTLYQEVMQENCGLLVSLGCPVPRPELIYHLEHGQEPWTRKEDLSQ

SEQ ID NO: 3962 - protein, 81 aa, Hylobates moloch
MAAAVLTDRAQVSVTFDDVAVTFTKEEWGQLDLAQRTLYQEVMQENCGLLVSLGDKGKPKTTEPTTCESALSEGISLQGQV

SEQ ID NO: 3963 - protein, 81 aa, Hylobates moloch
MAAAVLTDRAQVSVTFDDVAVTFTKEEWGQLDLAQRTLYQEVMQENCGLLVSLAPSQTHPGSIRCILQSNQVDTLIKIPEH

SEQ ID NO: 3964 - protein, 81 aa, Hylobates moloch
MNNSQGRVTFKDVTVNFTHGEWQRLNPKQRNLYRDVMLENYSNLVSVGREETTKPDVILRLEQGKEPWSVEEEVLGSGRPE

SEQ ID NO: 3965 - protein, 81 aa, Hylobates moloch
AGSQFLDFKHLGTFLVFEELVTFEDVFVDFSPEELSSLSAAQRNLYRKVMLENYRNLVCLGYQFSKPDIISRLEEEESRAM

SEQ ID NO: 3966 - protein, 81 aa, Hylobates moloch
NKQPEAVGTGIEPKAMSQGLVTFGDVAIDFSQEEWEWLNPIQRNLYRKVMLENYRNLASLGLCVSKPDVISSLEQGKEPWT

SEQ ID NO: 3967 - protein, 81 aa, Hylobates moloch
LEYALLGEHWDYDALFETQPGLVTIKNLAVDFPQQLHPAQKNFCKNGIWENYSDLGSAGHCVAKPDLVSLLEQEKEPWMVK

SEQ ID NO: 3968 - protein, 81 aa, Hylobates moloch
MNVEVVKVIPQDLVTFKDVAIDFSQEEWQWMNPAQKRLYRSMMLENYQSLVSLGLCISKPYVISLLEQGREPWEMTSEMTR

SEQ ID NO: 3969 - protein, 81 aa, Hylobates moloch
ITHKEILPEVQNKEYNKSWQTFHQDTIFDIQQNFPTKEKAHKHEPQKKSYRKKSVEMKHRKVYVEKKLLKCNDCEKVFNQS

SEQ ID NO: 3970 - protein, 81 aa, Hylobates moloch
MSLGSELFRDVAIVFSQEEWQWLAPAQRDLYRDVMLETYSNLVSLGLAISKPDVISFLEQGKEPWMVERVVSRGLCPVLES

SEQ ID NO: 3971 - protein, 81 aa, Hylobates moloch
DTKELSPKQHVYEVESPQWEIMESLTSYGLECSSFQDDWECRNQFDRQQGNPDGHFHQMIIRHEEMPTFDQHASLTFYQKI

SEQ ID NO: 3972 - protein, 81 aa, Hylobates moloch
MALSQGLLTFRDVAIEFSQEEWKCLDPAQRTLYRDVMLENYRNLASLDISSKCTMKEVLSTAQGNREVFHAGTLQRHESHH

SEQ ID NO: 3973 - protein, 81 aa, Hylobates moloch
MALPQGLLTFRDVAIEFSQEEWKCLDPAQRTLYRDVMLENYRNLVSLDISSKCMVKEFLSAAQGKREEFHTGTLERHESHH

SEQ ID NO: 3974 - protein, 81 aa, Hylobates moloch
MALSQSLLTFRDVAIEFSQEEWKCLDPAQRTLYRDVMLENYRNLVSLGISSKCTLKEFSSTAQGNREVIHTGTLERHESHH

SEQ ID NO: 3975 - protein, 81 aa, Hylobates moloch
MALPQGLLTFRDVAIEFSQEEWKCLDPAQRTLYRDVMLENYRNLASLDISSKCTMKEVLSTAQGNREVFHAGTLQRHESHH

SEQ ID NO: 3976 - protein, 81 aa, Hylobates moloch
MALPQGLLTFRDVAIEFSQEEWKCLDPAQRTLYRDVMLENYRNLVSLDISSKCTLKEVSSTAQGNTEVIHTGTLQRHERHH

SEQ ID NO: 3977 - protein, 81 aa, Hylobates moloch
SWTSAWTLAGLAMETAGSEGRLTFRDVAIEFSLAEWKCLNPAQRALYREVMLENYRNLEAVVMTLLSVMDGFLETLLWSAF

SEQ ID NO: 3978 - protein, 81 aa, Hylobates moloch
MALSQGLFTFKDVAVEFSQEEWECLDPAQRALYRDVMLENYRNLLSLDEDNIPPENDISVGFTSKGLSPKENNKEELYHLV

SEQ ID NO: 3979 - protein, 81 aa, Hylobates moloch
MPLQGSVSFKDVTVDFTQEEWQQLDPAQKALYRDVMLENYCHFVSVGFHMTKPDMIRKLEQGEELWTQRIFPSYSYLEADG

SEQ ID NO: 3980 - protein, 81 aa, Hylobates moloch
FHMTKPDMIRKLEQGEELWTQRIFPSYSYLEADGKTEDVLVKFKEYQDRHSRPLIFINHKKLIKERSNIYGKTLTLGKNHI

SEQ ID NO: 3981 - protein, 81 aa, Hylobates moloch
MSQGSVSFKDVTVDFTQEEWQQLDPAQKALYRDVMLENYCHFVSVGFHMTKPDMIRKLEQGEELWTQRIFPSYSYLEADGK

SEQ ID NO: 3982 - protein, 81 aa, Hylobates moloch
MPLQGSVSFKDVTVDFTQEEWQQLDPAQKALYRDVMLENYCHFVSVGFHMTKPDMIRKLEQGEELWTQRIFPSYSYLADGK

SEQ ID NO: 3983 - protein, 81 aa, Hylobates moloch
GFHMTKPDMIRKLEQGEELWTQRIFPSYSYLADGKTEDVLVKFKEYQDRHSRPLIFINHKKLIKERSNIYGKTLTLGKNHI

SEQ ID NO: 3984 - protein, 81 aa, Hylobates moloch
MMENYSNLLSLDLESRNETKHLSIGKDIIKNTGSQCEVMENSKLHGLESSILKNDWQSKSKIEVQGPEVGYFSQMKIISEN

SEQ ID NO: 3985 - protein, 81 aa, Hylobates moloch
MPEVEFPDQFFTILTMDHELVTLRDVVINFSQEEWEYLDSAQRNLYWDVMMENYSNLLSLDLESRNETKHLSIGKDIIKNT

SEQ ID NO: 3986 - protein, 81 aa, Hylobates moloch
MALRSVMFSDVSIDFSPEEWEYLDLEQKDLYRDVMLENYSNLVSLGCFISKPDVISLLEQGKEPWKVVRKGRRQYPDLETR

SEQ ID NO: 3987 - protein, 81 aa, Hylobates moloch
MAHGSVTFRDVAIDFSQEEWEFLDPAQRDLYRDVMWENYSNFISLGPSISKPDLITLLDEEGKEPGMVVREGTRRYCPDLE

SEQ ID NO: 3988 - protein, 81 aa, Hylobates moloch
MAHGSVTFRDVAIDFSQEEWEFLDPAQRDLYRDVMWENYSNFISLAGPSISKPDLITLLDEEGKEPGMVVREGTRRYCPGE

SEQ ID NO: 3989 - protein, 81 aa, Hylobates moloch
EESREIRAGQIVLKAMAQGLVTFRDVAIEFSLEEWKCLEPAQRDLYREVTLENFGHLASLGLSISKPDVVCLLEQGKEPWM

SEQ ID NO: 3990 - protein, 81 aa, Hylobates moloch
MAQGLVTFRDVAIEFSLEEWKCLEPAQRDLYREVTLENFGHLASLGLSISKPDVVCLLEQGKEPWMIANDVTGPWCPDLES

SEQ ID NO: 3991 - protein, 81 aa, Hylobates moloch
MAAAALRDPSQSCVTFEDVTIYFSQEEWVLLDEAQRLLYCDVMLENFALIASLGLISFRSHIVSQLEMGKEPWVPDSVDMT

SEQ ID NO: 3992 - protein, 81 aa, Hylobates moloch
MAAAALRDPSQEEWVLLDEAQRLLYCDVMLENFALIASLGLISFRSHIVSQLEMGKEPWVPDSVDMTSAMARGAYGRPGSD

SEQ ID NO: 3993 - protein, 81 aa, Hylobates moloch
MAHKYVGLQFQGSVTFEDVAIAFSQQEWERLDSSQRGLYRDVMLENYRNLVSMAGHSLSKPHVIALLEQWKEPEVTVRKDG

SEQ ID NO: 3994 - protein, 81 aa, Hylobates moloch
MAHKYVGLQFQGSVTFEDVAIAFSQQEWERLDSSQRGLYRDVMLENYRNLVSMGHSLSKPHVIALLEQWKEPEVTVRKDGR

SEQ ID NO: 3995 - protein, 81 aa, Hylobates moloch
MPQVTFNDVAIDFSHEEWGWLNSAQRDLYKDVMVQNYENLVSVAGLSVTKPYVITLLEDGKEPWIMEKKLSKGMIPDWESR

SEQ ID NO: 3996 - protein, 81 aa, Hylobates moloch
MPQVTFNDVAIDFSHEEWGWLNSAQRDLYKDVMVQNYENLVSVGLSVTKPYVITLLEDGKEPWIMEKKLSKGMIPDWESRW

SEQ ID NO: 3997 - protein, 81 aa, Hylobates moloch
MPQVTFNDVAIDFSHEEWGWLNSAQRDLYKDVMVQNYENLVSVAGLSVTKPYVITLLEDGKEPWIMEKKLSKDWESRWENK

SEQ ID NO: 3998 - protein, 81 aa, Hylobates moloch
MSQVTFSDVAIDFSHEEWACLDSAQRDLYKDVMVQNYENLVSVAGLSITKPYVIMLLEDGKEPWTVEKKLSKVYPFPLSHS

SEQ ID NO: 3999 - protein, 81 aa, Hylobates moloch
MSQVTFSDVAIDFSHEEWACLDSAQRDLYKDVMVQNYENLVSVGLSITKPYVIMLLEDGKEPWTVEKKLSKDWESRWENKE

SEQ ID NO: 4000 - protein, 81 aa, Hylobates moloch
MSQVTFSDVAIDFSHEEWACLDSAQRDLYKDVMVQNYENLVSVGLSITKPYVIMLLEDGKEPWTVEKKLSKVYPFPLSHSV

SEQ ID NO: 4001 - protein, 81 aa, Hylobates moloch
MSQVTFSDVAIDFSHEEWACLDSAQRDLYKDVMVQNYENLVSVAGLSITKPYVIMLLEDGKEPWTVEKKLSKDWESRWENK

SEQ ID NO: 4002 - protein, 81 aa, Hylobates moloch
NEELVGNHGMEGEACTEGDVTFSDVAIDFSHEEWACLDSAQRDLYKDVMVQNYENLVSVGLSITKPYVIMLLEDGKEPWTV

SEQ ID NO: 4003 - protein, 81 aa, Hylobates moloch
MSQVTFSDVAIDFSHEEWACLDSAQRDLYKDVMVQNYENLVSVGLSITKPYVIMLLEDGKEPWTVEKKLSKGMIPDWESRW

SEQ ID NO: 4004 - protein, 81 aa, Hylobates moloch
MSQVTFSDVAIDFSHEEWACLDSAQRDLYKDVMVQNYENLVSVAGLSITKPYVIMLLEDGKEPWTVEKKLSKGMIPDWESR

SEQ ID NO: 4005 - protein, 81 aa, Hylobates moloch
MLENYRNLAFLGIAVSKPDLITCLEQGKKPWNMKRHEMVDEPPGICPHFAQDLWPEQGMEDSFQKAILRRYEKYGHENLQL

SEQ ID NO: 4006 - protein, 81 aa, Hylobates moloch
IPGPPRSLEMELLTFRDVAIEFSLEEWQHLDVAQQNLYRNVMLENYRNLAFLGIAVSKPDLITCLEQGKKPWNMKRHEMVD

SEQ ID NO: 4007 - protein, 81 aa, Hylobates moloch
MGLLTFRDVAIEFSLEEWQCLDTAQKNLYRNVMLENYRNLAFLGIAVSKPDLIICLEKEKEPWNMKRHEMVDEPPGLAVSN

SEQ ID NO: 4008 - protein, 81 aa, Hylobates moloch
MGLLTFRDVAIEFSLEEWQCLDTAQKNLYRNVMLENYRNLAFLGIAVSKPDLIICLEKEKEPWNMKRHEMVDEPPDGVSLC

SEQ ID NO: 4009 - protein, 81 aa, Hylobates moloch
MGLLTFRDVAIEFSLEEWQCLDTAQKNLYRNVMLENYRNLAFLGIAVSKPDLIICLEKEKEPWNMKRHEMVDEPPVGQTGL

SEQ ID NO: 4010 - protein, 81 aa, Hylobates moloch
MEPLKFRDVAIEFSLEEWQCLDSIQQNLYRNVMLENYRNLVFLGIAASKPDLIICLEQEKEPWSRKRRRMVAELPVICSHF

SEQ ID NO: 4011 - protein, 81 aa, Hylobates moloch
MGLLTFRDVAIEFSLEEWQCLDTAQRNLYKNVILENYRNLVFLGIAVSKQDLITCLKQEKEPLTMKRHEMVDEPPVMCSHF

SEQ ID NO: 4012 - protein, 81 aa, Hylobates moloch
MGLLTFRDVAIEFSLEEWQCLDTAQRNLYKNVILENYRNLVFLGIAVSKQDLITCLKQEKEPLTMKRHEMVDEPPGSVGQT

SEQ ID NO: 4013 - protein, 81 aa, Hylobates moloch
MGLLTFRDVAIEFSLEEWQCLDTAQRNLYKNVILENYRNLVFLGIAVSKQDLITCLKQEKEPLTMKRHEMVDEPPESCSVA

SEQ ID NO: 4014 - protein, 81 aa, Hylobates moloch
MGLLTFRDVAIEFSLEEWQCLDTAQRNLYKNVILENYRNLVFLGIAVSKQDLITCLKQEKEPLTMKRHEMVDEPPALDKNP

SEQ ID NO: 4015 - protein, 81 aa, Hylobates moloch
MGLLTFRDVAIEFSLEEWQCLDTAQQNLYRNVMLENYRNLAFLGIAVSKPDLITCLEQGKEPWNMKRHEMVDEPPGVCPHF

SEQ ID NO: 4016 - protein, 81 aa, Hylobates moloch
TPRTPGSLEMGLLTFRDVAIEFSLEEWQCLDTAQQNLYRNVMLENYRNLAFLGIAVSKPDLITCLEQGKEPWNMKRHEMVD

SEQ ID NO: 4017 - protein, 81 aa, Hylobates moloch
MDVAIEFSVEEWQCLDTAQQNLYRNVMLENYRNLVFLGIAISKPDLITCLEQGKEPWNMERHEMVAKPPGMCCYFAQDLWP

SEQ ID NO: 4018 - protein, 81 aa, Hylobates moloch
MGPLTFMDVAIEFSVEEWQCLDTAQQNLYRNVMLENYRNLVFLGIAISKPDLITCLEQGKEPWNMERHEMVAKPPGMCCYF

SEQ ID NO: 4019 - protein, 81 aa, Hylobates moloch
MGALTFRDVAIEFSLEEWQCLDTEQQNLYRNVMLDNYRNLVFLGIAVSKPDLITCLEQEKEPWNVKTHDMVAEPPVICSHI

SEQ ID NO: 4020 - protein, 81 aa, Hylobates moloch
MGPLTFMDVAIKFSLEEWQFLDTAQQNLYRDVMLENYSNLVFLGVDVSKPDLITCLEQGKEPWNMKRHKMVAKPPVVCSHF

SEQ ID NO: 4021 - protein, 81 aa, Hylobates moloch
RTPGPPGSLEMGSLTFRDVTIEFSLEEWQCLDTAQQNLYRDVMLENYRNLVFLGIAVSKLHLITCLKQGKEPWNMKRHEMA

SEQ ID NO: 4022 - protein, 81 aa, Hylobates moloch
SEKCTRLSLYDLKIALKNGSLTFRDVTIEFSLEEWQCLDTAQQNLYRDVMLENYRNLVFLGIAVSKLHLITCLKQGKEPWN

SEQ ID NO: 4023 - protein, 81 aa, Hylobates moloch
MSGPPGSLEMEPLQFRDVAVEFSLEEWHCLDTAQQNLYRDVMLENYRHLVFLGIVVSKPDLITCLEQGKKPLTMKRHEMIA

SEQ ID NO: 4024 - protein, 81 aa, Hylobates moloch
MELLTFRDVTIEFSLEEWEFLKPAQQNLYRKVMLENYRNLVSLGLTVSKPELISCLEQRQEPWNVKRHETIAKPPGYITAL

SEQ ID NO: 4025 - protein, 81 aa, Hylobates moloch
MLENYRNLVSLGLTVSKPELISCLEQRQEPWNVKRHETIAKPPAISSHYPEDFLPEQGMKDSFQKVILRRYGSCGLEDLHL

SEQ ID NO: 4026 - protein, 81 aa, Hylobates moloch
MGPLQFRDVAIEFSLEEWHCLDTAQRNLYRNVMLENYSNLVFLGIVVSKPDLITRLEQGKKPLTMKRHEMVANPSGTCLLL

SEQ ID NO: 4027 - protein, 81 aa, Hylobates moloch
MGPLQFRDVAIEFSLEEWHCLDTAQRNLYRNVMLENYSNLVFLGIVVSKPDLITRLEQGKKPLTMKRHEMVANPSGPGVFV

SEQ ID NO: 4028 - protein, 81 aa, Hylobates moloch
MEPLQFRDVAIEFSLEEWHCLDTAQRNLYRDVMLENYRHLIFLGIVVSKPDLITSLEYGKKPLTMRRHEMIAKPPDLWPER

SEQ ID NO: 4029 - protein, 81 aa, Hylobates moloch
MGPLQFRDVAIEFSLEEWHCLDTAQRDLYRDVMLENYRHLVFLGIVVSKPDLITCLEQGKKPLTMKRHEMIAKPPVMCSHF

SEQ ID NO: 4030 - protein, 81 aa, Hylobates moloch
LRRYEKCRHDNLHLKKGCESVDECPVHKRSYNGLKQCLTTTQRKIFQCDEYVKFLHKFSNSNKHKIRDTGKRPFKCIEYGK

SEQ ID NO: 4031 - protein, 81 aa, Hylobates moloch
MGPLQFRDVAIEFSLEEWHCLDTAQRDLYRDVMLENYRHLVFLGIVVSKPDLITCLEQGKKPLTMKRHEMIAKPPETGFHR

SEQ ID NO: 4032 - protein, 81 aa, Hylobates moloch
SENEFQRRRRKKKIAFLQGPLQFRDVAIEFSLEEWHCLDTAQRDLYRDVMLENYRHLVFLGIVVSKPDLITCLEQGKKPLT

SEQ ID NO: 4033 - protein, 81 aa, Hylobates moloch
GPLQFRDVAIEFSLEEWHCLDTAQRDLYRDVMLENYRHLVFLGIVVSKPDLITCLEQGKKPLTMKRHEMIAKPPGQAQWLM

SEQ ID NO: 4034 - protein, 81 aa, Hylobates moloch
GPLQFRDVAIEFSLEEWHCLDTAQRDLYRDVMLENYRHLVFLGIVVSKPDLITCLEQGKKPLTMKRHEMIAKPPDGVSLFH

SEQ ID NO: 4035 - protein, 81 aa, Hylobates moloch
GPLQFRDVAIEFSLEEWHCLDTAQRDLYRDVMLENYRHLVFLGIVVSKPDLITCLEQGKKPLTMKRHEMIAKPPVMCSHFA

SEQ ID NO: 4036 - protein, 81 aa, Hylobates moloch
MDSVAFEDVAVNFTQEEWALLSPSQKNLYRDVMLETFRNLASVGIQWKDQNIENLYQNLGIKLRSLVERLCGPQEGSEHRE

SEQ ID NO: 4037 - protein, 81 aa, Hylobates moloch
MESVTFEDVAVEFIQEWALLDSARRSLCRYRMLDQCRTLASRGTPPCKPSCTSQLGPTAEPRATERGIFHATGVAWESQLK

SEQ ID NO: 4038 - protein, 81 aa, Hylobates moloch
EDKMEEEAMAPGLPTTCSQEPVTFADVAVVFTPEEWVFLDSTQRSLYRDVMLENYRNLASVADQPCKPSALSYLEERGEQW

SEQ ID NO: 4039 - protein, 81 aa, Hylobates moloch
MESVTFEDVAVEFIQEWALLDSARRSLCRYRMLDQCRTLASRGTGAVPEDAAGTLHRREGDTIDSRGPASSPGAALVSGMH

SEQ ID NO: 4040 - protein, 81 aa, Hylobates moloch
VLQMQNSEHHGQSIKTQTDSISLEDVAVNFTLEEWALLDPGQRNIYRDVMRATFKNLACIGEKWKDQDIEDDYKNQGRNLR

SEQ ID NO: 4041 - protein, 81 aa, Hylobates moloch
MDSISLEDVAVNFTLEEWALLDPGQRNIYRDVMRATFKNLACIGEKWKDQDIEDDYKNQGRNLRSPMVEALCENKEDRPCG

SEQ ID NO: 4042 - protein, 81 aa, Hylobates moloch
MDSVAFEDVSVSFSQEEWALLAPSQKKLYRDVMQETFKNLASIGEKWEDPSVEDQHKNQGRNLRSHMGERLCEGKEGSQCA

SEQ ID NO: 4043 - protein, 81 aa, Hylobates moloch
MDSVASEDVAVNFTLEEWALLDPSQKKLYRDVMRETFRNLACVGKKWEDQSIEDWYKNQGRILSNHMEEGLSESKEYDQCG

SEQ ID NO: 4044 - protein, 81 aa, Hylobates moloch
SDQRRRSKEARTPGSRDVDSVVFEDVAVNFTQEEWALLGPSQKKLYRDVMQETFVNLASIGENWEEKNIEDHKNQGRKLRS

SEQ ID NO: 4045 - protein, 81 aa, Hylobates moloch
MSSVALEDVAVNFTREEWALLGPCQKNLYKDVMQETIRNLDCVGMKWKDQNIEDQYRYPRKNLRCRMLERFVVSKGGSQCG

SEQ ID NO: 4046 - protein, 81 aa, Hylobates moloch
SSVALEDVAVNFTREEWALLGPCQKNLYKDVMQETIRNLDCVGMKWKDQNIEDQYRYPRKNLRCRMLERFVVSKGGSQCGE

SEQ ID NO: 4047 - protein, 81 aa, Hylobates moloch
MSSVALEDVAVNFTREEWALLGPCQKNLYKDVMQETIRNLDCVGMKWKDQNIEDQYRYPRKNLRCHMLERFVESKDGSQCG

SEQ ID NO: 4048 - protein, 81 aa, Hylobates moloch
RNDFFLPDSQTSEERKQYDSVAFEDVAVNFTREEWALLGPSQKSLYRDVMWETIRNLDCIGMKWEDTNIEDQHKNPRRNLR

SEQ ID NO: 4049 - protein, 81 aa, Hylobates moloch
MDAVDFEDVAVNFTQEEWALLGPSQKNLYRYVMQETIRNLDCIRMIWEDQNTEDQYKNPRRSLRCHMVERFSESKDSSQYG

SEQ ID NO: 4050 - protein, 81 aa, Hylobates moloch
HTHKQRGKAFSYHHSLQSHGRPHTGKKRYECKECGKTFSSRRNLRRHMVVQGGNRPYKFPIDMRECTLGRNRMNVSSVLKP

SEQ ID NO: 4051 - protein, 81 aa, Hylobates moloch
MDSVAFEDVAVNFTHEEWALLGPSQKNLYRDVMQETIRNLNCIGMKWETQNIDDQYQNLRRNPRCDMVERFGKSKDGSQCG

SEQ ID NO: 4052 - protein, 81 aa, Hylobates moloch
TLPRGQPEVLGWGLPKDQDSVAFEDVAVNFTHEEWALLGPSQKNLYRDVMQETIRNLNCIGMKWETQNIDDQYQNLRRNPR

SEQ ID NO: 4053 - protein, 81 aa, Hylobates moloch
KNLYRDVMQETIRNLNCIGMKWETQNIDDQYQNLRRNPRLSETWLQNFILIHYGHLVALSDGGSLRFSTGQGLPVTQAGVQ

SEQ ID NO: 4054 - protein, 81 aa, Hylobates moloch
MDSVAFEDVDVNFTQDEWALLDPSQKNLYRDVMQETFRNLASVGKKWKDQKIEDEYKNPRRNLRGLMGERLLEGKKDHQHG

SEQ ID NO: 4055 - protein, 81 aa, Hylobates moloch
DSVAFEDVDVNFTQDEWALLDPSQKNLYRDVMQETFRNLASVGKKWKDQKIEDEYKNPRRNLSLRKWSWLYPRQTLGLDSP

SEQ ID NO: 4056 - protein, 81 aa, Hylobates moloch
MDSVAFEDVDVNFTQDEWALLDPSQKNLYRDVMQETFRNLASVGKKWKDQKIEDEYKNPRRNLSLRKWSWLYPRQTLGLDS

SEQ ID NO: 4057 - protein, 81 aa, Hylobates moloch
MMFQDSVAFEDVAVSFTQEEWALLDPSQKNLYRDVMQETFKNLTSVGKTWKVQSIEEYKNPRRNLSLMREKLCESKESHHC

SEQ ID NO: 4058 - protein, 81 aa, Hylobates moloch
MDSVAFEDVAVSFTQEEWALLDPSQKNLYRDVMQETFKNLTSVGKTWKVQSIEEYKNPRRNLRRSFTPVTQAGVQWRDLGS

SEQ ID NO: 4059 - protein, 81 aa, Hylobates moloch
MDSVAFEDVAVSFTQEEWALLDPSQKNLYRDVMQETFKNLTSVGKTWKVQSIEEYKNPRRNLSLMREKLCESKESHHCGES

SEQ ID NO: 4060 - protein, 81 aa, Hylobates moloch
MDSVAFKDVAVNFTQEESLLDPSQKNLYREVMHETLRNLASVGEKWKDQNIEDQYKNPRNNLRSLLGERVDENTEENHCGE

SEQ ID NO: 4061 - protein, 81 aa, Hylobates moloch
MDSVAFEDVAVNFTQEEWALLDPSQKNLYREVMQETVRNLASIGKKWNNQYIEDEHQNPRKNLRRLIGERLSESKESHQHG

SEQ ID NO: 4062 - protein, 81 aa, Hylobates moloch
MMFQDSVAFEDVAVTFTQEEWALLDPSQKNLYRDVMQETFKNLASIGKKWKAQNIYVEYKNLRRNLRIVGERLFESKEGHQ

SEQ ID NO: 4063 - protein, 81 aa, Hylobates moloch
MDSVAFEDVAVTFTQEEWALLDPSQKNLYRDVMQETFKNLASIGKKWKAQNIYVEYKNLRRNLRIVGERLFESKEGHQHGE

SEQ ID NO: 4064 - protein, 81 aa, Hylobates moloch
LLVLSILLYTCEMFQDSVAFEDVAVTFTQEEWALLDPSQKNLYRDVMQETFKNLASIGKKWKAQNIYVEYKNLRRNLRIVG

SEQ ID NO: 4065 - protein, 81 aa, Hylobates moloch
MDPVAFEDVAVNFTQEEWALLDISQRKLYREVMLETFRNLTSIGKKWKDQNIEYEYQNPRRNFRSIIEGNVNEIKEDRHCG

SEQ ID NO: 4066 - protein, 81 aa, Hylobates moloch
MMFQDPVAFEDVAVNFTQEEWALLDISQRKLYREVMLETFRNLTSIGKKWKDQNIEYEYQNPRRNFRSIIEGNVNEIKEDR

SEQ ID NO: 4067 - protein, 81 aa, Hylobates moloch
PPVLSLSPILLYTCEMFQDPVAFEDVAVNFTQEEWALLDISQRKLYREVMLETFRNLTSIGKKWKDQNIEYEYQNPRRNFR

SEQ ID NO: 4068 - protein, 81 aa, Hylobates moloch
CSHRSCRKDPGTSESREMDPVAFEDVAVNFTQEEWALLDISQRKLYREVMLETFRNLTSIGKKWKDQNIEYEYQNPRRNFR

SEQ ID NO: 4069 - protein, 81 aa, Hylobates moloch
MPCCSHRSCRKDPGTSESREMRPESSDCKLRPMRNLQREVIESSPVIPALWEAEADGSSQMFQDPVAFEDVAVNFTQEEWA

SEQ ID NO: 4070 - protein, 81 aa, Hylobates moloch
CKLRPMRNLQREVIESSPVIPALWEAEADGSSQMFQDPVAFEDVAVNFTQEEWALLDISQRKLYREVMLETFRNLTSIGVS

SEQ ID NO: 4071 - protein, 81 aa, Hylobates moloch
MDPVAFEDVAVNFTQEEWTLLDISQKNLFREVMLETFRNLTSIGKKWKDQNIDYEYQNPRRSFRSLIEEKVNEIKDDSHCG

SEQ ID NO: 4072 - protein, 81 aa, Hylobates moloch
MFQDPVAFEDVAVNFTQEEWTLLDISQKNLFREVMLETFRNLTSIGKKWKDQNIDYEYQNPRRSFRSLIEEKVNEIKDDSH

SEQ ID NO: 4073 - protein, 81 aa, Hylobates moloch
RSCRKDPGTSESREMMFQDPVAFEDVAVNFTQEEWTLLDISQKNLFREVMLETFRNLTSIGKKWKDQNIDYEYQNPRRSFR

SEQ ID NO: 4074 - protein, 81 aa, Hylobates moloch
CSHRSCRKDPGTSESREMDPVAFEDVAVNFTQEEWTLLDISQKNLFREVMLETFRNLTSIGKKWKDQNIDYEYQNPRRSFR

SEQ ID NO: 4075 - protein, 81 aa, Hylobates moloch
MPCCSHRRCREDPGTSESQEMEEWALLDISQRKLYREVMLETFGNLASIGKSWKDQNIEYEYQNPRRNFRRLIEKKVNEIK

SEQ ID NO: 4076 - protein, 81 aa, Hylobates moloch
CSHRRCREDPGTSESQEMDSVAFKDVAVNFTQEEWALLDISQRKLYREVMLETFGNLASIGKSWKDQNIEYEYQNPRRNFR

SEQ ID NO: 4077 - protein, 81 aa, Hylobates moloch
MMFQDSVAFKDVAVNFTQEEWALLDISQRKLYREVMLETFGNLASIGKSWKDQNIEYEYQNPRRNFRRLIEKKVNEIKEDS

SEQ ID NO: 4078 - protein, 81 aa, Hylobates moloch
MDAVAFKDVAVNFTQEEWALLDISQRKLYREVMLETFRNLTSIGKSWKDKNIEYEYQNPRRNFRSVIEEKVNEIKDDSHCG

SEQ ID NO: 4079 - protein, 81 aa, Hylobates moloch
MFQDAVAFKDVAVNFTQEEWALLDISQRKLYREVMLETFRNLTSIGKSWKDKNIEYEYQNPRRNFRSVIEEKVNEIKDDSH

SEQ ID NO: 4080 - protein, 81 aa, Hylobates moloch
MMFQDAVAFKDVAVNFTQEEWALLDISQRKLYREVMLETFRNLTSIGKSWKDKNIEYEYQNPRRNFRSVIEEKVNEIKDDS

SEQ ID NO: 4081 - protein, 81 aa, Hylobates moloch
MDSVAFEDVAINFTCEEWALLGPSQKSLYRDVMQETIRNLDCIGMTWQTHDIEEDQYKDLRRNLRCHMVERSCEIKDNSQC

SEQ ID NO: 4082 - protein, 81 aa, Hylobates moloch
MDSVAFEDVAVNFTQEEWALLGPSQKSLYRNVMQETIRNLDCIEMKWEDQNIGDQCQNARRNLRSHTCEIKDDSQCGETFG

SEQ ID NO: 4083 - protein, 81 aa, Hylobates moloch
MDSVAFEDVAVNFTLEEWALLDPSQKNLYRDVMRETFRNLASIGKQWEDQNIEDPFKIPRRNISHIPERLCESKEGSQGEE

SEQ ID NO: 4084 - protein, 81 aa, Hylobates moloch
MDSSQHLVTFEDVAVDFPQEEWTLLDQTQRDFYRDVMLENYKNLIILAGLCKPCFMSGLEQMEELRTGVTGVLQGEKQYCR

SEQ ID NO: 4085 - protein, 81 aa, Hylobates moloch
EKTKAERMVEDYLANGYQDSVTFDDVAVDFTPEEWALLDTTEKYLYRDVMLENYMNLASVEWEIQPRTKWSSLQQGFLKNQ

SEQ ID NO: 4086 - protein, 81 aa, Hylobates moloch
FFSREPICPFEEKTKAERMVEDYLANGYQDSVTFDDVAVDFTPEEWALLDTTEKYLYRDVMLENYMNLASVDKRLQWMETL

SEQ ID NO: 4087 - protein, 81 aa, Hylobates moloch
EKTPAGRIVADCLTNCYQDSVTFDDVAVDFTQEEWTLLDSTQRSLYSDVMLENYKNLATVGGHIIKPSLISWLEQEESRTV

SEQ ID NO: 4088 - protein, 81 aa, Hylobates moloch
MDSVTFDDVAVDFTQEEWTLLDSTQRSLYSDVMLENYKNLATVGGHIIKPSLISWLEQEESRTVNGGVLQGWEMQLEAQWS

SEQ ID NO: 4089 - protein, 81 aa, Hylobates moloch
MAYSLTNCYQDSVTFEDTAVDFTQEEWTLLDPVQRNLYRDVMLENYENVAKVGFQLLKPSVISWLEEEELRTFQQGVLQDW

SEQ ID NO: 4090 - protein, 81 aa, Hylobates moloch
EKTEVERVVADCLTNCYQDSVTFDDLAVDFTPEEWTLLDPTQRNLYRDVMLENYKNLATVGCQLFKPSLISWLEQEESRTV

SEQ ID NO: 4091 - protein, 81 aa, Hylobates moloch
LVAGWLTNYSQDSVTFEDVAVDFTQEEWTLLDQTQRNLYRDVMLENYKNLVAVDWESRINTKWSAPQENFLQGKTSSVVEM

SEQ ID NO: 4092 - protein, 81 aa, Hylobates moloch
MEEERKTAELQKNRIRDSVVFEDVAVDFTQEEWALLDLAQRNLYRDVMLENFQNLASLGYPLHTPHLISQWEQEEDLQTVK

SEQ ID NO: 4093 - protein, 81 aa, Hylobates moloch
SSKDHSCPQNLNLFVCSGLEPHTPSVGSQESVTFQDIAVDFTEKEWPLLDSSQRKLYKDVMLENYSNLTSLEILAPPFCCS

SEQ ID NO: 4094 - protein, 81 aa, Hylobates moloch
NLFVCSGLEPHTPSVGSQESVTFQDIAVDFTEKEWPLLDSSQRKLYKDVMLENYSNLTSLGYQVGKPSLISHLEQEEEPRT

SEQ ID NO: 4095 - protein, 81 aa, Hylobates moloch
NLFVCSGLEPHTPSVGSQESVTFQDIAVDFTEKEWPLLDSSQRKLYKDVMLENYSNLTSLDWETPSKTKWSLLMEDIFGKE

SEQ ID NO: 4096 - protein, 81 aa, Hylobates moloch
GHTEGGELVNELLTSWLQGLVTFEDVAVEFTQEEWALLDPAQRTLYRDVMLENCRNLASLGCRVNKPSLISQLEQDKKVMT

SEQ ID NO: 4097 - protein, 81 aa, Hylobates moloch
GHTEGGELVNELLTSWLQGLVTFEDVAVEFTQEEWALLDPAQRTLYRDVMLENCRNLASLDLETLLKAKWLTPKKHVFRKE

SEQ ID NO: 4098 - protein, 81 aa, Hylobates moloch
MSQDSVTFADVAVNFTNEEWTLLDPAQRNLYRDVMLENSRNLAFIDWATPCKTKDTTPQPDILPKRTFPEANRVCLTSISS

SEQ ID NO: 4099 - protein, 81 aa, Hylobates moloch
PSSASQVAGTTGTRPHSWDSVTFADVAVNFTNEEWTLLDPAQRNLYRDVMLENSRNLAFIDWATPCKTKDTTPQPDILPKR

SEQ ID NO: 4100 - protein, 81 aa, Hylobates moloch
MAEEFVTLRDVGLDFPLEDWEQLGLEQGDMFWDTALDNCQDLFLLDPPRPNLTSHADGGEDLEPLAGGSPEATGPDVTETK

SEQ ID NO: 4101 - protein, 81 aa, Hylobates moloch
LDFPLEDWEQLGLEQGDMFWDTALDNCQDLFLLDPPRPNLTSHADGGEDLEPLAGGSPEATGPDVTETKNSPPMENFLEEG

SEQ ID NO: 4102 - protein, 81 aa, Hylobates moloch
MAEEFVTLRDVGLDFPLEDWEQLGLEQGDMFWDTALDNCQDLFLLDPPRPNLTSHADGGEDLEPLAGGSPEATGPVNRRHL

SEQ ID NO: 4103 - protein, 81 aa, Hylobates moloch
MANGTLMAEGQESVTFKDVAVDFTLEEWGWLEPGQRELYRDVMLENYRNLLSLDLETSSVTIRETPRKKSISEDSASPVEG

SEQ ID NO: 4104 - protein, 81 aa, Hylobates moloch
MANGTLMAEGQESVTFKDVAVDFTLEEWGWLEPGQRELYRDVMLENYRNLLSLGAGLPGSKPDVISRLERGEEPRQEEREA

SEQ ID NO: 4105 - protein, 81 aa, Hylobates moloch
LSQKPQVPGPEEQDGSCEASVSFEDVTVDFSREEWQQLDPAQRWLYQDVMLELYSHLFSVGYHIPNPDVIFRMLKEKEPRV

SEQ ID NO: 4106 - protein, 81 aa, Hylobates moloch
NQIQPVSHSAFFNKQTLNTESNCEYKDPGKMIHTWPHLASSQKQPQKCCLFAKSLKLNLEVNGQNESNDTAQLDDVVGSGQ

SEQ ID NO: 4107 - protein, 81 aa, Hylobates moloch
NATIVMSVRREQGSSSREGSLSFEDVAVGFTREEWQFLDQSQKVLYKEVMLENYSNLVSVGYQVTKPDALFKLEQGEPPWI

SEQ ID NO: 4108 - protein, 81 aa, Hylobates moloch
MTKAQESLTLKDVAVDFTREEWQLLGPAQKHLYRDVMLENYSNLVSVGYQASKPDALIELEQGEPLWTLEDEIHSPTHPEI

SEQ ID NO: 4109 - protein, 81 aa, Hylobates moloch
MLENYSNLVSVGYQASKPDALFKLEQGEPWTVENDSHICPEIKKVDNHLQIHSQNQRCLKRVEQCHKHNAFGNIIHQRKSD

SEQ ID NO: 4110 - protein, 81 aa, Hylobates moloch
ENYSNLVSVGYQASKPDALFKLEQGEPWTVENDSHICPEIKKVDNHLQIHSQNQRCLKRVEQCHKHNAFGNIIHQRKSDFP

SEQ ID NO: 4111 - protein, 81 aa, Hylobates moloch
MIKSQESLTLEDVAVEFTWEEWQLLGPAQKDLYRDVMLENYSNLVSVGYQASKPDALFKLEQGEPWTVENDSHICPEIKKV

SEQ ID NO: 4112 - protein, 81 aa, Hylobates moloch
MIQAQESVTLEDVAVDFTWEEWQLLGAAQKDLYRDVMMENYSNLVAVGYQPSKPDALFKLEQGEQPWTTEDGIHSGACSDI

SEQ ID NO: 4113 - protein, 81 aa, Hylobates moloch
MMQAQESLTLEDVAVDFTWEEWQFLSPAQKDLYRDVMLENYSNLVAVGYQARKPDALSKLERGEEPCTTEDEIYARICSDS

SEQ ID NO: 4114 - protein, 81 aa, Hylobates moloch
MMQAQESLTLEDVAVDFTWEEWQFLSPAQKDLYRDVMLENYSNLVAVGYQARKPDALSKLERGEEPCTTEDEIYARICSEI

SEQ ID NO: 4115 - protein, 81 aa, Hylobates moloch
MRPEQTKFWEESLTLEDVAVDFTWEEWQFLSPAQKDLYRDVMLENYSNLVAVGYQARKPDALSKLERGEEPCTTEDEIYAR

SEQ ID NO: 4116 - protein, 81 aa, Hylobates moloch
MESLTLEDVAVDFTWEEWQFLSPAQKDLYRDVMLENYSNLVAVGYQARKPDALSKLERGEEPCTTEDEIYARICSDSGGAS

SEQ ID NO: 4117 - protein, 81 aa, Hylobates moloch
MIKTQESLSLEDVAVEFSWEEWQLLDTAQKNLYRDVMVENYNHLVSLGYQTSKPDVLSKLAHGQEPWITDAKIQNKNCPGI

SEQ ID NO: 4118 - protein, 80 aa, Hylobates moloch
MIKTQESLSLEDVAVEFSWEEWQLLDTAQKNLYRDVMVENYNHLVSLGYQTSKPDVLSKLAHGQEPWITDAKIQNKNCPD

SEQ ID NO: 4119 - protein, 81 aa, Hylobates moloch
MINAQELLTLEDVTVEFTWEEWQLLDPFQKDLYRDVMLEIYSNLVSIGYQVSKPDALSKLERGEEPWTVEDERHSQICPEN

SEQ ID NO: 4120 - protein, 81 aa, Hylobates moloch
MINAQELLTLEDVTVEFTWEEWQLLDPFQKDLYRDVMLEIYSNLVSIGYQVSKPDALSKLERGEEPWTVEDERHSQICPGT

SEQ ID NO: 4121 - protein, 81 aa, Hylobates moloch
EAQERKKKEKEPGMALPQGSLTFRDVAVEFSQEEWKSLDPVQKALYRDVMLENYRNLGFLGLCLPDLNIISMLEQGKEPWT

SEQ ID NO: 4122 - protein, 81 aa, Hylobates moloch
MALPQGSLTFRDVAVEFSQEEWKSLDPVQKALYRDVMLENYRNLGFLGLCLPDLNIISMLEQGKEPWTVVSQVKIAKNPNC

SEQ ID NO: 4123 - protein, 81 aa, Hylobates moloch
MATQGPLTFKDVAIEFSQEEWKCLEPVQKALYKDVMLENYRNLVFLGISPKCVIKELPPTENSDTGERFQTVTLERHQSYD

SEQ ID NO: 4124 - protein, 81 aa, Hylobates moloch
MAFTQGPLTFRDVAIEFSQEEWKSLDPVQKALYWDVMLENYRNLVFLGILPKCMTKELPPVGNSNTGEKFQTVMLERHECY

SEQ ID NO: 4125 - protein, 81 aa, Hylobates moloch
LDPVQKALYWDVMLENYRNLVFLGILPKCMTKELPPVGNSNTGEKFQTVMLERHECYDVENFYLREIQKNLQDLEFQWKDG

SEQ ID NO: 4126 - protein, 81 aa, Hylobates moloch
MAFTQGPLTFRDVAIEFSQEEWKSLDPVQKALYWDVMLENYRNLVFLGKDNFALEVKICPRVFLYFLCCLSWEPFHYLTET

SEQ ID NO: 4127 - protein, 81 aa, Hylobates moloch
MAQLRRGHLTFRDVAIEFSQEEWKCLDPVQKALYRDVMLENYRNLVSLGICLPDLSVISMMKQRTEPWTVENEMKVAKNPD

SEQ ID NO: 4128 - protein, 81 aa, Hylobates moloch
CFHRVKSSLRVWLWHSKKGHLTFRDVAIEFSQEEWKCLDPVQKALYRDVMLENYRNLVSLGICLPDLSVISMMKQRTEPWT

SEQ ID NO: 4129 - protein, 81 aa, Hylobates moloch
EGEAQKRKAEESGMPLTQGHLTFRDVAIEFSQEEWKCLDPVQKALYRDVMLENYRNLVSLGICLPDLSVISMMKQRTEPWT

SEQ ID NO: 4130 - protein, 81 aa, Hylobates moloch
MLENYRNLVSLGICLPDLSVISMMKQRTEPWTVENEMKVAKNPDRWEGIKDINTGRNCAVRSQAGSKPITNQLGLTFHLPL

SEQ ID NO: 4131 - protein, 81 aa, Hylobates moloch
MGHLTFRDVAIEFSQEEWKCLDPVQKALYRDVMLENYRNLVSLGICLPDLSVISMMKQRTEPWTVENEMKVAKNPDRWEGI

SEQ ID NO: 4132 - protein, 81 aa, Hylobates moloch
AQKRRKRKAKESGMALPQGHLTFRDVAIEFSQAEWKCLDPAQRALYKDVMLENYRNLVSLGISLPDLNINSVLEQRREPWS

SEQ ID NO: 4133 - protein, 81 aa, Hylobates moloch
DEEAQKRKAKESGMALPQGHLTFMDVAIEFSQEEWKSLDPGQRALYRDVMLENYRNLVSLGICLPDLSIISMLKQRREPLT

SEQ ID NO: 4134 - protein, 81 aa, Hylobates moloch
MLRRGHLTFRDVAIEFSQEEGKCLDPAQRTLYRDVMLENYRNLVFLGICLPDLSVISMLEQRRDPQNLQSEVKIANNQGGR

SEQ ID NO: 4135 - protein, 81 aa, Hylobates moloch
MLRRGHLTFRDVAIEFSQEEGKCLDPAQRTLYRDVMLENYRNLVFLGICLPDLSVISMLEQRRDPQNLQSEVKIANNQGSC

SEQ ID NO: 4136 - protein, 81 aa, Hylobates moloch
MAFTQGPLKFMDVAIEFSQEEWKCLDPAQRTLYRDVMLENYRNLVSLGICLPDLSVISMLEQKKDPWTLQSEEKIANNPDS

SEQ ID NO: 4137 - protein, 81 aa, Hylobates moloch
MDVAIEFSQEEWKCLDPAQRTLYRDVMLENYRNLVSLGICLPDLSVISMLEQKKDPWTLQSEEKIANNPDSRECINGVNTV

SEQ ID NO: 4138 - protein, 81 aa, Hylobates moloch
LYRDVMLENYRNLVSLGICLPDLSVISMLEQKKDPWTLQSEEKIANNPDSRECINGVNTDSPLLQCITSVPCVFCTASMIY

SEQ ID NO: 4139 - protein, 81 aa, Hylobates moloch
MALTQGQLSFRDVAIEFSQEEWKCLDPGQKALYKDVMLENYRNLVSLGICLPDLSVISMLEQKKDPWTLQSEVKIAKNPNG

SEQ ID NO: 4140 - protein, 81 aa, Hylobates moloch
MALTQGQLSFRDVAIEFSQEEWKCLDPGQKALYKDVMLENYRNLVSLGEENVPPEACLCSGICLPDLSVISMLEQKKDPWT

SEQ ID NO: 4141 - protein, 81 aa, Hylobates moloch
MALTQGQLSFRDVAIEFSQEEWKCLDPGQKALYKDVMLENYRNLVSLDFSLLAWDALVFAVEAWRTSGGAEEPTSPNFGGN

SEQ ID NO: 4142 - protein, 81 aa, Hylobates moloch
MALPQGRLTFRDVAIEFSLAEWKFLNPSQRALYREVMLENYRNLEAVDISSKCMMKEVLSTGQGNSEVFYTGTLQRHESHH

SEQ ID NO: 4143 - protein, 81 aa, Hylobates moloch
ETQKRKRKAKESGMALPQGLLTFRDVAIEFSQEEWKCLDPAQRTLYRDVMLENYRNLVSLDISSKCMMNMFSSTGQGNTEV

SEQ ID NO: 4144 - protein, 81 aa, Hylobates moloch
MALPQGLLTFRDVAIEFSQEEWKCLDPAQRTLYRDVMLENYRNLVSLDISSKCMMNMFSSTGQGNTEVIHTGTLQRHASHH

SEQ ID NO: 4145 - protein, 81 aa, Hylobates moloch
MALPQGLLTFRDVAIEFSQEEWKCLDPAQRTLYRDVMLENYRNLVSLGQGNTEVIHTGTLQRHASHHTGDTCFQEIEKDIH

SEQ ID NO: 4146 - protein, 81 aa, Hylobates moloch
MALPQGLLTFRDVAIEFSQEEWKCLDPAQRTLYRDVMLENYRNLLSLDIFSKCEIKELPPKKKSNTGEVFQTAMLERHESH

SEQ ID NO: 4147 - protein, 81 aa, Hylobates moloch
LDPAQRTLYRDVMLENYRNLLSLDIFSKCEIKELPPKKKSNTGEVFQTAMLERHESHDIQDFCFRETQKNVHDSQCLQRHD

SEQ ID NO: 4148 - protein, 81 aa, Hylobates moloch
DPAQRTLYRDVMLENYRNLLSLDIFSKCEIKELPPKKKSNTGEVFQTAMLERHESHDIQDFCFRETQKNVHDSQCLQRHDE

SEQ ID NO: 4149 - protein, 81 aa, Hylobates moloch
AIEFSQEEWKCLDPAQRTLYRDVMLENYRNLLSLDIFSKCEIKELPPKKKSNTGEVFQTAMLERHESHDIQDFCFRETQKN

SEQ ID NO: 4150 - protein, 81 aa, Hylobates moloch
MALPQGLLTFRDVAIEFSQEEWKCLDPAQRTLYRDVMLENYRNLLSLGHDLIFFFPRWSFSCCPGWSAMARSRLTTTSASR

SEQ ID NO: 4151 - protein, 81 aa, Hylobates moloch
RNLLSLGHDLIFFFPRWSFSCCPGWSAMARSRLTTTSASRVQAILPPQPQKLELEIFFLNVRSRNYHQKRRVIQEKYSRRQ

SEQ ID NO: 4152 - protein, 81 aa, Hylobates moloch
MALPQGLLTFRDVAIEFSQEEWKCLDPAQRTLYRDVMLENYRNLLSLDGVSLVAPAGVQWHDLGSPQPLPPGFKRFSRLSL

SEQ ID NO: 4153 - protein, 81 aa, Hylobates moloch
HEETTKKTKEKEIRMALPQGRLTFRDVAIEFSLEEWKCLNSAQRALYREVMLENYRNLEAVAPAPGKYTPPRCKCLTPNPP

SEQ ID NO: 4154 - protein, 81 aa, Hylobates moloch
EEAAQKRKGKEPGMALPQGRLTFRDVAIEFSLAEWKFLNPSQRALYREVMLENYRNLEAVDISSKRLKKEVLSTGQGNTEV

SEQ ID NO: 4155 - protein, 81 aa, Hylobates moloch
EEAAQKRKGKEPGMALPQGRLTFRDVAIEFSLAEWKFLNPSQRALYREVMLENYRNLEAVESHFVTQAGVQWCDLGSLQLL

SEQ ID NO: 4156 - protein, 80 aa, Hylobates moloch
MLHEEAAQKRKGKEPGMALPQGRLTFRDVAIEFSLAEWKFLNPSQRALYREVMLENYRNLEAVETGFHSVSQDGLNLLTS

SEQ ID NO: 4157 - protein, 81 aa, Hylobates moloch
MALPQGLLTFRDVAIDFSQEEWKCLDPAQRTLYRDVMLENYRNLVSLDTSSKCMMKIFFSTGQGNTEVFHMGTLQTQASHH

SEQ ID NO: 4158 - protein, 81 aa, Hylobates moloch
MALPQGLLTFRDVAIDFSQEEWKCLDPAQRTLYRDVMLENYRNLVSLEFRSVTQAKVQWCHLSSLQPPLPRFKQFSCLSLP

SEQ ID NO: 4159 - protein, 81 aa, Hylobates moloch
MALPQGLLTFRDVAIEFSQEEWKCLDPAQRTLYRDVMLENYRNLVSLDISSKCMLKTLSSTGQGNTEVFHTRTLHRQASHH

SEQ ID NO: 4160 - protein, 81 aa, Hylobates moloch
MAFSQGLLTFRDVAIEFSQEEWKCLDPAQRTLYRDVMLENYRNLVSLDTSSKCMMTTLSSTGQGNTEVFHTGTLQRQASYR

SEQ ID NO: 4161 - protein, 81 aa, Hylobates moloch
MALPQGLLTFRDVAIEFSQEEWKCLDPAQRTLYRDVMLENYRNLVSLDISSKCLAKEFSSTGQGNTEVIHTGTLQRHESHH

SEQ ID NO: 4162 - protein, 81 aa, Hylobates moloch
GCLTFRDVAIEFSLEEWKCLNPAQRALYRAVMLENYRNLEFVDISSKCMMKKFSSTGQGNTEVIHTGTLQRHESHPIRDFC

SEQ ID NO: 4163 - protein, 81 aa, Hylobates moloch
GCLTFRDVAIEFSLEEWKCLNPAQRALYRAVMLENYRNLEFVDSSLKSMMEFLPTGHGNTREEFHTGTLERHKSHHIGDFC

SEQ ID NO: 4164 - protein, 81 aa, Hylobates moloch
MALLQGCLTFRDVAIEFSLEEWKCLNPAQRALYRAVMLENYRNLEFVGEENVPPDMRNLHLSILALPDFVFSFVMLLHTCF

SEQ ID NO: 4165 - protein, 81 aa, Hylobates moloch
MLENYWNLVSLGLCHFDMNIISMLEEGKEPWTVKSCVKIARKPRMRECVKSVVTDIPLKRTIKDLLPKEKSSTEAVFHTVV

SEQ ID NO: 4166 - protein, 81 aa, Hylobates moloch
CTGHGPGKGSHPDMDGDGVRLTFRDVAIEFSQEEWKCLDPAQRILYRDVMLENYWNLVSLGLCHFDMNIISMLEEGKEPWT

SEQ ID NO: 4167 - protein, 81 aa, Hylobates moloch
MAVTQLTFRDVAIEFSQEEWKCLNSTQRTLYRDVMLENYRNLVSLDLSRNCVIKELAPQWESNTGEVFHTVTLEQHEKHDI

SEQ ID NO: 4168 - protein, 81 aa, Hylobates moloch
MAVTQLTFRDVAIEFSQEEWKCLNSTQRTLYRDVMLENYRNLVSLEYSLMWEHREEPWTIESQVQIARKPKGWEWIKGVKI

SEQ ID NO: 4169 - protein, 81 aa, Hylobates moloch
MDGDGLTFRDVAIEFSQEEWKCLNSTQRTLYRDVMLENYRNLVSLDLSRNCVIKELAPQWESNTGEVFHTVTLEQHEKHDI

SEQ ID NO: 4170 - protein, 81 aa, Hylobates moloch
HEEETQKRRAEESGMAVTQLTFRDVAIEFSQEEWKCLNSTQRTLYRDVMLENYRNLVSLDLSRNCVIKELAPQWESNTGEV

SEQ ID NO: 4171 - protein, 81 aa, Hylobates moloch
MDGDGLTFRDVAIEFSQEEWKCLNSTQRTLYRDVMLENYRNLVSLEYSLMWEHREEPWTIESQVQIARKPKGWEWIKGVKI

SEQ ID NO: 4172 - protein, 81 aa, Hylobates moloch
MALTQGQVTFRDVAIEFSQEEWTCLDPAQRTLYRDVMLENYRNLASLGISCFDLSIISMLEQGKEPFTVESQVQIARNPDR

SEQ ID NO: 4173 - protein, 81 aa, Hylobates moloch
MLENYRNLASLGISCFDLSIISMLEQGKEPFTVESQVQIARNPDRWEWIKAMITALSSEFVMKDLPHKGKSDTGEVFQTVM

SEQ ID NO: 4174 - protein, 81 aa, Hylobates moloch
SMLEQGKEPFTVESQVQIARNPDRWEWIKAMITALSSEFVMKDLPHKGKSDTGEVFQTVMLERQESHDIEGCSFREVQKNT

SEQ ID NO: 4175 - protein, 81 aa, Hylobates moloch
MALPQGLLTFRDVAIEFSQEEWTCLDPAQKTLYRDAMLENYRNLVSLDTSCKCVNKDLPSKGKSNMREAFYTVKLERLESH

SEQ ID NO: 4176 - protein, 81 aa, Hylobates moloch
MIQSQISFEDVAVDFTLEEWQLLNPTQKNLYRDVMLENYSNLVFLGFQILKPDAIFKLEQQDPWIIDQEILNQNFSEVWLD

SEQ ID NO: 4177 - protein, 81 aa, Hylobates moloch
FGNLPGVPWAQGNSALPEGLLSFKDISMEFTWDEWQLLDSTQKYLYRDVILENYHNLISVGYHGTKPDLIFKLEQGEDPWI

SEQ ID NO: 4178 - protein, 81 aa, Hylobates moloch
MSQGSVTFRDVAIDFSQEEWKWLQPAQRDLYRCVMLENYGHLVSLGLSISKPDVVSLLEQGKEPWLGKRDVKRDLFSVSES

SEQ ID NO: 4179 - protein, 81 aa, Hylobates moloch
MLENYGHLVSLGLSISKPDVVSLLEQGKEPWLGKRDVKRDLFSVSESSGEIKDFSPKNVIYDDSSQYLIMERILSQGPVYS

SEQ ID NO: 4180 - protein, 81 aa, Hylobates moloch
MSQGSVTFRDVAIDFSQEEWKWLQPAQRDLYRCVMLENYGHLVSLAGLSISKPDVVSLLEQGKEPWLGKRDVKRDLFSVRV

SEQ ID NO: 4181 - protein, 81 aa, Hylobates moloch
MSQGSVTFRDVAIDFSQEEWKWLQPAQRDLYRCVMLENYGHLVSLGLSISKPDVVSLLEQGKEPWLGKRDVKRDLFSVLKE

SEQ ID NO: 4182 - protein, 81 aa, Hylobates moloch
REFGGMRAGHADICLSFQGSVTFRDVAIDFSQEEWKWLQPAQRDLYRCVMLENYGHLVSLGLSISKPDVVSLLEQGKEPWL

SEQ ID NO: 4183 - protein, 81 aa, Hylobates moloch
RNAEEERMIAVFLTTWLQEPMSFKDVAVEFTQEEWMMLDSAQRSLYRDVMLENYRNLTSVEYQLCRLTVISPLDQEEIRNM

SEQ ID NO: 4184 - protein, 81 aa, Hylobates moloch
MDAKSLTAWSQTLVTFKDVFVDFTREEWKLLDTAQQIVYRNVMLENYKNLVSLGYQLTKPDVILRLEKGEEPWLMERGIHQ

SEQ ID NO: 4185 - protein, 81 aa, Hylobates moloch
VLEWLFISQEQPKITKSWGPLSFMDVFVDFTWEEWLLLDPAQKCLYRSVMLENYSNLVSLGYQHTKPDVIFKLEQGEELCM

SEQ ID NO: 4186 - protein, 81 aa, Hylobates moloch
MDVFVDFTWEEWLLLDPAQKCLYRSVMLENYSNLVSLGYQHTKPDVIFKLEQGEELCMVQAQVPNQSCPNTVWKIDDLMDW

SEQ ID NO: 4187 - protein, 81 aa, Hylobates moloch
LLDPAQKCLYRSVMLENYSNLVSLGYQHTKPDVIFKLEQGEELCMVQAQVPNQSCPNTVWKIDDLMDWHQENKDKLGSTAK

SEQ ID NO: 4188 - protein, 81 aa, Hylobates moloch
KQKSHRTEKVLEWLFISQEQPKITKSWEWLLLDPAQKCLYRSVMLENYSNLVSLGYQHTKPDVIFKLEQGEELCMVQAQVP

SEQ ID NO: 4189 - protein, 81 aa, Hylobates moloch
MATRVRTASIWGPLSFMDVFVDFTWEEWLLLDPAQKCLYRSVMLENYSNLVSLGYQHTKPDVIFKLEQGEELCMVQAQVPN

SEQ ID NO: 4190 - protein, 81 aa, Hylobates moloch
LLDPAQKCLYRSVMLENYSNLVSLGYQHTKPDVIFKLEQGEELCMVQAQVPNQSCPILKAGKSKAKVLAGLVSGEGLPCAS

SEQ ID NO: 4191 - protein, 81 aa, Hylobates moloch
SFMDVFVDFTWEEWLLLDPAQKCLYRSVMLENYSNLVSLGYQHTKPDVIFKLEQGEELCMVQAQVPNQSCPILKAGKSKAK

SEQ ID NO: 4192 - protein, 81 aa, Hylobates moloch
MLENYRNLLSLGGHSISKPVVVDLLERGKEPWMILREETEFTDLDLQCEIISYIEVPTYETDISSTQLQSIYKREKLYECK

SEQ ID NO: 4193 - protein, 81 aa, Hylobates moloch
HRVGLIRSYNSKTMTCFQELVTFRDVAIDFSRQEWEYLDPNQRDLYRDVMLENYRNLLSLGGHSISKPVVVDLLERGKEPW

SEQ ID NO: 4194 - protein, 81 aa, Hylobates moloch
HRVGLIRSYNSKTMTCFQELVTFRDVAIDFSRQEWEYLDPNQRDLYRDVMLENYRNLLSLEMRSRCVAQVGLKLLVSSDPP

SEQ ID NO: 4195 - protein, 81 aa, Hylobates moloch
TCNWGRPLKFCPTKYMKFQELVTFRDVAIDFSRQEWEYLDPNQRDLYRDVMLENYRNLLSLGGHSISKPVVVDLLERGKEP

SEQ ID NO: 4196 - protein, 81 aa, Hylobates moloch
EPHRVGLIRSYNSKTMTCELVTFRDVAIDFSRQEWEYLDPNQRDLYRDVMLENYRNLLSLGGHSISKPVVVDLLERGKEPW

SEQ ID NO: 4197 - protein, 81 aa, Hylobates moloch
CNWGRPLKFCPTKYMKFQELVTFRDVAIDFSRQEWEYLDPNQRDLYRDVMLENYRNLLSLGGHSISKPVVVDLLERGKEPW

SEQ ID NO: 4198 - protein, 81 aa, Hylobates moloch
MTCFQELVTFRDVAIDFSRQEWEYLDPNQRDLYRDVMLENYRNLLSLGGHSISKPVVVDLLERGKEPWMILREETEFTDLD

SEQ ID NO: 4199 - protein, 81 aa, Hylobates moloch
MTCFQELVTFRDVAIDFSRQEWEYLDPNQRDLYRDVMLENYRNLLSLDLDLQCEIISYIEVPTYETDISSTQLQSIYKREK

SEQ ID NO: 4200 - protein, 81 aa, Hylobates moloch
MACGSITFGDVAIDFSHQEWEYLNLVQKTLYQEVMMENYDNLVSLGHSISKPDLITLLEQGKEPWMIVREETRGECTDLDS

SEQ ID NO: 4201 - protein, 81 aa, Hylobates moloch
MACGSITFGDVAIDFSHQEWEYLNLVQKTLYQEVMMENYDNLVSLGHSISKPDLITLLEQGKEPWMIVREETRGECTAELQ

SEQ ID NO: 4202 - protein, 81 aa, Hylobates moloch
MACGSITFGDVAIDFSHQEWEYLNLVQKTLYQEVMMENYDNLVSLAGHSISKPDLITLLEQGKEPWMIVREETRGECTDLD

SEQ ID NO: 4203 - protein, 81 aa, Hylobates moloch
MACDLVMFRDVAVDFSQEEWECLNSYQRNLYRDVILENYSNLVSLAGCSISKPDVITLLEQGKEPWMVVRDEKRRWTLDLE

SEQ ID NO: 4204 - protein, 81 aa, Hylobates moloch
MACDLVMFRDVAVDFSQEEWECLNSYQRNLYRDVILENYSNLVSLGCSISKPDVITLLEQGKEPWMVVRDEKRRWTLDLES

SEQ ID NO: 4205 - protein, 81 aa, Hylobates moloch
MACDLVMFRDVAVDFSQEEWECLNSYQRNLYRDVILENYSNLVSLGCSISKPDVITLLEQGKEPWMVVRDEKRRWTLGPTF

SEQ ID NO: 4206 - protein, 81 aa, Hylobates moloch
MAHALVTFRDVAIDFSQKEWECLDTTQRKLYRDVMLENYNNLVSLGYSGSKPDVITLLEQGKEPCMAARDVTGRQYPGLLS

SEQ ID NO: 4207 - protein, 81 aa, Hylobates moloch
MAHALVTFRDVAIDFSQKEWECLDTTQRKLYRDVMLENYNNLVSLAGYSGSKPDVITLLEQGKEPCMAARDVTGRQYPGLL

SEQ ID NO: 4208 - protein, 81 aa, Hylobates moloch
MPHLLVTFRDVAIDFSQEEWECLDPAQRDLYRDVMLENYSNLISLDLESSRTTKKLSPEKEIDEMESLQWENMEKLINHQY

SEQ ID NO: 4209 - protein, 81 aa, Hylobates moloch
MDLLFQLLVTFRDVAIDFSQEEWECLDPAQRDLYRDVMLENYSNLISLDLESSRTTKKLSPEKEIDEMESLQWENMEKLIN

SEQ ID NO: 4210 - protein, 81 aa, Hylobates moloch
DLLFQLLVTFRDVAIDFSQEEWECLDPAQRDLYRDVMLENYSNLISLDLESSRTTKKLSPEKEIDEMESLQWENMEKLINH

SEQ ID NO: 4211 - protein, 81 aa, Hylobates moloch
MIEYQIPVSFKDVVVGFTQEEWHQLSPAQRALYRDVMLETYSNLVSVGYEGTKPDVILRLEQEEAPWIGEAACLGCHCWED

SEQ ID NO: 4212 - protein, 81 aa, Hylobates moloch
EWHQLSPAQRALYRDVMLETYSNLVSVGYEGTKPDVILRLEQEEAPWIGEAACLGCHCWEDIWRVNIQRKRRQDMLLRQGT

SEQ ID NO: 4213 - protein, 81 aa, Hylobates moloch
MIEYQIPVSFKDVVVGFTQEEWHQLSPAQRALYRDVMLETYSNLVSVGYEGTKPDVILRLEQEEAPWIGEAACLGCHCWGI

SEQ ID NO: 4214 - protein, 81 aa, Hylobates moloch
VVVGFTQEEWHQLSPAQRALYRDVMLETYSNLVSVGYEGTKPDVILRLEQEEAPWIGEAACLGCHCWGISKLWPTDWPPAL

SEQ ID NO: 4215 - protein, 81 aa, Hylobates moloch
MIEYQIPVSFKDVVVGFTQEEWHQLSPAQRALYRDVMLETYSNLVSVGYEGTKPDVILRLEQEEAPWIGEAACLGCHCWGK

SEQ ID NO: 4216 - protein, 81 aa, Hylobates moloch
EWHQLSPAQRALYRDVMLETYSNLVSVGYEGTKPDVILRLEQEEAPWIGEAACLGCHCWGKCDKSSKRGTEGGWHVGNFVQ

SEQ ID NO: 4217 - protein, 81 aa, Hylobates moloch
SFKDVVVGFTQEEWHQLSPAQRALYRDVMLETYSNLVSVGYEGTKPDVILRLEQEEAPWIGEAACLGCHCWALTFLRELQP

SEQ ID NO: 4218 - protein, 81 aa, Hylobates moloch
FKDVVVGFTQEEWHQLSPAQRALYRDVMLETYSNLVSVGYEGTKPDVILRLEQEEAPWIGEAACLGCHCWALTFLRELQPR

SEQ ID NO: 4219 - protein, 81 aa, Hylobates moloch
MFWKQEQRGDLPHLQELVTFRDVAVDFSQEEWDCLDSSQRHLYSNVMLENYRILVSLGLCFSKPSVILLLEQGKAPWMVKR

SEQ ID NO: 4220 - protein, 81 aa, Hylobates moloch
QGKAPWMVKRELTKGLCSGWEPICETEELTPKQDFYEEHQSQKIIETLTSYNLEYSSLREEWKYEGYFERQPGNQKVCFKE

SEQ ID NO: 4221 - protein, 81 aa, Hylobates moloch
TSAGPIPSQEEEEMTQSQGIVTFKDVAIDFTQEEWKRLDPAQRNLYRNVMLENYNNLITVGYPFTKPDVIFKLEQEEEPWV

SEQ ID NO: 4222 - protein, 81 aa, Hylobates moloch
MTQSQGIVTFKDVAIDFTQEEWKRLDPAQRNLYRNVMLENYNNLITVGYPFTKPDVIFKLEQEEEPWVMEEEVLRRHWQGE

SEQ ID NO: 4223 - protein, 81 aa, Hylobates moloch
MDSARHHISHSTSAGPIPSQEEEEMTQSQGIVTFKDVAIDFTQEEWKRLDPAQRNLYRNVMLENYNNLITVGYPFTKPDVI

SEQ ID NO: 4224 - protein, 81 aa, Hylobates moloch
EMTQSQGIVTFKDVAIDFTQEEWKRLDPAQRNLYRNVMLENYNNLITVGYPFTKPDVIFKLEQEEEPWVMEEEVLRRHWQG

SEQ ID NO: 4225 - protein, 81 aa, Hylobates moloch
MAVGLCKAMSQGLVTFRDVALDFSQEEWEWLKPSQKDLYRDVMLENYRNLVWLGDGCSCRSTLRTTATAETSSSSSSIQVS

SEQ ID NO: 4226 - protein, 81 aa, Hylobates moloch
MAVGLCKAMSQGLVTFRDVALDFSQEEWEWLKPSQKDLYRDVMLENYRNLVWLDWESWCKIEELSPKWFIDEDEISQEMVM

SEQ ID NO: 4227 - protein, 81 aa, Hylobates moloch
AQAGVIRQPRPPRMLGLQAFVAFRDVAVDFTQEEWRLLSPAQRTLHREVMLETYNHLVSLEIPSSKPKLIAQLERGEEPWR

SEQ ID NO: 4228 - protein, 81 aa, Hylobates moloch
EEPWREERKCPLDLCPESKPEIQLCSSCPLIFSNQQALSQHVWLSHLSHLFSSLWAGNPLQLGKHYPEDQKQQQDPFCLSG

SEQ ID NO: 4229 - protein, 81 aa, Hylobates moloch
EPWREERKCPLDLCPAESKPEIQLCSSCPLIFSNQQALSQHVWLSHLSHLFSSLWAGNPLQLGKHYPEDQKQQQDPFCLSG

SEQ ID NO: 4230 - protein, 81 aa, Hylobates moloch
AKKEVIRQPRPPRMLGLQAFVAFRDVAVDFTQEEWRLLSPAQRTLHREVMLETYNHLVSLEIPSSKPKLIAQLERGEEPWR

SEQ ID NO: 4231 - protein, 81 aa, Hylobates moloch
MLETYNHLVSLEIPSSKPKLIAQLERGEEPWREERKCPLDLCPESKPEIQLCSSCPLIFSNQQALSQHVWLSHLSHLFSSL

SEQ ID NO: 4232 - protein, 81 aa, Hylobates moloch
GEEPWREERKCPLDLCPESKPEIQLCSSCPLIFSNQQALSQHVWLSHLSHLFSSLWAGNPLQLGKHYPEDQKQQQDPFCLS

SEQ ID NO: 4233 - protein, 81 aa, Hylobates moloch
MLETYNHLVSLEIPSSKPKLIAQLERGEEPWREERKCPLDLCPDVVSLCCLGSAVASQLTATSTSWVQAVLCLSLPISWDY

SEQ ID NO: 4234 - protein, 81 aa, Hylobates moloch
KLIAQLERGEEPWREERKCPLDLCPAESKPEIQLCSSCPLIFSNQQALSQHVWLSHLSHLFSSLWAGNPLQLGKHYPEDQK

SEQ ID NO: 4235 - protein, 81 aa, Hylobates moloch
MLETYNHLVSLEIPSSKPKLIAQLERGEEPWREERKCPLDLCPDGALLCHQAGIQWRDNGLLQPLPPGFKQFPCVSLLSSW

SEQ ID NO: 4236 - protein, 81 aa, Hylobates moloch
MAEGSVTFSDVSIDFSQEEWDCLDPVQRDLYRDVMLENYSNLVSMGLYTPKPQVISLLEQGKEPWMVGRELTRGLCSDLES

SEQ ID NO: 4237 - protein, 81 aa, Hylobates moloch
MAEGSVTFSDVSIDFSQEEWDCLDPVQRDLYRDVMLENYSNLVSMGKGIRTSDSQFFSGMSASSTVNFSAAFQDFTLLSLK

SEQ ID NO: 4238 - protein, 81 aa, Hylobates moloch
SPQKSSALAPEDHGSSYEGSVSFRDVAINFSREEWQHLDLSQRNLYRDVMLETYSHLLSVGYQVPKPEVVMLEQGKESWAL

SEQ ID NO: 4239 - protein, 81 aa, Hylobates moloch
MQLNEEINKGSVSFRDVAINFSREEWQHLDLSQRNLYRDVMLETYSHLLSVGYQVPKPEVVMLEQGKESWALQGERPRHSC

SEQ ID NO: 4240 - protein, 81 aa, Hylobates moloch
REEWQHLDLSQRNLYRDVMLETYSHLLSVGYQVPKPEVVMLEQGKESWALQGERPRHSCPGEKLWDHNQHRKIIGYKPASS

SEQ ID NO: 4241 - protein, 81 aa, Hylobates moloch
NEEINKGSVSFRDVAINFSREEWQHLDLSQRNLYRDVMLETYSHLLSVGYQVPKPEVVMLEQGKESWALQGERPRHSCPGE

SEQ ID NO: 4242 - protein, 81 aa, Hylobates moloch
LAPEDHGSSYEGSVSFRDVAIDFSREEWRHLDLSQRNLYRDVMLETYSHLLSVGYQVPEAEVVMLEQGKEPWALQGERPRH

SEQ ID NO: 4243 - protein, 81 aa, Hylobates moloch
REEWRHLDLSQRNLYRDVMLETYSHLLSVGYQVPEAEVVMLEQGKEPWALQGERPRHSCPVTHLPFPSTMTKSFLGLTRSQ

SEQ ID NO: 4244 - protein, 81 aa, Hylobates moloch
SPQKSSALAPEDHGSFYEGSVSFRDVAIDFSREEWRHLDLSQRNLYRDVMLETYSHLLSVGYQVPEAEVVMLEQGKEPWAL

SEQ ID NO: 4245 - protein, 81 aa, Hylobates moloch
VAIDFSREEWRHLDLSQRNLYRDVMLETYSHLLSVGYQVPEAEVVMLEQGKEPWALQGERPRHSCPAQCLVNSHHLQESFG

SEQ ID NO: 4246 - protein, 81 aa, Hylobates moloch
MARKLVMFRDVAIDFSQEEWECLDSAQRDLYRDVMLENYSNLVSLDLPSRYASKDLSPEKNTYETQLSQWEMSDRLENCDL

SEQ ID NO: 4247 - protein, 81 aa, Hylobates moloch
TQLSQWEMSDRLENCDLEESNSRDYLEAKGKREKQQENQKEYFRQGMIIYDKMSIFNQHTYLSQHSRCHSTEKPYKCKECG

SEQ ID NO: 4248 - protein, 81 aa, Hylobates moloch
FRDVAIDFSQEEWECLDSAQRDLYRDVMLENYSNLVSLDLPSRYASKDLSPEKNTYETQLSQWEMSDRLENCDLEESNSRD

SEQ ID NO: 4249 - protein, 81 aa, Hylobates moloch
MKPAQRNLYRDVMLENYSNLVTVGCQVTKPDVIFKLEQEEEPWVMEEEMFGRHCPDWELGRETKNLSPKENIYEIRSPQQE

SEQ ID NO: 4250 - protein, 81 aa, Hylobates moloch
SQESALSEEEEDTTRPLETVTFKDVAVDLTQEEWEQMKPAQRNLYRDVMLENYSNLVTVGCQVTKPDVIFKLEQEEEPWVM

SEQ ID NO: 4251 - protein, 81 aa, Hylobates moloch
QEEWEQMKPAQRNLYRDVMLENYSNLVTVGCQVTKPDVIFKLEQEEEPWVMEEEMFGRHCPDWELGRETKNLSPKENIYEI

SEQ ID NO: 4252 - protein, 81 aa, Hylobates moloch
EDTTRPLETVTFKDVAVDLTQEEWEQMKPAQRNLYRDVMLENYSNLVTVGCQVTKPDVIFKLEQEEEPWVMEEEMFGRHCP

SEQ ID NO: 4253 - protein, 81 aa, Hylobates moloch
EEEERMHDELLQAVSKGPVMFRDVSIDFSQEEWECLDAGQMNLYKEVMLENFSNLVSVGLSNSKPAVISLLEQGKEPWMVD

SEQ ID NO: 4254 - protein, 81 aa, Hylobates moloch
MAHLMMFRDVAVDFSQEEWECLDLEQRDLYRDVMLENYSNMVSLGLCIYQPEVFSLLEKGKEPWKILSNETRGPCPDMQSR

SEQ ID NO: 4255 - protein, 81 aa, Hylobates moloch
MNMEGLVMFQDLSIDFSQEEWECLDAAQKDLYRDVMMENYSSLVSLGLSIPKPDVISLLEQGKEPWMVSRDMLGGWCPDRL

SEQ ID NO: 4256 - protein, 81 aa, Hylobates moloch
MNMEGLVMFQDLSIDFSQEEWECLDAAQKDLYRDVMMENYSSLVSLGLSIPKPDVISLLEQGKEPWMVSRDMLGGWCPDSE

SEQ ID NO: 4257 - protein, 81 aa, Hylobates moloch
MNMEGLVMFQDLSIDFSQEEWECLDAAQKDLYRDVMMENYSSLVSLDSEFRCKTKDSCLPKEIYEATSSQWVRMEKCHSLV

SEQ ID NO: 4258 - protein, 81 aa, Hylobates moloch
MDVMLENYCHLISVGCHITKPDVILKLERGEEPWTSFAGHTCLEENWKAEDFLVKFKEHQEKYSRSVVSINHKKLVKEKSK

SEQ ID NO: 4259 - protein, 81 aa, Hylobates moloch
MAQGSVSFNDVTVDFTQEEWQHLDHAQKTLYMDVMLENYCHLISVGCHITKPDVILKLERGEEPWTSFAGHTCLEENWKAE

SEQ ID NO: 4260 - protein, 81 aa, Hylobates moloch
GESLESRVTLGSLTAESQELLTFKDVSVDFTQEEWGQLAPAHRNLYREVMLENYGNLVSVGYRLSKPGVISQLEKGEEPWL

SEQ ID NO: 4261 - protein, 81 aa, Hylobates moloch
EELHCGLMMEGSTKGSTMYSTLGRISKCNKLESQKENQRMDEGQIPLMCKKTFTQERGQKSNRFEKRINAKSEVMPEPIGL

SEQ ID NO: 4262 - protein, 81 aa, Hylobates moloch
QGESLESRVTLGSLTAESQELLTFKDVSVDFTQEEWGQLAPAHRNLYREVMLENYGNLVSVAGYRLSKPGVISQLEKGEEP

SEQ ID NO: 4263 - protein, 81 aa, Hylobates moloch
MINFQESVTFQDVAVDFTAEEWQLLDCAERTLYWDVMLENYRNLISVGCPITKTKVILKVEQGQEPWMVEGVNPDQSSPEN

SEQ ID NO: 4264 - protein, 81 aa, Hylobates moloch
MINFQESVTFQDVAVDFTAEEWQLLDCAERTLYWDVMLENYRNLISVGCPITKTKVILKVEQGQEPWMVEGVNPDQSSPGW

SEQ ID NO: 4265 - protein, 81 aa, Hylobates moloch
MINFQESVTFQDVAVDFTAEEWQLLDCAERTLYWDVMLENYRNLISVGCPITKTKVILKVEQGQEPWMVEGVNPDQSSPES

SEQ ID NO: 4266 - protein, 81 aa, Hylobates moloch
MLENYSNLVSVGYHVSKPDVIFKLEQGEEPWIMEKFSNQNYPEVDDALEKSKEIQDKHLIQTVFFSNKTLITERENVFGKT

SEQ ID NO: 4267 - protein, 81 aa, Hylobates moloch
MENEKERPVSFQDLTVNFTQEEWQQLDPAQRLLYRDVMLENYSNLVSVGYHVSKPDVIFKLEQGEEPWIMEKFSNQNYPEV

SEQ ID NO: 4268 - protein, 81 aa, Hylobates moloch
LKMKKFQRPVSFQDLTVNFTQEEWQQLDPAQRLLYRDVMLENYSNLVSVGYHVSKPDVIFKLEQGEEPWIMEKFSNQNYPE

SEQ ID NO: 4269 - protein, 81 aa, Hylobates moloch
MNSPSFLYSVHYFKRPVSFQDLTVNFTQEEWQQLDPAQRLLYRDVMLENYSNLVSVGYHVSKPDVIFKLEQGEEPWIMEKF

SEQ ID NO: 4270 - protein, 81 aa, Hylobates moloch
TQNHKAKGLPSNDTDWSQKKETKAQIVVPVTFRDVTVIFTEAEWKRLSPEQRNLYKEVMLENYRNILSLDGGQEQQDAAAY

SEQ ID NO: 4271 - protein, 81 aa, Hylobates moloch
LPSNDTDWSQKKETKAQIVVPVTFRDVTVIFTEAEWKRLSPEQRNLYKEVMLENYRNILSLAEPEPEIYTCSSCLLAFSCQ

SEQ ID NO: 4272 - protein, 81 aa, Hylobates moloch
PSNDTDWSQKKETKAQIVVPVTFRDVTVIFTEAEWKRLSPEQRNLYKEVMLENYRNILSLDRVSLLLPRLECNGAISAHHN

SEQ ID NO: 4273 - protein, 81 aa, Hylobates moloch
AKGLPSNDTDWSQKKETKAQIVVPVTFRDVTVIFTEAEWKRLSPEQRNLYKEVMLENYRNILSLGQEIETILANIVKSHLY

SEQ ID NO: 4274 - protein, 81 aa, Hylobates moloch
KNGENVETMKKLTQNHKAKGLPSNDTDWSQKKETKAQIVVPVTFRDVTVIFTEAEWKRLSPEQRNLYKEVMLENYRNILSL

SEQ ID NO: 4275 - protein, 81 aa, Hylobates moloch
MAEPASVTVTFDDVAFYFSEQEWEILEKWQKQMYRQEMKTNYETLDSLGYAFSKPDLITWMEQGRMLLISEQGCLDKTRRT

SEQ ID NO: 4276 - protein, 81 aa, Hylobates moloch
QEMKTNYETLDSLGYAFSKPDLITWMEQGRMLLISEQGCLDKTRRTTSPPTDEQLNMKNTGKLLRFDDQGTLRTKEGDCRL

SEQ ID NO: 4277 - protein, 81 aa, Hylobates moloch
GGECRLCNSGSCRSWIGVTVTFDDVAFYFSEQEWEILEKWQKQMYRQEMKTNYETLDSLGYAFSKPDLITWMEQGRMLLIS

SEQ ID NO: 4278 - protein, 81 aa, Hylobates moloch
MKTNYETLDSLGYAFSKPDLITWMEQGRMLLISEQGCLDKTRRTTSPPTDEQLNMKNTGKLLRFDDQGTLRTKEGDCRLNG

SEQ ID NO: 4279 - protein, 81 aa, Hylobates moloch
TLCVRGQRGLEERAIPMESITDSPISAQDLLSRIKQEEHQCVWDQQDLADRDIPTDPNSESLISAHDILSWIKQEEQPYPW

SEQ ID NO: 4280 - protein, 81 aa, Hylobates moloch
RNFWILRLPPGSKGEAPKVSRSLENDGVCFTEQEWENLEDWQKELYRNVMESNYETLVSLILLCCPGWSAVTRSWLTATSA

SEQ ID NO: 4281 - protein, 81 aa, Hylobates moloch
PGGAHPAGGVMIKQELQYTQEGPVDLSGEFSCIADEQAFLSPEQTELWGGQGSSVLLETGPGDSTLEEPVGSRDPSSSRTV

SEQ ID NO: 4282 - protein, 81 aa, Hylobates moloch
MAVEFGNQLEGKWAVLGTLLQEYGLLQRRLENVENLLRNRNFWILRLPPGSKGEAPKVSRSLENDGVCFTEQEWENLEDWQ

SEQ ID NO: 4283 - protein, 81 aa, Hylobates moloch
LEEEGPGGAHPAGGVMIKQELQYTQEGPVDLSGEFSCIADEQAFLSPEQTELWGGQGSSVLLETGPGDSTLEEPVGSRDPS

SEQ ID NO: 4284 - protein, 81 aa, Hylobates moloch
RNFWILRLPPGSKGEAPKVPVTFDDVAVYFSELEWGKLEDWQKELYKHVMRGNYETLVSLDYAISKPDILTRLERGEEPCP

SEQ ID NO: 4285 - protein, 81 aa, Hylobates moloch
MARQVSITFKDLAVRFSEEEWRLLEEGQREFYRDVMRENYETLVSVGTAELLPLSAFLSPSDPGRAVGGGSHADEGQEPAG

SEQ ID NO: 4286 - protein, 81 aa, Hylobates moloch
MRENYETLVSVGTAELLPLSAFLSPSDPGRAVGGGSHADEGQEPAGCGGPQGGQPRHSLHLTALVQLVKEIPEFLFGEVKG

SEQ ID NO: 4287 - protein, 81 aa, Hylobates moloch
MEPRESGKAPVTFDDITVYLLQEEWVLLSQQQKELCGSDKPVATLGPTVANPELFCKFGRGPEPWLGSVQGQRSLLEHHPG

SEQ ID NO: 4288 - protein, 81 aa, Hylobates moloch
MTFEDVAVEFTQWEWGQLNPAQKDLYREVMLETFRNLAFLGLLVSKPYVICQLEEGGEPFMVEREISTGAHSDWERRSKSK

SEQ ID NO: 4289 - protein, 81 aa, Hylobates moloch
MAAVSPTTRCQESVTFEDVAVVFTDEEWSHLVPIQRDLYKEVMLENYNSIVSLGLPVPQPDVIFQWKRGDKPWMVDLHGSE

SEQ ID NO: 4290 - protein, 81 aa, Hylobates moloch
ELVSSEEVAVHFTWEEWQDLDDAQGTLYRDVILETYSSLISLGHITKPEMIFKLEQGAEPWILQEAPNLRLSGGSRKRVFS

SEQ ID NO: 4291 - protein, 81 aa, Hylobates moloch
ELVSSEEVAVHFTWEEWQDLDDAQGTLYRDVILETYSSLISLGHITKPEMIFKLEQGAEPWILQEAPNLRLSAVQIIDDLI

SEQ ID NO: 4292 - protein, 81 aa, Hylobates moloch
TLLYIRELPLGKSPMNVMNVENPFIRSQSSLYIIELIPEENLTNVMSVGKPCHKSNLNMHQRTHSGEKPYECDECRKIYHK

SEQ ID NO: 4293 - protein, 81 aa, Hylobates moloch
QMGSIKEKMKAGSRTGKPQEPVTFKDVVVEFSKEEWGQLDSAVKNLYRSVMLENFRNLNSLRKAHLLSKPFESLKLESKKK

SEQ ID NO: 4294 - protein, 81 aa, Hylobates moloch
MAVTFEDVTIIFTWEEWKFLDSSQKSLYREVMWENYTNVMLVENWNESYKSQEEKFRYLEYENFSCWQGWWNAGTQMYENQ

SEQ ID NO: 4295 - protein, 81 aa, Hylobates moloch
SRKNLSMEKEQKLIVQHSYIPVEEALPQYIGVICQKDLLRDSMEEKYCGCNKCKEIYYWNSRCVFHKRNQPGENLYQCSIC

SEQ ID NO: 4296 - protein, 81 aa, Hylobates moloch
AEPSFSWEWPLRELCVLQEPVTFRDVAIYFSREEWACLEPSQRALYRDVMLDNFSSVAALGFCSPRPDLVSRLEQWEEPWV

SEQ ID NO: 4297 - protein, 81 aa, Hylobates moloch
MNTLQGPVSFRDVAVDFTQEEWQQLDPDEKITYRDVMLENYSHLVSVGYDITKPNVIIKLEQGEEPWIVEGEFPCQHSPEV

SEQ ID NO: 4298 - protein, 81 aa, Hylobates moloch
MNTLQGPVSFRDVAVDFTQEEWQQLDPDEKITYRDVMLENYSHLVSVGYDITKPNVIIKLEQGEEPWIVEGEFPCQHSPAA

SEQ ID NO: 4299 - protein, 81 aa, Hylobates moloch
EEEEEDEDEDDLLTAGSQGLVTFEDVAVYFSLEEWERLEADQRGLYQEVMQENYGILVSLGYPIPKPDLIFRLEQGEEPWV

SEQ ID NO: 4300 - protein, 81 aa, Hylobates moloch
MFPPARGKELLSFEDVAMYFTREEWGHLNLGQKDLYRDVMLENYRNMVLLGFQFPKPEVICQLENWDEQWILDLPRAGNRK

SEQ ID NO: 4301 - protein, 81 aa, Hylobates moloch
MELLSFEDVAMYFTREEWGHLNLGQKDLYRDVMLENYRNMVLLGFQFPKPEVICQLENWDEQWILDLPRAGNRKASGSACP

SEQ ID NO: 4302 - protein, 81 aa, Hylobates moloch
EEAVAVVRALQRALNGTSPQGMVTFEDMAVSLTWEEWERLDPARRDFCRESTQKDSGSTVGPSLESRVENKELIPMQQILE

SEQ ID NO: 4303 - protein, 81 aa, Hylobates moloch
DGEEHGKKCKQSFHKVTWHVLKPHKSDSGDSFHHSSLFETQRQLHEERPYKCGNCGKSFKQRSDLFRHQRIHTGEKPYGCQ

SEQ ID NO: 4304 - protein, 81 aa, Hylobates moloch
GEEHGKKCKQSFHKVTWHVLKPHKSDSGDSFHHSSLFETQRQLHEERPYKCGNCGKSFKQRSDLFRHQRIHTGEKPYGCQE

SEQ ID NO: 4305 - protein, 81 aa, Hylobates moloch
SQELTASLLSTGSQKLVKIEEVADVAVSFILEEWGHLDQSQKSLYRDDRKENYGSITSMGYESRDNMELIAKQISDDSESH

SEQ ID NO: 4306 - protein, 81 aa, Hylobates moloch
REGSPGDQAAALLTARYQEFVTFEDVAVHLTREEWGYLDPVQRDLYREVMLENYGNVVSLGFPISKPDGISQLEQDLQVFD

SEQ ID NO: 4307 - protein, 81 aa, Hylobates moloch
KPDGISQLEQDLQVFDLETKTREVLRDDCSDGETREENKLLIPKQKISEEVHSYKVRVGRLKHDITQVPETREVYKSEDRL

SEQ ID NO: 4308 - protein, 81 aa, Hylobates moloch
NECGKAFSQTSCLVQHHRMHRKEKSYECNEYEGSFSHSSDLILQQEVLTRQKAFDCDVWEKNSSQRAHLVQHQSIHTKENS

SEQ ID NO: 4309 - protein, 81 aa, Hylobates moloch
GPGLPTMNPRDQEMAAGFFTAGSQGLGPFKDMALAFPEEEWRHVTPAQIDCFGEYVEPQDCRVSPGGGSKEKEAKPPQEDL

SEQ ID NO: 4310 - protein, 81 aa, Hylobates moloch
EGSPRDQAMASALFTADSQAMVKIEDMAVSLILEEWGCQNLARRNLSRDNRQENYGSAFPQGGENRNENEESTSKAETTED

SEQ ID NO: 4311 - protein, 81 aa, Hylobates moloch
METQADLVSQEPQALLDSALPSKVPAFSNKDSLGDEMLAAALLKAKSQELVTFEDVAVYFIRKEWKRLEPAQRDLYRDVML

SEQ ID NO: 4312 - protein, 81 aa, Hylobates moloch
VPAFSNKDSLGDEMLAAALLKAKSQELVTFEDVAVYFIRKEWKRLEPAQRDLYRDVMLENYGNVFSLDRETRTENDQEISE

SEQ ID NO: 4313 - protein, 81 aa, Hylobates moloch
MGPLTFRDVKIEFSLEEWQCLDTAQRNLYRDVMLENYRNLVFLVMCSHFAQDVWPEQSIKDSFQKVILRTYGKYGHENLQL

SEQ ID NO: 4314 - protein, 81 aa, Hylobates moloch
MGPLTFRDVKIEFSLEEWQCLDTAQRNLYRDVMLENYRNLVFLGIAVSKPDLITWLEQGKEPWNMKRHEMVDKTAVMCSHF

SEQ ID NO: 4315 - protein, 81 aa, Hylobates moloch
GIGGSTAKTPGLPGSLEMGPLTFRDVAIEFSLEEWQCLDTSQQNLYRNVMLDNYRNLVFLGIAVSKPDLITCLEQGKEPCN

SEQ ID NO: 4316 - protein, 81 aa, Hylobates moloch
MEPLTFKDVAIEFSLEEWQCLDTAQRDLYRNVLLENYRNLVFLVMSFHFAQDLWPEQNIKDSFQKVTLRRHGKCEYENLQL

SEQ ID NO: 4317 - protein, 81 aa, Hylobates moloch
MGVLTFRDVAIEFSPEEWECLDSAQQRLYRDVMLENYGNLVSLGLAIFKPDLMTCLEQRKEPWKVKRQEAVAKHPAGSFHF

SEQ ID NO: 4318 - protein, 81 aa, Hylobates moloch
EQRKEPWKVKRQEAVAKHPAGSFHFTAEILPEHDMKDAFRKVILRKYRSCDLNNLHLKKDNQSVGNCKGQKSSYNGLHQCL

SEQ ID NO: 4319 - protein, 81 aa, Hylobates moloch
MANREMELLTFRDIAIEFSLEEWQCLDRAQQNLYREVMLENYRNLVSLGITLSKSDLITCLEQNKEPQNIKRNEMVSKHPV

SEQ ID NO: 4320 - protein, 81 aa, Hylobates moloch
MGVLTFRDVAIEFSPEEWECLDSAQQHLYRDVMLENYGNLFSLGLAIFKPHLITYLEQRKEPWNVKRQKTVAKHPAGSFHF

SEQ ID NO: 4321 - protein, 81 aa, Hylobates moloch
MAKRPGSPGSREMRLLTFRDIAIEFSLVEWQYLDHAQQNLYRDVMLENYRNLVSLGIADSKPDLITCLEQNKEYWNIKRNE

SEQ ID NO: 4322 - protein, 81 aa, Hylobates moloch
MEEKEMNDGSQIVRSQESLTFQDVAVDFTREEWDQLYPAQKNLYRDVMLENYRNLVALGYQLYKPEVIAQLELEEEWVIER

SEQ ID NO: 4323 - protein, 81 aa, Hylobates moloch
GNMEEKEMNDGSQIVRSQESLTFQDVAVDFTREEWDQLYPAQKNLYRDVMLENYRNLVALGYQLYKPEVIAQLELEEEWVI

SEQ ID NO: 4324 - protein, 81 aa, Hylobates moloch
MVHGSVTFRDVAIDFSQEEWECLQPDQRTLYRDVMLENYSHLISLAGSSISKPDVITLLEQEKEPWIVIWSQNMDLRKYLH

SEQ ID NO: 4325 - protein, 81 aa, Hylobates moloch
MVHGSVTFRDVAIDFSQEEWECLQPDQRTLYRDVMLENYSHLISLGSSISKPDVITLLEQEKEPWMVVRKETNRRYPDLES

SEQ ID NO: 4326 - protein, 81 aa, Hylobates moloch
MVHGSVTFRDVAIDFSQEEWECLQPDQRTLYRDVMLENYSHLISLAGSSISKPDVITLLEQEKEPWMVVRKETNRRYPDLE

SEQ ID NO: 4327 - protein, 81 aa, Hylobates moloch
GRSPRKIDQFCNSRNMVHGSVTFRDVAIDFSQEEWECLQPDQRTLYRDVMLENYSHLISLGSSISKPDVITLLEQEKEPWM

SEQ ID NO: 4328 - protein, 81 aa, Hylobates moloch
EESHGALISSCNSRTMTDGLVTFRDVAIDFSQEEWECLDPAQRDLYVDVMLENYSNLVSLDLESTTYETKKIFSEKDIFEI

SEQ ID NO: 4329 - protein, 81 aa, Hylobates moloch
MTKSKEPVTFKDVAVVFSEEELRLLDLAQRKLYRDVMLENFRNVVSVGHQSTPDGLPQLEREEKLRMMKMATQRDNSSGGK

SEQ ID NO: 4330 - protein, 81 aa, Hylobates moloch
MLENFRNVVSVGHQSTPDGLPQLEREEKLRMMKMATQRDNSSGGKNLKEMETLQEVGLRYLPHEELFCSQIWQQVTRELTK

SEQ ID NO: 4331 - protein, 81 aa, Hylobates moloch
HSGLCKFPEVEGKMTTFKEAVTFKDVAVVFTEEELGLMDPAQRKLYRDVMLENFRNLLSVGNQPFHQDTFHFLRKEMFWMI

SEQ ID NO: 4332 - protein, 81 aa, Hylobates moloch
LRKEMFWMIKTTSQREGNSGGKIQIEMETVPEAGPHEEWSCQQIWEQIASDLIRCQNSIRNSSLFFKESDVPCQIEAGLSI

SEQ ID NO: 4333 - protein, 81 aa, Hylobates moloch
EQCEKGYNSKFNLDMHQRVHRGERPYNCKECGKSFGWASCLLKHQRLHSGEKPLKRGVWEEIYSEFTASFTSVTLCGRKAI

SEQ ID NO: 4334 - protein, 81 aa, Hylobates moloch
AQRKLYRDVMLENFRNLLSVGNQPFHQDTFHFLRKEMFWMIKTTSQREGNSGGKIQIEMETVPEAGPHEEWSCQQIWEQIA

SEQ ID NO: 4335 - protein, 81 aa, Hylobates moloch
MTTFKEAVTFKDVAVVFTEEELGLLDPAQRKLYRDVMLENFRNLLSMGHQPFHRDTFHFLREEKFWMMGTATEREGNPGGK

SEQ ID NO: 4336 - protein, 81 aa, Hylobates moloch
LREEKFWMMGTATEREGNPGGKIQTELESVPEAGAHEEWSCQQIWEQIAKDLTRSQDSIINNSQFFENGDVPSQVEAGLPT

SEQ ID NO: 4337 - protein, 81 aa, Hylobates moloch
MIKRSKILVFCSKIMEEAVTFKDVAVVFTEEELGLLDPAQRKLYRDVMLENFRNLLSMGHQPFHRDTFHFLREEKFWMMGT

SEQ ID NO: 4338 - protein, 81 aa, Hylobates moloch
DVMLENFRNLLSMGHQPFHRDTFHFLREEKFWMMGTATEREGNPGGKIQTELESVPEAGAHEEWSCQQIWEQIAKDLTRSQ

SEQ ID NO: 4339 - protein, 81 aa, Hylobates moloch
MTTFKEAVTFKDVAVFFTEEELGLLDPAQRKLYQDVMLENFTNLLSVGHQPFHPFHFLREEKFWMMETATQRDGNSGGKTV

SEQ ID NO: 4340 - protein, 81 aa, Hylobates moloch
NNSDFFEQGDVPSQVEAGLSIIHTGQKPSQNGKCKQSFSDVAIFDLPQQLHSGEKSHTCNECGKSFCYISALRIHQRVHLR

SEQ ID NO: 4341 - protein, 81 aa, Hylobates moloch
MTTFKEAVTFKDVAVFFTEEELGLLDPAQRKLYQDVMLENFTNLLSVGHQPFHPFHFLREEKFWMMETATQRDGNSGKKQA

SEQ ID NO: 4342 - protein, 81 aa, Hylobates moloch
MIDPGEKKPGRRAEEAVTFKDVAVVFTEEELQLLDLAQRKLYRDVMLENFRNLLSVGHQPFHGDTFHFLREEKFWVMETTS

SEQ ID NO: 4343 - protein, 81 aa, Hylobates moloch
GRRAEEAVTFKDVAVVFTEEELQLLDLAQRKLYRDVMLENFRNLLSVGHQPFHGDTFHFLREEKFWVMETTSQREGNSGPL

SEQ ID NO: 4344 - protein, 81 aa, Hylobates moloch
RAKLYEAVTFKDVAVVFTEEELQLLDLAQRKLYRDVMLENFRNLLSVGGKIQTEMETVPEAGTHEEFSCKQIWEQIASDLT

SEQ ID NO: 4345 - protein, 81 aa, Hylobates moloch
HSGLCKFPKVGGKLTMSKEAVTFKDVAVVFTEEELGLLDLAQRKLYRDVMLENFRNLLSVGHQPFHQDTFHFLREEKFWMM

SEQ ID NO: 4346 - protein, 81 aa, Hylobates moloch
LTMSKEAVTFKDVAVVFTEEELGLLDLAQRKLYRDVMLENFRNLLSVGHQPFHQDTFHFLREEKFWMMDIAPQRERNSGGK

SEQ ID NO: 4347 - protein, 81 aa, Hylobates moloch
LTMSKEAVTFKDVAVVFTEEELGLLDLAQRKLYRDVMLENFRNLLSVGHQPFHQDTFHFLREEKFWMMDIAPQRERNSGKK

SEQ ID NO: 4348 - protein, 81 aa, Hylobates moloch
TFKDVAVVFTEEELGLLDLAQRKLYRDVMLENFRNLLSVGHQPFHQDTFHFLREEKFWMMDIAPQRERNSGKKQATVCPCL

SEQ ID NO: 4349 - protein, 81 aa, Hylobates moloch
LTMSKEAVTFKDVAVVFTEEELGLLDLAQRKLYRDVMLENFRNLLSVGHQPFHQDTFHFLREEKFWMMDIAPQRERNSGGS

SEQ ID NO: 4350 - protein, 81 aa, Hylobates moloch
DVAVVFTEEELGLLDLAQRKLYRDVMLENFRNLLSVGHQPFHQDTFHFLREEKFWMMDIAPQRERNSGGSVQASECRNWSK

SEQ ID NO: 4351 - protein, 81 aa, Hylobates moloch
MLENFRNLLSVGHQPFHQDTFHFLREEKFWMMDIAPQRERNSGGKIQPEMKTVPEAGPHEGWSCQQIWEEIASNLTRPQDS

SEQ ID NO: 4352 - protein, 81 aa, Hylobates moloch
MTMFREAVTFKDVAVVFTKEELGLLDLSQRKLYRDVMLENFRNLLSVGHQPSHRDTFHFRREEKFWIMETATQTEGNSGGK

SEQ ID NO: 4353 - protein, 81 aa, Hylobates moloch
RREEKFWIMETATQTEGNSGGKIQTELESVPATGPHEEWSCQQIWEQTASELTRPQDSISSSQFSTQGDVPSQVDAGLSII

SEQ ID NO: 4354 - protein, 81 aa, Hylobates moloch
MTTFKEAMTFKDVAVVFTEEELGLLDLAQRKLYQDVMLENFRNLLSVGHQAFHRDTFHFLREEKIWMMKTATQREGNSGDK

SEQ ID NO: 4355 - protein, 81 aa, Hylobates moloch
HFLREEKIWMMKTATQREGNSGDKIQTEMETVSEAGTHQEWSCQQIWEKIASDLTRSQDLVINSSQFSKEGDFPCQTGEGL

SEQ ID NO: 4356 - protein, 81 aa, Hylobates moloch
DLAQRKLYQDVMLENFRNLLSVGHQAFHRDTFHFLREEKIWMMKTATQREGNSGDKIQTEMETVSEAGTHQEWSCQQIWEK

SEQ ID NO: 4357 - protein, 81 aa, Hylobates moloch
LLSVGHQAFHRDTFHFLREEKIWMMKTATQREGNSGDKIQTEMETVSEAGTHQEWSCQQIWEKIASDLTRSQDLVINSSQF

SEQ ID NO: 4358 - protein, 81 aa, Hylobates moloch
MTTLKEAVTFKDVAVVFTEEELRLLDFAQRKLYREVMLENFRNLLSVGHQPLHRDTFHFLKEEKFWMMETATQREGNLGGK

SEQ ID NO: 4359 - protein, 81 aa, Hylobates moloch
RNLLSVGHQPLHRDTFHFLKEEKFWMMETATQREGNLGGKIQTEMETVPESGTLEGLFSHQTWGQISSDLTRFQDSTVNSF

SEQ ID NO: 4360 - protein, 81 aa, Hylobates moloch
MTTLKEAVTFKDVAVVFTEEELRLLDFAQRKLYREVMLENFRNLLSVGHQPLHRDTFHFLKEEKFWMMETATQREGNLGPA

SEQ ID NO: 4361 - protein, 81 aa, Hylobates moloch
MTTFKEGLTFKDVAVVFTEEELGLLDPVQRNLYRDVMLENFRNLLSVGHHPFKHDVFPLEKEKKLHMMKTAAQRKGKSADK

SEQ ID NO: 4362 - protein, 81 aa, Hylobates moloch
VGHQPFKQDVSPIERNEQLWIMTTATRRQGNLGEKNQSKLITVQDRESEEELSCWQIWQQIANDLTRCQDSMINNSQFHKQ

SEQ ID NO: 4363 - protein, 81 aa, Hylobates moloch
RNEQLWIMTTATRRQGNLGEKNQSKLITVQDRESEEELSCWQIWQQIANDLTRCQDSMINNSQFHKQGDFPCQVGAELSIQ

SEQ ID NO: 4364 - protein, 81 aa, Hylobates moloch
IERNEQLWIMTTATRRQGNLGEKNQSKLITVQDRESEEELSCWQIWQQIANDLTRCQDSMINNSQFHKQGDFPCQVGAELS

SEQ ID NO: 4365 - protein, 81 aa, Hylobates moloch
SRDCDLPQKEQEKMTKFQEAVTFKDVAVVFSREELRLLDLTQRKLYRDVMVENFKNLVAVGHLPFQPDMVSQLEAEEKLWM

SEQ ID NO: 4366 - protein, 81 aa, Hylobates moloch
SRDCDLPQKEQEKMTKFQEAVTFKDVAVVFSREELRLLDLTQRKLYRDVMVENFKNLVAVGSKHQNKMETLQKFALKYLSN

SEQ ID NO: 4367 - protein, 81 aa, Hylobates moloch
MPSRDCDLPQKEQEKMTKFQEAVTFKDVAVVFSREELRLLDLTQRKLYRDVMVENFKNLVAVGHLPFQPDMVSQLEAEEKL

SEQ ID NO: 4368 - protein, 81 aa, Hylobates moloch
PSRDCDLPQKEQEKMTKFQEAVTFKDVAVVFSREELRLLDLTQRKLYRDVMVENFKNLVAVGHLPFQPDMVSQLEAEEKLW

SEQ ID NO: 4369 - protein, 81 aa, Hylobates moloch
MTKFQEAVTFKDVAVAFTEEELGMLDSAQKKLYRDVMLENFRNLVSVGHQSFKPDMISQLEREEKLWMKELQTQRGKHSGD

SEQ ID NO: 4370 - protein, 81 aa, Hylobates moloch
MTKFQEAVTFKDVAVAFTEEELGMLDSAQKKLYRDVMLENFRNLVSVGHQSFKPDMISQLEREEKLWMKELQTQRGDRNQN

SEQ ID NO: 4371 - protein, 81 aa, Hylobates moloch
MVTFKDVAVVFTEEELELLDSVQRKLYRDVMLENFRNLLLVARQPFKPDLISQLEREEKLLMVETEAPRDGCSGRKNQQKM

SEQ ID NO: 4372 - protein, 81 aa, Hylobates moloch
MTKFQEMVTFKDVAVVFTEEELELLDSVQRKLYRDVMLENFRNLLLVARQPFKPDLISQLEREEKLLMVETEAPRDGCSGR

SEQ ID NO: 4373 - protein, 81 aa, Hylobates moloch
EREEKLLMVETEAPRDGCSGRKNQQKMESIQEVTVSYLSPKELSSCQTWQQSAGGLIGCQNFLKVFQGKNSQLQEQGNSLC

SEQ ID NO: 4374 - protein, 81 aa, Hylobates moloch
GPRSLPFSRKRKRKMTKFQEMVTFKDVAVVFTEEELELLDSVQRKLYRDVMLENFRNLLLVARQPFKPDLISQLEREEKLL

SEQ ID NO: 4375 - protein, 81 aa, Hylobates moloch
RQPFKPDLISQLEREEKLLMVETEAPRDGCSGRKNQQKMESIQEVTVSYLSPKELSSCQTWQQSAGGLIGCQNFLKVFQGK

SEQ ID NO: 4376 - protein, 81 aa, Hylobates moloch
HSEASAVSQDREDKIMSQEPLSFKDVAVVFTEEELELLDSTQRQLYQDVMQENFRNLLSVGDKNGKDMEYIQDEELRFFSH

SEQ ID NO: 4377 - protein, 81 aa, Hylobates moloch
HSEASAVSQDREDKIMSQEPLSFKDVAVVFTEEELELLDSTQRQLYQDVMQENFRNLLSVGERSPLGDKNGKDMEYIQDEE

SEQ ID NO: 4378 - protein, 81 aa, Hylobates moloch
TLTSRHEKRALHSEASAVSQDREDKIMSQEPLSFKDVAVVFTEEELELLDSTQRQLYQDVMQENFRNLLSVGERSPLGNWN

SEQ ID NO: 4379 - protein, 81 aa, Hylobates moloch
MIKFQERVTFKDVAAVFTKEELALLDKAQINLYQDVMLENFRNLISVRDGIKNNILNLQAKGLSYLSQEVLHCWQIWKQRI

SEQ ID NO: 4380 - protein, 81 aa, Hylobates moloch
SMEEQDEKPPEPPKACAQEGVNFKIVTVDFTQEEEGTWNPAQRTLDRDVILENDRDLVSWDLATAVGKKDSTSKQRIFDEE

SEQ ID NO: 4381 - protein, 81 aa, Hylobates moloch
IIIKVEGEDTGSLTIPSKEGVNFKIVTVDFTQEEEGTWNPAQRTLDRDVILENDRDLVSWDLATAVGKKDSTSKQRIFDEE

SEQ ID NO: 4382 - protein, 81 aa, Hylobates moloch
AQDSFLPQEIIIKVEGEDTGSLTIPSKEEEGTWNPAQRTLDRDVILENDRDLVSWDLATAVGKKDSTSKQRIFDEEPANGV

SEQ ID NO: 4383 - protein, 81 aa, Hylobates moloch
MDSVVFEEVAVNFTPEEWALLDHAQRSLYRDVMLETCRNLASLDCCIYVRTSGSSSQRDIFGNGISDDEEIVKFTRSDSWS

SEQ ID NO: 4384 - protein, 81 aa, Hylobates moloch
MDSVVFEDVAVDFTLEEWALLDSAQRNLYRDVMLETFRNLASVDDETQFKANGSVSQQDMYGQDKSKEQTIPTFTGNNSCA

SEQ ID NO: 4385 - protein, 81 aa, Hylobates moloch
MDSVVFEDVAVDFTLEEWALLDSAQRNLYRDVMLETFRNLASVGFEMWERTNGSVSQQDMYGQDKSKEQTIPTFTGNNSCA

SEQ ID NO: 4386 - protein, 81 aa, Hylobates moloch
MDTVVFQDVVVDFTLEEWALLNPAQRKLYRDVMLEIFKHLASVDNEAQLKTNGSISQQDTCGEKLSLKQKIEKFTRKNAWA

SEQ ID NO: 4387 - protein, 81 aa, Hylobates moloch; identical to SEQ ID NO: 401

SEQ ID NO: 4388 - protein, 81 aa, Hylobates moloch
MVTCAHLGRRARLPAAQPSACPGTYFSQEERMAAGYLPRWSQELVTFEDVSVDFSQEEWELLEPAQKNLYREVMLENYRNV

SEQ ID NO: 4389 - protein, 81 aa, Hylobates moloch
YFSQEERMAAGYLPRWSQELVTFEDVSVDFSQEEWELLEPAQKNLYREVMLENYRNVISLEALKNQCTDVGIKEGLLSPAQ

SEQ ID NO: 4390 - protein, 81 aa, Hylobates moloch
EPAQKNLYREVMLENYRNVISLEALKNQCTDVGIKEGLLSPAQTSQVTSLSSWTGYLRFEPVASSHLEQREALWMEEKGTP

SEQ ID NO: 4391 - protein, 81 aa, Hylobates moloch
SPSVQEQNKMNKVEQKFQGSVSFKDVTVGFTQEEWQHLDPSQRALYRDVMLENYSNLVSVGYCVHKPEVIFRLEQGEEPWR

SEQ ID NO: 4392 - protein, 81 aa, Hylobates moloch
MITSQGSVSFRDVTMGFTQEEWQHLDPAQRTLYRNVMLDNYSHLVSVEVILKLEKGKEPWILEEKFGSQSHQGELVSARWN

SEQ ID NO: 4393 - protein, 81 aa, Hylobates moloch
TAAEDKAEKEHGPDLHGEGSVSFSDVAVGFTQEEWQHLDPAQRTLYRDVMLENYSLLLSVGYCTTKPEVVCKLEHEEVLWI

SEQ ID NO: 4394 - protein, 81 aa, Hylobates moloch
VMLENYSLLLSVGYCTTKPEVVCKLEHEEVLWILEEESPSQSHLDCCIDDELMEKRQENQDQHLQKVDFVNNKTLTMDRNG

SEQ ID NO: 4395 - protein, 81 aa, Hylobates moloch
MAPRAQIQGPLTFGDVAVAFTWIEWRHLDAAQRALYRDVMLENYGNLVSVGLLSSKPKLITQLEQGAEPWTEVREAPSGTH

SEQ ID NO: 4396 - protein, 81 aa, Hylobates moloch
RDVMLENYGNLVSVGLLSSKPKLITQLEQGAEPWTEVREAPSGTHAVQDYWFETKMSALKQSTSEGSVLGGRMKSVMMEKG

SEQ ID NO: 4397 - protein, 81 aa, Hylobates moloch
MLENYSNLVSVGYCVHKPEVIFRLEQGEEPWRLEEEFPSQSFPEVWTADHLKERSQENQSKHVWEVVFINNEMLTKEQGDV

SEQ ID NO: 4398 - protein, 81 aa, Hylobates moloch
MNKVEQKFQGSVSFKDVTVGFTQEEWQHLDPSQRALYRDVMLENYSNLVSVGYCVHKPEVIFRLEQGEEPWRLEEEFPSQS

SEQ ID NO: 4399 - protein, 81 aa, Hylobates moloch
MNKSQEQVSFKDVCVDFTQEEWYLLDPAQKILYRDVILENYSNLVSVGYCITKPEVIFKIEQGEEPWILEKGFPSQWHPER

SEQ ID NO: 4400 - protein, 81 aa, Hylobates moloch
WPERGPAAPRHQEMASASPFLSAWSQVPVNLEDMAVYLSGEEPGCLDPAQRDTPLENEGPGIQLEDGGDGREDAPVRMEWY

SEQ ID NO: 4401 - protein, 81 aa, Hylobates moloch
MASMPPTPEAQGPILFEDLAVYFSQEECVTLHPAQRSLSKDATKESLEDAALMGEEGKPEINQQLSLESMELDELALEEYP

SEQ ID NO: 4402 - protein, 81 aa, Hylobates moloch
QNTGLHDQETGAVVWTAGSQGPATCDNRAVSLCQQEWMCPGPAQRALYRGATQRKDRHVSLATGVPWGYEETKTLLAILSS

SEQ ID NO: 4403 - protein, 81 aa, Hylobates moloch
TCDNRAVSLCQQEWMCPGPAQRALYRGATQRKDRHVSLATGVPWGYEETKTLLAILSSSQFYGKLQTCQQNSQIYRAMAEG

SEQ ID NO: 4404 - protein, 81 aa, Hylobates moloch
ENGEEAVALVEDVQRAPGQQGPATCDNRAVSLCQQEWMCPGPAQRALYRGATQRKDRHVSLATGVPWGYEETKTLLAILSS

SEQ ID NO: 4405 - protein, 81 aa, Hylobates moloch
MYFSQEEWELLDPTQKALYNDVMQENYETVISLALFVLPKPKVISCLEQGEEPWVQVSPEFKDSAGKSPTGLQLKNDTEKH

SEQ ID NO: 4406 - protein, 81 aa, Hylobates moloch
QTTTKDWTVTPEHVLPESQSLLTFEEVAMYFSQEEWELLDPTQKALYNDVMQENYETVISLALFVLPKPKVISCLEQGEEP

SEQ ID NO: 4407 - protein, 81 aa, Hylobates moloch
LFPPEGNVEDKEMTGPQLPESLEDVAMYISQEEWGHQDPSKRVLSRDTVQESYENVDSLESHIPSQEVPGTQVGQGGKLWD

SEQ ID NO: 4408 - protein, 81 aa, Hylobates moloch
PLVKLLPKGVQREQDTVSLYLKANPEELVVFEDLNVFHCQEECVSLDPTQQLTSEKEDDSSVGEMMLLVNGSNPEGEDPER

SEQ ID NO: 4409 - protein, 81 aa, Hylobates moloch
PLVKLLPKGVQREQDTVSLYLKANPEELVVFEDLNVFHCQEECVSLDPTQQLTSEKEDDSSVGEMMLLAVNGSNPEGEDPE

SEQ ID NO: 4410 - protein, 81 aa, Hylobates moloch
LKEGCTRETTDTCFVSGVHGPVALGDIPFYFSQEEWGTLDPAQRDLFWDIKRENSRNTTLGLGLKGQSEKSRLQEVVPVVP

SEQ ID NO: 4411 - protein, 81 aa, Hylobates moloch
SRNTTLGLGLKGQSEKSRLQEVVPVVPGQTGSDVTVSWSPEEAEGWESENRPRAALGPVVGARRGRPPTRRRQFRDLAAEK

SEQ ID NO: 4412 - protein, 81 aa, Hylobates moloch
QHSHSAQPPALLKEGCTRETTDTCFVSGVHEEWGTLDPAQRDLFWDIKRENSRNTTLGLGLKGQSEKSRLQEVVPVVPGQT

SEQ ID NO: 4413 - protein, 81 aa, Hylobates moloch
EGRTRDRQMAAALLTAWSQMPVTFEDVALYLSREEWGRLDHTQQNFYRDVLQKENGLSLGFPFSRPFWAPQAHGKGEASGS

SEQ ID NO: 4414 - protein, 81 aa, Hylobates moloch
EGRTRDRQMAAALLTAWSQMPVTFEDVALYLSREEWGRLDHTQQNFYRDVLQKENGLSLGAVEMGQRVPTSSAAALGDVKP

SEQ ID NO: 4415 - protein, 81 aa, Hylobates moloch
MLVAAAAERNKDPILHVLRQYLDPAQRGVRVLEVASGSGQHAAHFARAFPLAEWQPSDVDQRCLDRNPEWGLRDTALLEDL

SEQ ID NO: 4416 - protein, 81 aa, Hylobates moloch
VLRQYLDPAQRGVRVLEVASGSGQHAAHFARAFPLAEWQPSDVDQRCLDRNPEWGLRDTALLEDLGQASGLLLERMVDMPA

SEQ ID NO: 4417 - protein, 81 aa, Hylobates moloch
RGVRVLEVASGSGQHAAHFARAFPLAEWQPSDVDQRCLDRNPEWGLRDTALLEDLGQASGLLLERMVDMPANNKCLIFRKN

SEQ ID NO: 4418 - protein, 81 aa, Hylobates moloch
PRGKHAFQAGWLNDLVTKESMTFKDVAVDITQEDWELMRPVQKELYKTVTLQNYWNMVSLGLTVYRPTVIPILEEPWMVIK

SEQ ID NO: 4419 - protein, 81 aa, Hylobates moloch
TQPDEDLHLQVEETQLVKESVTFKDVAIDFTLEEWRLMDPTQRNLHKDVMLENYRNLVSLGLAVSKPDMISHLENGKGPWV

SEQ ID NO: 4420 - protein, 81 aa, Hylobates moloch
PEVTQPDEDLHLQVEETQLVKESVTFKDVAIDFTLEEWRLMDPTQRNLHKDVMLENYRNLVSLGLAVSKPDMISHLENGKG

SEQ ID NO: 4421 - protein, 81 aa, Hylobates moloch
FQEKITEEGEVAALHLTARSQETVTFKDVAMDFTPEEWGKLDPAQRDVMLENYRNLVSLWLPVSKPENHNLEHGKEPLKLE

SEQ ID NO: 4422 - protein, 81 aa, Hylobates moloch
EGEVAALHLTARSQETVTFKDVAMDFTPEEWGKLDPAQRDVMLENYRNLVSLWLPVSKPENHNLEHGKEPLKLERKAPKSS

SEQ ID NO: 4423 - protein, 81 aa, Hylobates moloch
ASQPAPLEERLIRDQDLGASLLPAAPQEQWRHLDSTQKEQYWDLMLETYGKMVSGAGISHSKSDLTNSIEYGEELAGLYLH

SEQ ID NO: 4424 - protein, 81 aa, Hylobates moloch
ASQPAPLEERLIRDQDLGASLLPAAPQEQWRHLDSTQKEQYWDLMLETYGKMVSGGISHSKSDLTNSIEYGEELAGLYLHV

SEQ ID NO: 4425 - protein, 81 aa, Hylobates moloch
AASQPAPLEERLIRDQDLGASLLPAAPQWRHLDSTQKEQYWDLMLETYGKMVSGGISHSKSDLTNSIEYGEELAGLYLHVN

SEQ ID NO: 4426 - protein, 81 aa, Hylobates moloch
ASQPAPLEERLIRDQDLGASLLPAAPQEQWRHLDSTQKEQYWDLMLETYGKMVSGGDRQENDKENLNLENHRDQELLHASC

SEQ ID NO: 4427 - protein, 81 aa, Hylobates moloch
VLFQEATAFEDMTKDWNYLEGSQKDCYRDTMLDSYENMVPQGSFLQFSMMPQRAGNDPPGVSNASEMEMEISTMREKFLMS

SEQ ID NO: 4428 - protein, 81 aa, Hylobates moloch
LQGKYGNVTKEVIVLYLTLCKQCHQKNPVPKRGLAPKPMTFKDIDSTCQVEIFDMQSSADGEFKFILYYQDHLTKFIILRP

SEQ ID NO: 4429 - protein, 81 aa, Hylobates moloch
LFSPGPKTVWSLWQQPVLFQEATAFEDMTKDWNYLEGSQKDCYRDTMLDSYENMVPQGSFLQFSMMPQRAGNDPPGVSNAS

SEQ ID NO: 4430 - protein, 81 aa, Hylobates moloch
ENSKEDKMVAVCPNTESCESITLKDVAVNFSRGEWKKLEPFQKELYKEVLLENLRNLEFLDFPVSKLELISQLKWVELPWL

SEQ ID NO: 4431 - protein, 81 aa, Hylobates moloch
MNTFQASVSFQDVTVEFSQEEWQHLGPVERTLYRDVMLENYSHLVSVGYCFTKPELIFTLEQGEDPWLLEKEKGFLSRNSP

SEQ ID NO: 4432 - protein, 81 aa, Hylobates moloch
PLRFSTLFQEQQKMNISQASVSFKDVTIEFTQEEWQQMAPVQKNLYRDVMLENYSNLISVGYCHFKPEVIFKLEHGEEPWF

SEQ ID NO: 4433 - protein, 81 aa, Hylobates moloch
EFTQEEWQQMAPVQKNLYRDVMLENYSNLISVGYCHFKPEVIFKLEHGEEPWFSEEEFSNQSHPSELLSSSRHNSAGVVRL

SEQ ID NO: 4434 - protein, 81 aa, Hylobates moloch
PTSASRVAGITGTHHNAQASVSFKDVTIEFTQEEWQQMAPVQKNLYRDVMLENYSNLISVGYCHFKPEVIFKLEHGEEPWF

SEQ ID NO: 4435 - protein, 81 aa, Hylobates moloch
MAPGLLTTREEALMAFWDVAVAFTQKEWKLLSSAQRTLYREVMLENYSHLVSVGIAFSKPKLIKQLEQGDEPWREENEHLD

SEQ ID NO: 4436 - protein, 81 aa, Hylobates moloch
REVMLENYSHLVSVGIAFSKPKLIKQLEQGDEPWREENEHLDLCPAQTPSSWLLDKQQAKQMFLRQGLIGLSWSKSKGAVP

SEQ ID NO: 4437 - protein, 81 aa, Hylobates moloch
LLSSAQRTLYREVMLENYSHLVSVGIAFSKPKLIKQLEQGDEPWREENEHLDLCPESRSVAQAGVQWHDLGSLQPLPPGFK

SEQ ID NO: 4438 - protein, 81 aa, Hylobates moloch
YREVMLENYSHLVSVGIAFSKPKLIKQLEQGDEPWREENEHLDLCPGEWEALGRRACRAVRSSAGKEGGAVFEVLGGSSSG

SEQ ID NO: 4439 - protein, 81 aa, Hylobates moloch
LENYSHLVSVGIAFSKPKLIKQLEQGDEPWREENEHLDLCPGEWEALGRRACRAVRSSAGKEGGAVFEVLGGSSSGLLGHW

SEQ ID NO: 4440 - protein, 81 aa, Hylobates moloch
MTKSLESVSFKDITVDFSRDEWQQLDLAQKSLYREVMLENYFNLISVGCQVPKPEVIFSLEQEEPCMLDGEIPSQSRLDGD

SEQ ID NO: 4441 - protein, 81 aa, Hylobates moloch
MAVDLLPTQEHVTFRDVAVFFSQDEWLHLDSAQRALYREVMLENYSSLVSLGIPFSMPKLIHQLQQGEDPCMVEREVSADT

SEQ ID NO: 4442 - protein, 81 aa, Hylobates moloch
MARRLLPAQVQESVTFRDVAVFFSQDEWLHLDSAQRALYREVMLENYSILVSLGILFSKPKVISQLEQGEDPWMVESGVPQ

SEQ ID NO: 4443 - protein, 81 aa, Hylobates moloch
MAVSHLPTMVQESVTFKDVAVLFTQEEWGQLSPAQRALYRDVMLENYSNLVSLGLLGPKPDMFSQLEKREVWMPEDTPGGF

SEQ ID NO: 4444 - protein, 81 aa, Hylobates moloch
MAAGQREARPQVSLTFEDVAVLFTRDEWRKLAPSQRNLYRDVMLENYRNLVSLGLSFTKPKVISLLQQGEDPWKVEKDSSG

SEQ ID NO: 4445 - protein, 81 aa, Hylobates moloch
MLENYSHLVSMGYPVSKPDVISKLEQGEEPWIIKGDISNWIYPDEYQADGRQDRKSKLHNSQACILGTVSFHHKILKGVTR

SEQ ID NO: 4446 - protein, 81 aa, Hylobates moloch
ADPSSSGPLEEQKMMKSQGLVSFKDVAVDFTQEEWQQLDPSQRTLYRDVMLENYSHLVSMGYPVSKPDVISKLEQGEEPWI

SEQ ID NO: 4447 - protein, 81 aa, Hylobates moloch
MGLVSFKDVAVDFTQEEWQQLDPSQRTLYRDVMLENYSHLVSMGYPVSKPDVISKLEQGEEPWIIKGDISNWIYPDEYQAD

SEQ ID NO: 4448 - protein, 81 aa, Hylobates moloch
MLENYGNVASLGFPLLKPAVISQLEGGGDLGGPSPLAAGTGLQGLRTDIQTDNDLTKEMYEGKENVSFVLQRDFSQETDFS

SEQ ID NO: 4449 - protein, 81 aa, Hylobates moloch
MAAIHLTAWPQKSVTFEDVAVYFTQAEWDGLSPAQRTLYRDVMLENYGNVASLGFPLLKPAVISQLEGGGDLGGPSPLAAG

SEQ ID NO: 4450 - protein, 81 aa, Hylobates moloch
MLENYGNVASLGFPLLKPAVISQLEGGGDLGGPSPLAAGTGLQGLRTDGVSLCHPNWSAVARTWLTATSVSWVRAILLPQP

SEQ ID NO: 4451 - protein, 81 aa, Hylobates moloch
IHLTAWPQKSVTFEDVAVYFTQAEWDGLSPAQRTLYRDVMLENYGNVASLGFPLLKPAVISQLEGGGDLGGPSPLAAGTGL

SEQ ID NO: 4452 - protein, 81 aa, Hylobates moloch
MLENYGNVASLGFPLLKPAVISQLEGGVDIQTDNDLTKEMYEGKENVSFVLQRDFSQETDFSEASLLEKQQEFYSARNIKK

SEQ ID NO: 4453 - protein, 81 aa, Hylobates moloch
QLEGGVDIQTDNDLTKEMYEGKENVSFVLQRDFSQETDFSEASLLEKQQEFYSARNIKKEKSNTIDGTVKDETSPVEECFF

SEQ ID NO: 4454 - protein, 81 aa, Hylobates moloch
MAAMPLKARYQEMVTFEDVAVHFTKTEWTGLSPAQRALYRSVMLENFGNLTALGYPVPKPALISLLEGGDMDWGLEAQDDP

SEQ ID NO: 4455 - protein, 81 aa, Hylobates moloch
MVTFEDVAVHFTKTEWTGLSPAQRALYRSVMLENFGNLTALGYPVPKPALISLLEGGDMDWGLEAQDDPPAERTKNVCKVI

SEQ ID NO: 4456 - protein, 81 aa, Hylobates moloch
MPLKARYQEMVTFEDVAVHFTKTEWTGLSPAQRALYRSVMLENFGNLTALGYPVPKPALISLLEGGDMDWGLEAQDDPPAE

SEQ ID NO: 4457 - protein, 81 aa, Hylobates moloch
MGLFSFRDVAVEFSLEEWEHLEPAQKNLYQDVMLENYRNLVSLGLVVSKPDLITFLEQRKESWNVKSEETVAIQPDVFSHY

SEQ ID NO: 4458 - protein, 81 aa, Hylobates moloch
MLENYRNLVSLGLVVSKPDLITFLEQRKESWNVKSEETVAIQPDVFSHYNKDLLTEHCTEASFQKVISRRHGNCDRENLHL

SEQ ID NO: 4459 - protein, 81 aa, Hylobates moloch
MGLLTFRDVAIEFSREEWEHLDSNQKLLYGDVMLENYRNLVSLGLAVSKPDLITFLEQRKEPWNVKSEETVAIQPEIFSHD

SEQ ID NO: 4460 - protein, 81 aa, Hylobates moloch
MGLLTFRDVAIEFSREEWEHLDSNQKLLYGDVMLENYRNLVSLGLAVSKPDLITFLEQRKEPWNVKSEETVAIQPEVKVNT

SEQ ID NO: 4461 - protein, 81 aa, Hylobates moloch
EVTEHLTGWAPAPVPSVEGLLTFRDVAIEFSREEWEHLDSNQKLLYGDVMLENYRNLVSLGLAVSKPDLITFLEQRKEPWN

SEQ ID NO: 4462 - protein, 81 aa, Hylobates moloch
PDLITFLEQRKEPWNVKSEETVAIQPEIFSHDTQVLLRKKLIEASFQKVILDGYGSCGPQNLNLRKEWESEEKNQYNKSDT

SEQ ID NO: 4463 - protein, 81 aa, Hylobates moloch
PAQGPGEARPSRKRGRRPRALKFVDVAVYFSPEEWGCLRPAQRALYRDVMRETYGHLGALGCAGPKPALISWLERNTDDWE

SEQ ID NO: 4464 - protein, 81 aa, Hylobates moloch
PAHVPGEAGPRRTRESRLGAVSFADVAVDFSPEEWGCLRPAQRALYRDVMRETFGHLGALGFSGPKPAFISWMEGEVEAWS

SEQ ID NO: 4465 - protein, 81 aa, Hylobates moloch
ALLLAPRPGETRPGCRKPGAVSFADVAVYFSPEEWGCLRPAQRALYRDVMRETYGHLGALGFPGPKPALISWMEQESEAWS

SEQ ID NO: 4466 - protein, 81 aa, Hylobates moloch
APLPPRDPNGAGPKWREPGAVNFADVAVYFCREEWGCLRPAQRALYRDVMRDTYGHLSALGIGGHKPALISWVEEEAELWG

SEQ ID NO: 4467 - protein, 81 aa, Hylobates moloch
SPLPPRDPNRAGLEWRKPGAVSFADVAVYFSREEWGCLRPAQRALYRDVMRETYGHLGALGESPNCSPGPCALTGPAAPLG

SEQ ID NO: 4468 - protein, 81 aa, Hylobates moloch
SPLPPRDPNRAGLEWRKPGAVSFADVAVYFSREEWGCLRPAQRALYRDVMRETYGHLGALGVGGSKPALISWVEEKAELWG

SEQ ID NO: 4469 - protein, 81 aa, Hylobates moloch
EAGSLHSGHQEQLNRKREHRPLPKNARPSPWVPALADEWNTLDQEVTTTQLPAGSQEPVKDIHVARGFSYKKNVHQIPAHR

SEQ ID NO: 4470 - protein, 81 aa, Hylobates moloch
TLDQEVTTTQLPAGSQEPVKDIHVARGFSYKKNVHQIPAHRDLYRDFRKENIGNVVSLGSTVSTSNKITRLEQRKEPWTLG

SEQ ID NO: 4471 - protein, 81 aa, Hylobates moloch
GGRQMSSEHVQDKPNQVQGSVSFTDVTVDFTQEEWEQLDPSQRILYMDVMLENYSNLLSVEVWKADDQMERDHRNPDEQAR

SEQ ID NO: 4472 - protein, 81 aa, Hylobates moloch
EQTQAAGMVAGCLINCYQDLVTFDDVAVDFTQEEWTLLDPSQRDLYRDVMLENYENLASVGHDLFKPNVICWLEEEEELRA

SEQ ID NO: 4473 - protein, 81 aa, Hylobates moloch
MAAPDLAHGGHVSRDSICLHEEQTQAAGMVAGCLINCYQDLVTFDDVAVDFTQEEWTLLDPSQRDLYRDVMLENYENLASV

SEQ ID NO: 4474 - protein, 81 aa, Hylobates moloch
MLENYENLASVGHDLFKPNVICWLEEEEELRAGRRGVLQEWRLKTKGPALWQDRSWLRTSNETQTARSHNGGQLCDCTQCG

SEQ ID NO: 4475 - protein, 81 aa, Hylobates moloch
MEPLTFRDVAIEFSPEEWKCLDPAQQNLFRDVMLENYRNLVSLAVCSHFTQDHWPVQGIEDSFHKLILRRYEKCGHDNLQL

SEQ ID NO: 4476 - protein, 81 aa, Hylobates moloch
AIEFSPEEWKCLDPAQQNLFRDVMLENYRNLVSLAVCSHFTQDHWPVQGIEDSFHKLILRRYEKCGHDNLQLRKGCKSLNE

SEQ ID NO: 4477 - protein, 81 aa, Hylobates moloch
MLENYRNLVSLAMCSHFTQDFLPVQGIEDSFHKLILRRYEKYGHDNLQLRKDCKSMSVCKVQKGVYSGINQCLSNTQSKIF

SEQ ID NO: 4478 - protein, 81 aa, Hylobates moloch
MLENYRNLVSLGVAISNPDLVTCLEQRKEPYNVKIHKIVARPPAMCSHFTQDFLPVQGIEDSFHKLILRRYEKYGHDNLQL

SEQ ID NO: 4479 - protein, 81 aa, Hylobates moloch
MELLTFRDVAIEFSPEEWKCLDPAQQNLYRDVMLENYRNLVSLGVAISNPDLVTCLEQRKEPYNVKIHKIVARPPAMCSHF

SEQ ID NO: 4480 - protein, 81 aa, Hylobates moloch
MELLTFRDVAIEFSPEEWKCLDSAQQSLYRDVMLENYRNLVSLGVAISNPDLVIYLEQRKEPYKVKIHETVAKHPAMCSHF

SEQ ID NO: 4481 - protein, 81 aa, Hylobates moloch
ELLTFRDVAIEFSPEEWKCLDSAQQSLYRDVMLENYRNLVSLGVAISNPDLVIYLEQRKEPYKVKIHETVAKHPAMCSHFT

SEQ ID NO: 4482 - protein, 81 aa, Hylobates moloch
MELLTFRDVAIEFSPEEWKCLDPAQQNLYRDVMLENYRNLVSLGVTISNPDLVTCLEQRKEPYNLKIHETAARPPGHYRKT

SEQ ID NO: 4483 - protein, 81 aa, Hylobates moloch
MELLTFRDVAIEFSPEEWKCLDPAQQNLYRDVMLENYRNLVSLGVTISNPDLVTCLEQRKEPYNLKIHETAARPPAVCSHF

SEQ ID NO: 4484 - protein, 81 aa, Hylobates moloch
MLENYRNLVSLGVTISNPDLVTCLEQRKEPYNLKIHETAARPPAVCSHFTQNLWTVQGIEDSFQELIPKGHEKRGHENLRK

SEQ ID NO: 4485 - protein, 81 aa, Hylobates moloch
MELLTFRDVAIEFSPEEWKCLDPAQQNLYRDVMLENYRNLVSLAICSPFSQDLSPVQGTEDSFHRLILRRYEKCGHENLQL

SEQ ID NO: 4486 - protein, 81 aa, Hylobates moloch
MNMSQASVSFQDVTVEFTQEEWQHLGPVERTLYREVMLENYSRLVSVGYCITKPMIYKLEQGAEPWSLDDEFLNQRYPGYF

SEQ ID NO: 4487 - protein, 81 aa, Hylobates moloch
MLENYSRLVSVGYCITKPMIYKLEQGAEPWSLDDEFLNQRYPGYFKVDHIKGIREKQEKPLWQEIFINDADKTLNKEGQVL

SEQ ID NO: 4488 - protein, 81 aa, Hylobates moloch
GSSGDQEMTATLLTAGFQTLEKIEDMAVSLIREEWLLDPSQKDLNRDNRPENFRNVFSLGGETRNENRELASKQVISTGIQ

SEQ ID NO: 4489 - protein, 81 aa, Hylobates moloch
GGCCREDAMVASRLTPGSQGLLKMEDVALTLTPGWTQLDSSQVNLYRDEKQENHSSLVSLGDGIQTKSRDLPPVKKLPEKE

SEQ ID NO: 4490 - protein, 81 aa, Hylobates moloch
GGCCREDAVVASRLTLESQGLLKVEDVALTLTPEWTQQDSSQGNLYRDEKQENHGSLVSLGDEKQTKSRDLPPAEELPEKE

SEQ ID NO: 4491 - protein, 81 aa, Hylobates moloch
GSQGNLPQADITLMSQAQESVTFEDVAVNFTNREWQCLTYAQRHLYKDVMLENYRNMASLGFPFPKPPLISHLEREVDPCV

SEQ ID NO: 4492 - protein, 81 aa, Hylobates moloch
ADITLMSQAQDSRSILFQESVTFEDVAVNFTNREWQCLTYAQRHLYKDVMLENYRNMASLGFPFPKPPLISHLEREVDPCV

SEQ ID NO: 4493 - protein, 81 aa, Hylobates moloch
EQLKPVEPRDCWREAWVKKKPVTFEDVAVNFTQEEWDCLDASQRVLYQDVMSETFKNLTSVARIFLHKPELITKLEQEEEQ

SEQ ID NO: 4494 - protein, 81 aa, Hylobates moloch
PVQKMLPWVGEVSATLQEAMKRDCWREAWVKKKPVTFEDVAVNFTQEEWDCLDASQRVLYQDVMSETFKNLTSVGVKDLSH

SEQ ID NO: 4495 - protein, 81 aa, Hylobates moloch
DVSDSEVWLDSHLGSPGLKVAGSTFQNDCLSEETVVPKTFKDLAQGCKELGSSGLDCQPLESQKESAEGTSRRCEGCGKGV

SEQ ID NO: 4496 - protein, 81 aa, Hylobates moloch
MEVVTFGDVAVHFSREEWQCLDPGQRALYREVMLENHSSVAGLAFSDPTLWFGYLCPCFPHDGNLWAWPSRGSAAFPGFLV

SEQ ID NO: 4497 - protein, 81 aa, Hylobates moloch
MAMALPMPGPQEAVVFEDVAVYFTRIEWGCLAPDQQALYRDVMLENYGNLASLGFLVAKPALISLLEQGEEPGALILQVAE

SEQ ID NO: 4498 - protein, 81 aa, Hylobates moloch
MAMALPMPGPQEAVVFEDVAVYFTRIEWGCLAPDQQALYRDVMLENYGNLASLALISLLEQGEEPGALILQVAEQSVAKAS

SEQ ID NO: 4499 - protein, 81 aa, Hylobates moloch
ENYGNLASLALISLLEQGEEPGALILQVAEQSVAKASLCTDSRMEAGIMESPLQRKLSRQAGLPGTVWGCLPRGHPAPPHP

SEQ ID NO: 4500 - protein, 81 aa, Hylobates moloch
LRKPNPQAMAALFLSAPPQAEVTFEDVAVFLSREEWGRLGPAQRGLYRDVMLETYGNLVSLALGTRTEYKELTSRKTFGEE

SEQ ID NO: 4501 - protein, 81 aa, Hylobates moloch
MAALFLSAPPQAEVTFEDVAVFLSREEWGRLGPAQRGLYRDVMLETYGNLVSLGVGPAGPKPGVISQLEQGDEPWVLDVQG

SEQ ID NO: 4502 - protein, 81 aa, Hylobates moloch
RKPNPQAMAALFLSAPPQAEVTFEDVAVFLSREEWGRLGPAQRGLYRDVMLETYGNLVSLGVGPAGPKPGVISQLEQGDEP

SEQ ID NO: 4503 - protein, 81 aa, Hylobates moloch
MAALFLSAPPQAEVTFEDVAVFLSREEWGRLGPAQRGLYRDVMLETYGNLVSLALGTRTEYKELTSRKTFGEEDPQGSEPV

SEQ ID NO: 4504 - protein, 81 aa, Hylobates moloch
MAATLQLPGHQEMPLTFQDVAVYFSQAEGQQLGPQQRALYRDVMLENYGNVASLGFPVPKPELISQLEQGKELWVLNLLGA

SEQ ID NO: 4505 - protein, 81 aa, Hylobates moloch
AAHAHRMAATLQLPGHQEMPLTFQDVAVYFSQAEGQQLGPQQRALYRDVMLENYGNVASLGFPVPKPELISQLEQGKELWV

SEQ ID NO: 4506 - protein, 81 aa, Hylobates moloch
MDVAQEPVTFRDVAIYFSREEWACLEPSQRALYRDVMLDNFSSVAALGFCSPRPDLVSRLEQWEEPWVEDQERPELQAVQR

SEQ ID NO: 4507 - protein, 81 aa, Hylobates moloch
MDVAQEPVTFRDVAIYFSREEWACLEPSQRALYRDVMLDNFSSVAALAPDQTSSLAWNSGRSRGLKTRRDLSSRQCRGGPG

SEQ ID NO: 4508 - protein, 81 aa, Hylobates moloch
FPVSSRCFQEQQETKKSLDMVSFEEVAVHFTWEEWQNLDDAQRTLYRDVMLETYSSLVSLGHHITKPEMIFKLEQGAEPWI

SEQ ID NO: 4509 - protein, 81 aa, Hylobates moloch
MAATLLMAGSQAPVTFEDMAMYLTREEWRPLDPAQRDLYRDVMQENYGNVVSLDFEIRSENEVNPKQEISEDVQFGTTSER

SEQ ID NO: 4510 - protein, 81 aa, Hylobates moloch
MGPLQFRDVAIEFSLEEWHCLDTAQRNLYRNVMLENYRNLVFLGIVISKPDLITCLEQGKKPLTMKKHEMVANPSVMCSHF

SEQ ID NO: 4511 - protein, 81 aa, Hylobates moloch
MGPLQFRDVAIEFSLEEWHCLDTAQRNLYRNVMLENYRNLVFLGIVISKPDLITCLEQGKKPLTMKKHEMVANPSETGFHH

SEQ ID NO: 4512 - protein, 81 aa, Hylobates moloch
MGPLQFRDVAIEFSLEEWHCLDTAQRNLYRDVMLENYRNLVFLGITVSKPDLITCLEQGKKPLTMKRNEMIAKPPVMCSHF

SEQ ID NO: 4513 - protein, 81 aa, Hylobates moloch
MGPLQFRDVAIEFSLEEWHCLDTAQRNLYRDVMLENYRNLVFLGITVSKPDLITCLEQGKKPLTMKRNEMIAKPPVSFLQV

SEQ ID NO: 4514 - protein, 81 aa, Hylobates moloch
MGPLQFRDVAIEFSLEEWHCLDTAQRNLYRNVMLENYRNLVFLGIVVSKPDLITRLEQGKKPSTMKRCEMVANPSEMVFHH

SEQ ID NO: 4515 - protein, 81 aa, Hylobates moloch
MGPLQFRDVAIEFSLEEWHCLDTAQRNLYRNVMLENYRNLVFLGIVVSKPDLITRLEQGKKPSTMKRCEMVANPSVLCSHF

SEQ ID NO: 4516 - protein, 81 aa, Hylobates moloch
GPLQFRDVAIEFSLEEWHCLDTAQRNLYRNVMLENYRNLVFLGIVVSKPDLITRLEQGKKPSTMKRCEMVANPSEMVFHHV

SEQ ID NO: 4517 - protein, 81 aa, Hylobates moloch
MGPLSFRDVAIEFSLKEWQCLDTAQQNLYRNVMLENYRNLVFLGIAVSKPDLITCLEQGKEAWSMKRHEIMVAKPAVVCSH

SEQ ID NO: 4518 - protein, 81 aa, Hylobates moloch
MLENYRNLVFLGIAVSKPDLITCLEQGKEAWSMKRHEIMVAKPAVVCSHFAQDLWPEQNIKDYFQKATLKRYGKCRHENLP

SEQ ID NO: 4519 - protein, 81 aa, Hylobates moloch
MGPLSFRDVAIEFSLKEWQCLDTAQQNLYRNVMLENYRNLVFLDLITCLEQGKEAWSMKRHEIMVAKPAVVCSHFAQDLWP

SEQ ID NO: 4520 - protein, 80 aa, Hylobates moloch
MGPLSFRDVAIEFSLKEWQCLDTAQQNLYRNVMLENYRNLVFLGIAVSKPDLITCLEQGKEAWSMKRHEIMVAKPAAYFV

SEQ ID NO: 4521 - protein, 81 aa, Hylobates moloch
MGPLSFRDVAIEFSLKEWQCLDTAQQNLYRNVMLENYRNLVFLGIAVSKPDLITCLEQGKEAWSMKRHEIMVAKPADGVSR

SEQ ID NO: 4522 - protein, 81 aa, Hylobates moloch
MGPLSFRDVAIEFSLKEWQCLDTAQQNLYRNVMLENYRNLVFLGIAVSKPDLITCLEQGKEAWSMKRHEIMVAKPAGGLSK

SEQ ID NO: 4523 - protein, 81 aa, Hylobates moloch
SGCPGADRNLLVYSFYEKGPLTFRDVAIEFSLEEWQCLDTAQQDLYRKVMLENYRNLVFLGIAVSKPDLITCLEQGKEPWN

SEQ ID NO: 4524 - protein, 81 aa, Hylobates moloch
MNVMLENYKNLVFLAGIAVSKQDPITSLEQEKEPWNMKRREMVDESPAMCSYFTRDLWPEQDIKDSFQQVILRRYRKCEHE

SEQ ID NO: 4525 - protein, 81 aa, Hylobates moloch
MNVMLENYKNLVFLGIAVSKQDPITSLEQEKEPWNMKRREMVDESPGQVWWLTPVIPALWEARAGALLEPRSLIPAWSTWK

SEQ ID NO: 4526 - protein, 81 aa, Hylobates moloch
MNVMLENYKNLVFLGIAVSKQDPITSLEQEKEPWNMKRREMVDESPGYMCRMCSYVFLFYERPLARARHKRFFSTSDTEKI

SEQ ID NO: 4527 - protein, 81 aa, Hylobates moloch
MNVMLENYKNLVFLGIAVSKQDPITSLEQEKEPWNMKRREMVDESPAMCSYFTRDLWPEQDIKDSFQQVILRRYRKCEHEN

SEQ ID NO: 4528 - protein, 81 aa, Hylobates moloch
METLTFRDVAIEFSLEEGECLNPAQRNLYMNVMLENYKNLVFLAMCSYFTRDLWPEQDIKDSFQQVILRRYRKCEHENLQL

SEQ ID NO: 4529 - protein, 81 aa, Hylobates moloch
SGCPGAERNLLVYSYFEKETLTFRDVAIEFSLEEWQCLSPAQQNLYMNVMLENYKNLVFLDIAVSKQDPVTCLEQEKEPWN

SEQ ID NO: 4530 - protein, 81 aa, Hylobates moloch
SRAQVILLPQPPELGLQETLTFRDVAIEFSLEEWQCLSPAQQNLYMNVMLENYKNLVFLDIAVSKQDPVTCLEQEKEPWNM

SEQ ID NO: 4531 - protein, 81 aa, Hylobates moloch
ASGCPGAERNLLVYSYFEKETLTFRDVAIEFSLEEWQCLSPAQQNLYMNVMLENYKNLVFLADIAVSKQDPVTCLEQEKEP

SEQ ID NO: 4532 - protein, 81 aa, Hylobates moloch
MNVMLENYKNLVFLADIAVSKQDPVTCLEQEKEPWNMKRHEMVDEPPAMCSYFTKDLWPEQDIKDSFQQVILRRYGKCEHE

SEQ ID NO: 4533 - protein, 81 aa, Hylobates moloch
MGPLTFMDVAIEFSLEEWQCLDTAQQNLYRTVMLENYRNLVFLGIAVSNLDLITCLEQGKEPWNMKRHEMVAKPPAMCSHF

SEQ ID NO: 4534 - protein, 81 aa, Hylobates moloch
SGYPGAERNLLEYSYFEKGPLTFRDVVIEFSQEEWQCLDTAQQDLYRKVMLENFRNLVFLGIAVSKPDLVTCLEQGRDPWN

SEQ ID NO: 4535 - protein, 81 aa, Hylobates moloch
ASGYPGAERNLLEYSYFEKGPLTFRDVVIEFSQEEWQCLDTAQQDLYRKVMLENFRNLVFLAGIAVSKPDLVTCLEQGRDP

SEQ ID NO: 4536 - protein, 81 aa, Hylobates moloch
TPGLPESLEMGPLTFRDVAIEFSLEEWQCLDTAQQDLYRKVMLENYRNLVFLAGIAVSKPDLVTCLEQGKDPWNMKRHSMV

SEQ ID NO: 4537 - protein, 81 aa, Hylobates moloch
MGPLTFRDVAIEFSLEEWQCLDTAQQDLYRKVMLENYRNLVFLAGIAVSKPDLVTCLEQGKDPWNMKRHSMVVKPPGRVSL

SEQ ID NO: 4538 - protein, 81 aa, Hylobates moloch
MGPLTFRDVAIEFSLEEWQCLDTAQQDLYRKVMLENYRNLVFLGIAVSKPDLVTCLEQGKDPWNMKRHSMVVKPPVICSHF

SEQ ID NO: 4539 - protein, 81 aa, Hylobates moloch
TPGLPESLEMGPLTFRDVAIEFSLEEWQCLDTAQQDLYRKVMLENYRNLVFLGIAVSKPDLVTCLEQGKDPWNMKRHSMVV

SEQ ID NO: 4540 - protein, 81 aa, Hylobates moloch
EFSLEEWQCLDTAQQDLYRKVMLENYRNLVFLAGIAVSKPDLVTCLEQGKDPWNMKRHSMVVKPPGGDCSIFLMEHQGDVT

SEQ ID NO: 4541 - protein, 81 aa, Hylobates moloch
MGPLTFTDVAIEFSLEEWQCLDTAQQNLYRNVMLENYRNLVFLGIAVSKPDLITCLEKEKEPCNIKRHEMVDEPPVVCSHF

SEQ ID NO: 4542 - protein, 81 aa, Hylobates moloch
MGPLTFTDVAIEFSLEEWQCLDTAQQNLYRNVMLENYRNLVFLGIAVSKPDLITCLEKEKEPCNIKRHEMVDEPPDGVSLL

SEQ ID NO: 4543 - protein, 81 aa, Hylobates moloch
RRYDKRGHENLQLRKGYKTVGDCKLYKVGYNGLNQCLTLTQSKMYHCDIYVKVFYAFSNADRYKRRHTGKKPFQCKKCGKS

SEQ ID NO: 4544 - protein, 81 aa, Hylobates moloch
ASGCPGAERSLLVQSSFEKGPLTFRDVAIEFSLEEWQCLDTAQQGLYRKVMLENYRNLVFLAGIAVTKPDLITCLEQGKEP

SEQ ID NO: 4545 - protein, 81 aa, Hylobates moloch
MLENYRNLVFLGIAVTKPDLITCLEQGKEPWNMKRHEMVAKPPVICSHFPQDLWPEQDIKDSFQEAILKKYGKYGHDNLQL

SEQ ID NO: 4546 - protein, 81 aa, Hylobates moloch
SGCPGAERSLLVQSSFEKGPLTFRDVAIEFSLEEWQCLDTAQQGLYRKVMLENYRNLVFLGIAVTKPDLITCLEQGKEPWN

SEQ ID NO: 4547 - protein, 81 aa, Hylobates moloch
MPGHPGSWEMGPLTFMDVAIEFCLEEWQCLDTAQQNLYRTVMLENYRNLVFLGIAVSKPDLITCLEQEKEPWEPMRRHEMV

SEQ ID NO: 4548 - protein, 81 aa, Hylobates moloch
MDVAIEFCLEEWQCLDTAQQNLYRTVMLENYRNLVFLGIAVSKPDLITCLEQEKEPWEPMRRHEMVAKPPVMCSHFTQDFW

SEQ ID NO: 4549 - protein, 81 aa, Hylobates moloch
MGPLTFMDVAIEFCLEEWQCLDTAQQNLYRTVMLENYRNLVFLGIAVSKPDLITCLEQEKEPWEPMRRHEMVAKPPVMCSH

SEQ ID NO: 4550 - protein, 81 aa, Hylobates moloch
MDVAIEFCLEEWQCLDTAQQNLYRTVMLENYRNLVFLGIAVSKPDLITCLEQEKEPWEPMRRHEMVAKPPGGIVSLLNVFD

SEQ ID NO: 4551 - protein, 81 aa, Hylobates moloch
MGPLTIRDVTVEFSLEEWQCLDIVQQNLYSDVMLENYRNLVFLGIAVSKRDLITCLKQGKEPWNMKRHEMVAKPPVMCSHI

SEQ ID NO: 4552 - protein, 81 aa, Hylobates moloch
MLENYRNLVFVGIAASKPDLITCLEQGKEPWNVKRHEMVAEPPVVCSYFAQDLWPKQGKKKYFQKVILRRYKKCGRENLQL

SEQ ID NO: 4553 - protein, 81 aa, Hylobates moloch
MPGPPGSLEMGVLTFRDVAIEFSLEEWQCLDITQQNLYRNVMLENYRNLVFVGIAASKPDLITCLEQGKEPWNVKRHEMVA

SEQ ID NO: 4554 - protein, 81 aa, Hylobates moloch
MELLTFRDVAIEFSPEEWKCLDPAQQNLYRDVMLENYRNLVSLAVYSYYKQGIVPEQGIEDSFKKATLGRYGSCGLENICL

SEQ ID NO: 4555 - protein, 81 aa, Hylobates moloch
MAGTQTLLTFRDVAIEFSLEEWKCLDLAQQNLYRDVMLENYRNLFSIGLTVSKPGLITCLEQRKEPWNVKRQEAVDGHPGY

SEQ ID NO: 4556 - protein, 81 aa, Hylobates moloch
MAGTQTLLTFRDVAIEFSLEEWKCLDLAQQNLYRDVMLENYRNLFSIGLTVSKPGLITCLEQRKEPWNVKRQEAVDGHPAM

SEQ ID NO: 4557 - protein, 81 aa, Hylobates moloch
MAGTQTLLTFRDVAIEFSLEEWKCLDLAQQNLYRDVMLENYRNLFSIGLTVSKPGLITCLEQRKEPWNVKRQEAVDGHPEM

SEQ ID NO: 4558 - protein, 81 aa, Hylobates moloch
MAGTQTLLTFRDVAIEFSLEEWKCLDLAQQNLYRDVMLENYRNLFSIGLTVSKPGLITCLEQRKEPWNVKRQEAVDGHPGP

SEQ ID NO: 4559 - protein, 81 aa, Hylobates moloch
VSVDKFTAMSSHFTQDVLPEQGIQDAFPKTILRGYGNCGLDNSHLRKDWRSLDEYKLQKDYNGLNQCSSTTHSKIFQCNKY

SEQ ID NO: 4560 - protein, 81 aa, Hylobates moloch
MTLLTFRDVAIEFSLEEWKCLDLAQQNLYRDVMLENYRNLFSIGLTVSKPGLITCLEQRKEPWNVKRQEAVDGHPEFHSIT

SEQ ID NO: 4561 - protein, 81 aa, Hylobates moloch
MTLLTFRDVAIEFSLEEWKCLDLAQQNLYRDVMLENYRNLFSIGLTVSKPGLITCLEQRKEPWNVKRQEAVDGHPAMSSHF

SEQ ID NO: 4562 - protein, 81 aa, Hylobates moloch
MAGTQTLLTFRDVAIEFSLEEWKCLDLAQQNLYRDVMLENYRNLFSIGLTVSKPGLITCLEQRKEPWNVKRQEAVDGHPAL

SEQ ID NO: 4563 - protein, 81 aa, Hylobates moloch
SHFTQDVLPEQGIQDAFPKTILRGYGNCGLDNSHLRKDWRSLDEYKLQKDYNGLNQCSSTTHSKIFQCNKYVKIFDNFSNV

SEQ ID NO: 4564 - protein, 81 aa, Hylobates moloch
VSKPGLITCLEQRKEPWNVKRQEAVDGHPAMSSHFTQDVLPEQGIQDAFPKTILRGYGNCGLDNSHLRKDWRSLDEYKLQK

SEQ ID NO: 4565 - protein, 81 aa, Hylobates moloch
MAGTQTLLTFRDVAIEFSLEEWKCLDLAQQNLYRDVMLENYRNLFSIGLTVSKPGLITCLEQRKEPWNVKRQEAVDGHPDI

SEQ ID NO: 4566 - protein, 80 aa, Hylobates moloch
MTLLTFRDVAIEFSLEEWKCLDLAQQNLYRDVMLENYRNLFSIGLTVSKPGLITCLEQRKEPWNVKRQEAVDGHPASTNI

SEQ ID NO: 4567 - protein, 81 aa, Hylobates moloch
MPLAERNLLVYSSSKETLLTFRDVAIEFSLEEWKCLDLAQQNLYRDVMLENYRNLFSIGLTVSKPGLITCLEQRKEPWNVK

SEQ ID NO: 4568 - protein, 80 aa, Hylobates moloch
MWAPREQLLGWATEALPAKDSAWSWKEKPRYLGPVTFEDVAVLFTEAEWKRLSLEQRNLYKEVMLENLRNLVLLVLSYQI

SEQ ID NO: 4569 - protein, 81 aa, Hylobates moloch
EALPAKDSAWSWKEKPRYLGPVTFEDVAVLFTEAEWKRLSLEQRNLYKEVMLENLRNLVLLVLELGSPRSGLLPLDLNLDL

SEQ ID NO: 4570 - protein, 81 aa, Hylobates moloch
ALPAKDSAWSWKEKPRYLGPVTFEDVAVLFTEAEWKRLSLEQRNLYKEVMLENLRNLVLLESKPEVHTCSSCPLAFGSQQF

SEQ ID NO: 4571 - protein, 81 aa, Hylobates moloch
EALPAKDSAWSWKEKPRYLGPVTFEDVAVLFTEAEWKRLSLEQRNLYKEVMLENLRNLVLLAESKPEVHTCSSCPLAFGSQ

SEQ ID NO: 4572 - protein, 81 aa, Hylobates moloch
MTRENWAHSALRQEGLVKGKDDTWKWGTSFQGSSSSVWETSHLHFRQLRYHETSGPQEALSRLRELCRRWLRPEARTKAQI

SEQ ID NO: 4573 - protein, 81 aa, Hylobates moloch
TLPQVGNSGDQAGATVLRMVRPQDAVAYEDLSVDYTQKKWKGLPLSQRALQWNMMPENDRSMASLDGETGTEEELIPKHHS

SEQ ID NO: 4574 - protein, 81 aa, Hylobates moloch
DFAQCTSPVPTLPQVGNSGDQAGATVLRMVRPQDAVAYEDLSVDYTQKKWKGLPLSQRALQWNMMPENDRSMASLGWSTMA

SEQ ID NO: 4575 - protein, 81 aa, Hylobates moloch
GNSGDQAGATVLRMVRPQDAVAYEDLSVDYTQKKWKGLPLSQRALQWNMMPENDRSMASLGENMMKGSELTPKQEIFKGSE

SEQ ID NO: 4576 - protein, 81 aa, Hylobates moloch
VGNSGDQAGATVLRMVRPQDAVAYEDLSVDYTQKKWKGLPLSQRALQWNMMPENDRSMASLAGENMMKGSELTPKQEIFKG

SEQ ID NO: 4577 - protein, 81 aa, Hylobates moloch
MVRPQDTVAYEDLSEDYTQKKWKGLPLSQRALHWNMMLENDRSMASLGRNMMESSELTPKQEIFKGSESSNSTSGGLFGVV

SEQ ID NO: 4578 - protein, 81 aa, Hylobates moloch
VHQRTHTGEKPYKCNSCGKAFSDSSQLTVHQRVHTGRNLMNVLSVGKPLVSVPLLITTSELMLERSPQVWLGHLLKAWFSE

SEQ ID NO: 4579 - protein, 81 aa, Hylobates moloch
MVRPQDTVAYEDLSEDYTQKKWKGLPLSQRALHWNMMLENDRSMASLAGRNMMESSELTPKQEIFKGSESSNSTSGGLFGV

SEQ ID NO: 4580 - protein, 81 aa, Hylobates moloch
EDYTQKKWKGLPLSQRALHWNMMLENDRSMASLAGRNMMESSELTPKQEIFKGSESSNSTSGGLFGVVPGGTETGDVCEDT

SEQ ID NO: 4581 - protein, 81 aa, Hylobates moloch
TPAAQMPALFQREGCPGDQETMTFKDVEVTFSQDEWGWLDSAQRNLYRDVMLENYRNMASLVGPFTKPALISWLEAREPWG

SEQ ID NO: 4582 - protein, 81 aa, Hylobates moloch
MMTAVSLTTRPQESVAFEDVAVYFTAKEWDIMVPAERALYRDVMLENYEAVAFVVPPTSKPALVSHLEQGKESCFTRPQGV

SEQ ID NO: 4583 - protein, 81 aa, Hylobates moloch
YEAVAFVVPPTSKPALVSHLEQGKESCFTRPQGVLCRNDWRAGLIGYLELRRYTYLAKALLRTVVSKIFQNRQSWEDRRKA

SEQ ID NO: 4584 - protein, 81 aa, Hylobates moloch
LGLVLELLPGQPALPRARRESVTFEDVAVYFSENEWIGLGPAQRALYRDVMLENYGAVASLAFPFPKPALISQLERGEAPW

SEQ ID NO: 4585 - protein, 81 aa, Hylobates moloch
MLQTTWPQESVTFEDVAVYFTQNQWASLDPAQRALYREVMLENYANVASLVAFPFPKPALISHLERGEAPWGPDPWDTEIP

SEQ ID NO: 4586 - protein, 81 aa, Hylobates moloch
MLQTVWFQGLSKNLLFQEPVTFEDVAVYFTQNEWASLHLKQRALYREVMLENYENVTSLSAFPFPKPDLIFQLEQGEAAGP

SEQ ID NO: 4587 - protein, 81 aa, Hylobates moloch
MLQTVWFQGLSKNLLFQEPVTFEDVAVYFTQNEWASLHLKQRALYREVMLENYENVTSLYPTAGGFPLGTERTEKVPGALS

SEQ ID NO: 4588 - protein, 81 aa, Hylobates moloch
MLQTVWFQGLSKNLLFQEPVTFEDVAVYFTQNEWASLHLKQRALYREVMLENYENVTSCRARWLKPVIPALWEAEAGGSQE

SEQ ID NO: 4589 - protein, 81 aa, Hylobates moloch
GLSKNLLFQEPVTFEDVAVYFTQNEWASLHLKQRALYREVMLENYENVTSCRARWLKPVIPALWEAEAGGSQAAFPFPKPD

SEQ ID NO: 4590 - protein, 81 aa, Hylobates moloch
MLQTVWFQGLSKNLLFQEPVTFEDVAVYFTQNEWASLHLKQRALYREVMLENYENVTSCRARWLKPVIPALWEAEAGGSQA

SEQ ID NO: 4591 - protein, 81 aa, Hylobates moloch
EEAAQKRKEKDPSMVLPQGHLTFRDVGIEFSLEEWKCLDPAPRALYRAVMLENYRNLHSVDISSKCMLKKFSSTGQGNTEV

SEQ ID NO: 4592 - protein, 81 aa, Hylobates moloch
KKVTFEDVAIDFTQEEWAMMDTSKRKLYRDVMLENISHLVSLGYQMSKSYIILQLEQGKELWREGREFLQGQNPDRESAVK

SEQ ID NO: 4593 - protein, 81 aa, Hylobates moloch
MPSLDSMTFEDIVVDFTQEEWALLDTSQRKLFQDVMLENISHLVSIGKQLCKSTVLSHLEQVEKFSTQRISLLQGREVDIK

SEQ ID NO: 4594 - protein, 81 aa, Hylobates moloch
VDIKHQEIPFIQHIYQKGTSTISTLRSHTQEDPFLCNDIGEDFTQHIALTQNVITYMRKKHFESGRSCEHQSVVTATSIKT

SEQ ID NO: 4595 - protein, 81 aa, Hylobates moloch
TQRISLLQGREVDIKHQEIPFIQHIYQKGTSTISTLRSHTQEDPFLCNDIGEDFTQHIALTQNVITYMRKKHFVSKKFGKT

SEQ ID NO: 4596 - protein, 81 aa, Hylobates moloch
STVLSHLEQVEKFSTQRISLLQGREVDIKHQEIPFIQHIYQKGTSTISTLRSHTQEDPFLCNDIGEDFTQHIALTQNVITY

SEQ ID NO: 4597 - protein, 81 aa, Hylobates moloch
QEENVRDTQQVTTLQLPPNRVSPFKDMILCFSEEDWSLLDPAQTGFYGEFIIGEDYGVSVPPNDLAAQPDLSQGGENEPRV

SEQ ID NO: 4598 - protein, 81 aa, Hylobates moloch
GSGGKKAQIISVLSQIYVNRVSPFKDMILCFSEEDWSLLDPAQTGFYGEFIIGEDYGVSVPPNDLAAQPDLSQGGENEPRV

SEQ ID NO: 4599 - protein, 81 aa, Hylobates moloch
MAGSQGLLIFKDVAIEFSPEEWSYLDPAQQNLYRDVMLENYRNLVSLGIAVSKPDLITCLEQRNEPWNVKKHETVARHPAV

SEQ ID NO: 4600 - protein, 81 aa, Hylobates moloch
MSGHPGRWETNSVAFEDVAVNFTQEEWALLDPSQKNLYRDVMQETFRNLASIGNKGEDQSIEDQYKNSSRNLSSFQIHQRS

SEQ ID NO: 4601 - protein, 81 aa, Hylobates moloch
MSGHPGRWETNSVAFEDVAVNFTQEEWALLDPSQKNLYRDVMQETFRNLASIGNKGEDQSIEDQYKNSSRNLRHIIPHSGN

SEQ ID NO: 4602 - protein, 81 aa, Hylobates moloch
MSGHPGRWETNSVAFEDVAVNFTQEEWALLDPSQKNLYRDVMQETFRNLASIGNKGEDQSIEDQYKNSSRNLRHKRIHTGE

SEQ ID NO: 4603 - protein, 81 aa, Hylobates moloch
RHFRRPEPSREPRASPTQDSVAFEDVAVNFTQEEWALLNSSQKNLYREVMQETCRNLASVGSKWKDQNIEDHFEKPGKNIR

SEQ ID NO: 4604 - protein, 81 aa, Hylobates moloch
MDSVAFEDVAVNFTQEEWALLNSSQKNLYREVMQETCRNLASVGSKWKDQNIEDHFEKPGKNIRKHMVQKLCESKEGSQYG

SEQ ID NO: 4605 - protein, 81 aa, Hylobates moloch
AELLHPVCTCGRHFRRPEPSREPRASPTQDSVAFEDVAVNFTQEEWALLNSSQKNLYREVMQETCRNLASVENIWYRNCVK

SEQ ID NO: 4606 - protein, 81 aa, Hylobates moloch
MGLLAFRDVALEFSPEEWECLDPAQRSLYRDVMLENYRNLFSLGLAVSKPELIMCLEARKEPWNVNTERTAKHSVETRFHH

SEQ ID NO: 4607 - protein, 81 aa, Hylobates moloch
MGLLAFRDVALEFSPEEWECLDPAQRSLYRDVMLENYRNLFSLGLAVSKPELIMCLEARKEPWNVNTERTAKHSALSSYLT

SEQ ID NO: 4608 - protein, 81 aa, Hylobates moloch
EARKEPWNVNTERTAKHSALSSYLTEDILPEQGLQVSFQKVMLRRYERCCLEKLRLRNDWEIVVETRFHRVSQDGLDLLTS

SEQ ID NO: 4609 - protein, 81 aa, Hylobates moloch
MDSVSFEDVAVAFTQEEWALLDHSQKNLYRDVMQEIFRNLASVGNKSEDQNIQDDFKNPGRNLSSHVVERLFEIKEGSQYG

SEQ ID NO: 4610 - protein, 81 aa, Hylobates moloch
MGLLAFRDVALEFSPEEWECLDPAQRSLYRDVMLENYRNLFSLGEDNFNMQFLFHSLAVSKPELIMCLEARKEPWNVNTER

SEQ ID NO: 4611 - protein, 81 aa, Hylobates moloch
RKEPWNVNTERTAKHSALSSYLTEDILPEQGLQVSFQKVMLRRYERCCLEKLRLRNDWEIPCEYVLASRLPSAMIVSFLRL

SEQ ID NO: 4612 - protein, 81 aa, Hylobates moloch
FSLGLAVSKPELIMCLEARKEPWNVNTERTAKHSALSSYLTEDILPEQGLQVSFQKVMLRRYERCCLEKLRLRNDWEIVAM

SEQ ID NO: 4613 - protein, 81 aa, Hylobates moloch
LFHSLAVSKPELIMCLEARKEPWNVNTERTAKHSALSSYLTEDILPEQGLQVSFQKVMLRRYERCCLEKLRLRNDWEIVAM

SEQ ID NO: 4614 - protein, 81 aa, Hylobates moloch
NSLPQVILLPNPPKVLRLQGLLAFSDVVIEFSPEEWACLDPAQRNLYRDVMFENYRNLVSLAILSYSIQDLLPEQDMKDLC

SEQ ID NO: 4615 - protein, 81 aa, Hylobates moloch
AQRNLYRDVMFENYRNLVSLAILSYSIQDLLPEQDMKDLCQKVTLTRHRSWGLDNLHLVKDRRTVNEGKGQKEYYNRLTQC

SEQ ID NO: 4616 - protein, 81 aa, Hylobates moloch
SQEESPEEDTERTEQKPTVKDAFKDISIYFTKEEWAEMGDWEKTRYRNVKRNYNALITIGLRATRPAFMCHRRQAIKLQVD

SEQ ID NO: 4617 - protein, 81 aa, Hylobates moloch
RQAIKLQVDDTEDSDEEWTPRQQVKPPWMALRMEQRKHQKGMPKASFSNESSLKELSGAANLLNASGSEQAQKPVSPPGEA

SEQ ID NO: 4618 - protein, 81 aa, Hylobates moloch
SGDPSGEGTSGSGSVSIRKPVSEMQLQVQSQQEELEQLKKDLSSQKELVRLLQQTVRSSQYDKYFTSSRLCEGVPKDTLEL

SEQ ID NO: 4619 - protein, 81 aa, Hylobates moloch
SSGDPSGEGTSGSGSVSIRKPVSEMQLQVQSQQEELEQLKKDLSSQKELVRLLQQTVRSSQYDKYFTSSRLCEGVPKDTLE

SEQ ID NO: 4620 - protein, 81 aa, Hylobates moloch
KENLEDISAWGLPEARSKESVSFKDVAVDFTQEEWGQLDSPQRALYRDVMLENYQNLLALGAGPPLHKPDVISHLERGEEP

SEQ ID NO: 4621 - protein, 81 aa, Hylobates moloch
VDRRRSAGTTKEAGRPLEMAVSEPEASAAEWKQLDPAQRNLYNDVMLENYSNQASMAPKPDMISKLEKGEAPWLGKRKRPS

SEQ ID NO: 4622 - protein, 81 aa, Hylobates moloch
KEAGRPLEMAVSEPEASAAVSVTFKHVTMAFTQKEWKQLDPAQRNLYNDVMLENYSNQASMAPKPDMISKLEKGEAPWLGK

SEQ ID NO: 4623 - protein, 81 aa, Hylobates moloch
MAAGLLTAGPRGSTFFSSVTVAFAQKGWRCLVSTPRDKFKEGIPGKCRNLVLLGLPVSQPGMNSQLEQREGTWMLEGEDLR

SEQ ID NO: 4624 - protein, 81 aa, Hylobates moloch
ENTGEEGMAAGLLTAGPRGSTFFSSVTVAFAQKGWRCLVSTPRDKFKEGIPGKCRNLVLLGLPVSQPGMNSQLEQREGTWM

SEQ ID NO: 4625 - protein, 81 aa, Hylobates moloch
GDDAFAKRPRDDAKTSEKRSKALDDIATYFSKKEWENMKYSEKISYVYMKRNYEAMTKLGFNVTLPPFMCNKQATDFQGND

SEQ ID NO: 4626 - protein, 81 aa, Hylobates moloch
MIESQEPVTFEDVAVDFTQEEWQQLNPAQKTLHRDVMLETYNHLVSVGCSGIKPDVIFKLEHGEDPWIIESELSRWIYPDL

SEQ ID NO: 4627 - protein, 81 aa, Hylobates moloch
MPANEDAPQPGEHGSACEVSVSFEDVTVDFSREEWQQLDSTQRRLYQDVMLENYSHLLSVGFKVPKPEVIFKLEQGEGPWT

SEQ ID NO: 4628 - protein, 81 aa, Hylobates moloch
SPPWSPALAAEGRGSSCEASVSFEDVTVDFSREEWQHLDPAQRRLYWDVTLENYSHLLSVGYQVPKSEATFKLEQGEGPWT

SEQ ID NO: 4629 - protein, 81 aa, Hylobates moloch
AAHVSADHAALNRIVSLQASVSFEDVTVDFSREEWQHLDPAQRRLYWDVTLENYSHLLSVGYQVPKSEATFKLEQGEGPWT

SEQ ID NO: 4630 - protein, 81 aa, Hylobates moloch
EGEAPHQSCSGGAIGKMQQQGIPGGIFFHCERFDQPIGEDSLCSILEELWQDNNQLEQRQENQNNLLSHVKVLIKERGYEP

SEQ ID NO: 4631 - protein, 81 aa, Hylobates moloch
RPWLQRDVAAHVRIVSLQASVSFEDVTVDFSREEWQHLDPAQRRLYWDVTLENYSHLLSVGYQVPKSEATFKLEQGEGPWT

SEQ ID NO: 4632 - protein, 81 aa, Hylobates moloch
MAMSQESLTFKDVFVDFTLEEWQQLDSAQKNLYRDVMLENYSHLVSVGYLVVKPDVIFRLGPGEESWMADGGTPVRTCAGE

SEQ ID NO: 4633 - protein, 81 aa, Hylobates moloch
MAMSQESLTFKDVFVDFTLEEWQQLDSAQKNLYRDVMLENYSHLVSVGYLVVKPDVIFRLGPGEESWMADGGTPVRTCAVE

SEQ ID NO: 4634 - protein, 81 aa, Hylobates moloch
MAMSQESLTFKDVFVDFTLEEWQQLDSAQKNLYRDVMLENYSHLVSVGYLVVKPDVIFRLGPGEESWMADGGTPVRTCAVW

SEQ ID NO: 4635 - protein, 81 aa, Hylobates moloch
MAMSQESLTFKDVFVDFTLEEWQQLDSAQKNLYRDVMLENYSHLVSVGYLVVKPDVIFRLGPGEESWMADGGTPVRTCAEV

SEQ ID NO: 4636 - protein, 81 aa, Hylobates moloch
MSMSQESLTFKDVFVDFTLEEWQQLDSAQKNLYRDVMLENYSHLVSVGYLVVKPDVIFRLGPGEESWMADGGTPVRTCAGT

SEQ ID NO: 4637 - protein, 81 aa, Hylobates moloch
MSMSQESLTFKDVFVDFTLEEWQQLDSAQKNLYRDVMLENYSHLVSVGYLVVKPDVIFRLGPGEESWMADGGTPVRTCAGE

SEQ ID NO: 4638 - protein, 81 aa, Hylobates moloch
MSMSQESLTFKDVFVDFTLEEWQQLDSAQKNLYRDVMLENYSHLVSVGYLVVKPDVIFRLGPGEESWMADGGTPVRTCAEV

SEQ ID NO: 4639 - protein, 81 aa, Hylobates moloch
VVKPDVIFRLGPGEESWMADGGTPVRTCAGEDRPGESGQGKGTRLVGESLASGMRSGALLRAPDLWTCLGSDERNCCHVQM

SEQ ID NO: 4640 - protein, 81 aa, Hylobates moloch
KNSWAGTLTKKPSLYMKESLLTFEDVAVYFSEEEWQLLNPLEKTLYNDVMQDIYETVISLGLKLKNDTGNDHPISVSTSEI

SEQ ID NO: 4641 - protein, 81 aa, Macaca mulatta
LQEENVRDTQQVTTLQLPPNRVSPFKDMILCFSEEDWSLLDPAQTGFYGEFIIGEDCGVSIPPNELAAQPDLSQREENEPR

SEQ ID NO: 4642 - protein, 81 aa, Macaca mulatta
LGSGGKKAQIISVLSQIYMNRVSPFKDMILCFSEEDWSLLDPAQTGFYGEFIIGEDCGVSIPPNELAAQPDLSQREENEPR

SEQ ID NO: 4643 - protein, 81 aa, Macaca mulatta
MGLLIFRDVAIEFSPEEWSYLDPAQQNLYRDVMLENYRNLVSLGIAVSKPDLITCLEQRNEPWNVKKHETIGRHPAVSSHF

SEQ ID NO: 4644 - protein, 81 aa, Macaca mulatta
MSGHPGSWEMNSVAFEDVAVNFTQEEWALLDPSQKNLYRDVMQETFRNLASIGNKGKDQSIEDQYKNSSRNLSSFQMHQRN

SEQ ID NO: 4645 - protein, 81 aa, Macaca mulatta
MSGHPGSWEMNSVAFEDVAVNFTQEEWALLDPSQKNLYRDVMQETFRNLASIGNKGKDQSIEDQYKNSSRNLRHIISHSGT

SEQ ID NO: 4646 - protein, 81 aa, Macaca mulatta
MDSVAFEDVAVNFTQEEWALLDSSQKNLYREVMQETCRNLASVGNKWKDQNIEDHFEKPGKDIRNDMVQRLCESKEGSQCG

SEQ ID NO: 4647 - protein, 81 aa, Macaca mulatta
MGLLAFRDVALEFSPEEWECLDPAQRNLYRDVMLENYRNLFSLGLAMSKPELIIYLEARKEPWNVNTEKTAKHSVETFRHV

SEQ ID NO: 4648 - protein, 81 aa, Macaca mulatta
MGLLAFRDVALEFSPEEWECLDPAQRNLYRDVMLENYRNLFSLGLAMSKPELIIYLEARKEPWNVNTEKTAKHSALSSYLT

SEQ ID NO: 4649 - protein, 81 aa, Macaca mulatta
EARKEPWNVNTEKTAKHSALSSYLTEDILPEQGLQISFQKVMLRRYERCCLEKLRLRNDWEIVVETGFHHVSQDGLHLLTS

SEQ ID NO: 4650 - protein, 81 aa, Macaca mulatta
MDSVSFEDVAVAFTQEEWALLDPSQKNLYRDVMQEIFRNLASVGNKSEDQNIQDDFKNPGGNLSSHVVERLFEIKEGSQYG

SEQ ID NO: 4651 - protein, 81 aa, Macaca mulatta
MGLLAFRDVALEFSPEEWECLDPAQRNLYRDVMLENYRNLFSLGEDHFNMQFLFHRLAMSKPELIIYLEARKEPWNVNTEK

SEQ ID NO: 4652 - protein, 81 aa, Macaca mulatta
RKEPWNVNTEKTAKHSALSSYLTEDILPEQGLQISFQKVMLRRYERCCLEKLRLRNDWEIPCEEVLASPLPSAMIVSFMRP

SEQ ID NO: 4653 - protein, 81 aa, Macaca mulatta
FSLGLAMSKPELIIYLEARKEPWNVNTEKTAKHSALSSYLTEDILPEQGLQISFQKVMLRRYERCCLEKLRLRNDWEIVAM

SEQ ID NO: 4654 - protein, 81 aa, Macaca mulatta
LFHRLAMSKPELIIYLEARKEPWNVNTEKTAKHSALSSYLTEDILPEQGLQISFQKVMLRRYERCCLEKLRLRNDWEIVAM

SEQ ID NO: 4655 - protein, 81 aa, Macaca mulatta
QKALYREVMRMNYETVLSLEFPFPKPDMITRLEGEEESQNSDEWQLHGGTSAENEESDVKPPDWPHPMNATSQFPQPQHFD

SEQ ID NO: 4656 - protein, 81 aa, Macaca mulatta
SLPQVILLPNPPKVFKLGLLAFSDVVIEFSPEEWACLDPAQRNLYRDVMFENYRNLVSLAILSYSIQDLLPEQDMKDLCQK

SEQ ID NO: 4657 - protein, 81 aa, Macaca mulatta
RNLYRDVMFENYRNLVSLAILSYSIQDLLPEQDMKDLCQKVTLTRHRSWGLDNLHLVKDWRTVNEGKGQKECYNRLTQCSS

SEQ ID NO: 4658 - protein, 81 aa, Macaca mulatta
MPGHTEIRKTGLLAFSDVVIEFSPEEWACLDPAQRNLYRDVMFENYRNLVSLAILSYSIQDLLPEQDMKDLCQKVTLTRHR

SEQ ID NO: 4659 - protein, 81 aa, Macaca mulatta
QRNLYRDVMFENYRNLVSLAILSYSIQDLLPEQDMKDLCQKVTLTRHRSWGLDNLHLVKDWRTVNEGKGQKECYNRLTQCS

SEQ ID NO: 4660 - protein, 81 aa, Macaca mulatta
MIHPPWPPKVLGLQGLLAFSDVVIEFSPEEWACLDPAQRNLYRDVMFENYRNLVSLGPANSLCTLCFCEFHRFGFSIQDFQ

SEQ ID NO: 4661 - protein, 81 aa, Macaca mulatta
VCAFEGANTSTSSYKLVYTAILSYSIQDLLPEQDMKDLCQKVTLTRHRSWGLDNLHLVKDWRTVNEGKGQKECYNRLTQCS

SEQ ID NO: 4662 - protein, 81 aa, Macaca mulatta
MINFQESVTFQDVAVDFTAEEWQLLDCTERTLYWDVMLENYRNLISVGCPINKTKVILKVEQGQEPWMVEGVNLHQSSPES

SEQ ID NO: 4663 - protein, 81 aa, Macaca mulatta
MINFQESVTFQDVAVDFTAEEWQLLDCTERTLYWDVMLENYRNLISVGCPINKTKVILKVEQGQEPWMVEGVNLHQSSPGC

SEQ ID NO: 4664 - protein, 81 aa, Macaca mulatta
RESVEDEVTPGLPTAESHELLTFKDISVDFTQEEWGQLAPAYQNLYREVMLENYSNLVSVGYQLSKPSVISQLEKGEEPWM

SEQ ID NO: 4665 - protein, 81 aa, Macaca mulatta
EEPWMAEKEGPGDPSSDLKSKMETIESSAKSAISQERLYHGIMMERFMRDDIIYSTLRKASTYDDVLERHQETCVRDVRQA

SEQ ID NO: 4666 - protein, 81 aa, Macaca mulatta
IRFGDQRISKQIQRRLLIKELLTFKDISVDFTQEEWGQLAPAYQNLYREVMLENYSNLVSVAGYQLSKPSVISQLEKGEEP

SEQ ID NO: 4667 - protein, 81 aa, Macaca mulatta
GDSLDSRVALGPLTAESQELLTFKDVSVDFTQEEWGQLAPAHRNLYREVMLENYGNLVSVGYQLSKPGVISQLEKGEEPWL

SEQ ID NO: 4668 - protein, 81 aa, Macaca mulatta
MAATLLMAGSQAPVTFEDMAMYLTREEWRPLDPAQRDLYRDVMQENYGNVVSLDFEIRSENEVNPKQEISEDVQFGTSERP

SEQ ID NO: 4669 - protein, 81 aa, Macaca mulatta
QFGTSERPAENAEENPESEEGFESGDRSERQWGDLTAEEWVSYPLQQVTDLLVHKEVHTGIRYHICSHCGKAFSQISDLNR

SEQ ID NO: 4670 - protein, 81 aa, Macaca mulatta
LPECSVRFHNQQTVNKSLGLVSFEEVAVHFTWEEWQDLDDAQRTLYRDVMLETYSSLVSLGHCITKPEVIFKLEQGAEPWL

SEQ ID NO: 4671 - protein, 81 aa, Macaca mulatta
KENPEDISGWGLPEARSKESVSFKDVAVDFTQEEWGQLDSPQRALYRDVMLENYQNLLALGPPLHKPDVISHLERGEEPWS

SEQ ID NO: 4672 - protein, 81 aa, Macaca mulatta
KENPEDISGWGLPEARSKESVSFKDVAVDFTQEEWGQLDSPQRALYRDVMLENYQNLLALEWQLKAVPSQQQGICKEEPAQ

SEQ ID NO: 4673 - protein, 81 aa, Macaca mulatta
LKENPEDISGWGLPEARSKESVSFKDVAVDFTQEEWGQLDSPQRALYRDVMLENYQNLLALAGPPLHKPDVISHLERGEEP

SEQ ID NO: 4674 - protein, 81 aa, Macaca mulatta
MAFRDVAVDFTQDEWRLLSPAQRTLYREVMLENYSNLVSLGISFSKPELITQLEQGKETWREEKNCSPATCPADPEPELYL

SEQ ID NO: 4675 - protein, 81 aa, Macaca mulatta
MAFRDVAVDFTQDEWRLLSPAQRTLYREVMLENYSNLVSLGISFSKPELITQLEQGKETWREEKNCSPATCPDPEPELYLD

SEQ ID NO: 4676 - protein, 81 aa, Macaca mulatta
MAHMAFRDVAVDFTQDEWRLLSPAQRTLYREVMLENYSNLVSLGISFSKPELITQLEQGKETWREEKNCSPATCPADPEPE

SEQ ID NO: 4677 - protein, 81 aa, Macaca mulatta
MAFRDVAVDFTQDEWRLLSPAQRTLYREVMLENYSNLVSLGISFSKPELITQLEQGKETWREEKNCSPATCPDHQKYGNNC

SEQ ID NO: 4678 - protein, 81 aa, Macaca mulatta
LPSNDTDWPQEKEGKAQIVVPVTFRDVAVIFTEAEWKRLSPEQRNLYKEVMLENYRNLLSLAEPKPEIYPCSSCLLAFSCQ

SEQ ID NO: 4679 - protein, 81 aa, Macaca mulatta
AKGLPSNDTDWPQEKEGKAQIVVPVTFRDVAVIFTEAEWKRLSPEQRNLYKEVMLENYRNLLSLGHGIETILANMVKPHLY

SEQ ID NO: 4680 - protein, 81 aa, Macaca mulatta
PSNDTDWPQEKEGKAQIVVPVTFRDVAVIFTEAEWKRLSPEQRNLYKEVMLENYRNLLSLDRISLLLPRLECNGAISAHHN

SEQ ID NO: 4681 - protein, 81 aa, Macaca mulatta
KNGENVETMKKLIQNHKAKGLPSNDTDWPQEKEGKAQIVVPVTFRDVAVIFTEAEWKRLSPEQRNLYKEVMLENYRNLLSL

SEQ ID NO: 4682 - protein, 81 aa, Macaca mulatta
IQNHKAKGLPSNDTDWPQEKEGKAQIVVPVTFRDVAVIFTEAEWKRLSPEQRNLYKEVMLENYRNLLSLDGGQKQQDAAAY

SEQ ID NO: 4683 - protein, 81 aa, Macaca mulatta
MALSLGHFRWSRIGLLQGSVLFEDVSVDFTQKEWQLLNPAQRLLYRDVMLENYRHLVSMGHCVTKPELIVKLKQGEESWIL

SEQ ID NO: 4684 - protein, 81 aa, Macaca mulatta
MENEKERSVSFQDLTVNFTQEEWQQLDPAQRLLYRDVMLENYSNLVSVGYHVSKPDVIFKLEQGEEPWIVEEFSNQNYPEV

SEQ ID NO: 4685 - protein, 81 aa, Macaca mulatta
LKMNKFQRSVSFQDLTVNFTQEEWQQLDPAQRLLYRDVMLENYSNLVSVGYHVSKPDVIFKLEQGEEPWIVEEFSNQNYPE

SEQ ID NO: 4686 - protein, 81 aa, Macaca mulatta
MLENYSNLVSVGYHVSKPDVIFKLEQGEEPWIVEEFSNQNYPEVNDALEKNKEIQDKHLTQTVFFGNKTLITERENVFGKT

SEQ ID NO: 4687 - protein, 81 aa, Macaca mulatta
MIQSQISFEDVAVDFTLEEWQLLNPTQKNLYRDVMLENYSNLIFLEVWLDNPKMWLRDNQDNLKSMERGHKYDVFGKIFNS

SEQ ID NO: 4688 - protein, 81 aa, Macaca mulatta
MIQSQISFEDVAVDFTLEEWQLLNPTQKNLYRDVMLENYSNLIFLGYQILKPKLEQQDPWIIGQEILNNFSEVWLDNPKMW

SEQ ID NO: 4689 - protein, 81 aa, Macaca mulatta
MATSFRTASCWGLLSFKDISMEFTWDEWQLLDSTQKYLYRDVILENYHNLLSVGYHGTKPDLIFKLEQGEDPWIINAKISR

SEQ ID NO: 4690 - protein, 80 aa, Macaca mulatta
MATSFRTASCWGLLSFKDISMEFTWDEWQLLDSTQKYLYRDVILENYHNLLSVDGWEEWYQNNQDELESIERSYACSVLG

SEQ ID NO: 4691 - protein, 81 aa, Macaca mulatta
FRNLLGVLWAQGNSALPEGLLSFKDISMEFTWDEWQLLDSTQKYLYRDVILENYHNLLSVGYHGTKPDLIFKLEQGEDPWI

SEQ ID NO: 4692 - protein, 81 aa, Macaca mulatta
RDVILENYHNLLSVGYHGTKPDLIFKLEQGEDPWIINAKISRQSCPDGWEEWYQNNQDELESIERSYACSVLGRLNLSKTH

SEQ ID NO: 4693 - protein, 81 aa, Macaca mulatta
NGRMEECTMTFYHTKYAKESFSFDDLSVDFTQKEWQLLDPSQKNLYKDVMLENYSSLVSLGYEVMKPDVIFKLEQGEEPWV

SEQ ID NO: 4694 - protein, 81 aa, Macaca mulatta
MSQGSVTFRDVAIDFSQEEWKWLQPAQRDLYRCVMLENYGHLVSLGLSISKPDVVSLLEQGKEPWLGKRNVNRDLFSVSES

SEQ ID NO: 4695 - protein, 81 aa, Macaca mulatta
MLENYGHLVSLGLSISKPDVVSLLEQGKEPWLGKRNVNRDLFSVSESSGDIKDFSPKNVIYDDSSQYLIMERILSQGPVYS

SEQ ID NO: 4696 - protein, 81 aa, Macaca mulatta
MSQGSVTFRDVAIDFSQEEWKWLQPAQRDLYRCVMLENYGHLVSLAGLSISKPDVVSLLEQGKEPWLGKRNVNRDLFSVRV

SEQ ID NO: 4697 - protein, 81 aa, Macaca mulatta
MSQGSVTFRDVAIDFSQEEWKWLQPAQRDLYRCVMLENYGHLVSLGLSISKPDVVSLLEQGKEPWLGKRNVNRDLFSVLKE

SEQ ID NO: 4698 - protein, 81 aa, Macaca mulatta
REFGSMGPGHADICVSFQGSVTFRDVAIDFSQEEWKWLQPAQRDLYRCVMLENYGHLVSLGLSISKPDVVSLLEQGKEPWL

SEQ ID NO: 4699 - protein, 81 aa, Macaca mulatta
RNAEEERMITIFLTTWLQEPMTFKDVAVEFTQDEWMMLDSAQRSLYRDVMLENYRNLTSVEYQLCKLTVISPLDQEEIRNM

SEQ ID NO: 4700 - protein, 81 aa, Macaca mulatta
MHAKSLTAWSQTLVTFKDVFVDFTREEWKLLDTAQQIVYRNVMLENYKNLVSLGYQLTKPDVILRLEKGEEPWLVERGIHQ

SEQ ID NO: 4701 - protein, 81 aa, Macaca mulatta
VLEWLFISQEQPKITTSWGPLSFMDVFVDFTWEEWQLLDPAQKCLYRNVMLENYSNLVSLGYQHTKPDIIFKLEQGEELCV

SEQ ID NO: 4702 - protein, 81 aa, Macaca mulatta
MPELTPGHPGSRGTDSVAFEDVAVNFTQQEWALLDSSQKNLYREVMQETYRNLASVEILWYRDCVKAKKVVSMDKLSATFQ

SEQ ID NO: 4703 - protein, 81 aa, Macaca mulatta
MTFEDVAVEFTQGEWGQLNPAQKDLYREVMLENFRNLAFLGLPVSKPYVICQLEEGGEPFIVEREISTGAYSDWERRSKSK

SEQ ID NO: 4704 - protein, 81 aa, Macaca mulatta
MAAVSPTTRCQESVTFEDVAVVFTDEEWSHLVPIQRDLYKEVMLENYNSIVSLGLPVPQPDVIFQLKRGDKPWVVDLHGSE

SEQ ID NO: 4705 - protein, 81 aa, Macaca mulatta
TLLTFRDVAIEFSLEEWKCLDPAQQNLYRDVMLENYRNLFSIGLTVSKPGLITCLEQRKEPWNVKRQEAVDGHPAMSSHVT

SEQ ID NO: 4706 - protein, 81 aa, Macaca mulatta
MAGAQTLLTFRDVAIEFSLEEWKCLDPAQQNLYRDVMLENYRNLFSIGLTVSKPGLITCLEQRKEPWNVKRQEAVDGHPEM

SEQ ID NO: 4707 - protein, 81 aa, Macaca mulatta
MTLLTFRDVAIEFSLEEWKCLDPAQQNLYRDVMLENYRNLFSIGLTVSKPGLITCLEQRKEPWNVKRQEAVDGHPEMGFHH

SEQ ID NO: 4708 - protein, 81 aa, Macaca mulatta
MAVTFEDVTIVFTWEEWKFLDSSQKRLYREVMWENYTNVMSVENWNKSYKSQEEKFRYLEYENFSCWQGWWNAGAQMCANQ

SEQ ID NO: 4709 - protein, 81 aa, Macaca mulatta
SRKNLSMEKEQKLIVQRSYIPVEEALPQYVGVICQKDLLKDSMEENYCGCNKCKEIYCWNSRCIFHKRNQPGENLCQCSIH

SEQ ID NO: 4710 - protein, 81 aa, Macaca mulatta
QMGNIKEKMKAGSRTGKPQEPVTFKDVVVEFSKEEWGQLDSAVKNLYRNVMLENFRNLNSLRKAYLLSKPVESLKLESKKK

SEQ ID NO: 4711 - protein, 81 aa, Macaca mulatta
MGNIKEKMKAGSRTGKPQEPVTFKDVVVEFSKEEWGQLDSAVKNLYRNVMLENFRNLNSLRKAYLLSKPVESLKLESKKKR

SEQ ID NO: 4712 - protein, 81 aa, Macaca mulatta
ERSSGDSEMVALLTALSQGLVTFKDVAVCFSQDQWSDLDPTQKEFYGEYVLEEDCGIVVSLDRSKDEEECLEQEDLSLEDI

SEQ ID NO: 4713 - protein, 81 aa, Macaca mulatta
ENTGEEGMAAGLLTAGPRGSTFFSSVTVAFAQEGWRCLVSTPRERYKEGIPEKSRNLVLLGLPVSQPGMNSQLEQREGTWM

SEQ ID NO: 4714 - protein, 81 aa, Macaca mulatta
MAAGLLTAGPRGSTFFSSVTVAFAQEGWRCLVSTPRERYKEGIPEKSRNLVLLGLPVSQPGMNSQLEQREGTWMLEGEDVR

SEQ ID NO: 4715 - protein, 81 aa, Macaca mulatta
DRRRSAGTIKEAGRPLEMAVSEPETSAAEWKQLDPAQRNVYHDVMLENYSNQASMGYQAPKPDLISKLEKGEAPWLGKGKR

SEQ ID NO: 4716 - protein, 81 aa, Macaca mulatta
RRRSAGTIKEAGRPLEMAVSEPETSAAKEWKQLDPAQRNVYHDVMLENYSNQASMGYQAPKPDLISKLEKGEAPWLGKGKR

SEQ ID NO: 4717 - protein, 81 aa, Macaca mulatta
EAGRPLEMAVSEPETSAAVSVTFKHVTMTFTQKEWKQLDPAQRNVYHDVMLENYSNQASMGYQAPKPDLISKLEKGEAPWL

SEQ ID NO: 4718 - protein, 81 aa, Macaca mulatta
ENSKEDKMVAVCPNTESRESITLKDVAVNFSRGEWKKLEPFQKELYKEVLLENFRNLEFLDFPVSKLELISQLKWVELPWL

SEQ ID NO: 4719 - protein, 81 aa, Macaca mulatta
MMENYGNLVSLDVLNRDKDEEPTVKQEIEEIEEEVEPQGVIVTRIKSEIDQDPMSRETFELVGRLDKQRGIFLWEIPRESL

SEQ ID NO: 4720 - protein, 81 aa, Macaca mulatta
MASPSPPPESKEEWDYLDPAQRSLYKDVMMENYGNLVSLGLTVLLRLVCSDANMACCSLNLLGLSDQSSHLSYLSSWDYRC

SEQ ID NO: 4721 - protein, 81 aa, Macaca mulatta
MAPGLLTTREEALMAFRDVAVAFTQKEWKLLSSAQRTLYREVMLENYSHLVSLGIAFSKPKLIEQLEQGNEPWREENEHLL

SEQ ID NO: 4722 - protein, 81 aa, Macaca mulatta
LENYSHLVSLGIAFSKPKLIEQLEQGNEPWREENEHLLDLCPGEWGTLGRRGCRAVRSTAGKEGGAVFGVLGGSSSSSGLL

SEQ ID NO: 4723 - protein, 81 aa, Macaca mulatta
MTKSLESVSFKDVTVDFSRDEWQQLDLAQKSLYREVMLENYFNLISVGCQVPKPEVIFSLEQEEPCMLDGEISGQSHPDGD

SEQ ID NO: 4724 - protein, 81 aa, Macaca mulatta
SPPISAPLSEEPKMTKSLESVSFKDVTVDFSRDEWQQLDLAQKSLYREVMLENYFNLISVGCQVPKPEVIFSLEQEEPCML

SEQ ID NO: 4725 - protein, 81 aa, Macaca mulatta
MTKSLESVSFKDVTVDFSRDEWQQLDLAQKSLYREVMLENYFNLISVGCQVPKPEVIFSLEQEEPCMLDGEISGQSHPAPS

SEQ ID NO: 4726 - protein, 81 aa, Macaca mulatta
MNISQASVSFQDVTVEFTQEEWQHLGPVERTLYRDVMLENYSHLISVGYCITKPKVISRLEQGEEPWSLEDEFLNQKHQGY

SEQ ID NO: 4727 - protein, 81 aa, Macaca mulatta
MLENYSHLISVGYCITKPKVISRLEQGEEPWSLEDEFLNQKHQGYFKVDHIKGIWEKQEKPLWQEIFISDADKTLSKEREK

SEQ ID NO: 4728 - protein, 81 aa, Macaca mulatta
MNTFQASVSFKDVTVEFTQEEWQHMGPVERTLYRDVMLENYSHLVSVGYCFTKPELIFTLEQGEDPWLLEKEKGFLSRNSP

SEQ ID NO: 4729 - protein, 81 aa, Macaca mulatta
PLRFSTLFQEQQKMNISQASVSFKDVTIEFTQEEWQQMAPVQKNLYRDVMLENYSNLVSVGYCHFKPEVIFKLEQGEEPWF

SEQ ID NO: 4730 - protein, 81 aa, Macaca mulatta
EFTQEEWQQMAPVQKNLYRDVMLENYSNLVSVGYCHFKPEVIFKLEQGEEPWFSEEEFSNQSHPSELLSSSRHNSVGVVRL

SEQ ID NO: 4731 - protein, 81 aa, Macaca mulatta
VLSQEATAFEDMTKYWNYLEAFQKDCYRDTMLDSYENTVPQASFLQFSMMPQRAGNDPPGVSNVNEMEMEISNMRETFLMS

SEQ ID NO: 4732 - protein, 81 aa, Macaca mulatta
LQGKYGNVTKEVIVLYLTLCKQCHQKNPVPKKGLPPKPLTFKDIDSTCQVEILDMQSSADGEFKFILYYQDHLTKFIILRP

SEQ ID NO: 4733 - protein, 81 aa, Macaca mulatta
LLLIPGPQTVWSLWQQPVLSQEATAFEDMTKYWNYLEAFQKDCYRDTMLDSYENTVPQASFLQFSMMPQRAGNDPPGVSNV

SEQ ID NO: 4734 - protein, 81 aa, Macaca mulatta
ASQPARPEERLIRDQDLGASLLPAAPQEQWRHLDSTQKEQYWDLMLETYGKMVSGAGISHSKPDLTNSIEYGEELAGLYLH

SEQ ID NO: 4735 - protein, 81 aa, Macaca mulatta
ASQPARPEERLIRDQDLGASLLPAAPQEQWRHLDSTQKEQYWDLMLETYGKMVSGGISHSKPDLTNSIEYGEELAGLYLHV

SEQ ID NO: 4736 - protein, 81 aa, Macaca mulatta
ASQPARPEERLIRDQDLGASLLPAAPQEQWRHLDSTQKEQYWDLMLETYGKMVSGGDRQENDKENLNLENHRDQELLHASC

SEQ ID NO: 4737 - protein, 81 aa, Macaca mulatta
AASQPARPEERLIRDQDLGASLLPAAPQWRHLDSTQKEQYWDLMLETYGKMVSGGISHSKPDLTNSIEYGEELAGLYLHVN

SEQ ID NO: 4738 - protein, 81 aa, Macaca mulatta
EGEVAALRLTARSQETVTFKDVAMDFTPEEWGKLDPAQRDVMLENYRNLVSLWLPVSKPENYNLENGKEPLKLERKTPKSS

SEQ ID NO: 4739 - protein, 81 aa, Macaca mulatta
TQPDEDLHLHAEETKLVKESVTFKDVAIDFTLEEWRLMDPTQRNLHKDVMLENYRNLVSLGLAVSKPDMISHLENGKEPWV

SEQ ID NO: 4740 - protein, 81 aa, Macaca mulatta
TQPDEDLHLQAEETKLVKESVTFKDVAIDFTLEEWRLMDPTQRNLHKDVMLENYRNLVSLGLAVSKPDMISHLENGKGPWV

SEQ ID NO: 4741 - protein, 81 aa, Macaca mulatta
PEVTQPDEDLHLQAEETKLVKESVTFKDVAIDFTLEEWRLMDPTQRNLHKDVMLENYRNLVSLGLAVSKPDMISHLENGKG

SEQ ID NO: 4742 - protein, 81 aa, Macaca mulatta
PRGKHAFQAGWLNDLVTKESMTFKDVAVDITQEDWELMRPVQKELYKTVTLQNYWNMVSLGLTVYRPTVIPMLEEPWMVIK

SEQ ID NO: 4743 - protein, 81 aa, Macaca mulatta
MVTCAHLGRRARLPAAQLSDCPGTRFSQEERMAAGYLPCRSQELVTFEDVSVDFSQEEWELLEPAQKNLYREVMLENYRNV

SEQ ID NO: 4744 - protein, 81 aa, Macaca mulatta
RFSQEERMAAGYLPCRSQELVTFEDVSVDFSQEEWELLEPAQKNLYREVMLENYRNVVSLEALKNQCTDAGIKKGSLSPAQ

SEQ ID NO: 4745 - protein, 81 aa, Macaca mulatta
MLETFRNLASVDDETQFKASGSVSQQDIYGEKIPKESKIAAFTRNVSWASVLGKIWDSLSIEDQPTKQGRNLSRNHVLERV

SEQ ID NO: 4746 - protein, 81 aa, Macaca mulatta
EKIPKESKIAAFTRNVSWASVLGKIWDSLSIEDQPTKQGRNLSRNHVLERVCESNDQCGEAFSQIPHLNLYKKIPPGVKQC

SEQ ID NO: 4747 - protein, 81 aa, Macaca mulatta
MDTVVFEDVVVGFTLEEWALLNPAQRNLYREVMLETFKHLASVDNEAQPKTNGSISQQDTSGEKLSLKLKIEKFTRKHTWA

SEQ ID NO: 4748 - protein, 81 aa, Macaca mulatta
MDSVVFEDVAVDFTLEEWALLDSAQRNLYRDVMLETFRNLASVDNKTHFKASGSVSQQDTYREEKSKEQTIPNFTRNNSCA

SEQ ID NO: 4749 - protein, 81 aa, Macaca mulatta
MDSVVFEEVAVNFTPEEWALLDHAQRSLYRDVMLETCRNLACCIYVRTSGSSSQRDVLGNGISNDEEIVKFTSDYWSIFGE

SEQ ID NO: 4750 - protein, 81 aa, Macaca mulatta
GGAGRAPGPRERGHSGRPDSVVFEEVAVNFTPEEWALLDHAQRSLYRDVMLETCRNLASLDCCIYVRTSGSSSQRDVLGNG

SEQ ID NO: 4751 - protein, 81 aa, Macaca mulatta
MDSVVFEEVAVNFTPEEWALLDHAQRSLYRDVMLETCRNLASLDCCIYVRTSGSSSQRDVLGNGISNDEEIVKFTSDYWSI

SEQ ID NO: 4752 - protein, 81 aa, Macaca mulatta
GHTEGGGLVNELLTSWLKGLVTFEDVAVEFTQEEWALLDPAQRTLYRDVMLENFRNVASLGDQVDKPGLITQLEQEDEVMT

SEQ ID NO: 4753 - protein, 81 aa, Macaca mulatta
MLENFRNVASLGDQVDKPGLITQLEQEDEVMTEERGILPDVENPFKAKGLTPKLHVFQKEQSGNMKMERNHLGAEFSECNQ

SEQ ID NO: 4754 - protein, 81 aa, Macaca mulatta
GHTESGELVDELLTSWLRGLVTFEDVAVEFTQEEWALLDPAQRTLYRDVMLENCRNLASLGCRVNKPSLISQLEQDKKVMT

SEQ ID NO: 4755 - protein, 81 aa, Macaca mulatta
SSKDRSCPQNLDLFACSGLEPHTPSVGSQESVTFQDVAVDFTEKEWPLLDSSQRKLYKDVMLENYSNLTSLEILAPPLCCS

SEQ ID NO: 4756 - protein, 81 aa, Macaca mulatta
MEEERTTVELQKNSIQDSVVFEDVAVDFTQEEWALLDLAQRNLYREVMLENFQNLASLGYLLHTPHLICQWEQEEDLQTVK

SEQ ID NO: 4757 - protein, 81 aa, Macaca mulatta
MAAGWLTTWSQNSVTFQEVAVDFSQEEWALLDPAQKNLYKDVMLENFRNLASVGYQLCRHSLISKVDQEELKTDERGILQG

SEQ ID NO: 4758 - protein, 81 aa, Macaca mulatta
MVAGWLTSYSQDSVTFEDVAVDFTQEEWTLLDQTQRNLYRDVMLENYNNLVAVDWESHINTKWSAPQQNFLQGKTSSVVEM

SEQ ID NO: 4759 - protein, 81 aa, Macaca mulatta
EKTEVERVVAGCLTSCYQDSVTFDDLAVDFTPEEWTLLDPTQRNLYRDVMLENYKNLATVGYQLFKPSLISWLEQEESRTV

SEQ ID NO: 4760 - protein, 81 aa, Macaca mulatta
MAYFLTNCYQDLLIFEDTAVDFTQEEWTLLDPVQRNLYRDVMLENYENVAKVGFQLLKPSVISWLEEEELRTLQQGVLQDR

SEQ ID NO: 4761 - protein, 81 aa, Macaca mulatta
SALQQDFWKIQISNGIQTDLVTFDSVAVEFTQEEWTLLDPTQRNLYCDVMLENYKNLSSVGYQLFKPSLISWLEEEEELST

SEQ ID NO: 4762 - protein, 81 aa, Macaca mulatta
EKTPAGRIASDCLTGCYQDSVTFDDVAVDFTQEEWTLLDPTQRSLYSDVMLENYKNLATVGGQIIKPSLISWLEQEESRTV

SEQ ID NO: 4763 - protein, 81 aa, Macaca mulatta
MDSVTFDDVAVDFTQEEWTLLDPTQRSLYSDVMLENYKNLATVGGQIIKPSLISWLEQEESRTVRGGVLQGWEMQLETQWS

SEQ ID NO: 4764 - protein, 81 aa, Macaca mulatta
EKTKAERMVEDYLANSYQDSVTFDDVAVDFTPEEWALLDTTEKYLYRDVMLENYMNLASVEWEIQPRIKRSSFQQGFLKNQ

SEQ ID NO: 4765 - protein, 81 aa, Macaca mulatta
EKTKVERMVEDYLANSYQDSVTFDDVAVEFTPEEWVLLDTTQKYLYRDVMLENYMNLASVDFFFCLTSEWEIQPRTKRSSL

SEQ ID NO: 4766 - protein, 81 aa, Macaca mulatta
MVEDYLANSYQDSVTFDDVAVEFTPEEWVLLDTTQKYLYRDVMLENYMNLASVDFFFCLTSEWEIQPRTKRSSLQQGFLKN

SEQ ID NO: 4767 - protein, 81 aa, Macaca mulatta
MDSSQHLVTFEDVAVDFTQEEWTLLDQTQRDLYRDVMLENYKNLIILAGSEFCKPSLMSELEQMEELRTGVTGVLQGEKQY

SEQ ID NO: 4768 - protein, 81 aa, Macaca mulatta
MDSSQHLVTFEDVAVDFTQEEWTLLDQTQRDLYRDVMLENYKNLIILAGSEFCKPSLMSELEQMEELRTGVTGVLQELDLQ

SEQ ID NO: 4769 - protein, 81 aa, Macaca mulatta
MDSSQHLVTFEDVAVDFTQEEWTLLDQTQRDLYRDVMLENYKNLIILGSEFCKPSLMSELEQMEELRTGVTGVLQELDLQL

SEQ ID NO: 4770 - protein, 81 aa, Macaca mulatta
MDSVAFEDVAVNFTLEEWALLDPSQKNLYRDVMRETFRNLASIGKQWEDQNIEDPFKIPRRNISHIPERLCEGKEGSQGEE

SEQ ID NO: 4771 - protein, 81 aa, Macaca mulatta
MDSVAFEDVAVNFTQEEWALLGPSQKSLYRNVMQETIRNLDCIETKWEDQNIGDQCQNPRRNLRSHTCEIKDDSQCGETFG

SEQ ID NO: 4772 - protein, 81 aa, Macaca mulatta
MDPVAFEDVAVNFTQEEWALLDIFQKNLYREVMLETFRNLTSIGNSWKDQNIEYEYQNPRRNFRSLIEEKVNEIKENSHCG

SEQ ID NO: 4773 - protein, 81 aa, Macaca mulatta
PPVLSLSPILLYTCEMFQDPVAFEDVAVNFTQEEWALLDIFQKNLYREVMLETFRNLTSIGNSWKDQNIEYEYQNPRRNFR

SEQ ID NO: 4774 - protein, 81 aa, Macaca mulatta
MFQDPVAFEDVAVNFTQEEWALLDIFQKNLYREVMLETFRNLTSIGNSWKDQNIEYEYQNPRRNFRSLIEEKVNEIKENSH

SEQ ID NO: 4775 - protein, 81 aa, Macaca mulatta
MMFQDPVAFEDVAVNFTQEEWALLDIFQKNLYREVMLETFRNLTSIGNSWKDQNIEYEYQNPRRNFRSLIEEKVNEIKENS

SEQ ID NO: 4776 - protein, 81 aa, Macaca mulatta
CSHRRCREDPGTSESQEMDPVAFEDVAVNFTREEWALLDIFQKNLYREVMLETFRNLTSIGKSWKDQNIEYEYQNPRRNFR

SEQ ID NO: 4777 - protein, 81 aa, Macaca mulatta
MPCCSHRRCREDPGTSESQEMEEWALLDIFQKNLYREVMLETFRNLTSIGKSWKDQNIEYEYQNPRRNFRSLIEEKVNEIK

SEQ ID NO: 4778 - protein, 81 aa, Macaca mulatta
NKVVSSCPTGRWSPECSCDPVAFEDVAVNFTQEEWTLLDISQKNLFREVMLETFRNLTSIGKKWKDKNIEYEYKIPRRSFR

SEQ ID NO: 4779 - protein, 81 aa, Macaca mulatta
RFQSADVCFNVKMDQWLCDSVAFEDVAVTFTQEEWALLDPSQKTLYRDVMQETFRNLASVGKKWKAQNMYVEYENLKRNLR

SEQ ID NO: 4780 - protein, 81 aa, Macaca mulatta
MDSVAFEDVAVTFTQEEWALLDPSQKTLYRDVMQETFRNLASVGKKWKAQNMYVEYENLKRNLRTFVGERLFESKEGHQHG

SEQ ID NO: 4781 - protein, 81 aa, Macaca mulatta
LLVLPILLYTCEMFQDSVAFEDVAVTFTQEEWALLDPSQKTLYRDVMQETFRNLASVGKKWKAQNMYVEYENLKRNLRTFV

SEQ ID NO: 4782 - protein, 81 aa, Macaca mulatta
MDSVAFEDVAVNFTQEEWALLDPSQKNLYREVMQETLRNLASIGKKWNNQYIEDEHQNPRRNLRRLTKERLSESEESHQHG

SEQ ID NO: 4783 - protein, 81 aa, Macaca mulatta
MDSVAFEDVAVNFTQEEWSLLDPSQKNLYREVMQETLRNLASIGEKWKDENIEDQYKNPRNNLRSLLGERVDENTEENHCG

SEQ ID NO: 4784 - protein, 81 aa, Macaca mulatta
MDSVAFEDVAVSFTQDEWALLDPSQKNLYRDVMQETFKNLTSVGKTWKIQNMEDKYKNPRRNLRWSFTLVAQAGVQWCDLG

SEQ ID NO: 4785 - protein, 81 aa, Macaca mulatta
MMFQDSVAFEDVAVSFTQDEWALLDPSQKNLYRDVMQETFKNLTSVGKTWKIQNMEDKYKNPRRNLSLMREKLFESKESHH

SEQ ID NO: 4786 - protein, 81 aa, Macaca mulatta
MDSVAFEDVAVSFTQDEWALLDPSQKNLYRDVMQETFKNLTSVGKTWKIQNMEDKYKNPRRNLSLMREKLFESKESHHCGE

SEQ ID NO: 4787 - protein, 81 aa, Macaca mulatta
MDSVAFEDVDVNFTQDEWALLDPSQKNLYRDVMQETFRNLASVGKKWKDQKIEDEYKNSRRNLRGLMGERLLESKKDHQHG

SEQ ID NO: 4788 - protein, 81 aa, Macaca mulatta
NRHHRADTGHKTYEYQEYGQKPYKCTYCKKAFSDLPYFRTHEWAHTGGKPYDCEECGKSFISRSSIRRHRIMHSGDGPYKC

SEQ ID NO: 4789 - protein, 81 aa, Macaca mulatta
DSVAFEDVDVNFTQDEWALLDPSQKNLYRDVMQETFRNLASVGKKWKDQKIEDEYKNSRRNLSLRKWSWLYPRQTRLNSPV

SEQ ID NO: 4790 - protein, 81 aa, Macaca mulatta
MDSVAFEDVDVNFTQEEWALLDPSQKNLYRDVMWETMRNLASIGKKWKDKNIKDHYKHRRRNLRSHMLERFYQSKDGSQRG

SEQ ID NO: 4791 - protein, 81 aa, Macaca mulatta
TLPRGQSEVLGWGLPKDQDSVAFEDVAVNFTHEEWALLGPSQKNLYRDVMRETIRNLNCVGMKWENQNIDDQYQNLRRNPS

SEQ ID NO: 4792 - protein, 81 aa, Macaca mulatta
QKNLYRDVMRETIRNLNCVGMKWENQNIDDQYQNLRRNPSISVTLQNFMLIHYGHLVALSDGGLQFSTGQGLPVTQAGVQW

SEQ ID NO: 4793 - protein, 81 aa, Macaca mulatta
MDSVTFEDVAVNFTQEEWALLDPSQKKLYRDVMWETFRNLASIGTKQKEWNTEEQYKNQGRNLRNHMVERLCESEEGSHGE

SEQ ID NO: 4794 - protein, 81 aa, Macaca mulatta
MDSVAFEDVAVNFTHEEWALLGPSQKNLYRDVMRETIRNLNCVGMKWENQNIDDQYQNLRRNPRCDVVERFGKSKDGSQCE

SEQ ID NO: 4795 - protein, 81 aa, Macaca mulatta
MDTVAFEDVAVNFTQEEWALLGPSQKNLYRYVMQETIRNLDCIRKIWEGQNTEDQKKNPRRNLRCHMLERFSESKDSSQCG

SEQ ID NO: 4796 - protein, 81 aa, Macaca mulatta
HTHKQRGKAFSYHHSFPSRGRPHTGKKRYECKECGKTFSSRRNLRRHMVVQGGNRPYKFPIDMRECTLGRNRMNVSSVLRP

SEQ ID NO: 4797 - protein, 81 aa, Macaca mulatta
RNDFFLPDSQTSEERKQYDSVAFEDVAVNFTREEWALLGPSQKTLYRDVMWETIRNLNCIGMKWEDTDVEDQHKNPRRSLR

SEQ ID NO: 4798 - protein, 81 aa, Macaca mulatta
MASVALGDVAVNFTREEWALLGPCQKNLYKDVMQETIRNLDCVGMKWKDQFLFKDQIEDQYKYPRKNLRCRMLERFGESKD

SEQ ID NO: 4799 - protein, 81 aa, Macaca mulatta
MDSVASEDVAVNFTLEEWALLDPSQKKLYRDVMRETFRNLACVGKKWEDQSIEDWYKNQGRILSNHTEEGLSESKEYDQCG

SEQ ID NO: 4800 - protein, 81 aa, Macaca mulatta
VLQMQNSEHHGQSIKTQTDSISLEDVAVNFTLEEWALLDPGQRNIYRDVMRATFKNLACIGEKWKDQDVEDDPKNQGRKPS

SEQ ID NO: 4801 - protein, 81 aa, Macaca mulatta
MDSISLEDVAVNFTLEEWALLDPGQRNIYRDVMRATFKNLACIGEKWKDQDVEDDPKNQGRKPSSPMVETLCENKEDRPCG

SEQ ID NO: 4802 - protein, 81 aa, Macaca mulatta
LRLQDSISLEDVAVNFTLEEWALLDPGQRNIYRDVMRATFKNLACIGEKWKDQDVEDDPKNQGRKPSSPMVETLCENKEDR

SEQ ID NO: 4803 - protein, 81 aa, Macaca mulatta
MDSVAFEDVSVSFSQEEWALLAPSQKKLYRDVMQETFKNLASIGEKWEDQNVEDQHKNQGRNLRSHMGERLCEGKESSQCA

SEQ ID NO: 4804 - protein, 81 aa, Macaca mulatta
MDSVAFEDVSVSFSQEEWALLAPSQKKLYRDVMQETFKNLASIGEKWEDQNVEDQHKNQGRNLSKTVSGRSLRRYSRKKAL

SEQ ID NO: 4805 - protein, 81 aa, Macaca mulatta
MESVTLEDVAVEFIQEWALLDSARRSLCRYGMLDQCRTLTSRGTPPCKPSRVSQLGPRAEPRATERGILHATGVAWESQLK

SEQ ID NO: 4806 - protein, 81 aa, Macaca mulatta
EDRVEEEAMAPGLPTACSQEPVTFADVAVVFTPEEWVFLDSTQRSLYRDVMLENYRNLASVADQLCKPNASSYLEQRGEQW

SEQ ID NO: 4807 - protein, 81 aa, Macaca mulatta
MESVTLEDVAVEFIQEWALLDSARRSLCRYGMLDQCRTLTSRGAGAVPEDAAGALRRSEGDTIDSRGPASSPGAALVSGIH

SEQ ID NO: 4808 - protein, 81 aa, Macaca mulatta
MDSVAFEDVAVNFTQEEWALLSPSQKNLYRDVMLEAFRNLASVGIQWKDQDTENLYQNLGIKLRSLVERLCGRKEGSEHRE

SEQ ID NO: 4809 - protein, 81 aa, Macaca mulatta
WALLSPSQKNLYRDVMLEAFRNLASVGIQWKDQDTENLYQNLGIKLRSLVERLCGRKEGSEHRETFRQIPDCHLNKKVILE

SEQ ID NO: 4810 - protein, 81 aa, Macaca mulatta
MDSVAFEDVAVNFTQEEWALLSPSQKNLYRDVMLEAFRNLASVGIQWKDQDTENLYQNLGIKLRHMRAHAGHTRSECGGEW

SEQ ID NO: 4811 - protein, 81 aa, Macaca mulatta
MNSVSFEDVAVNFTLEEWALLDSSQKKLYEDVMQETFKNLVCLGKKWEDQDIEDDHRNQGRNRRGHMVERLCESRKGSKCG

SEQ ID NO: 4812 - protein, 81 aa, Macaca mulatta
PASESRVTGITSVHHHAWGPLQFRDVAIEFSLEEWHCLDTAQRNLYRDVMLENYRNLVFLGIVVSKPDLITCLEQGKKPLT

SEQ ID NO: 4813 - protein, 81 aa, Macaca mulatta
LRRYEKCGHDNLQLKKGCESVDECPVHKRGYNGLKQCLTTTQRKIFHCDEYVKFLPKFSNSNRHKIRIRDTGKKPFKCIEY

SEQ ID NO: 4814 - protein, 81 aa, Macaca mulatta
MGPLQFRDVAIEFSLEEWHCLDTAQRNLYRDVMLENYRNLVFLVICSHFAQDVWSEQSIKDSFQKVILRRYEKCGHDNLQL

SEQ ID NO: 4815 - protein, 81 aa, Macaca mulatta
MGPLQFRDVAIEFSLEEWHCLDTAQRNLYRDVMLENYRNLVFLGIVVSKPDLVTCLEQGKKPMERHEMIAKPPVMSSHFAQ

SEQ ID NO: 4816 - protein, 81 aa, Macaca mulatta
KRYEKCRHDNLQFKKGCKSMGEHKVHKRGYNGLNQCLTTTQKKIFQCDKYGKVFPKFSNSNTYKIRHTGINLFKCIICGKA

SEQ ID NO: 4817 - protein, 81 aa, Macaca mulatta
GPLQFRDVAIEFSLEEWHCLDTAQRNLYRDVMLENYRNLVFLGIVVSKPDLVTCLEQGKKPMERHEMIAKPPVMSSHFAQD

SEQ ID NO: 4818 - protein, 81 aa, Macaca mulatta
MGPLQFRDVAIEFSLEEWHCLDTAQRNLYKNVMLENYSNLVFLGIVVSKPDLITRLEQGKKPLTVKRHEMVAKPPVMCSHF

SEQ ID NO: 4819 - protein, 81 aa, Macaca mulatta
MGPLQFRDVAIEFSLEEWHCLDTAQRNLYKNVMLENYSNLVFLGIVVSKPDLITRLEQGKKPLTVKRHEMVAKPPGSRLLS

SEQ ID NO: 4820 - protein, 81 aa, Macaca mulatta
MELLTFRDVTIEFSLEEWEFLKPAQQNLYRKVMLENYRNLVSLGLTVSKPELISCLEQRQEPWNVKRRETIAKPSGTYRCG

SEQ ID NO: 4821 - protein, 81 aa, Macaca mulatta
MLENYRNLVSLGLTVSKPELISCLEQRQEPWNVKRRETIAKPSAVSSHCTEDFLPEQGMKDSFQKVILRRYGSCGLEDLHL

SEQ ID NO: 4822 - protein, 81 aa, Macaca mulatta
MELLTFRDVTIEFSLEEWEFLKPAQQNLYRKVMLENYRNLVSLGLTVSKPELISCLEQRQEPWNVKRRETIAKPSAVSSHC

SEQ ID NO: 4823 - protein, 81 aa, Macaca mulatta
EQGMKDSFQKVILRRYGSCGLEDLHLRKDGENVGECKDQKEIYNGLNQCLSTLPSKIFPYNKCVKVFSKSSSLKRQSIRHT

SEQ ID NO: 4824 - protein, 81 aa, Macaca mulatta
MELLTFRDVTIEFSLEEWEFLKPAQQNLYRKVMLENYRNLVSLGLTVSKPELISCLEQRQEPWNVKRRETIAKPSDYHLTI

SEQ ID NO: 4825 - protein, 81 aa, Macaca mulatta
MEPLQFRDVAIEFSLEEWHCLDTAQQNLYRHVMLENYRNLVFLGIVVSKPDLITRLEQGENPLTVKRHKMTANPSVMCSHF

SEQ ID NO: 4826 - protein, 81 aa, Macaca mulatta
MGPLQFRDVAIEFSLEEWHCLDTAQRNLYRNVMLENYRNLVFLGIVVSKPDLITCLEQGEKPLTMKKHEMVANPSVLCSHF

SEQ ID NO: 4827 - protein, 81 aa, Macaca mulatta
MGPLQFRDVAIEFSLEEWHCLDTAQRNLYRNVMLENYRNLVFLGIVVSKPDLITCLEQGEKPLTMKKHEMVANPSGRTDHK

SEQ ID NO: 4828 - protein, 81 aa, Macaca mulatta
GIGRSTAKTPGPPGSLEMGPLQFRDVAIEFSLEEWHCLDTAQRNLYRDVMLENYRNLVFLGIIVSKPDLITRLEQGKKPLT

SEQ ID NO: 4829 - protein, 81 aa, Macaca mulatta
MGPLQFRDVAIEFSLEEWHCLDTAQRNLYRDVMLENYRNLVFLGIIVSKPDLITRLEQGKKPLTMKRHEMVGKPPVLCSHF

SEQ ID NO: 4830 - protein, 81 aa, Macaca mulatta
MLENYRNLVFLGIIVSKPDLITRLEQGKKPLTMKRHEMVGKPPVLCSHFTQDLWPEQSIKNSFQKLILRRYEKYGHDNLQF

SEQ ID NO: 4831 - protein, 81 aa, Macaca mulatta
MGPLTFRDVAIEFSLKEWQCLDTAQRNLYRNVMLENYRNLVFLGIAVSKPDLITCLEQGKEAWSMKRHEIMVAKSPVMCSH

SEQ ID NO: 4832 - protein, 81 aa, Macaca mulatta
GPLTFRDVAIEFSLKEWQCLDTAQRNLYRNVMLENYRNLVFLGIAVSKPDLITCLEQGKEAWSMKRHEIMVAKSPVMCSHF

SEQ ID NO: 4833 - protein, 81 aa, Macaca mulatta
ANGCPGAERNLLVYSFYEKGPLTFRDVAIEFSLEEWQCLDTAQQDLYRKVMLENYRNLVFLAGIAVSNPDLITCLEQGKEP

SEQ ID NO: 4834 - protein, 81 aa, Macaca mulatta
NGCPGAERNLLVYSFYEKGPLTFRDVAIEFSLEEWQCLDTAQQDLYRKVMLENYRNLVFLGIAVSNPDLITCLEQGKEPWN

SEQ ID NO: 4835 - protein, 81 aa, Macaca mulatta
SGSVGAERKLLVHSYFEKETLTFRDVAVEFSLEEWECLNPAQQNLYRNVMLENYKNLVFLGIDISKQDPITSLEQEKEPWN

SEQ ID NO: 4836 - protein, 81 aa, Macaca mulatta
RNVMLENYKNLVFLGIDISKQDPITSLEQEKEPWNMKRHEMVDESPGQVWLTPVISALWEARAGGLLEPRSLRPAWSTWKN

SEQ ID NO: 4837 - protein, 81 aa, Macaca mulatta
RNVMLENYKNLVFLGIDISKQDPITSLEQEKEPWNMKRHEMVDESPAVCSYFTKDLWPEQDIKDSFQQVILRRYRKCEHEN

SEQ ID NO: 4838 - protein, 81 aa, Macaca mulatta
ASGSVGAERKLLVHSYFEKETLTFRDVAVEFSLEEWECLNPAQQNLYRNVMLENYKNLVFLAVCSYFTKDLWPEQDIKDSF

SEQ ID NO: 4839 - protein, 81 aa, Macaca mulatta
SGCPAAERNLLVYSYFEKETLTFRDVAIEFSLEEWECLNPAQQNLYMNVMLENYKNLVFLGIAVSKQDPVTCLEQEKEPWN

SEQ ID NO: 4840 - protein, 81 aa, Macaca mulatta
ASGCPAAERNLLVYSYFEKETLTFRDVAIEFSLEEWECLNPAQQNLYMNVMLENYKNLVFLAGIAVSKQDPVTCLEQEKEP

SEQ ID NO: 4841 - protein, 81 aa, Macaca mulatta
MGLLTFMDVAVEFSLEEWQCLDTAQQNLYRNVMLENYRNLVFLGIAVSNLDLITCLEQGKEPWNMKRHEMVAKPPAMCSHF

SEQ ID NO: 4842 - protein, 81 aa, Macaca mulatta
GGYPGAERNLLEYSYFEKGPLTFRDVVIEFSQEEWQCLDTAQQDLYRKVMLENFRNLVFLGIDVSKPDLITCLEQGKDPWN

SEQ ID NO: 4843 - protein, 81 aa, Macaca mulatta
SQSAPQSAPEFSLPSSASGPLTFRDVAIEFSLEEWQCLDTAQQDLYRKVMLENYRNLVLAGIDVSKPNLITCLEQGKYPWN

SEQ ID NO: 4844 - protein, 81 aa, Macaca mulatta
MPGPPESLEMGPLTFRDVAIEFSLEEWQCLDTAQQDLYRKVMLENYRNLVLAGIDVSKPNLITCLEQGKYPWNMKRHSMVV

SEQ ID NO: 4845 - protein, 81 aa, Macaca mulatta
MPGPPESLEMGPLTFRDVAIEFSLEEWQCLDTAQQDLYRKVMLENYRNLVLGIDVSKPNLITCLEQGKYPWNMKRHSMVVK

SEQ ID NO: 4846 - protein, 81 aa, Macaca mulatta
MGPLTFRDVAIEFSLEEWQCLDTAQQDLYRKVMLENYRNLVLAGIDVSKPNLITCLEQGKYPWNMKRHSMVVKPPVICSHF

SEQ ID NO: 4847 - protein, 81 aa, Macaca mulatta
EFSLEEWQCLDTAQQDLYRKVMLENYRNLVLAGIDVSKPNLITCLEQGKYPWNMKRHSMVVKPPGGDCSIFLIEHQGDVTL

SEQ ID NO: 4848 - protein, 81 aa, Macaca mulatta
MGPLTFTDVAVEFSLEEWQCLDTAQQNLYRNVMLENYRNLVFLGITVSKPDLITCLEKEKEPWNMKRYEMVDEPPVICSHF

SEQ ID NO: 4849 - protein, 81 aa, Macaca mulatta
RRYDKCGPENLQLRKGYKTVGDCKLYKGDYNGLNQCLTPTQSKMYHCDIYVKVFYAFSNSDRYKTRLTGKKPFQCKKCDKS

SEQ ID NO: 4850 - protein, 81 aa, Macaca mulatta
MGPLTFTDVAVEFSLEEWQCLDTAQQNLYRNVMLENYRNLVFLGGVSLLLPRLECSGTISAHYNLHLPGSSDYPASASVAG

SEQ ID NO: 4851 - protein, 81 aa, Macaca mulatta
MGPLTFTDVAVEFSLEEWQCLDTAQQNLYRNVMLENYRNLVFLGITVSKPDLITCLEKEKEPWNMKRYEMVDEPPDNLKCF

SEQ ID NO: 4852 - protein, 81 aa, Macaca mulatta
MPSLTFMDVAIEFSLEEWQCLDTAQQNLYRNVMLENYRNLVFLGIVASKPDLITCLEKEKEPWNMKQHEIVDEPPVMRSHF

SEQ ID NO: 4853 - protein, 81 aa, Macaca mulatta
ASGCPGAERNLLVHSYFEKGPLTFRDVAIEFSLEEWQCLDTAQQGLYRKVMLENYRNLVFLAGIAVTKPDLITCLEQRKEP

SEQ ID NO: 4854 - protein, 81 aa, Macaca mulatta
MLENYRNLVFLGIAVTKPDLITCLEQRKEPWNIKRHEMVAKPSVICSHFAQDLWPERDIKDSFQESILKKYRNYEHDNLQL

SEQ ID NO: 4855 - protein, 81 aa, Macaca mulatta
SGCPGAERNLLVHSYFEKGPLTFRDVAIEFSLEEWQCLDTAQQGLYRKVMLENYRNLVFLGIAVTKPDLITCLEQRKEPWN

SEQ ID NO: 4856 - protein, 81 aa, Macaca mulatta
MGPLTFMDVAIEFCLEEWQCLDTAQQNLYRNVMLENYRNLVFLGIAVSKPDLITCLEQEKEPWEPMRRHEMVAKPSVMCSH

SEQ ID NO: 4857 - protein, 81 aa, Macaca mulatta
MDVAIEFCLEEWQCLDTAQQNLYRNVMLENYRNLVFLGIAVSKPDLITCLEQEKEPWEPMRRHEMVAKPSVMCSHVAQDFW

SEQ ID NO: 4858 - protein, 81 aa, Macaca mulatta
VLGDPQLKTPGPSGSLEMGPLTFMDVAIEFCLEEWQCLDTAQQNLYRNVMLENYRNLVFLGIAVSKPDLITCLEQEKEPWE

SEQ ID NO: 4859 - protein, 81 aa, Macaca mulatta
MDVAIEFCLEEWQCLDTAQQNLYRNVMLENYRNLVFLGIAVSKPDLITCLEQEKEPWEPMRRHEMVAKPSGGIVSLLNVFF

SEQ ID NO: 4860 - protein, 81 aa, Macaca mulatta
MGPLTFRDVTVEFSLEEWQCLDTAQQNLYRDVMLENYRNLVFLGIAVSKPDLVTCLEQGKEPWNMKRHEMVAKTPVMCSHI

SEQ ID NO: 4861 - protein, 81 aa, Macaca mulatta
RRYDKCGRDNLQLRLGCKSVDECKVCKGDCNRLNQCLTTTQRKIYQCDEYEKVFYKFSNVDRHKIRHTEKKTCKCKECGKS

SEQ ID NO: 4862 - protein, 81 aa, Macaca mulatta
MGSLTFRDVAIELSLEEWQCLDTAQQNLYRNVMLENYRNLVFLGIAAFKPDLIIFLEQGKEPWNMKRHEMVEEPPVICSHF

SEQ ID NO: 4863 - protein, 81 aa, Macaca mulatta
MGPLTFRDVTVEFSLEEWQCLDTVQQNLYRDVMLENYRNLVFLGIAVSKPDLITCLEEGKEPWNMNRHEMVATPPGSHSVT

SEQ ID NO: 4864 - protein, 81 aa, Macaca mulatta
MGPLTFRDVTVEFSLEEWQCLDTVQQNLYRDVMLENYRNLVFLGIAVSKPDLITCLEEGKEPWNMNRHEMVATPPDRVSLF

SEQ ID NO: 4865 - protein, 81 aa, Macaca mulatta
MGPLTFRDVTVEFSLEEWQCLDTVQQNLYRDVMLENYRNLVFLGIAVSKPDLITCLEEGKEPWNMNRHEMVATPPVVCSHI

SEQ ID NO: 4866 - protein, 81 aa, Macaca mulatta
RRHDKCEHENLQLRKGCKSVDECKVCKGSYNGLNQCLITTQRKIYQCDKYVKVFYKFSNSDRHQIRHTEKKTCKCKECGKS

SEQ ID NO: 4867 - protein, 81 aa, Macaca mulatta
MGPLTFRDVTVEFSLEEWQCLDTVQQNLYRDVMLENYRNLVFLGIAVSKPDLITCLEEGKEPWNMNRHEMVATPPAFYLMG

SEQ ID NO: 4868 - protein, 81 aa, Macaca mulatta
MGSLTFRDVAVEFSLEEWQFLDTAQQNLYRNVMLENYRNLVFLGIAAFKPDLIIFLEQGKEPWNVKRYEMVEEPPVICSHF

SEQ ID NO: 4869 - protein, 81 aa, Macaca mulatta
MGSLRFRDVAIEFSVEEWQCLDTAQRNLYRNVMLENYRNLVFLGIAVPKPDLIIFLEQGKEPWNMKRHEMAEETPVICSHF

SEQ ID NO: 4870 - protein, 81 aa, Macaca mulatta
GPLTFQDVTIEFSLEEWQCLDTAQQTLYRDVMLENYRNLVFLGIAVSKLDLIACLKQGKESWNMKRHEMVTKPPVTRSHFT

SEQ ID NO: 4871 - protein, 81 aa, Macaca mulatta
IACLKQGKESWNMKRHEMVTKPPVTRSHFTQDLWPDQSMKDCFQEVILRTYTRCGRKNLQLRKDCKSANECKMHKEGYNKL

SEQ ID NO: 4872 - protein, 81 aa, Macaca mulatta
LIACLKQGKESWNMKRHEMVTKPPVTRSHFTQDLWPDQSMKDCFQEVILRTYTRCGRKNLQLRKDCKSANECKMHKEGYNK

SEQ ID NO: 4873 - protein, 81 aa, Macaca mulatta
GVLTFRDVAIEFSLEEWQCLDTAQQNLYRNVMLENYRNLVFLGIAASKPDLITCLEQGKEPWNVKRHEMGAELPVVCSYFA

SEQ ID NO: 4874 - protein, 81 aa, Macaca mulatta
MLENYRNLVFLGIAASKPDLITCLEQGKEPWNVKRHEMGAELPVVCSYFAQDLWPKQGIKNYFQKVILRRYKKYGHENLQL

SEQ ID NO: 4875 - protein, 81 aa, Macaca mulatta
MGPLTFMDVVIKFSPEEWQFLDTAQQNLYRDVMLENYRNLVFLGIGVPKPDLITCLEQGKEPWNMKRHKMVAKPPVVYSHF

SEQ ID NO: 4876 - protein, 81 aa, Macaca mulatta
GIGRSTAKSPGPPGSLDMGSLTFRDVAIEFSVEEWQCLDTAQQNLYRNVMLENYRNLVFLGIAVPKPDLIIFLEQGKEPWN

SEQ ID NO: 4877 - protein, 81 aa, Macaca mulatta
MGLLTFRDVAIEFSLEEWQRLDAAQQNLYRNVMLENYRNLAFLGIAVSKPDLITCLEQGKEPWNMKRHEMVDKAPAICPHF

SEQ ID NO: 4878 - protein, 81 aa, Macaca mulatta
MGLLTFRDVAIEFSLEEWQCLDTAQKNLYRNVMLENYRNLAFLGVAVSKPDLIICLEKDKEPWNMKRHEMVDEPPGLTVSN

SEQ ID NO: 4879 - protein, 81 aa, Macaca mulatta
MEPLKFRDVAVEFSLEEWQCLDTIQQNLYRNVMLENYRNLVFLGIAVSKPDLITCLEQEKEPWTRKRHRMVAKPVTCSHFA

SEQ ID NO: 4880 - protein, 81 aa, Macaca mulatta
FLGIAVSKPDLITCLEQEKEPWTRKRHRMVAKPVTCSHFAQDFSPEQNIKDSFQKVTLRRHGKCEHENLQLRKCGKSVDEC

SEQ ID NO: 4881 - protein, 81 aa, Macaca mulatta
MGLLTFRDVAVEFSLEEWQCLDTAQRNLYKNVILENYRNLVFLGIAVSKPDLITCLEQEKEPLTMQRHEMVDEPPALDKHH

SEQ ID NO: 4882 - protein, 81 aa, Macaca mulatta
MGLLTFRDVAVEFSLEEWQCLDTAQRNLYKNVILENYRNLVFLGIAVSKPDLITCLEQEKEPLTMQRHEMVDEPPVMCSHF

SEQ ID NO: 4883 - protein, 81 aa, Macaca mulatta
MGLLTFRDVAVEFSLEEWQCLDTAQRNLYKNVILENYRNLVFLGIAVSKPDLITCLEQEKEPLTMQRHEMVDEPPESHSVT

SEQ ID NO: 4884 - protein, 81 aa, Macaca mulatta
MGLLTFRDVAIEFSLEEWQHLDIAQQNLYRNVMLENYRNLAFLGIAVSKPDLIICLEQGKEPWNMTQHEMVDESPGICPRF

SEQ ID NO: 4885 - protein, 81 aa, Macaca mulatta
MPGPPRGLEMGLLTFRDVAIEFSLEEWQHLDIAQQNLYRNVMLENYRNLAFLGIAVSKPDLIICLEQGKEPWNMTQHEMVD

SEQ ID NO: 4886 - protein, 81 aa, Macaca mulatta
MGLLTFRDVAIEFSLEEWQHLDIAQQNLYRNVMLENYRNLAFLGIAVSKPDLIICLEQGKEPWNMTQHEMVDESPGGVLLC

SEQ ID NO: 4887 - protein, 81 aa, Macaca mulatta
MAQVTFSDVAIDFSHEEWAWLDSAQRDLYKDVMVQNYENLVSVAGLSITKPYVIMLLEDGKEPWMVEKKLSKVYPFPLSHS

SEQ ID NO: 4888 - protein, 81 aa, Macaca mulatta
MAQVTFSDVAIDFSHEEWAWLDSAQRDLYKDVMVQNYENLVSVAGLSITKPYVIMLLEDGKEPWMVEKKLSKGMIPDWESR

SEQ ID NO: 4889 - protein, 81 aa, Macaca mulatta
MAQVTFSDVAIDFSHEEWAWLDSAQRDLYKDVMVQNYENLVSVAGLSITKPYVIMLLEDGKEPWMVEKKLSKDWESRWENK

SEQ ID NO: 4890 - protein, 81 aa, Macaca mulatta
MAQVTFSDVAIDFSHEEWAWLDSAQRDLYKDVMVQNYENLVSVGLSITKPYVIMLLEDGKEPWMVEKKLSKGMIPVYPFPL

SEQ ID NO: 4891 - protein, 81 aa, Macaca mulatta
MAQVTFSDVAIDFSHEEWAWLDSAQRDLYKDVMVQNYENLVSVGLSITKPYVIMLLEDGKEPWMVEKKLSKDWESRWENKE

SEQ ID NO: 4892 - protein, 81 aa, Macaca mulatta
NEELVGQNHGMKGEACTGGDVTFSDVAIDFSHEEWAWLDSAQRDLYKDVMVQNYENLVSVGLSITKPYVIMLLEDGKEPWM

SEQ ID NO: 4893 - protein, 81 aa, Macaca mulatta
MAQVTFSDVAIDFSHEEWAWLDSAQRDLYKDVMVQNYENLVSVGLSITKPYVIMLLEDGKEPWMVEKKLSKVYPFPLSHSV

SEQ ID NO: 4894 - protein, 81 aa, Macaca mulatta
MSQVTFSDVAIDFSHEEWGWLDSAQRDLYKDVMVQNYENLVSVGLSVTKPYVIMLLEDGKEPWMVEKKLSKGMIPDWESRW

SEQ ID NO: 4895 - protein, 81 aa, Macaca mulatta
MSQVTFSDVAIDFSHEEWGWLDSAQRDLYKDVMVQNYENLVSVAGLSVTKPYVIMLLEDGKEPWMVEKKLSKGMIPDWESR

SEQ ID NO: 4896 - protein, 81 aa, Macaca mulatta
MAAPALALVSFEDVVVTFTGEEWGHLDLAQRTLYQEVMLETCRLLVSLGHPVPKPELIYLLEHGQDLWTVKRGLSQSTCAG

SEQ ID NO: 4897 - protein, 81 aa, Macaca mulatta
MAAPALALVSFEDVVVTFTGEEWGHLDLAQRTLYQEVMLETCRLLVSLGHPVPKPELIYLLEHGQDLWTVKRGLSQSTCAA

SEQ ID NO: 4898 - protein, 81 aa, Macaca mulatta
MAHKYVGLQFQGSVTFEDVAIAFSQQEWESLDSSQRGLYRDVMLENYRNLVSMAGHSLSKPHVIALLERWKEPKVTERKDG

SEQ ID NO: 4899 - protein, 81 aa, Macaca mulatta
MAHKYVGLQFQGSVTFEDVAIAFSQQEWESLDSSQRGLYRDVMLENYRNLVSMGHSLSKPHVIALLERWKEPKVTERKDGR

SEQ ID NO: 4900 - protein, 81 aa, Macaca mulatta
MAHFQGSVTFEDVAIAFSQQEWESLDSSQRGLYRDVMLENYRNLVSMGHSLSKPHVIALLERWKEPKVTERKDGRRWCTDL

SEQ ID NO: 4901 - protein, 81 aa, Macaca mulatta
MAHFQGSVTFEDVAIAFSQQEWESLDSSQRGLYRDVMLENYRNLVSMAGHSLSKPHVIALLERWKEPKVTERKDGRRWCTD

SEQ ID NO: 4902 - protein, 81 aa, Macaca mulatta
MAEAALRDPAQGCVTFEDVTIYFSQEEWGLLDEAQRLLYCDVMLENFALIASLGLISFRSHIVSQLEMGKEPWVPDSVDMT

SEQ ID NO: 4903 - protein, 81 aa, Macaca mulatta
ESREIRAGQIVLKAMAQGLVTFRDVAIEFSLEEWKCLEPAQRDLYREVTLENFGHLASLGLSISKPDVVSLLEQGKEPWMI

SEQ ID NO: 4904 - protein, 81 aa, Macaca mulatta
MAHGSVTFRDVAIDFSQEEWEFLDPAQRDLYRDVMWENYSNFISLGPSISKPDVITLLDEEGKEPGMVVREGTRRYCPDLE

SEQ ID NO: 4905 - protein, 81 aa, Macaca mulatta
MAHGSVTFRDVAIDFSQEEWEFLDPAQRDLYRDVMWENYSNFISLAGPSISKPDVITLLDEEGKEPGMVVREGTRRYCPGE

SEQ ID NO: 4906 - protein, 81 aa, Macaca mulatta
MAQESVMFSDVSIDFSQEEWECLNDDQRDLYRDVMLENYSNLVSMGHSISKPNVISYLEQGKEPWLVDRELTRGQWPVLES

SEQ ID NO: 4907 - protein, 81 aa, Macaca mulatta
MAQESVMFSDVSIDFSQEEWECLNDDQRDLYRDVMLENYSNLVSMAGHSISKPNVISYLEQGKEPWLVDRELTRGQWPVLE

SEQ ID NO: 4908 - protein, 81 aa, Macaca mulatta
MPEVEFPDQFFTVLTMDHELVTLRDVVINFSQEEWEYLDSAQRNLYWDVMMENYSNLLSLDLESRSETKHLSVGKDIIKNT

SEQ ID NO: 4909 - protein, 81 aa, Macaca mulatta
MMENYSNLLSLDLESRSETKHLSVGKDIIKNTGSQWEVMESSKLRGLESSICRNDWQSKSKIEVQGPEVGYFSQMKIISEN

SEQ ID NO: 4910 - protein, 81 aa, Macaca mulatta
TVLTMDHELVTLRDVVINFSQEEWEYLDSAQRNLYWDVMMENYSNLLSLDLESRSETKHLSVGKDIIKNTGSQWEVMESSK

SEQ ID NO: 4911 - protein, 81 aa, Macaca mulatta
MPLQGSVSFKDVTVDFTQEEWQQLDPAQKALYRDVMLENYCHFVSVGFHMTKPDMIRKLEQGEELWTQRIFPSYSYLEEDG

SEQ ID NO: 4912 - protein, 81 aa, Macaca mulatta
FHMTKPDMIRKLEQGEELWTQRIFPSYSYLEEDGKTEDVLVKFKEYQDRHSRSLIFINHKKLIKERSNIYGKALTLGKNRI

SEQ ID NO: 4913 - protein, 81 aa, Macaca mulatta
MSQGSVSFKDVTVDFTQEEWQQLDPAQKALYRDVMLENYCHFVSVGFHMTKPDMIRKLEQGEELWTQRIFPSYSYLEEDGK

SEQ ID NO: 4914 - protein, 81 aa, Macaca mulatta
MPLQGSVSFKDVTVDFTQEEWQQLDPAQKALYRDVMLENYCHFVSVGFHMTKPDMIRKLEQGEELWTQRIFPSYSYLEDGK

SEQ ID NO: 4915 - protein, 81 aa, Macaca mulatta
GFHMTKPDMIRKLEQGEELWTQRIFPSYSYLEDGKTEDVLVKFKEYQDRHSRSLIFINHKKLIKERSNIYGKALTLGKNRI

SEQ ID NO: 4916 - protein, 81 aa, Macaca mulatta
MAHELVMFRDVAIDVSQEEWECLNPAQRNLYKEVMLENYSNLVSLGLSVSKPAIISSLEQGKEPWMVVREETGRWCPGTWK

SEQ ID NO: 4917 - protein, 81 aa, Macaca mulatta
MAHELVMFRDVAIDVSQEEWECLNPAQRNLYKEVMLENYSNLVSLGLSVSKPAIISSLEQGKEPWMVVREETGRWCPDLAS

SEQ ID NO: 4918 - protein, 81 aa, Macaca mulatta
LTRELVMFRDVAIDVSQEEWECLNPAQRNLYKEVMLENYSNLVSLGLSVSKPAIISSLEQGKEPWMVVREETGRWCPGTWK

SEQ ID NO: 4919 - protein, 81 aa, Macaca mulatta
MAQGSVSFNDVTVDFTQEEWQHLDHAQKTLYMDVMLENYCHLISVGCHMTKPDVILKLERGEEPWTSFSGHTCLEENWKAE

SEQ ID NO: 4920 - protein, 81 aa, Macaca mulatta
MDVMLENYCHLISVGCHMTKPDVILKLERGEEPWTSFSGHTCLEENWKAEDFLLKFKEHQEKYSRSVVSINHKKLVKEKSN

SEQ ID NO: 4921 - protein, 81 aa, Macaca mulatta
MNMEGLVMFQDLFIHFSQEEWECLDAAQKDLYRDVMMENYSSLVSLGLCIPKPDVISLLEQGKEPWMVSRDVLGGWCPDRL

SEQ ID NO: 4922 - protein, 81 aa, Macaca mulatta
MNMEGLVMFQDLFIHFSQEEWECLDAAQKDLYRDVMMENYSSLVSLGLCIPKPDVISLLEQGKEPWMVSRDVLGGWCPDSE

SEQ ID NO: 4923 - protein, 81 aa, Macaca mulatta
MVHLMMFRDVAVDFCQEEWECLDLEQRDLYRDVMLENYSNLVSLGLCIYQPEVFSLLEKGKEPWKILRDETRGPCPDMQSR

SEQ ID NO: 4924 - protein, 81 aa, Macaca mulatta
REIAQLEIMKICKNHSLECLCFRGDWEGNVQFQTLQDNQEECFKQVILTCEKRPTFNQHTAFNLHQRLNTGDKLNEFKELG

SEQ ID NO: 4925 - protein, 81 aa, Macaca mulatta
HQEEAERMHDELLQAVSKGSVMFRDVSIDFSQEEWECLDSGQMNLYKEVMLENFSNLVSVGLSNSKPAVISLLEQGKEPWM

SEQ ID NO: 4926 - protein, 81 aa, Macaca mulatta
YSQESALSEEEEDTTRPLETVTFKDVAVDLTQEEWEQMKPAQRNLYRDVMLENYSNLVTVGCQVTKPDVIFKLEQEEEPWV

SEQ ID NO: 4927 - protein, 81 aa, Macaca mulatta
QEEWEQMKPAQRNLYRDVMLENYSNLVTVGCQVTKPDVIFKLEQEEEPWVMEEEIFGRHCPESRRGENCRASEVMAERSWC

SEQ ID NO: 4928 - protein, 81 aa, Macaca mulatta
MKPAQRNLYRDVMLENYSNLVTVGCQVTKPDVIFKLEQEEEPWVMEEEIFGRHCPEVWEVDEQIKKQQETLVRKVTSISKK

SEQ ID NO: 4929 - protein, 81 aa, Macaca mulatta
HCPESRRGENCRASEVMAEDLKFKDVVIYFSQKEWECLHSAQKDLYRDVMLENYGNLVLLGLSDTKPNVISLLEQKKEPWL

SEQ ID NO: 4930 - protein, 81 aa, Macaca mulatta
MKPAQRNLYRDVMLENYSNLVTVGCQVTKPDVIFKLEQEEEPWVMEEEIFGRHCPESRRGENCRASEVMAEDLKFKDVVIY

SEQ ID NO: 4931 - protein, 81 aa, Macaca mulatta
MAEDLKFKDVVIYFSQKEWECLHSAQKDLYRDVMLENYGNLVLLGLSDTKPNVISLLEQKKEPWLVKRNETKEWCPDWEFG

SEQ ID NO: 4932 - protein, 81 aa, Macaca mulatta
MDLKFKDVVIYFSQKEWECLHSAQKDLYRDVMLENYGNLVLLDWEFGRETKNFSPKENIYEIRSLQQERVRAIREIRCQVE

SEQ ID NO: 4933 - protein, 81 aa, Macaca mulatta
MARKLVMFRDVAIDFSQEEWECLDSAQRDLYRDVMLENYSNLVSLDLPSRCASKDLSPEKNTYETELSQWEMSDRLEKCDL

SEQ ID NO: 4934 - protein, 81 aa, Macaca mulatta
TELSQWEMSDRLEKCDLEESKSRDYLEAKGKMEKQQENQKEYFRQGMIIYDKMSIFNQHTYLSQHSRCHSTEKPYKCKECG

SEQ ID NO: 4935 - protein, 81 aa, Macaca mulatta
LAPEDQGSSYEGSVSFRDVAIDFSREEWRHLDPSQRNLYRDVMLETYSHLLSVGYQVPEAEVVMLEQGKEPWALQGERPRQ

SEQ ID NO: 4936 - protein, 81 aa, Macaca mulatta
REEWRHLDPSQRNLYRDVMLETYSHLLSVGYQVPEAEVVMLEQGKEPWALQGERPRQSCPVTYRLPFPSTMTESFLGLTGS

SEQ ID NO: 4937 - protein, 81 aa, Macaca mulatta
SPQKSSALAPEDQGSSYEGSVSFRDVAINFSREEWQHLDLSQRNLYRDVMLETYSHLLSVGYQVPKPEVVMLEQGKEPWAL

SEQ ID NO: 4938 - protein, 81 aa, Macaca mulatta
SSQKSSALAPEDHGSSCEGSVSFRDVAIDFSREEWRHLDPSQRNLYRDVMLETYSHLLSVGYQVPEAEVVMLEQGKEPWAL

SEQ ID NO: 4939 - protein, 81 aa, Macaca mulatta
DVAIDFSREEWRHLDPSQRNLYRDVMLETYSHLLSVGYQVPEAEVVMLEQGKEPWALQGERPRQSCPAQCLVNSHRLQESF

SEQ ID NO: 4940 - protein, 81 aa, Macaca mulatta
GSVSFRDVAINFSREEWQHLDLSQRNLYRDVMLETYSHLLSVGYQVPKPEVVMLEQGKEPWALQGERPRQSCPGEKLWDHN

SEQ ID NO: 4941 - protein, 81 aa, Macaca mulatta
REEWQHLDLSQRNLYRDVMLETYSHLLSVGYQVPKPEVVMLEQGKEPWALQGERPRQSCPGEKLWDHNQHRKIIGYKPAFS

SEQ ID NO: 4942 - protein, 81 aa, Macaca mulatta
QGSSYEGSVSFRDVAINFSREEWQHLDLSQRNLYRDVMLETYSHLLSVGYQVPKPEVVMLEQGKEPWALQGERPRQSCPGE

SEQ ID NO: 4943 - protein, 81 aa, Macaca mulatta
MAEGSVMFSDVSIDFSQEEWDCLDPVQRDLYRDVMLENYSNLVSMGKGIRTSDSQFSSGMSASSTVNFSAASQDFTLLSLK

SEQ ID NO: 4944 - protein, 81 aa, Macaca mulatta
MLETYNHLVSLEIPSSKPKLIAQLERGEEPWREERKCSLDLCPESKPEIRLCPSCPLIFSNQQALSQHVWLSHLSQLFSSL

SEQ ID NO: 4945 - protein, 81 aa, Macaca mulatta
GEEPWREERKCSLDLCPESKPEIRLCPSCPLIFSNQQALSQHVWLSHLSQLFSSLWAGNPLQLGKHYLEDQKEQQDPFCLS

SEQ ID NO: 4946 - protein, 81 aa, Macaca mulatta
MATGLLRAKKEEEWRLLSPAQRTLHREVMLETYNHLVSLEIPSSKPKLIAQLERGEEPWREERKCSLDLCPAESKPEIRLC

SEQ ID NO: 4947 - protein, 81 aa, Macaca mulatta
KLIAQLERGEEPWREERKCSLDLCPAESKPEIRLCPSCPLIFSNQQALSQHVWLSHLSQLFSSLWAGNPLQLGKHYLEDQK

SEQ ID NO: 4948 - protein, 81 aa, Macaca mulatta
MATGLLRAKKEASVAFRDVAVDFTQEEWRLLSPAQRTLHREVMLETYNHLVSLEIPSSKPKLIAQLERGEEPWREERKCSL

SEQ ID NO: 4949 - protein, 81 aa, Macaca mulatta
PWREERKCSLDLCPESKPEIRLCPSCPLIFSNQQALSQHVWLSHLSQLFSSLWAGNPLQLGKHYLEDQKEQQDPFCLSGKT

SEQ ID NO: 4950 - protein, 81 aa, Macaca mulatta
WREERKCSLDLCPAESKPEIRLCPSCPLIFSNQQALSQHVWLSHLSQLFSSLWAGNPLQLGKHYLEDQKEQQDPFCLSGKT

SEQ ID NO: 4951 - protein, 81 aa, Macaca mulatta
TMSCSRAGGITGCIKYSTASVAFRDVAVDFTQEEWRLLSPAQRTLHREVMLETYNHLVSLEIPSSKPKLIAQLERGEEPWR

SEQ ID NO: 4952 - protein, 81 aa, Macaca mulatta
MAVGLCKAMSQGLVTFRDVALDFSQEEWEWLKPSQKDLYRDVMLENYRNLVWLDWESWCEIKELSPKWFIDEDEISQEMIM

SEQ ID NO: 4953 - protein, 81 aa, Macaca mulatta
MTESQGTVTFKDVAIDFTQEEWKRLDPAQRNLYRNVMLENYNNLITVGYPFTKPDVIFKLEQEEEPWVMEEEVLRRHWKGE

SEQ ID NO: 4954 - protein, 81 aa, Macaca mulatta
MTESQGTVTFKDVAIDFTQEEWKRLDPAQRNLYRNVMLENYNNLITVGYPFTKPDVIFKLEQEEEPWVMEEEVLRRHWKGK

SEQ ID NO: 4955 - protein, 81 aa, Macaca mulatta
KSKEGERMAVGLLKAMYQELVTFRDVAVDFSQEEWDCLDSSQRHLYSNVMLENYRILVSLGLCFSKPSVILLLEQGKAPWM

SEQ ID NO: 4956 - protein, 81 aa, Macaca mulatta
PICETEELTPKQDFYEEHQSQKIIETLTSYNLEYSSLKEEWKCEGYFERQPGNQKACFKEEIITHEEPLVDEREQEYKSWG

SEQ ID NO: 4957 - protein, 81 aa, Macaca mulatta
QGKAPWMVKRELTKGLCSGWEPICETEELTPKQDFYEEHQSQKIIETLTSYNLEYSSLKEEWKCEGYFERQPGNQKACFKE

SEQ ID NO: 4958 - protein, 81 aa, Macaca mulatta
MIEYQTPVSFKDVVVGFTQEEWHRLSPAQRALYRDVMLETYSNLVSVGYEGTKPDVILRLEQEEAPWIGEAACPGCHCWED

SEQ ID NO: 4959 - protein, 81 aa, Macaca mulatta
MIEYQTPVSFKDVVVGFTQEEWHRLSPAQRALYRDVMLETYSNLVSVGYEGTKPDVILRLEQEEAPWIGEAACPGCHCWAI

SEQ ID NO: 4960 - protein, 81 aa, Macaca mulatta
VVVGFTQEEWHRLSPAQRALYRDVMLETYSNLVSVGYEGTKPDVILRLEQEEAPWIGEAACPGCHCWAISKLWPADWPPAL

SEQ ID NO: 4961 - protein, 81 aa, Macaca mulatta
MIEYQTPVSFKDVVVGFTQEEWHRLSPAQRALYRDVMLETYSNLVSVGYEGTKPDVILRLEQEEAPWIGEAACPGCHCWGK

SEQ ID NO: 4962 - protein, 81 aa, Macaca mulatta
EWHRLSPAQRALYRDVMLETYSNLVSVGYEGTKPDVILRLEQEEAPWIGEAACPGCHCWGKCNKSSKRGTEGGWHLWNFVQ

SEQ ID NO: 4963 - protein, 81 aa, Macaca mulatta
YEGTKPDVILRLEQEEAPWIGEAACPGCHCWGKCNKSSKRGTEGGWHLWNFVQRSSLKSLDVPPRTSATLMPLPPCNPNTI

SEQ ID NO: 4964 - protein, 81 aa, Macaca mulatta
SFKDVVVGFTQEEWHRLSPAQRALYRDVMLETYSNLVSVGYEGTKPDVILRLEQEEAPWIGEAACPGCHCWALTFLRELQP

SEQ ID NO: 4965 - protein, 81 aa, Macaca mulatta
FKDVVVGFTQEEWHRLSPAQRALYRDVMLETYSNLVSVGYEGTKPDVILRLEQEEAPWIGEAACPGCHCWALTFLRELQPR

SEQ ID NO: 4966 - protein, 81 aa, Macaca mulatta
MAHALVTFRDVAIDFSQKEWECLDTTQRKLYRDVMLENYSNLVSLGYSGSKPDVITLLEQGKEPCVAVRDVTGRQYPGLLS

SEQ ID NO: 4967 - protein, 81 aa, Macaca mulatta
MAHALVTFRDVAIDFSQKEWECLDTTQRKLYRDVMLENYSNLVSLAGYSGSKPDVITLLEQGKEPCVAVRDVTGRQYPGLL

SEQ ID NO: 4968 - protein, 81 aa, Macaca mulatta
MPHLLVTFRDVAIDFSQEEWECLDPAQRDLYRDVMLENYSNLISLDLESSRATKELSPEKEIYEMESLQWENMGKLINHHL

SEQ ID NO: 4969 - protein, 81 aa, Macaca mulatta
MDLLFQLLVTFRDVAIDFSQEEWECLDPAQRDLYRDVMLENYSNLISLDLESSRATKELSPEKEIYEMESLQWENMGKLIN

SEQ ID NO: 4970 - protein, 81 aa, Macaca mulatta
MARDLVMFRDVAVDFSQEEWECLNSYQRNLYRDVILENYSNLVSLGCSISKPDVITLLEQGKEPWMVMRDEKRRWTLGPTF

SEQ ID NO: 4971 - protein, 81 aa, Macaca mulatta
MARDLVMFRDVAVDFSQEEWECLNSYQRNLYRDVILENYSNLVSLAGCSISKPDVITLLEQGKEPWMVMRDEKRRWTLDLE

SEQ ID NO: 4972 - protein, 81 aa, Macaca mulatta
MARDLVMFRDVAVDFSQEEWECLNSYQRNLYRDVILENYSNLVSLGCSISKPDVITLLEQGKEPWMVMRDEKRRWTLDLES

SEQ ID NO: 4973 - protein, 81 aa, Macaca mulatta
MACESITFGDVAIDFSHQEWEYLNLVQKTLYQEVMMENYDNLVSLAGHSISKPDLITLLEQGKEPWMIVGEETRGECTDLD

SEQ ID NO: 4974 - protein, 81 aa, Macaca mulatta
MACESITFGDVAIDFSHQEWEYLNLVQKTLYQEVMMENYDNLVSLGHSISKPDLITLLEQGKEPWMIVGEETRGECTDLDS

SEQ ID NO: 4975 - protein, 81 aa, Macaca mulatta
MACESITFGDVAIDFSHQEWEYLNLVQKTLYQEVMMENYDNLVSLGHSISKPDLITLLEQGKEPWMIVGEETRGECTAELQ

SEQ ID NO: 4976 - protein, 81 aa, Macaca mulatta
CNWGRSLKFCPTKYMKFQELVTFRDVAIDFSQQEWEYLDPNQRDLYRDVMLENYRNLVSLGGHSISKPVVVDLLEQGKEPW

SEQ ID NO: 4977 - protein, 81 aa, Macaca mulatta
HRVGLIRSYSSKTMTCFQELVTFRDVAIDFSQQEWEYLDPNQRDLYRDVMLENYRNLVSLGGHSISKPVVVDLLEQGKEPW

SEQ ID NO: 4978 - protein, 81 aa, Macaca mulatta
MTCFQELVTFRDVAIDFSQQEWEYLDPNQRDLYRDVMLENYRNLVSLGGHSISKPVVVDLLEQGKEPWMILREETQFTDLD

SEQ ID NO: 4979 - protein, 81 aa, Macaca mulatta
MLENYRNLVSLGGHSISKPVVVDLLEQGKEPWMILREETQFTDLDLQCEIISYIEVPTYETGISSVQLQSIYKREKLYECK

SEQ ID NO: 4980 - protein, 81 aa, Macaca mulatta
HRVGLIRSYSSKTMTCFQELVTFRDVAIDFSQQEWEYLDPNQRDLYRDVMLENYRNLVSLEMRSRCVAQVGLKLLVSDPPT

SEQ ID NO: 4981 - protein, 81 aa, Macaca mulatta
MIQLKAIQEMFQELVTFRDVAIDFSQQEWEYLDPNQRDLYRDVMLENYRNLVSLGGHSISKPVVVDLLEQGKEPWMILREE

SEQ ID NO: 4982 - protein, 81 aa, Macaca mulatta
EPHRVGLIRSYSSKTMTCELVTFRDVAIDFSQQEWEYLDPNQRDLYRDVMLENYRNLVSLGGHSISKPVVVDLLEQGKEPW

SEQ ID NO: 4983 - protein, 81 aa, Macaca mulatta
TCNWGRSLKFCPTKYMKFQELVTFRDVAIDFSQQEWEYLDPNQRDLYRDVMLENYRNLVSLGGHSISKPVVVDLLEQGKEP

SEQ ID NO: 4984 - protein, 81 aa, Macaca mulatta
EEAQGELTSSCRSKTMADVSLAFRDVSIDLSQEEWECLNPAQRDLYKDVMLENYSNLVSLGYTIPKPDVITLLEQQKEPWI

SEQ ID NO: 4985 - protein, 81 aa, Macaca mulatta
MQVDPPLHGPPNDLLIFQIIPLHSLSIMPRLLWILCFSMEEAQGELTSSCRSKTMADVSLAFRDVSIDLSQEEWECLNPAQ

SEQ ID NO: 4986 - protein, 81 aa, Macaca mulatta
MVHGSVTFRDVAIDFSQEEWECLQPDQRTLYRDVMLENYSHLISLGSSISKPDVITLLEQEKEPWIVVRKETSRWYPDLES

SEQ ID NO: 4987 - protein, 81 aa, Macaca mulatta
MVHGSVTFRDVAIDFSQEEWECLQPDQRTLYRDVMLENYSHLISLAGSSISKPDVITLLEQEKEPWIVIWSQNMDLKKYLQ

SEQ ID NO: 4988 - protein, 81 aa, Macaca mulatta
GRSTRKIDQFCNSRNMVHGSVTFRDVAIDFSQEEWECLQPDQRTLYRDVMLENYSHLISLGSSISKPDVITLLEQEKEPWM

SEQ ID NO: 4989 - protein, 81 aa, Macaca mulatta
EESHGALISSCNSRTMTDGLVTFRDVAIDFSQEEWECLDPAQRDLYVDVMLENYSNLVSLGNKMCGFLVFFQIWSQQHTRP

SEQ ID NO: 4990 - protein, 81 aa, Macaca mulatta
MTKSKEPVTFKDVAVVFSEEELRLLNLAQRKLYRDVMLENFRNVVSVGHQSTPDGLPQLEREEKLWMMKMAIQRDNSSGGK

SEQ ID NO: 4991 - protein, 81 aa, Macaca mulatta
MLENFRNVVSVGHQSTPDGLPQLEREEKLWMMKMAIQRDNSSGGKNLKEMETLQEVGLRYPSHEEFFCSQIWQQITRELTK

SEQ ID NO: 4992 - protein, 81 aa, Macaca mulatta
HSGLCKFPEVEGKMTTFKEAVTFKDVAVVFTEDELGLLDPAQRKLYRDVMLENFRNLLSVGNQPFHQDTFHFLRKEKLRMM

SEQ ID NO: 4993 - protein, 81 aa, Macaca mulatta
LRKEKLRMMKTTSQRGGNSGGKIQIEMETVPEAGPHEEWSCQQIWEQIASDLTRSQDSIRNSSELFIEGDVLCQIEAGLSI

SEQ ID NO: 4994 - protein, 81 aa, Macaca mulatta
AQRKLYRDVMLENFRNLLSVGNQPFHQDTFHFLRKEKLRMMKTTSQRGGNSGGKIQIEMETVPEAGPHEEWSCQQIWEQIA

SEQ ID NO: 4995 - protein, 81 aa, Macaca mulatta
MTTFKEAVTFKDVAVFFTEEELGLLDPAQRKLYRDVMLENFRNLLSAGHQPFHQDTFHFLREEKFWMMETVTQREGNSGSK

SEQ ID NO: 4996 - protein, 81 aa, Macaca mulatta
FKDVAVFFTEEELGLLDPAQRKLYRDVMLENFRNLLSAGHQPFHQDTFHFLREEKFWMMETVTQREGNSGSKIQTELESVP

SEQ ID NO: 4997 - protein, 81 aa, Macaca mulatta
FLREEKFWMMETVTQREGNSGSKIQTELESVPEAGTQEEWSCQQIWEQIAKDLTRSQDSIINNSQFFENGDVPSQVEAGLP

SEQ ID NO: 4998 - protein, 81 aa, Macaca mulatta
MIKRSKVLVFCSKIMEEAVTFKDVAVFFTEEELGLLDPAQRKLYRDVMLENFRNLLSAGHQPFHQDTFHFLREEKFWMMET

SEQ ID NO: 4999 - protein, 81 aa, Macaca mulatta
DVMLENFRNLLSAGHQPFHQDTFHFLREEKFWMMETVTQREGNSGSKIQTELESVPEAGTQEEWSCQQIWEQIAKDLTRSQ

SEQ ID NO: 5000 - protein, 81 aa, Macaca mulatta
MTTFKEAVTFKDVAVFFTEEELGLLDPAQRKLYQDVMLENFTNLLSVGYQPFHPFHFLREEKFWMMETATQREGSSGGRTV

SEQ ID NO: 5001 - protein, 81 aa, Macaca mulatta
NNSHFFEQGDVPSQVEAELSIIHTGQKPSQNGKCKQSFSDVAIFDLPQQLHSGEKSHTCKECGKSFCYISALRIHQRVHLR

SEQ ID NO: 5002 - protein, 81 aa, Macaca mulatta
MTTFKEAVTFKDVAVFFTEEELGLLDPAQRKLYQDVMLENFTNLLSVGYQPFHPFHFLREEKFWMMETATQREGSSGKKQA

SEQ ID NO: 5003 - protein, 81 aa, Macaca mulatta
MIDSGEKKPGRRAEEAVTFKDVAVVFTEEELELLDPAQRKLYRDVMLENFRNLLSVGHQPFHGDTFHFLREEKFWVMETTS

SEQ ID NO: 5004 - protein, 81 aa, Macaca mulatta
GRRAEEAVTFKDVAVVFTEEELELLDPAQRKLYRDVMLENFRNLLSVGHQPFHGDTFHFLREEKFWVMETTSQREGTSGPL

SEQ ID NO: 5005 - protein, 81 aa, Macaca mulatta
MITCDEAVTFKDVAVVFTEEELELLDPAQRKLYRDVMLENFRNLLSVGHQPFHGDTFHFLREEKFWVMETTSQREGTSGKI

SEQ ID NO: 5006 - protein, 81 aa, Macaca mulatta
HSGLCKFPKVGGKMTTSKEAVTFKDVVVVFTEEELGLLDLAQRKLYRDVMLENFRNLLSVGHQPFHRDTFHFLREEKFWMM

SEQ ID NO: 5007 - protein, 81 aa, Macaca mulatta
MTTSKEAVTFKDVVVVFTEEELGLLDLAQRKLYRDVMLENFRNLLSVGHQPFHRDTFHFLREEKFWMMDIATQREGNSGGK

SEQ ID NO: 5008 - protein, 81 aa, Macaca mulatta
MTTSKEAVTFKDVVVVFTEEELGLLDLAQRKLYRDVMLENFRNLLSVGHQPFHRDTFHFLREEKFWMMDIATQREGNSGKK

SEQ ID NO: 5009 - protein, 81 aa, Macaca mulatta
TFKDVVVVFTEEELGLLDLAQRKLYRDVMLENFRNLLSVGHQPFHRDTFHFLREEKFWMMDIATQREGNSGKKQATVCPCL

SEQ ID NO: 5010 - protein, 81 aa, Macaca mulatta
MTTSKEAVTFKDVVVVFTEEELGLLDLAQRKLYRDVMLENFRNLLSVGHQPFHRDTFHFLREEKFWMMDIATQREGNSGES

SEQ ID NO: 5011 - protein, 81 aa, Macaca mulatta
MLENFRNLLSVGHQPFHRDTFHFLREEKFWMMDIATQREGNSGGKIQPEMKTVPEAGPHEGLSCQQIWEEIASDLTRPQDS

SEQ ID NO: 5012 - protein, 81 aa, Macaca mulatta
MTMFKEAVTFKDVAVVFTEEELGLLDPAQKKLYRDVMLENFRNLLSVGHQLSYQDTFHFQREEKFWIMETATQKEGNSGGK

SEQ ID NO: 5013 - protein, 81 aa, Macaca mulatta
QREEKFWIMETATQKEGNSGGKIQTELESVPETGPHEEWSCQQVWEQTASELTRPQDSMISSSQFSTQGDVPSQVDAGLSI

SEQ ID NO: 5014 - protein, 81 aa, Macaca mulatta
MTMFKEAMTFKDVAVVFTEEELGLLDLAQRKLYQDVMLENFRNLLSVGHQAFHRDTFHFLREEKIWMMKTATQREGDSGDK

SEQ ID NO: 5015 - protein, 81 aa, Macaca mulatta
LREEKIWMMKTATQREGDSGDKIQTEMETISEAGTDQEWSCQQIWEKIASDLTRSQDLVINSSQFSREGDFPSQSEAGLSV

SEQ ID NO: 5016 - protein, 81 aa, Macaca mulatta
DLAQRKLYQDVMLENFRNLLSVGHQAFHRDTFHFLREEKIWMMKTATQREGDSGDKIQTEMETISEAGTDQEWSCQQIWEK

SEQ ID NO: 5017 - protein, 81 aa, Macaca mulatta
LLSVGHQAFHRDTFHFLREEKIWMMKTATQREGDSGDKIQTEMETISEAGTDQEWSCQQIWEKIASDLTRSQDLVINSSQF

SEQ ID NO: 5018 - protein, 81 aa, Macaca mulatta
MNTLKEVVTFKDVAVVFSEEELRLLDLAQRKLYREVMLENFRNLLSVGHQPLHRDTFHFLKEEKFWMMETVTQREGNLGDK

SEQ ID NO: 5019 - protein, 81 aa, Macaca mulatta
MTTFKEGLTFKDVAVVFTEEELGLLDPVQRNLYRDVMLENFRNLLSVGHHPFKHDVFPLEKEKKLGMMKTATQRKGKSADK

SEQ ID NO: 5020 - protein, 81 aa, Macaca mulatta
MNMFKEAVTFNDVAVAFTEEELGLLGPAQRKLYRDVMVENFRNLLSVGHQPFKQDVSPIERNEQLWIVTTATQRQRNLGEK

SEQ ID NO: 5021 - protein, 81 aa, Macaca mulatta
VGHQPFKQDVSPIERNEQLWIVTTATQRQRNLGEKNQSKLVTIQDRESEEELSCWQIWQQIANDLTRCQDSMINNSQFHKQ

SEQ ID NO: 5022 - protein, 81 aa, Macaca mulatta
MNMFKEAVTFNDVAVAFTEEELGLLGPAQRKLYRDVMVENFRNLLSVGHQPFKQDVSPIERNEQLWIVTTATQRQRNLGKN

SEQ ID NO: 5023 - protein, 81 aa, Macaca mulatta
TFNDVAVAFTEEELGLLGPAQRKLYRDVMVENFRNLLSVGHQPFKQDVSPIERNEQLWIVTTATQRQRNLGKNQTVVSSYS

SEQ ID NO: 5024 - protein, 81 aa, Macaca mulatta
MNMFKEAVTFNDVAVAFTEEELGLLGPAQRKLYRDVMVENFRNLLSVGHQPFKQDVSPIERNEQLWIVTTATQRQRNLDTL

SEQ ID NO: 5025 - protein, 81 aa, Macaca mulatta
AVAFTEEELGLLGPAQRKLYRDVMVENFRNLLSVGHQPFKQDVSPIERNEQLWIVTTATQRQRNLDTLLVKALLLYDLAQT

SEQ ID NO: 5026 - protein, 81 aa, Macaca mulatta
MVENFRNLLSVGHQPFKQDVSPIERNEQLWIVTTATQRQRNLGEKNQSKLVTIQDRESEEELSCWQIWQQIANDLTRCQDS

SEQ ID NO: 5027 - protein, 81 aa, Macaca mulatta
RNEQLWIVTTATQRQRNLGEKNQSKLVTIQDRESEEELSCWQIWQQIANDLTRCQDSMINNSQFHKQGDFPCQVGAELSVQ

SEQ ID NO: 5028 - protein, 81 aa, Macaca mulatta
IERNEQLWIVTTATQRQRNLGEKNQSKLVTIQDRESEEELSCWQIWQQIANDLTRCQDSMINNSQFHKQGDFPCQVGAELS

SEQ ID NO: 5029 - protein, 81 aa, Macaca mulatta
SQDYDLPQKEQEKMTKFQDAVTFKDVAVVFSREELRLLDLTQRKLYRDVMVENFKNLVAVGHLPFQPDMVSQLEAEEKLWM

SEQ ID NO: 5030 - protein, 81 aa, Macaca mulatta
SQDYDLPQKEQEKMTKFQDAVTFKDVAVVFSREELRLLDLTQRKLYRDVMVENFKNLVAVGSKHQNKMETLQKFALKYLSN

SEQ ID NO: 5031 - protein, 81 aa, Macaca mulatta
PSQDYDLPQKEQEKMTKFQDAVTFKDVAVVFSREELRLLDLTQRKLYRDVMVENFKNLVAVGHLPFQPDMVSQLEAEEKLW

SEQ ID NO: 5032 - protein, 81 aa, Macaca mulatta
MTKFQGMVTFKDVAVVFTREELGLLDLAQRKLYQDVMLENFRNLLSVGYHPFKLDVILQLGREDKLWLMETEIQRDGCSGH

SEQ ID NO: 5033 - protein, 81 aa, Macaca mulatta
MTKFQGMVTFKDVAVVFTREELGLLDLAQRKLYQDVMLENFRNLLSVGYHPFKLDVILQLGREDKLWLMETEIQRDGCSGE

SEQ ID NO: 5034 - protein, 81 aa, Macaca mulatta
MTKFRGMVTFKDVAVVFTREELGLLDLAQRKLYQDVMLENFRNLLSVGKHKHLKLLSPLQTRCDTTVGKRRQALADGDRNP

SEQ ID NO: 5035 - protein, 81 aa, Macaca mulatta
MVTFKDVAVVFTREELGLLDLAQRKLYQDVMLENFRNLLSVGKHKHLKLLSPLQTRCDTTVGKRRQALADGDRNPKRWLFR

SEQ ID NO: 5036 - protein, 81 aa, Macaca mulatta
MTKFQEAVTFKDVAVAFTEEELGLLDSAQRKLYRDVMLENFRNLVSVGHQSFKPDMISQLEREEKLWMKEFQTQRGKHSET

SEQ ID NO: 5037 - protein, 81 aa, Macaca mulatta
MTKFQEAVTFKDVAVAFTEEELGLLDSAQRKLYRDVMLENFRNLVSVGHQSFKPDMISQLEREEKLWMKEFQTQRGKHSVW

SEQ ID NO: 5038 - protein, 81 aa, Macaca mulatta
MTKFQEAVTFKDVAVAFTEEELGLLDSAQRKLYRDVMLENFRNLVSVGHQSFKPDMISQLEREEKLWMKEFQTQRGKHSGF

SEQ ID NO: 5039 - protein, 81 aa, Macaca mulatta
MTKFQEAVTFKDVAVAFTEEELGLLDSAQRKLYRDVMLENFRNLVSVGHQSFKPDMISQLEREEKLWMKEFQTQRGDRNQN

SEQ ID NO: 5040 - protein, 81 aa, Macaca mulatta
MTKFQEAVTFKDVAVAFTEEELGLLDSAQRKLYRDVMLENFRNLVSVGHQSFKPDMISQLEREEKLWMKEFQTQRGKHSGD

SEQ ID NO: 5041 - protein, 81 aa, Macaca mulatta
PGTLPFPGRKRGKMTKFQEAVTFKDVAVAFTEEELGLLDSAQRKLYRDVMLENFRNLVSVGHQSFKPDMISQLEREEKLWM

SEQ ID NO: 5042 - protein, 81 aa, Macaca mulatta
MVTFKDVAVVFTEEELGLLDSVQRKLYRDVMLENFRNLLLVAHQPFKPDLISQLEREEKLLMVETETPKDGCSGRKNQQKM

SEQ ID NO: 5043 - protein, 81 aa, Macaca mulatta
MTKFQEMVTFKDVAVVFTEEELGLLDSVQRKLYRDVMLENFRNLLLVAHQPFKPDLISQLEREEKLLMVETETPKDGCSGR

SEQ ID NO: 5044 - protein, 81 aa, Macaca mulatta
SLPFSRTRKRKMTKFQEMVTFKDVAVVFTEEELGLLDSVQRKLYRDVMLENFRNLLLVAHQPFKPDLISQLEREEKLLMVE

SEQ ID NO: 5045 - protein, 81 aa, Macaca mulatta
HQPFKPDLISQLEREEKLLMVETETPKDGCSGRKNQQKMESIQEVTVSYLSPKELSSCQTWQQSAGGLIRCQDFLKVFQGK

SEQ ID NO: 5046 - protein, 81 aa, Macaca mulatta
MMKFQMVTFKDVAVVFTEEELGLLDSVQRKLYRDVMLENFRNLLLVAHQPFKPDLISQLEREEKLLMVETETPKDGCSGRK

SEQ ID NO: 5047 - protein, 81 aa, Macaca mulatta
EREEKLLMVETETPKDGCSGRKNQQKMESIQEVTVSYLSPKELSSCQTWQQSAGGLIRCQDFLKVFQGKNSQLQEQGDSLC

SEQ ID NO: 5048 - protein, 81 aa, Macaca mulatta
MMKFQERVTFKDVAVVFTKEELALLDKAQINLYQDVMLENFRNLISVGDGIKNNILNLQEKGLSYLSQEVLRCWQIWKQRI

SEQ ID NO: 5049 - protein, 81 aa, Macaca mulatta
HSQASALSQDRKDKTMFQEPLSFKDVAVVFTEEELGLLDSTQRQLYRDVMLENFRNLLSVGERNPPGDKNGRDMEYIQDEE

SEQ ID NO: 5050 - protein, 81 aa, Macaca mulatta
HSQASALSQDRKDKTMFQEPLSFKDVAVVFTEEELGLLDSTQRQLYRDVMLENFRNLLSVGDKNGRDMEYIQDEELRLFSH

SEQ ID NO: 5051 - protein, 81 aa, Macaca mulatta
IIIKVEGEDTGSLTIPSQEGVNFKIVTVDFTQEEQGTWNPAQRTLDRDVILENHRDLVSWDLTTAVGKKDPTSKQSIFDEE

SEQ ID NO: 5052 - protein, 81 aa, Macaca mulatta
SMAEQDEKPPEPPKACAQEGVNFKIVTVDFTQEEQGTWNPAQRTLDRDVILENHRDLVSWDLTTAVGKKDPTSKQSIFDEE

SEQ ID NO: 5053 - protein, 81 aa, Macaca mulatta
GNTGEPGLAVASVTKMSQDSVTFADVAVNFTKEEWTLLDPAQRNLYRDVMLENSRNLAFIDWATPCETKDAAPQPDILPKR

SEQ ID NO: 5054 - protein, 81 aa, Macaca mulatta
MSQDSVTFADVAVNFTKEEWTLLDPAQRNLYRDVMLENSRNLAFIDWATPCETKDAAPQPDILPKRTYPEANSVCLTSISS

SEQ ID NO: 5055 - protein, 81 aa, Macaca mulatta
DEIDTGANRHQQNPFGKAFHEDGSLRAHNTRVREKMYDFTQGENTSRNNSVHAVQMQSYTAETNKKDCQTGATSANAPNSG

SEQ ID NO: 5056 - protein, 81 aa, Macaca mulatta
PSSASRVAGTTGAHPHSRDSVTFADVAVNFTKEEWTLLDPAQRNLYRDVMLENSRNLAFIDWATPCETKDAAPQPDILPKR

SEQ ID NO: 5057 - protein, 81 aa, Macaca mulatta
MTEEFVTLKDVGMDFTLEDWEQLGLEQGDVFWDTALDNCQDLLLLDPPRPNLTSHPDGGEDLEPLPGGSPEATGPDATETK

SEQ ID NO: 5058 - protein, 81 aa, Macaca mulatta
MDFTLEDWEQLGLEQGDVFWDTALDNCQDLLLLDPPRPNLTSHPDGGEDLEPLPGGSPEATGPDATETKNSPLMEDFLEEG

SEQ ID NO: 5059 - protein, 81 aa, Macaca mulatta
AHAQDPAMANGTLMAEGQESVTFKDVAVDFTLEEWGWLEPDQRELYRDVMLENYRNLLSLGAGLPGSKPDVISRLERGEEP

SEQ ID NO: 5060 - protein, 81 aa, Macaca mulatta
LSQKPQVLGPEEQDGSCEASLSFEDVTVDFSREEWQQLDPAQRRLYQDVTLELYSHLFSVGYHIPNPDVIFRMLKEKEPCV

SEQ ID NO: 5061 - protein, 81 aa, Macaca mulatta
NATIVMSVRREQGSSSGEGSLSFEDVAVDFTREEWQFLDWSQKVLYKEVMLENYSNLVSVGYQGTKPDSLFKLEQGEPPWI

SEQ ID NO: 5062 - protein, 81 aa, Macaca mulatta
MTEAQESLTLRDVAVDFTWEEWQLLGPAQKHLYRDVMLENYSNLVSVGFQASKPDALTKLEQGEPLWALEDEIHSPTHPEI

SEQ ID NO: 5063 - protein, 81 aa, Macaca mulatta
MLENYSNLVSVGYQASKPDALSKLEQGEPWTVENEIHSQICPEIKKVDNHLQMHSQNQRCLKRVEQCHKHNAFGNIIHQRK

SEQ ID NO: 5064 - protein, 81 aa, Macaca mulatta
YSNLVSVGYQASKPDALSKLEQGEPWTVENEIHSQICPEIKKVDNHLQMHSQNQRCLKRVEQCHKHNAFGNIIHQRKSDFP

SEQ ID NO: 5065 - protein, 81 aa, Macaca mulatta
MIKSQESLTLEDVAVEFTWEEWQLLGPAQKDLYRDVMLENYSNLVSVGYQASKPDALSKLEQGEPWTVENEIHSQICPEIK

SEQ ID NO: 5066 - protein, 81 aa, Macaca mulatta
MIQAQESVTLEDVAVDFTWEEWQLLGPAQKDLYRDVMLENYSNLVAVGYQASKPDVFFKLEQGEPPWTTEDGIHSGACSEI

SEQ ID NO: 5067 - protein, 81 aa, Macaca mulatta
AYMSCLVKHKRIHTREKQDAVKVEIPPAERHSILHTSDVMQEKNSANGVTTQVSSVTPQTSLNISGLLANRNIVLVGQPVV

SEQ ID NO: 5068 - protein, 81 aa, Macaca mulatta
MLENYSNLVAVGYQASKPDVFFKLEQGEPPWTTEDGIHSGACSEIWKVDDHVLKRLHSETLVNRRKQCHEHDAFENIVHCS

SEQ ID NO: 5069 - protein, 81 aa, Macaca mulatta
MMQAQESLTLEDVALDFTWEEWQFLSPAQKDLYRDVMLENYSNLVAVGYQASKPDALSKLEQGEEPCTTEDEIYTRICCEI

SEQ ID NO: 5070 - protein, 81 aa, Macaca mulatta
MRPEPTKFWEESLTLEDVALDFTWEEWQFLSPAQKDLYRDVMLENYSNLVAVGYQASKPDALSKLEQGEEPCTTEDEIYTR

SEQ ID NO: 5071 - protein, 81 aa, Macaca mulatta
MESLTLEDVALDFTWEEWQFLSPAQKDLYRDVMLENYSNLVAVGYQASKPDALSKLEQGEEPCTTEDEIYTRICCEIRKID

SEQ ID NO: 5072 - protein, 81 aa, Macaca mulatta
MIKTQESLTLEDVAVEFSWEEWQLLDTAQKNLYRDVMVENYNHLVSLGYQTSKPDVLSKLAHGQEPWITVAKIQNKNCPGI

SEQ ID NO: 5073 - protein, 80 aa, Macaca mulatta
MIKTQESLTLEDVAVEFSWEEWQLLDTAQKNLYRDVMVENYNHLVSLGYQTSKPDVLSKLAHGQEPWITVAKIQNKNCPD

SEQ ID NO: 5074 - protein, 81 aa, Macaca mulatta
MINAQELLTLEDVTVEFTWEEWQLLDPFQKGLYRDVMLEIYSNLVSMGYQVSKPDALSRLERGEEPWTMEDERHSQICPEN

SEQ ID NO: 5075 - protein, 81 aa, Macaca mulatta
ALSRLERGEEPWTMEDERHSQICPENNKVDDHLQDHLENQRMLKSVEQYHERNAFGNTASQTKSHCLFRENHDTFELYIKA

SEQ ID NO: 5076 - protein, 81 aa, Macaca mulatta
LVSMGYQVSKPDALSRLERGEEPWTMEDERHSQICPENNKVDDHLQDHLENQRMLKSVEQYHERNAFGNTASQTKSHCLFR

SEQ ID NO: 5077 - protein, 81 aa, Macaca mulatta
MINAQELLTLEDVTVEFTWEEWQLLDPFQKGLYRDVMLEIYSNLVSMGYQVSKPDALSRLERGEEPWTMEDERHSQICPGM

SEQ ID NO: 5078 - protein, 81 aa, Macaca mulatta
MALPQGSLTFRDVAIEFSQEEWKCLDPIQKALYRDVMLENYRNLGFLGLCLPDLNIISMLEQGKEPWTVVSQVKIARNPNW

SEQ ID NO: 5079 - protein, 81 aa, Macaca mulatta
MATQGPLTFKDVAIEFSQEEWKCLEPVQKALYKDVMLENYRNLVFLGISPKCVIKELPPTENSNTGERFQTVALERHQSCD

SEQ ID NO: 5080 - protein, 81 aa, Macaca mulatta
AQKRKNRKEKESGMALTQGPLTFRDVAIEFSQEEWKSLDPVQKALYWDVMLENYRNLVFLGILPKCMTKELPPIGNSNTGE

SEQ ID NO: 5081 - protein, 81 aa, Macaca mulatta
MALTQGPLTFRDVAIEFSQEEWKSLDPVQKALYWDVMLENYRNLVFLGILPKCMTKELPPIGNSNTGEKFQTVMLERHECY

SEQ ID NO: 5082 - protein, 81 aa, Macaca mulatta
LDPVQKALYWDVMLENYRNLVFLGILPKCMTKELPPIGNSNTGEKFQTVMLERHECYDIENFSLREIQKNLQDLEFQWKDG

SEQ ID NO: 5083 - protein, 81 aa, Macaca mulatta
MAQLRRGHLTFRDVAIEFSQEEWKCLDPVQKALYRDVMLENYRNLVSLGICLPDLSIISMMKQRTEPWTVENEMKVAKNPV

SEQ ID NO: 5084 - protein, 81 aa, Macaca mulatta
EGEAQKRKAKESGMPLTQGHLTFRDVAIEFSQEEWKCLDPVQKALYRDVMLENYRNLVSLGICLPDLSIISMMKQRTEPWT

SEQ ID NO: 5085 - protein, 81 aa, Macaca mulatta
MLENYRNLVSLGICLPDLSIISMMKQRTEPWTVENEMKVAKNPVRWEGIKDINTGRCCAMRSKAGNKPITNQLGLTFQLPL

SEQ ID NO: 5086 - protein, 81 aa, Macaca mulatta
MGHLTFRDVAIEFSQEEWKCLDPVQKALYRDVMLENYRNLVSLGICLPDLSIISMMKQRTEPWTVENEMKVAKNPVRWEGI

SEQ ID NO: 5087 - protein, 81 aa, Macaca mulatta
AQKRRKRKAKESGTALPQGHLTFRDVAIEFSQAEWKCLDLAQRALYKDVMLENYRNLVSLGISLPDLNINSMLEQRREPWS

SEQ ID NO: 5088 - protein, 81 aa, Macaca mulatta
DEEAQKREAKESGMALPQGHLTFMDVAIEFSQEEWKCLDPGQRALYRDVMLENYRNLVSLGICLPDLSIISMLKQRREPLT

SEQ ID NO: 5089 - protein, 81 aa, Macaca mulatta
DEEAQKREAKESGMALPQGHLTFMDVAIEFSQEEWKCLDPGQRALYRDVMLENYRNLVSLGRSCILGSNAENKPIKNQLGF

SEQ ID NO: 5090 - protein, 81 aa, Macaca mulatta
VSWRPGSRLRGVTVMLRRGLLTFRDVAIEFSQEEWKCLDPAQRTLYRDVMLENYRNLVFLGICLPDLSIISMLEQRRDPRN

SEQ ID NO: 5091 - protein, 81 aa, Macaca mulatta
MLRRGLLTFRDVAIEFSQEEWKCLDPAQRTLYRDVMLENYRNLVFLGICLPDLSIISMLEQRRDPRNLQSEVKIANNPDGR

SEQ ID NO: 5092 - protein, 81 aa, Macaca mulatta
KEATRKMKEKESGMALTQGPLKFMDVAIEFSQEEWKCLEPAQRTLYRDVMLENYRNLVSLGICLPDLSVISTLEQKKDPWI

SEQ ID NO: 5093 - protein, 81 aa, Macaca mulatta
MALTHGQLLFRDVAIEFSQEEWKCLNPGQKALYRDVMLENYRNLISLGICLPDLSVISILEQKRDPWTLQSDVKVANNPNG

SEQ ID NO: 5094 - protein, 81 aa, Macaca mulatta
MALTHGQLLFRDVAIEFSQEEWKCLNPGQKALYRDVMLENYRNLISLGEDNVPPEAWICSGICLPDLSVISILEQKRDPWT

SEQ ID NO: 5095 - protein, 81 aa, Macaca mulatta
MALPQGRLTFRDVAIEFSLAEWKCLNPAQRALYREVMLENYRNLESVDISSKCMMKEILSTGQGNTEVFHTGTLQRHESHH

SEQ ID NO: 5096 - protein, 81 aa, Macaca mulatta
TGVSHCTWPLCFQGLTSKDLVREEKTRKRKAKAGMAIPQGLLTFRDVAIEFSQEEWKCLDPAQRTLYRDVMLENYRNLVSL

SEQ ID NO: 5097 - protein, 81 aa, Macaca mulatta
MAIPQGLLTFRDVAIEFSQEEWKCLDPAQRTLYRDVMLENYRNLVSLGQGNTEVIHTGTLQRQASHHIGDICFQEIGKDIH

SEQ ID NO: 5098 - protein, 81 aa, Macaca mulatta
MALPQGLLTFRDVAIEFSQEEWKCLDPAQRTLYRNVMLENYRNLVSLDMHHHHTWLIFVFLIATRFCHVGQIGLELPTSVS

SEQ ID NO: 5099 - protein, 81 aa, Macaca mulatta
SDSPASASKVAGITGIFSKYEIKELPTKKESNTGEIFQTVMLERHESHDIEDFCFSETQKNVHDSQCRWRHDERHYKRVCV

SEQ ID NO: 5100 - protein, 81 aa, Macaca mulatta
MALPQGLLTFRDVAIEFSQEEWKCLDPAQRTLYRNVMLENYRNLVSLGIFSKYEIKELPTKKESNTGEIFQTVMLERHESH

SEQ ID NO: 5101 - protein, 81 aa, Macaca mulatta
DPAQRTLYRNVMLENYRNLVSLGIFSKYEIKELPTKKESNTGEIFQTVMLERHESHDIEDFCFSETQKNVHDSQCRWRHDE

SEQ ID NO: 5102 - protein, 81 aa, Macaca mulatta
AIEFSQEEWKCLDPAQRTLYRNVMLENYRNLVSLGIFSKYEIKELPTKKESNTGEIFQTVMLERHESHDIEDFCFSETQKN

SEQ ID NO: 5103 - protein, 81 aa, Macaca mulatta
MALPQGLLTFRDVAIEFSQEEWKCLDPAQRTLYRNVMLENYRNLVSLGHDLILFFSFLFEMEFRSYSHVSLLLYAQASCWK

SEQ ID NO: 5104 - protein, 81 aa, Macaca mulatta
NYRNLVSLGHDLILFFSFLFEMEFRSYSHVSLLLYAQASCWKNSPFWGANLTNFCNVFFLNMRSRNYQQKRRVIQEKYSRQ

SEQ ID NO: 5105 - protein, 81 aa, Macaca mulatta
MALPQGLLTFRDVAIEFSQEEWKCLDPAQRTLYRNVMLENYRNLVSLETGFHQFGQDGLLVIHLPRPPKDMISFFFFLFFS

SEQ ID NO: 5106 - protein, 81 aa, Macaca mulatta
MALPQGRVTFRDVAIEFSLAEWKCLNPAQRALYREVMLENYRNLESVDISSKCMMKEVLSTGQGNTEVFYPGTLQRPESHH

SEQ ID NO: 5107 - protein, 81 aa, Macaca mulatta
MALPQGRVTFRDVAIEFSLAEWKCLNPAQRALYREVMLENYRNLESVDISSKCIMKEFSSTGQCNTEVIHTGTLQRHESHH

SEQ ID NO: 5108 - protein, 81 aa, Macaca mulatta
MALPQGLLTFRDVAIEFSQDEWKCLDPAQRSLYRDVMLENYRNLVSLVDIWAEVIVADISSKCMLKTLSSTGQGNTEVILI

SEQ ID NO: 5109 - protein, 81 aa, Macaca mulatta
MALPQGLLTFRDVAIEFSQDEWKCLDPAQRSLYRDVMLENYRNLVSLAISSKCMLKTLSSTGQGNTEVILTGTLQRQASHH

SEQ ID NO: 5110 - protein, 81 aa, Macaca mulatta
MALPQGLLTFRDVAIEFSQEEWKCLDPAQRTLYRDVMLENYRNLVSLDISSKCMMNTLSSTGQGNTEVFHTGILQRQASYH

SEQ ID NO: 5111 - protein, 81 aa, Macaca mulatta
MAPPQGLLTFRDVAIEFSQEEWKCLDPAQRTLYRDVMLENYRNLVSLAISSKCMMKKFSSTGQGNTEVIHTGTLQRQASHH

SEQ ID NO: 5112 - protein, 81 aa, Macaca mulatta
EEATKKSKEKYPGMAPPQGRLTFRDVAIEFSFMEWKCLNPAQRALYREVMLENYRNLEFVDSSLKSMMEFSSHEHSNTGEG

SEQ ID NO: 5113 - protein, 81 aa, Macaca mulatta
GRLTFRDVAIEFSFMEWKCLNPAQRALYREVMLENYRNLEFVDSSLKSMMEFSSHEHSNTGEGFHTGTLERHKSYHIGDFC

SEQ ID NO: 5114 - protein, 81 aa, Macaca mulatta
EEATKKSKEKYPGMAPPQGRLTFRDVAIEFSFMEWKCLNPAQRALYREVMLENYRNLEFVESCSCCPGWSAMSWSPHAATS

SEQ ID NO: 5115 - protein, 81 aa, Macaca mulatta
EEATKKSKEKYPGMAPPQGRLTFRDVAIEFSFMEWKCLNPAQRALYREVMLENYRNLEFVGEENVPSDMRSLLLSILALSG

SEQ ID NO: 5116 - protein, 81 aa, Macaca mulatta
MALPQGLLTFRDVAIEFSQEEWKCLDPAQRTLYRDVMLENYRNLVSLAISSKCMTRKFSSTGQGNTEVIHTGTLQRQASHH

SEQ ID NO: 5117 - protein, 81 aa, Macaca mulatta
MALTQVRLTFRDVAIEFSQEEWKCLDPAQRTLYRDVMLENYWNLVSLGLCHFDMNIISMLEEGKEPWTVKNCVKIARKPRM

SEQ ID NO: 5118 - protein, 81 aa, Macaca mulatta
KPRMRECVKGVITDIPPKCTTKDLLPEEKSSTEAVFHTVMLERHESPDIEDFSFKELQKNMHDFECQWRDDTGNYKGVLMT

SEQ ID NO: 5119 - protein, 81 aa, Macaca mulatta
MLENYWNLVSLGLCHFDMNIISMLEEGKEPWTVKNCVKIARKPRMRECVKGVITDIPPKCTTKDLLPEEKSSTEAVFHTVM

SEQ ID NO: 5120 - protein, 81 aa, Macaca mulatta
RKPRMRECVKGVITDIPPKCTTKDLLPEEKSSTEAVFHTVMLERHESPDIEDFSFKELQKNMHDFECQWRDDTGNYKGVLM

SEQ ID NO: 5121 - protein, 81 aa, Macaca mulatta
KIARKPRMRECVKGVITDIPPKCTTKDLLPEEKSSTEAVFHTVMLERHESPDIEDFSFKELQKNMHDFECQWRDDTGNYKG

SEQ ID NO: 5122 - protein, 81 aa, Macaca mulatta
MAFTQLTFRDVAIEFSQEEWKCLNSTQRTLYRDVMLENYRNLVSLDLSRNCMIKELAPQRESNREEVFHTVTLEQHEKHDI

SEQ ID NO: 5123 - protein, 81 aa, Macaca mulatta
MAFTQLTFRDVAIEFSQEEWKCLNSTQRTLYRDVMLENYRNLVSLEYYLMWEHRKEPWTMESQVQIARKPKGWEWIKGVKI

SEQ ID NO: 5124 - protein, 81 aa, Macaca mulatta
MDGDGLTFRDVAIEFSQEEWKCLNSTQRTLYRDVMLENYRNLVSLDLSRNCMIKELAPQRESNREEVFHTVTLEQHEKHDI

SEQ ID NO: 5125 - protein, 81 aa, Macaca mulatta
MAFTQGQLTFRDVAIEFSQEEWKCLNSTQRTLYRDVMLENYRNLVSLDLSRNCMIKELAPQRESNREEVFHTVTLEQHEKH

SEQ ID NO: 5126 - protein, 81 aa, Macaca mulatta
HEEETRKKRAKESGMAFTQLTFRDVAIEFSQEEWKCLNSTQRTLYRDVMLENYRNLVSLDLSRNCMIKELAPQRESNREEV

SEQ ID NO: 5127 - protein, 81 aa, Macaca mulatta
TQRTLYRDVMLENYRNLVSLDLSRNCMIKELAPQRESNREEVFHTVTLEQHEKHDIEEFCFREMKKKIHDFDCQWRDNERN

SEQ ID NO: 5128 - protein, 81 aa, Macaca mulatta
MDGDGLTFRDVAIEFSQEEWKCLNSTQRTLYRDVMLENYRNLVSLEYYLMWEHRKEPWTMESQVQIARKPKGWEWIKGVKI

SEQ ID NO: 5129 - protein, 81 aa, Macaca mulatta
MLENYRNLASLGISCFDLSIISMLEQGKEPFTVESQVQIARNPDGWEWIKAVITALSSEFLMKDLPHKGKSNKGEIFQTVM

SEQ ID NO: 5130 - protein, 81 aa, Macaca mulatta
SMLEQGKEPFTVESQVQIARNPDGWEWIKAVITALSSEFLMKDLPHKGKSNKGEIFQTVMLERQESHDIEGCSFREVQKNT

SEQ ID NO: 5131 - protein, 81 aa, Macaca mulatta
MAPPQGQLTLKDVAIEFSQEEWTYLDPAQKTLYRDVMLENYRNLVSLDISCKCVNKDPPPKGKNSTGEAFHMVKLEGLESC

SEQ ID NO: 5132 - protein, 81 aa, Macaca mulatta
MLENYRNLVSLGISLSEMSIISMLGQGKEPWTVEREVRITKTSNGWERIKGVNTDVSPTHMIKKSPPKQNNSTEKVFQAVM

SEQ ID NO: 5133 - protein, 81 aa, Macaca mulatta
TKTSNGWERIKGVNTDVSPTHMIKKSPPKQNNSTEKVFQAVMLERHEIHDIKDFYFREMQQNIHDFECQCHNDERNYREIP

SEQ ID NO: 5134 - protein, 81 aa, Macaca mulatta
MLENYRNLVSLAGISLSEMSIISMLGQGKEPWTVEREVRITKTSNGWERIKGVNTDVSPTHMIKKSPPKQNNSTEKVFQAV

SEQ ID NO: 5135 - protein, 81 aa, Macaca mulatta
MEKGLFTFKDVAIEFSQEEWEYLDPAQRALYRDVMLENYRNLLSLDEDNVLPENDISVGFTSKGLSPKENNKEELYHLVIL

SEQ ID NO: 5136 - protein, 81 aa, Macaca mulatta
ALYRDVMLENYRNLLSLDEDNVLPENDISVGFTSKGLSPKENNKEELYHLVILERKESHGINNFDLKEVWENMSKFDSLWD

SEQ ID NO: 5137 - protein, 81 aa, Macaca mulatta
MALSQGLFTFKDVAIEFSQEEWEYLDPAQRALYRDVMLENYRNLLSLDEDNVLPENDISVGFTSKGLSPKENNKEELYHLV

SEQ ID NO: 5138 - protein, 81 aa, Macaca mulatta
LYRDVMLENYRNLLSLDEDNVLPENDISVGFTSKGLSPKENNKEELYHLVILERKESHGINNFDLKEVWENMSKFDSLWDY

SEQ ID NO: 5139 - protein, 81 aa, Macaca mulatta
EEATKKSKEKDPGMALPQGRLTFRDVAIEFSLAEWKCLDPVQRALYTAVMLENYRNLEFVDSFLKFMMEFSSTGHSNTREG

SEQ ID NO: 5140 - protein, 81 aa, Macaca mulatta
MALPQGLLTFRDVAIEFSQEEWKCLDPAQRTLYRDVMLENYRNLVSLDISSKCMMKEFSSTAQGNTEVIHRGTIQRHERHH

SEQ ID NO: 5141 - protein, 81 aa, Macaca mulatta
MALPQGLLTFRDVAIEFSQEEWKCLDPAQRTLYRAVMLENYRNLVSLAISSKCMMKEFSSTAQGNREVLHTGTLQRHESHH

SEQ ID NO: 5142 - protein, 81 aa, Macaca mulatta
MALPQGLLTFRDVAIEFSQEEWKCLDPAQRTLYRDVMVENYRNLVSLDISSKCKMKEFLSTAQSNREVFHTGTLQRHESHQ

SEQ ID NO: 5143 - protein, 81 aa, Macaca mulatta
MAPPQGLLTFRDVAIEFSQEEWKCLDPAQRTLYRDVMLENYRNLVSLDISSKCTMKDFSSTVQGNTEVIHTRTLERHHIGD

SEQ ID NO: 5144 - protein, 81 aa, Macaca mulatta
MAPPQGLLTFRDVAIEFSQEEWKCLDPAQRTLYREVMVENYRNLVSLDISSKCMMEFLSTAQSNREVIHTGTLERHESHHI

SEQ ID NO: 5145 - protein, 81 aa, Macaca mulatta
MAPPQGLLTFRDVAIEFSQEEWKCLDPAQRTLYREVMVENYRNLVSLGSHFVTQAGGQWRDLGLLQPQPSGFKGSSHLSPH

SEQ ID NO: 5146 - protein, 81 aa, Macaca mulatta
MAQGLVTFADVAIDFSQEEWACLNSAQRDLYWDVMLENYSNLVSLDLESAYENKSLPTGKNIHEIRASKRNSDRRSKSLGR

SEQ ID NO: 5147 - protein, 81 aa, Macaca mulatta
MSQGSVTFQDVAIDFSKEEWRFLNPAQRDLYTTVMLENYQNLVWLGLSISKSVISLLEKRKLPWIMGKEEIRVPLPGMEEV

SEQ ID NO: 5148 - protein, 81 aa, Macaca mulatta
MSLGSELFRDVAIVFSQEEWQCLAPAQRDLYRDVMLETYNNLVSLGLAISKPDVISFLEQGKEPWMVERVVSGGLCPGAKG

SEQ ID NO: 5149 - protein, 81 aa, Macaca mulatta
MSLGSELFRDVAIVFSQEEWQCLAPAQRDLYRDVMLETYNNLVSLGLAISKPDVISFLEQGKEPWMVERVVSGGLCPVLES

SEQ ID NO: 5150 - protein, 81 aa, Macaca mulatta
MSKDLVTFGDVAVNFSQEEWEWLNPAQRNLYRKVMLENYRSLVSLGVSVSKPDVISLLEQGKEPWMVKKEGTRGTCPDWEY

SEQ ID NO: 5151 - protein, 81 aa, Macaca mulatta
ITHKEILPEVQNKEYNKSWQTFHQDTIFDIQQSFPTKEKEHKHEPQKKSYRKKSVEMKHRKVYVEKKLLKCNDCEKVFNQS

SEQ ID NO: 5152 - protein, 81 aa, Macaca mulatta
MSKDLVTFGDVAVNFSQEEWEWLNPAQRNLYRKVMLENYRSLVSLAGVSVSKPDVISLLEQGKEPWMVKKEGTRGTCPDWE

SEQ ID NO: 5153 - protein, 81 aa, Macaca mulatta
MPAARGKSKSKAPITFGDLAIYFSQEEWEWLSPIQKDLYEDVMLENYRNLVSLGLSFRRPNVITLLEKGKAPWMVEPVRRR

SEQ ID NO: 5154 - protein, 81 aa, Macaca mulatta
DPKGGEGMPAARGKSKSKAPITFGDLAIYFSQEEWEWLSPIQKDLYEDVMLENYRNLVSLGLSFRRPNVITLLEKGKAPWM

SEQ ID NO: 5155 - protein, 81 aa, Macaca mulatta
MNVEVVKVMPQDLVTFKDVAIDFSQEEWQWMNPAQKHLYRSMMLENYQSLVSLGLCISKPCVISLLEQGREPWEMTSEMTR

SEQ ID NO: 5156 - protein, 81 aa, Macaca mulatta
NQKLEAAGTGIEPKAMPQGLVTFGDVAVDFSQEEWEWLNPNQRNLYRKVMLENYKNLASLGLCVSKPDVISSLEQGKEPWT

SEQ ID NO: 5157 - protein, 81 aa, Macaca mulatta
LEYSLLGEHWDYDALFDTQPGLVTIKNLAVDFPQQLHPAQKNFSKNGIWENHSDLGSAGHCVAKPDLVSLLQQEKEPWMVK

SEQ ID NO: 5158 - protein, 81 aa, Macaca mulatta
SQEEVEVAGIKLRKAMSLGSVTFTDVAIDFSQDEWEWLNLAQRSLYKKVMLENYRNLVSVGLCLSKPDVISLLEQEKDPWV

SEQ ID NO: 5159 - protein, 81 aa, Macaca mulatta
MAAQLLTDEALESVTFRDVTVDFTQEEWQQLEPAQKDLYRDVMLENYRNLVSLDWETRPEMKELDPKKDISEDKPSVVGVA

SEQ ID NO: 5160 - protein, 81 aa, Macaca mulatta
AGSQFLDFKHLGAFLVFEELVTFEDVFVDFSPEELSSLSAAQRNLYREVMLENYRNLVSLGYQFSKPDIISRLEAEESRAM

SEQ ID NO: 5161 - protein, 81 aa, Macaca mulatta
RDSRAYESRSQDAESYQNVVDLTEDRKPHNTIQDNMENYRKLLSLGFLAQDSVPAEKRNTEMLDNLPSAGSQFLDFKHLGA

SEQ ID NO: 5162 - protein, 81 aa, Macaca mulatta
MNNSQGRVTFEDVTVNFTKGEWQRLNPEQRNLYRDVMLENYSNLVFVGREETTKPDVILRLEQGKEPWLVEEEVLGSGRPE

SEQ ID NO: 5163 - protein, 81 aa, Macaca mulatta
MAAAVLTDRAQVSVTFDDVAVTFTKEEWGQLDLAQRTLYQEVMLENCGLLVSLGCPIPRPELIYHLEHGQEPWTRKEDLSQ

SEQ ID NO: 5164 - protein, 81 aa, Macaca mulatta
MAAAVLTDRAQVSVTFDDVAVTFTKEEWGQLDLAQRTLYQEVMLENCGLLVSLGNKGKPKTTEPTTCEPALSEGISLQGQL

SEQ ID NO: 5165 - protein, 81 aa, Macaca mulatta
MATALTDPAQVSVTFDDVAVTFTQEEWGQLDLAQRTLYQEVMLENCGLLVSLGCPVPRPELIYHLEHGQEPWTRKEDLSQD

SEQ ID NO: 5166 - protein, 81 aa, Macaca mulatta
MAASAQVSVTFEDVAVTFTQEEWGQLDAAQRTLYQEVMLETYGLLVSLGCPLFEPELIYQLDRREELWIVKKDLSQSSYPG

SEQ ID NO: 5167 - protein, 81 aa, Macaca mulatta
MAAAVLMDRVQSCVTFEDVFVYFSREEWELLEEAQRFLYRDVMLENFALVATLGFWCEAENEEAPSEQSVSVGVSQVRTAE

SEQ ID NO: 5168 - protein, 81 aa, Macaca mulatta
MAAAVLMDRVQSCVTFEDVFVYFSREEWELLEEAQRFLYRDVMLENFALVATLAFIFPVPCSCPVGRGRKPWVPDRADTTA

SEQ ID NO: 5169 - protein, 81 aa, Macaca mulatta
MYSSLPIWQGRVVFEDVAIYFSQEEWGHLDEAQRLLYRDVMLENLALLSSLGCCHGAEDEEAPLEPGVSVGVSQVMAPKPC

SEQ ID NO: 5170 - protein, 81 aa, Macaca mulatta
MAEMNPAQGRVVFEDVAIYFSQEEWGHLDEAQRLLYRDVMLENLALLSSLGCWHGAEDEEAPSQQGFSVGMPEVTTSKSYL

SEQ ID NO: 5171 - protein, 81 aa, Macaca mulatta
MNLTEGPLVMAETDPTQGRVVFEDVAIYFSQEEWGHLDEAQRLLYRDVMLENLALLSSLGCWHGAEDEEAPSQQGFSVGMP

SEQ ID NO: 5172 - protein, 81 aa, Macaca mulatta
MAETDPTQGRVVFEDVAIYFSQEEWGHLDEAQRLLYRDVMLENLALLSSLGCWHGAEDEEAPSQQGFSVGMPEVTTSKSYL

SEQ ID NO: 5173 - protein, 81 aa, Macaca mulatta
RQVDIKGPLVMAETDPTQGRVVFEDVAIYFSQEEWGHLDEAQRLLYRDVMLENLALLSSLGCWHGAEDEEAPSQQGFSVGM

SEQ ID NO: 5174 - protein, 81 aa, Macaca mulatta
MNLTEGPVMAETDPTQDCMVFEDVAIHFSQEEWGILNGVQRHLHSDVMLENFALLSSVGCWHGAKDEEAPSKQCVSVGVSQ

SEQ ID NO: 5175 - protein, 81 aa, Macaca mulatta
VLMDAGQDCMVFEDVAIHFSQEEWGILNGVQRHLHSDVMLENFALLSSVGCWHGAKDEEAPSKQCVSVGVSQVTTLKPALC

SEQ ID NO: 5176 - protein, 81 aa, Macaca mulatta
MNLTEDCMVFEDVAIHFSQEEWGILNGVQRHLHSDVMLENFALLSSVGCWHGAKDEEAPSKQCVSVGVSQVTTLKPALCTQ

SEQ ID NO: 5177 - protein, 81 aa, Macaca mulatta
MNLTEECMVFEDVAIYFSREEWGILNDAQRHLHSNVMLENFALLSSVGCWHGAKDEEVLSKQCVSVRVLQVTAPKPALPTL

SEQ ID NO: 5178 - protein, 81 aa, Macaca mulatta
VNCSAHRGERNFTCTQGGRDFTASSDLLQQHVLNSGRKLYRDTQNGENFQGKQNDFNSSQGGKDFCHQHRLFEHQKTHNGE

SEQ ID NO: 5179 - protein, 81 aa, Macaca mulatta
MAAAEPMGPAQVPMNSEVIMDPIQGQVNFEDVFVYFSQEEWVLLDEAQRLLYRDVMLENFALMASLERQAMSIRTVLQHPT

SEQ ID NO: 5180 - protein, 81 aa, Macaca mulatta
AAAEPMGPAQVPMNSEVIMDPIQGQVNFEDVFVYFSQEEWVLLDEAQRLLYRDVMLENFALMASLERQAMSIRTVLQHPTG

SEQ ID NO: 5181 - protein, 81 aa, Macaca mulatta
MGPAQVPMNSEVIMDPIQGQVNFEDVFVYFSQEEWVLLDEAQRLLYRDVMLENFALMASLGHTSFMSHIVASLVMGSEPWL

SEQ ID NO: 5182 - protein, 81 aa, Macaca mulatta
MGPAQVPMNSEVIMDPIQGQVNFEDVFVYFSQEEWVLLDEAQRLLYRDVMLENFALMASLGCWHGMEDEEIPFEQSFSIGM

SEQ ID NO: 5183 - protein, 81 aa, Macaca mulatta
MNSEVIMDPIQGQVNFEDVFVYFSQEEWVLLDEAQRLLYRDVMLENFALMASLGHTSFMSHIVASLVMGSEPWLPDWVDMT

SEQ ID NO: 5184 - protein, 81 aa, Macaca mulatta
MAAAALRDPTQQGYVTFEDVAVYFSQEEWRLLDEAQRLLCRNVMLENFSLLASLGLASSKTHDITQLESWKEPFMPASEVV

SEQ ID NO: 5185 - protein, 81 aa, Macaca mulatta
MAAAALRDPTQGYVTFEDVAVYFSQEEWRLLDEAQRLLCRNVMLENFSLLASLGLASSKTHDITQLESWKEPFMPASEVVT

SEQ ID NO: 5186 - protein, 81 aa, Macaca mulatta
RDPTQVLVTAELFTYHEEGYVTFEDVAVYFSQEEWRLLDEAQRLLCRNVMLENFSLLASLGLASSKTHDITQLESWKEPFM

SEQ ID NO: 5187 - protein, 81 aa, Macaca mulatta
MAAAALRDPTQGYVTFEDVAVYFSQEEWRLLDEAQRLLCRNVMLENFSLLASLGKFLTAHPSILGWTWLFLLFLVTGLFFP

SEQ ID NO: 5188 - protein, 81 aa, Macaca mulatta
EAQRLLCRNVMLENFSLLASLGKFLTAHPSILGWTWLFLLFLVTGLFFPKLNCGHSFLLQDLEVATVVSLGCVYYHLLSPS

SEQ ID NO: 5189 - protein, 81 aa, Macaca mulatta
MAAAALRDPTQQGYVTFEDVAVYFSQEEWRLLDEAQRLLCRNVMLENFSLLASLGCWHGAEAEEAPEQSASVGLCSSNVQQ

SEQ ID NO: 5190 - protein, 81 aa, Macaca mulatta
RDPTQVLVTAELFTYHEQGYVTFEDVAVYFSQEEWRLLDEAQRLLCRNVMLENFSLLASLGLASSKTHDITQLESWKEPFM

SEQ ID NO: 5191 - protein, 81 aa, Macaca mulatta
MAGAALRDPAQGYVTFEDVAVYFSQEEWRLLDETQRLLYRNVMLENFSLLASLGLASSKTHEITQLESWEEPFMPAWEVMT

SEQ ID NO: 5192 - protein, 81 aa, Macaca mulatta
MAGAALRDPAQQGYVTFEDVAVYFSQEEWRLLDETQRLLYRNVMLENFSLLASLGLASSKTHEITQLESWEEPFMPAWEVM

SEQ ID NO: 5193 - protein, 81 aa, Macaca mulatta
VNTPQIPMATEEFVKPSQGHVTFEDIAVYFSQEEWGLLDEAQRCLYHDVMLENFSLMASVGCLHGIETEEAPSEHTISAQG

SEQ ID NO: 5194 - protein, 81 aa, Macaca mulatta
LVNTPQIPMATEEFVKPSQGHVTFEDIAVYFSQEEWGLLDEAQRCLYHDVMLENFSLMASVARLSESNHKDSCSQQKVTVS

SEQ ID NO: 5195 - protein, 81 aa, Macaca mulatta
MAEAKDAAQMLVTFKDVAVTFTQEEWRQLDLTQRTLYREVMLETCGLLVSLGHRVPKPELVHLLEHGQELWTVKRGLSHPT

SEQ ID NO: 5196 - protein, 81 aa, Macaca mulatta
MLVTFKDVAVTFTQEEWRQLDLTQRTLYREVMLETCGLLVSLGHRVPKPELVHLLEHGQELWTVKRGLSHPTCAGDRTQVH

SEQ ID NO: 5197 - protein, 81 aa, Macaca mulatta
RDSTSVPVTAEAKVMGFTQGSVTFEDVAIYFSQEEWGLLDEAQRLLYRDVMLENFALITALVCCHGMEDEETPEQSVSVER

SEQ ID NO: 5198 - protein, 81 aa, Macaca mulatta
MDLTKGCVTFEDIAIYFSQEEWGLLDEAQRRLYLEVMLENFALVASLGCGHGTEDEETPSEQNVSVRVSQSKAGSSTQKTQ

SEQ ID NO: 5199 - protein, 81 aa, Macaca mulatta
MAAAALRAPTQGCVTFEDIAIYFSQEEWGLLDEAQRRLYLEVMLENFALVASLGCGHGTEDEETPSEQNVSVRVSQSKAGS

SEQ ID NO: 5200 - protein, 81 aa, Macaca mulatta
RAPTQVTVSPETHMDLTKGCVTFEDIAIYFSQEEWGLLDEAQRRLYLEVMLENFALVASLGCGHGTEDEETPSEQNVSVRV

SEQ ID NO: 5201 - protein, 81 aa, Macaca mulatta
MAAAALRAPTQEEWGLLDEAQRRLYLEVMLENFALVASLGCGHGTEDEETPSEQNVSVRVSQSKAGSSTQKTQSCEMCVPV

SEQ ID NO: 5202 - protein, 81 aa, Macaca mulatta
MAAAMRAPTLQGFVAFEDVAIYFSQEEWELLDETQRLLYHDVMLENFAVMASLGCWCGAEDEGAPSAESISVSELSQGRTP

SEQ ID NO: 5203 - protein, 81 aa, Macaca mulatta
SASAFRVAGTTGMRHHAQGSVTFEDVAVYFSWEEWDLLDEAQKHLYFDVMLENFALTSSLGCWHGVEHEETPSEQRISVEG

SEQ ID NO: 5204 - protein, 81 aa, Macaca mulatta
VQLRPQTRMATALRDPAPGSVTFEDVAVYFSWEEWDLLDEAQKHLYFDVMLENFALTSSLGLTSSWSHVVAQLGLGEVSSV

SEQ ID NO: 5205 - protein, 81 aa, Macaca mulatta
RDPAPVPIATEVLFKLTQGSVTFEDVAVYFSWEEWDLLDEAQKHLYFDVMLENFALTSSLGLTSSWSHVVAQLGLGEVSSV

SEQ ID NO: 5206 - protein, 81 aa, Macaca mulatta
MATALRDPAPGSVTFEDVAVYFSWEEWDLLDEAQKHLYFDVMLENFALTSSLGLTSSWSHVVAQLGLGEVSSVLHRMFMTP

SEQ ID NO: 5207 - protein, 81 aa, Macaca mulatta
MTFEDVAIYFSQEEWELLDESQRFLYCDVMLENFAHVTSLGYCHGTENEVIASEQSVSTQVRTSEGDTPTQKSLSEIKMCV

SEQ ID NO: 5208 - protein, 81 aa, Macaca mulatta
SPPSRRSSMAAVALRDPAQGMTFEDVAIYFSQEEWELLDESQRFLYCDVMLENFAHVTSLGYCHGTENEVIASEQSVSTQV

SEQ ID NO: 5209 - protein, 81 aa, Macaca mulatta
MAAVALRDPAQGTVTFEDVAVNFSQEEWSLLSEAQRCLYHDVMLENLALISSLGCWYGAKDEPPSKQTLSIQQESPLRTHW

SEQ ID NO: 5210 - protein, 81 aa, Macaca mulatta
MAAAALRAPAQGTVTFEDVAIHFSWEEWGLLDEAQRCLYRDVMLENLALLTSLDVHHRKQHLGEKHFRSNVGTALFVKTCT

SEQ ID NO: 5211 - protein, 81 aa, Macaca mulatta
PAAVRAHGPVAELTDSARGCVVFEDVFVYFSREEWELLDDAQRLLYHDVMLENFALLASLGIAFSRSCAVIKLEQAEEPWV

SEQ ID NO: 5212 - protein, 81 aa, Macaca mulatta
MAAAALRPTAQGTVTFEDVAVNFSQEEWSLLSEAQRCLYHDVMLENLALISSLGCWYGAKDEPPSKQTLSIQQESPLRTHW

SEQ ID NO: 5213 - protein, 81 aa, Macaca mulatta
MAAAAALRDPAQSSVTFEDVAVNFSLEEWSLLNEAQRCLYHDVMLETLTLISSLGCWHGGEDEAAPSKQSTCIHIYKDQGG

SEQ ID NO: 5214 - protein, 81 aa, Macaca mulatta
LREEEDQTGSYCPSRETQSSVTFEDVAVNFSLEEWSLLNEAQRCLYHDVMLETLTLISSLGCWHGGEDEAAPSKQSTCIHI

SEQ ID NO: 5215 - protein, 81 aa, Macaca mulatta
MRWGERQGTVTFEDVAVNFTQEEWNLLSEAQRCLYRDVMLENLALISSLGCWCGVEDEEGPSKQSIYKQRETQIRIPMAGV

SEQ ID NO: 5216 - protein, 81 aa, Macaca mulatta
MAAPALRFPVQGTVTFEDVAVNFTQEEWNLLSEAQRCLYRDVMLENLALISSLGCWCGVEDEEGPSKQSIYKQRETQIRIP

SEQ ID NO: 5217 - protein, 81 aa, Macaca mulatta
MAATAPRRLAQQDTVTFEDVAVNFSQEEWSLLSEVQRCLYRDVMLENLALISSLDCWCGSKDKEAPSTQSISVQRESQNRT

SEQ ID NO: 5218 - protein, 81 aa, Macaca mulatta
MAAAATLRLSAQGTVTFEDVAVKFTREEWNLLSEAQRCLYRDVTLENLALISSLGCWCGVEDEAPSKQSIYIQRETQVRIP

SEQ ID NO: 5219 - protein, 81 aa, Macaca mulatta
MAAAALRLPAQQGTVAFEDVAVNFSQEEWSLLSEVQRCLYHDVMLENWVLISSLGYWCGSEDEEAPSKRNILHLADHQGTH

SEQ ID NO: 5220 - protein, 81 aa, Macaca mulatta
HRMTWDCIALGNHENSVQGTVAFEDVAVNFSQEEWSLLSEVQRCLYHDVMLENWVLISSLGYWCGSEDEEAPSKRNILHLA

SEQ ID NO: 5221 - protein, 81 aa, Macaca mulatta
GTVAFEDVAVNFSQEEWSLLSEVQRCLYHDVMLENWVLISSLGYWCGSEDEEAPSKRNLHLSAQAEVSRSQLTAASASRVQ

SEQ ID NO: 5222 - protein, 81 aa, Macaca mulatta
MAAAELTAPAQGVVTFEDVAVYFSWKEWGLLDEAQKCLYHDVMLENLTLTTSLGGCGAGDEEAPYQQSTSSQRVSQVRLPK

SEQ ID NO: 5223 - protein, 81 aa, Macaca mulatta
GNLEEGRRATGLPAAQVQEPVTFKDVAVDFTQEEWGQLDLVQRTLYRDVMLETYGHLLSVGNQIAKPEVISLLEQGEEPWS

SEQ ID NO: 5224 - protein, 81 aa, Macaca mulatta
RRRSVGRRCSGLCLAVRREQVTFEDVVVDFSQEEWGQLKPAQRTLYRDVMLDTFRLLVSVGHWLPKPNVISLLEQEAEPRA

SEQ ID NO: 5225 - protein, 81 aa, Macaca mulatta
RFLWDSLWYCRGEDTEDHWEWSCESLESLAVPVAFTPVKTPVQEQWQRNGFGENVSLNPDLPHQPMTPEKQGPHMWGTRGK

SEQ ID NO: 5226 - protein, 81 aa, Macaca mulatta
MTPGLRVSTDPEQVTFEDVVVDFSQEEWGQLKPAQRTLYRDVMLDTFRLLVSVGHWLPKPNVISLLEQEAEPRAVDSRVPP

SEQ ID NO: 5227 - protein, 81 aa, Macaca mulatta
QEEKQEDAAICPVTVLSEEPVTFQDVAVDFSREEWGLLGPTQRTEYRDVMLETFGHLVSVGWETTLENKELAPNSDIPQEE

SEQ ID NO: 5228 - protein, 81 aa, Macaca mulatta
MASRLPTAWSCEPVNFEDVTLGFTPEEWGLLDLKQKSLYREVMLENYRNLVSVEHQLSKPDVVSQLEEAEDFWPVERGIPQ

SEQ ID NO: 5229 - protein, 81 aa, Macaca mulatta
MASRLPTAWSCEPVNFEDVTLGFTPEEWGLLDLKQKSLYREVMLENYRNLVSVEYSELQLDPKLDPLPAESPLMNIEVVEV

SEQ ID NO: 5230 - protein, 81 aa, Macaca mulatta
MLENYRNLVSVEHQLSKPDVVSQLEEAEDFWPVERGIPQDTIPEYSELQLDPKLDPLPAESPLMNIEVVEVLTLNQEVAGP

SEQ ID NO: 5231 - protein, 81 aa, Macaca mulatta
MEARSKLVPPQASVCFEDVAMAFTQEEWEQLDLAQRTLYREVTLETWEHIVSLGLFLSKSDVISQLEQEEDLCRAEQVVPR

SEQ ID NO: 5232 - protein, 81 aa, Macaca mulatta
EDVAMAFTQEEWEQLDLAQRTLYREVTLETWEHIVSLGLFLSKSDVISQLEQEEDLCRAEQVVPRDRVSLLLPRLECSGTI

SEQ ID NO: 5233 - protein, 81 aa, Macaca mulatta
EDVAMAFTQEEWEQLDLAQRTLYREVTLETWEHIVSLGLFLSKSDVISQLEQEEDLCRAEQVVPRGARSSKEQRGYRARRM

SEQ ID NO: 5234 - protein, 81 aa, Macaca mulatta
MSVGPPATRLQEPVTFRDVAVDFTQEEWGQLDPTQRILYRDVMLETFGHLLSIGPELPKPEVISQLEQGTELWVAERGTIQ

SEQ ID NO: 5235 - protein, 81 aa, Macaca mulatta
MAGEAEVQLDPSLQGLVMFEDVAVYFSREEWGLLNVTQKGLYRDVMLENFALVSSLGLAPSRSPVFSQLEKDEQLWVPSWV

SEQ ID NO: 5236 - protein, 81 aa, Macaca mulatta
MAGEAEGLVMFEDVAVYFSREEWGLLNVTQKGLYRDVMLENFALVSSLGLAPSRSPVFSQLEKDEQLWVPSWVDVTPVSRA

SEQ ID NO: 5237 - protein, 81 aa, Macaca mulatta
GPAQHTSWPCGSAVPALKSLVTFEDVAVYFSQEEWELLDAAQRHLYHSVMLENLELVTSLGCWHGVEGEEAHPKQNISVEE

SEQ ID NO: 5238 - protein, 81 aa, Macaca mulatta
PALKSLVTFEDVAVYFSQEEWELLDAAQRHLYHSVMLENLELVTSLGNTLSQHDVFTCSVGTDLSNYFPNWLHHFTSLSGV

SEQ ID NO: 5239 - protein, 81 aa, Macaca mulatta
MAFEDVAVYFSQEEWGLLDTAQRALYRHVMLENFTLVTSLGLSTSRPHVVIQLERGEEPWVPSGKDMTLARNTYRRLNAGS

SEQ ID NO: 5240 - protein, 81 aa, Macaca mulatta
MAFEDVAVYFSQEEWGLLDTAQRALYRRVMLDNFALVASLGLSTSRPRVVIQLERGEEPWVPSGTDTILSRNTYRRRNPGS

SEQ ID NO: 5241 - protein, 81 aa, Macaca mulatta
PLAVQSPEGHHGHQAAASTSFHPPRIQEEWGLLDRSQKELYWDTMLEKYGTVVSLGLPPHQPEAQAQSELGMLLMGTGVCR

SEQ ID NO: 5242 - protein, 81 aa, Macaca mulatta
EEAAQKRKEKEPGMALPQGHLTFRDVAIEFSLEEWKCLDPVQRALYRAVMLENYRNLHSVDISSKCVMKKFSSTGQGNTEV

SEQ ID NO: 5243 - protein, 81 aa, Macaca mulatta
MLQTVWFQGLSRNLLFQEPVTFEDVAVYFTQNEWASLHPMQRALYREVMLENYANVTSLYPTAGGFPLSTERTEKVPGALP

SEQ ID NO: 5244 - protein, 81 aa, Macaca mulatta
MLQTVWFQGLSRNLLFQEPVTFEDVAVYFTQNEWASLHPMQRALYREVMLENYANVTSLSAFPFSKPDLIFQLEQGEAAWG

SEQ ID NO: 5245 - protein, 81 aa, Macaca mulatta
MLQTAWRQEPVTFEDVAVYFTQNEWASLDSVQRALYREVMLENYANVASLAFPFTTPVLVSQLEQGELPWGLDPWEPMGRE

SEQ ID NO: 5246 - protein, 81 aa, Macaca mulatta
MLQATWPQESVTFEDVAVYFTQNQWASLDPAQRALYGEVMLENYANVASLVAFPFPKPALISHLERGEAPWGPDPWDTEIP

SEQ ID NO: 5247 - protein, 81 aa, Macaca mulatta
MLQATWPQESVTFEDVAVYFTQNQWASLDPAQRALYGEVMLENYANVASLAFPFPKPALISHLERGEAPWGPDPWDTEIPR

SEQ ID NO: 5248 - protein, 81 aa, Macaca mulatta
MMTAVSLTTRSQESVAFEDVAVYFTTKEWAIMVPAERALYRDVMLENYEAVAFVVPPTSKPALVSHLEQGKESCFIRPQGV

SEQ ID NO: 5249 - protein, 81 aa, Macaca mulatta
LGPDLELLQGQPAPPRARPESVTFEDVAVYFSENEWIGLGPAQRALYRDVMLENYGAVASLAFPFPKPALISQLERGEAPW

SEQ ID NO: 5250 - protein, 81 aa, Macaca mulatta
REGCPGDQVTPPRSLTAQLQTMTFKDVEVTFSQDEWGWLDSAQRNLYRDVMLENYRNMAFLVGPFTKPALISWLEAREPWG

SEQ ID NO: 5251 - protein, 81 aa, Macaca mulatta
DTPAAQMPALFQREGCPGDQTMTFKDVEVTFSQDEWGWLDSAQRNLYRDVMLENYRNMAFLVGPFTKPALISWLEAREPWG

SEQ ID NO: 5252 - protein, 81 aa, Macaca mulatta
FLAGQSDTPAAQMPALFQREGCPGDQVTPPRSLTAQLQTMTFKDVEVTFSQDEWGWLDSAQRNLYRDVMLENYRNMAFLGK

SEQ ID NO: 5253 - protein, 81 aa, Macaca mulatta
MVRPQDTVAYEDLCVDYTQKKWKCPALSQALQWNMIPENDHSMASLGRNMMESSELIPKQEIFKGSESSNSTSGGLFGVVP

SEQ ID NO: 5254 - protein, 81 aa, Macaca mulatta
GFSYNSSLMVHQRTHTGEKPYKCNSCEKAFSDSSQLTVHQRVHTGRNLMNVLSVGKPLVSVPLLITTSELTLERSPQVWLG

SEQ ID NO: 5255 - protein, 81 aa, Macaca mulatta
PVPTLPQVGNSGLRMVRPQDTVAYEDLSVGYTQKKWKCPALSQRALQWNMMPENDRSMASLAGENMMKGSELTPKQEIFKG

SEQ ID NO: 5256 - protein, 81 aa, Macaca mulatta
HHLPNGDFAQCASPVPTLPQVGNSGLRMVRPQDTVAYEDLSVGYTQKKWKCPALSQRALQWNMMPENDRSMASLGWSTMAR

SEQ ID NO: 5257 - protein, 81 aa, Macaca mulatta
VPTLPQVGNSGLRMVRPQDTVAYEDLSVGYTQKKWKCPALSQRALQWNMMPENDRSMASLGENMMKGSELTPKQEIFKGSE

SEQ ID NO: 5258 - protein, 81 aa, Macaca mulatta
QCASPVPTLPQVGNSGLRMVRPQDTVAYEDLSVGYTQKKWKCPALSQRALQWNMMPENDRSMASLDGETGTEAELIPKHHS

SEQ ID NO: 5259 - protein, 81 aa, Macaca mulatta
MTRENWAHNALRQEGLVKGKDDTWKWGTSFQGSSSSVWETSHLHFRQLRYHETSGPQEALSRLRELCRRWLRPEARTKAQI

SEQ ID NO: 5260 - protein, 81 aa, Macaca mulatta
EALPAKDSAWPWEGKPRYLGPVTFEDVAVLFTEAEWKRLNLEQRNLFKEVMLENLRNLVSLAESKPEVHTCPSCPLAFGML

SEQ ID NO: 5261 - protein, 81 aa, Macaca mulatta
ALPAKDSAWPWEGKPRYLGPVTFEDVAVLFTEAEWKRLNLEQRNLFKEVMLENLRNLVSLGLGSLRSGLLHLDMNMNLDLW

SEQ ID NO: 5262 - protein, 80 aa, Macaca mulatta
MWAPREQLLGSATEALPAKDSAWPWEGKPRYLGPVTFEDVAVLFTEAEWKRLNLEQRNLFKEVMLENLRNLVSLVLSYQI

SEQ ID NO: 5263 - protein, 81 aa, Macaca mulatta
EALPAKDSAWPWEGKPRYLGPVTFEDVAVLFTEAEWKRLNLEQRNLFKEVMLENLRNLVSLAESKPEVHTCPSCPLAFGSQ

SEQ ID NO: 5264 - protein, 81 aa, Macaca mulatta
ALPAKDSAWPWEGKPRYLGPVTFEDVAVLFTEAEWKRLNLEQRNLFKEVMLENLRNLVSLESKPEVHTCPSCPLAFGSQQF

SEQ ID NO: 5265 - protein, 81 aa, Macaca mulatta
REQLLGSATEALPAKDSAWPWEGKPRYLGPVTFEDVAVLFTEAEWKRLNLEQRNLFKEVMLENLRNLVSLELTIFQYRRHP

SEQ ID NO: 5266 - protein, 81 aa, Macaca mulatta
ALPAKDSAWPWEGKPRYLGPVTFEDVAVLFTEAEWKRLNLEQRNLFKEVMLENLRNLVSLGSRCHPGWRALAQSQLTAAST

SEQ ID NO: 5267 - protein, 81 aa, Macaca mulatta
MLVAAAAERNKEPILHVLRQYLDPTQRGVRVLEVASGSGQHAAHFARAFPLAEWQPSDVDQRCLDRNPEWGLRDTALLEDL

SEQ ID NO: 5268 - protein, 81 aa, Macaca mulatta
VLRQYLDPTQRGVRVLEVASGSGQHAAHFARAFPLAEWQPSDVDQRCLDRNPEWGLRDTALLEDLGQASGLLLERMVDMPA

SEQ ID NO: 5269 - protein, 81 aa, Macaca mulatta
EGRTRDRQMAAALLTAWSQMPVTFEDVALYLSREEWGRLDHTQQNFYRDVLQKRNGLSLGFPFSRPFWAPQALGKGEASGS

SEQ ID NO: 5270 - protein, 81 aa, Macaca mulatta
EGRTRDRQMAAALLTAWSQMPVTFEDVALYLSREEWGRLDHTQQNFYRDVLQKRNGLSLGKHSPGVGTGFPFSRPFWAPQA

SEQ ID NO: 5271 - protein, 81 aa, Macaca mulatta
EGRTRDRQMAAALLTAWSQMPVTFEDVALYLSREEWGRLDHTQQNFYRDVLQKRNGLSLGAIEVGQRMPTSSVAALGDVKP

SEQ ID NO: 5272 - protein, 81 aa, Macaca mulatta
LKEGRTRETTDTCFVSGVHGPVALGDIPFYFSREEWGTLDPAQRDLFWDIKRENSRNTTLGLGLKGQNEKSRLEEVVPVLP

SEQ ID NO: 5273 - protein, 81 aa, Macaca mulatta
SRNTTLGLGLKGQNEKSRLEEVVPVLPGQTGSDVTVSWSPEEAETWESENRPRAALGPVVGARRGRPPTRRRQFRDLAAEK

SEQ ID NO: 5274 - protein, 81 aa, Macaca mulatta
LFPPEGNMEDKEMTGPQLPESLEDVAMYISQEEWGHQDPSKRALSRDTVQESYENVDSLESHIPSQEVPGTQVGQGGKLWD

SEQ ID NO: 5275 - protein, 81 aa, Macaca mulatta
AVKERGNMEDKEMTGPQLPESLEDVAMYISQEEWGHQDPSKRALSRDTVQESYENVDSLESHIPSQEVPGTQVGQGGKLWD

SEQ ID NO: 5276 - protein, 81 aa, Macaca mulatta
MYFSQEEWELLDPTQKALYNDVMQENYETVISLALFVLPKPKVISCLEQGEEPWVQVSPEFQDSAGKSPTGLKLKNDTENH

SEQ ID NO: 5277 - protein, 81 aa, Macaca mulatta
TNTKDWTVTPEHVLPESQSLLTFEEVAMYFSQEEWELLDPTQKALYNDVMQENYETVISLGEKMQQSRTPSADKAAANVEN

SEQ ID NO: 5278 - protein, 81 aa, Macaca mulatta
TCDNRAVSLCQQEWMCPGPARKALYRGATQRKNRHISLATGVPWGYEETKTLLAILSSSQFYGKLQTCQQNSQIYRAMAQQ

SEQ ID NO: 5279 - protein, 81 aa, Macaca mulatta
QNTGLHDQETGAVVWTAGSQGPATCDNRAVSLCQQEWMCPGPARKALYRGATQRKNRHISLATGVPWGYEETKTLLAILSS

SEQ ID NO: 5280 - protein, 81 aa, Macaca mulatta
ENGEEAVALVEDVQRAPGQQGPATCDNRAVSLCQQEWMCPGPARKALYRGATQRKNRHISLATGVPWGYEETKTLLAILSS

SEQ ID NO: 5281 - protein, 81 aa, Macaca mulatta
MASMPPTPEAQGPILFEDLAVYFSQEECVTLHPAQMSLSRDATKECLEDAALMGEEGKPEINQQLSLESMELDELALEKYP

SEQ ID NO: 5282 - protein, 81 aa, Macaca mulatta
ERGPPAPRHQEIASASPFHSAWSQAPVNLEDVAVYLSGEEPGCLDPAQRDVPLENEGLGIQLEDGGDGREDAPVRMEWYRV

SEQ ID NO: 5283 - protein, 81 aa, Macaca mulatta
EAGSLHSVHQEQLNRKRERRPLPKNARPSPWVPALADEWNTLDQEVTTTRLPAGSQEPVKDVHVARGFSYKKSVHQIPAHR

SEQ ID NO: 5284 - protein, 81 aa, Macaca mulatta
NTLDQEVTTTRLPAGSQEPVKDVHVARGFSYKKSVHQIPAHRDLYQDFRKENVGNMVSLGSTASTSNKITRLEQRREPWTL

SEQ ID NO: 5285 - protein, 81 aa, Macaca mulatta
APLPSRDPNGAVPEWRKPRTVSFADVAVYFSREEWGCLRPAQRALYRDVMRETYGHLGALGVGGSKPALISWVEEEAELWD

SEQ ID NO: 5286 - protein, 81 aa, Macaca mulatta
LRPAQRALYRDVMRETYGHLGALGVGGSKPALISWVEEEAELWDPAARDPEVTKCPTETDPDSRNEEEERQREGMGALEKP

SEQ ID NO: 5287 - protein, 81 aa, Macaca mulatta
APLPSRDPNGAVPEWRKPRTVSFADVAVYFSREEWGCLRPAQRALYRDVMRETYGHLGALGESPTCSPGPCAPTRPAAPLG

SEQ ID NO: 5288 - protein, 81 aa, Macaca mulatta
APLPPRDPNGAGPEWREPGIVSFADVAVYFCREEWGCLRPAQRALYRDVMRETYGHLSALGIGGNKPALISWVEEEAELWG

SEQ ID NO: 5289 - protein, 81 aa, Macaca mulatta
LRPAQRALYRDVMRETYGHLSALGIGGNKPALISWVEEEAELWGPAARDPETKCPTETDPADSRNKEEERQREGMEALEKP

SEQ ID NO: 5290 - protein, 81 aa, Macaca mulatta
LRPAQRALYRDVMRETYGHLSALGIGGNKPALISWVEEEAELWGPAARDPETKCPTETDPDSRNKEEERQREGMEALEKPV

SEQ ID NO: 5291 - protein, 81 aa, Macaca mulatta
APLLARKPGETRPGCRKPGAVSFADVAVYFSPEEWGCLRPAQRALYRDVMRETYGHLGALGFPGPKPALISWMEQETEAWS

SEQ ID NO: 5292 - protein, 81 aa, Macaca mulatta
RAQGPGEARPSRKRGRRPRALKFVDVAVYFSPEEWGCLRPAQRALYRDVMRETYGHLGALGCAGPKPALISWLERNTDDWE

SEQ ID NO: 5293 - protein, 81 aa, Macaca mulatta
MLENYRNLVSLGLAVSKPDLITFLEQRKEPWNVKSEETVAIQPDMFSHDTQGLLRKKLIEASFQKVILDGYGSCGPQNLNL

SEQ ID NO: 5294 - protein, 81 aa, Macaca mulatta
MGLLTFRDVAIEFSQEEWEHLDSDQKLLYGDVMLENYRNLVSLGLAVSKPDLITFLEQRKEPWNVKSEETVAIQPDMFSHD

SEQ ID NO: 5295 - protein, 81 aa, Macaca mulatta
MGLLTFRDVAIEFSQEEWEHLDSDQKLLYGDVMLENYRNLVSLGLAVSKPDLITFLEQRKEPWNVKSEETVAIQPEVKVNT

SEQ ID NO: 5296 - protein, 81 aa, Macaca mulatta
NVPGRGSPEETVGQISTEGLLTFRDVAIEFSQEEWEHLDSDQKLLYGDVMLENYRNLVSLGLAVSKPDLITFLEQRKEPWN

SEQ ID NO: 5297 - protein, 81 aa, Macaca mulatta
VTEHLTGWAPAPVPSLEGLLTFRDVAIEFSQEEWEHLDSDQKLLYGDVMLENYRNLVSLGLAVSKPDLITFLEQRKEPWNV

SEQ ID NO: 5298 - protein, 81 aa, Macaca mulatta
MGLLTFRDVAVEFSLEEWEHLEPAQKTLYQDVMLENYRNLVSLGLLVSKPDLITFLEQRKEPWNVKREETVAVQPDVFSHY

SEQ ID NO: 5299 - protein, 81 aa, Macaca mulatta
MLENYRNLVSLGLLVSKPDLITFLEQRKEPWNVKREETVAVQPDVFSHYNKDLLTEQCTEASFQKVVSRRHGNCHLENLHL

SEQ ID NO: 5300 - protein, 81 aa, Macaca mulatta
MGPLTFMDVAIEFSLKEWQCLDTAQQNLYRDVMLENYRNLVFLGIAFSKPDLITYLEQGKEPWNMKRHETVAKPLVVCSYF

SEQ ID NO: 5301 - protein, 81 aa, Macaca mulatta
MAPRPPTATPQESVTFKDVSVDFTQEEWYHVDPAQRSLYRDVMLENYSHLVSLGYQVSKPEVIFKLEQGEEPWISEGEIQR

SEQ ID NO: 5302 - protein, 81 aa, Macaca mulatta
MAAIPLKTRHQEMVTFEDVAVHFTKTEWTGLSPAQRALYRSVMLENFGNLTALGYPVPKPALISLLEGGDMAWGLEAQDDA

SEQ ID NO: 5303 - protein, 81 aa, Macaca mulatta
MVTFEDVAVHFTKTEWTGLSPAQRALYRSVMLENFGNLTALGYPVPKPALISLLEGGDMAWGLEAQDDAPAERTKNICKGR

SEQ ID NO: 5304 - protein, 81 aa, Macaca mulatta
MVTFEDVAVHFTKTEWTGLSPAQRALYRSVMLENFGNLTALGYPVPKPALISLLEGGDMAWGLEAQDDAPAERTKNICKVI

SEQ ID NO: 5305 - protein, 81 aa, Macaca mulatta
MLENYGNVASLGFPLLKPAVISQLEGGGELGGPSPLAAGTGLWGLRTDIQTDNDLTKEMYEGKENVSFELQRDFSQETDFS

SEQ ID NO: 5306 - protein, 81 aa, Macaca mulatta
MLENYGNVASLGFPLLKPAVISQLEGGGELGGPSPLAAGTGLWGLRTDGVSLCRPNWSAMATWLSATSVSWVRAILLPQPP

SEQ ID NO: 5307 - protein, 81 aa, Macaca mulatta
MLENYGNVASLGFPLLKPAVISQLEGGVDIQTDNDLTKEMYEGKENVSFELQRDFSQETDFSEACLLEKQQEVYSTGNTKK

SEQ ID NO: 5308 - protein, 81 aa, Macaca mulatta
QLEGGVDIQTDNDLTKEMYEGKENVSFELQRDFSQETDFSEACLLEKQQEVYSTGNTKKEKSNSIDGTVKDETSPMEECFF

SEQ ID NO: 5309 - protein, 81 aa, Macaca mulatta
MHLTAWSQKLVTFEDVAVYFTQAEWDGLSPAQRTLYRDVMLENYGNVASLGFPLLKPAVISQLEGGGELGGPSPLAAGTGL

SEQ ID NO: 5310 - protein, 81 aa, Macaca mulatta
MNKSQGSVSFTDVTVDFTQEEWEQLDPSQRILYMDVMLENYSNLLSVEVWKADDQMERDHRNPDEQARQFLILKNQTPVEE

SEQ ID NO: 5311 - protein, 81 aa, Macaca mulatta
MDVMLENYSNLLSVEVWKADDQMERDHRNPDEQARQFLILKNQTPVEERGDLFGKALNLNTDFVSLRQVPYKYDLYEKTLK

SEQ ID NO: 5312 - protein, 81 aa, Macaca mulatta
EQTQAAGMVAGWLINCYQDSVTFDDVAVDFTQEEWTLLDPSQRDLYRDVMRENYENLASVGRDLFKPSVICWLEEEEELRA

SEQ ID NO: 5313 - protein, 81 aa, Macaca mulatta
MAAPDLAHGSHVSRDSVCLRGEQTQAAGMVAGWLINCYQDSVTFDDVAVDFTQEEWTLLDPSQRDLYRDVMRENYENLASV

SEQ ID NO: 5314 - protein, 81 aa, Macaca mulatta
MNTLQGPVSFKDVAVDFTQEEWQQLDPDEKITYRDVMLENYSHLVSVGYDITKPNVIIKLEQGEEPWIMEGEFPCQHSPAA

SEQ ID NO: 5315 - protein, 81 aa, Macaca mulatta
MLENYSNLVSVGYHIIKPDVISKLEQGEEPWIVEGEFLLQSYPDEVWQADDLIERIQEGENKPSRQTVFTETLIEEREYIS

SEQ ID NO: 5316 - protein, 81 aa, Macaca mulatta
EEEEEEEDEDDLLMAGSQGLVTFEDVAVYFSLEEWERLEADQRGLYQEVMQENYGILVSLGYPIPKPDLIFRLEQGEEPWV

SEQ ID NO: 5317 - protein, 81 aa, Macaca mulatta
MFPPARGKELLSFEDVAMYFTREEWGHLDWGQKDLYRDVMLENYRNMVLLGFQFPKPEVICQLENWDEQWILDLPRAGSRK

SEQ ID NO: 5318 - protein, 81 aa, Macaca mulatta
MELLSFEDVAMYFTREEWGHLDWGQKDLYRDVMLENYRNMVLLGFQFPKPEVICQLENWDEQWILDLPRAGSRKASGSACP

SEQ ID NO: 5319 - protein, 81 aa, Macaca mulatta
MFPPARGKELLSFEDVAMYFTREEWGHLDWGQKDLYRDVMLENYRNMVLLGSEARHRMKKLTPKQKFSEDLESYKISVVMQ

SEQ ID NO: 5320 - protein, 81 aa, Macaca mulatta
GEEAVAVVRALQRALDGTSPQGMATFEDMAVSLTWEEWERLDPARRDFCRESAQKDSGSTVPPSLESRAENKELIPMQEIL

SEQ ID NO: 5321 - protein, 81 aa, Macaca mulatta
SQELTASLLSTGSQKLVKIEEVADVAVSFILEEWGHLDQSQKSLYRDDRKENYGSITSMGYESRDNMELIVKQISDDAESH

SEQ ID NO: 5322 - protein, 81 aa, Macaca mulatta
LAGHLRLHSREKAHQCRECGEIFFQYVSLIEHQVLHMGQKNEKHGVCEEAYSWNLTVIEDKKIELQEQPYQCDICGKAFGY

SEQ ID NO: 5323 - protein, 81 aa, Macaca mulatta
DSQELTASLLSTGSQLVKIEEVADVAVSFILEEWGHLDQSQKSLYRDDRKENYGSITSMGYESRDNMELIVKQISDDAESH

SEQ ID NO: 5324 - protein, 81 aa, Macaca mulatta
CEGSPGDQAAALLTARYQEFVTFEDVAVHLTREEWGYLDPVQRDLYREVMLENYGNVVSLGILLRLPTTRIHSVNSCPALS

SEQ ID NO: 5325 - protein, 81 aa, Macaca mulatta
LAGAPPVPQVPALPCEGSPGDQAAALLTARYQEFVTFEDVAVHLTREEWGYLDPVQRDLYREVMLENYGNVVSLGIVGSWD

SEQ ID NO: 5326 - protein, 81 aa, Macaca mulatta
QVPALPCEGSPGDQAAALLTARYQSSQDVLFQEFVTFEDVAVHLTREEWGYLDPVQRDLYREVMLENYGNVVSLGIVGSWD

SEQ ID NO: 5327 - protein, 81 aa, Macaca mulatta
GPGLPTMNSRDQEMAAGFFTAGPQGLGPFKDMALAFPEEEWRHVTPAQIDCFGEYVEPQHCRVCPGGGSKEKEAKPPQEDL

SEQ ID NO: 5328 - protein, 81 aa, Macaca mulatta
GSPRDQGMASALFTADSQAMVKIEDMAVSLILEEWGCQNLARRNLSRDHRQENYGSTFPQGGENRNENEESTSKAETTEDL

SEQ ID NO: 5329 - protein, 81 aa, Macaca mulatta
DSLGDEMLAAALLKAKSQELVTFEDVAVYFIRKEWKRLEPAQRDLYRDVMLENYGNVFSLDWIHISLTMQKVMLAWFTGTL

SEQ ID NO: 5330 - protein, 81 aa, Macaca mulatta
VTFEDVAVYFIRKEWKRLEPAQRDLYRDVMLENYGNVFSLDWIHISLTMQKVMLAWFTGTLSVGKGLCSSELASVEPPDTF

SEQ ID NO: 5331 - protein, 81 aa, Macaca mulatta
MGPLTFRDVKIEFSLEEWQCLDTAQRNLYRDVMLENYRNLVFLGIAVSKPDLITWLEQGKEPWNMKRREMVDKTPVMCSHF

SEQ ID NO: 5332 - protein, 81 aa, Macaca mulatta
MLRIILGIISFTPGPLTFMDVAIEFSLEEWECLDSAQQSLYRHVMLENYRNLVFLGIAICKPDLISCLEQEKEPWDMKRPE

SEQ ID NO: 5333 - protein, 81 aa, Macaca mulatta
MGPLTFSDVAIEFSLEEWQCLDTSQQNLYRNVMLDNYRNLVFLGIAVSKPDLIICLEQGKEPCNMKRHAMVAKPPVVCSHF

SEQ ID NO: 5334 - protein, 81 aa, Macaca mulatta
GIGRSTAKTPGLPGSLEMGPLTFSDVAIEFSLEEWQCLDTSQQNLYRNVMLDNYRNLVFLGIAVSKPDLIICLEQGKEPCN

SEQ ID NO: 5335 - protein, 81 aa, Macaca mulatta
MEPLTFKDVAIEFSLEEWQCLDTAQRDLYRNVLLENYRNLVFLGIAVSKPYLITCLEQKKEPWNIKRHEMVARPPVMSFHF

SEQ ID NO: 5336 - protein, 81 aa, Macaca mulatta
MGPLTFRDVAIEFSLEEWQCLDTAQRNLYRKVMFENYRNLVFLGIAVSKPHLITCLEQGKEPWNRKRQEMVAKPPVIYSHF

SEQ ID NO: 5337 - protein, 81 aa, Macaca mulatta
MGVLTFRDVAIEFSPEEWECLDSAQQCLYRDVMLENYRNLVSLGLAIFKPDLMTCLEQRKEPWKVKRQEAVVKHPAGSFHF

SEQ ID NO: 5338 - protein, 81 aa, Macaca mulatta
MLENYRNLVSLGIAVSKPDLIACLEQNKEPRNIKRNEMVSKHPVTCSHFTQDLQPELGIKDSLQKVIPRIYGKCEHENLQV

SEQ ID NO: 5339 - protein, 81 aa, Macaca mulatta
MEEKEMNDGSQMVRSQESLTFQDVAVDFTKEEWDQLYPAQKNLYRDVMLENYRNLVALGYQLYKPEVIAQLELEEEWVIER

SEQ ID NO: 5340 - protein, 81 aa, Macaca mulatta
GNMEEKEMNDGSQMVRSQESLTFQDVAVDFTKEEWDQLYPAQKNLYRDVMLENYRNLVALGYQLYKPEVIAQLELEEEWVI

SEQ ID NO: 5341 - protein, 81 aa, Macaca mulatta
MAEPPRLPLTFEDVAIYFSEQEWQDLEAWQKELYKHVMRSNYETLVSLDDGLPKPELISWIEHGGEPFRNWRESQKSGNII

SEQ ID NO: 5342 - protein, 81 aa, Macaca mulatta
MAEPASVTVTFDDVALYFSEQEWEILEKWQKQMYKQEMKTNYQTLDSLGYAFSKPDLITWMEQGRMLFISEQGCLDKTRRT

SEQ ID NO: 5343 - protein, 81 aa, Macaca mulatta
QEMKTNYQTLDSLGYAFSKPDLITWMEQGRMLFISEQGCLDKTRRTTSPPTDEQLDMKDTGKLPCFDHEGTLRTKEEDCRL

SEQ ID NO: 5344 - protein, 81 aa, Macaca mulatta
ADGGCRCRNSGPCCSWSGVTVTFDDVALYFSEQEWEILEKWQKQMYKQEMKTNYQTLDSLGYAFSKPDLITWMEQGRMLFI

SEQ ID NO: 5345 - protein, 81 aa, Macaca mulatta
SLGYAFSKPDLITWMEQGRMLFISEQGCLDKTRRTTSPPTDEQLDMKDTGKLPCFDHEGTLRTKEEDCRLNGPQKQDLGAA

SEQ ID NO: 5346 - protein, 81 aa, Macaca mulatta
RNFWVLRLPPGSKGEAPKVPVTFVDIAVYFSEDEWKNLDEWQKELYNNLVKENYKTLMSLDAEGPVPKPDAPTQPEPREEP

SEQ ID NO: 5347 - protein, 81 aa, Macaca mulatta
ALCVRGQRGLEERAIPTESITDSPISAQDLLSRIKQEEHQCVWDQQDLADRDIPTDPNSESLISAHDILSWIKQEEQPYPW

SEQ ID NO: 5348 - protein, 81 aa, Macaca mulatta
PGGAHPAGGVMIKQELQYTQEGPADLPGEFSCIAEEQAFLSPEQTELWGGQGSSVLLETGPGDSTLQEPVGSRDPSSSRTV

SEQ ID NO: 5349 - protein, 81 aa, Macaca mulatta
NFWILRLPPGSKGEAPKVSRSLENDGVCFTEQEWENLEDWQKELYRNVMESNYETLVSLSSSDSPASASQVAEITEVLGQT

SEQ ID NO: 5350 - protein, 81 aa, Macaca mulatta
LEEEGPGGAHPAGGVMIKQELQYTQEGPADLPGEFSCIAEEQAFLSPEQTELWGGQGSSVLLETGPGDSTLQEPVGSRDPS

SEQ ID NO: 5351 - protein, 81 aa, Macaca mulatta
KKLADCEKTAVEFGNQLEGKWAVLGTLLQEYGLLQRRLENVENLLRNRNFWILRLPPGSKGESPKVPVTFDDVAVYFSELE

SEQ ID NO: 5352 - protein, 81 aa, Macaca mulatta
RNFWILRLPPGSKGESPKVPVTFDDVAVYFSELEWGKLEDWQKELYKHVMRGNYETLVSLDYAISKPDILTRIERGEEPCL

SEQ ID NO: 5353 - protein, 81 aa, Macaca mulatta
RNFWILRLPPGSKGESPKVPVTFDDVAVYFSEQEWGKLEDWQKELYKHVMRGNYETLVSLDYAISKPEVLSQIEQGKEPCH

SEQ ID NO: 5354 - protein, 81 aa, Macaca mulatta
LENVENLLRNRNFWILRLPPGSKGESPKEWGKLEDWQKELYKHVMRGNYETLVSLDYAISKPEVLSQIEQGKEPCHWRRPG

SEQ ID NO: 5355 - protein, 81 aa, Macaca mulatta
MARQVSITFKDLAVRFSEEEWRLLEEGQREFYRDVMRENYETLVSVGTAELLPLSAFLSPSESGGAVVGGSHADEGQEPAG

SEQ ID NO: 5356 - protein, 81 aa, Macaca mulatta
MRENYETLVSVGTAELLPLSAFLSPSESGGAVVGGSHADEGQEPAGGGGPQWGQPRHSLHLTALVQLVKEIPEFLFGEVKG

SEQ ID NO: 5357 - protein, 81 aa, Macaca mulatta
MEPRESGKAPVTFDDITVYLLQEEWVLLSQQQKELCGSDKLVAPLGPTVANPELFCKFGPGPEPWLGSVQGQRSHLEHHPG

SEQ ID NO: 5358 - protein, 81 aa, Macaca mulatta
QDPSAEGLSEEVPVVFEELPVVFEDVAVYFTRKEWGMLDKRQKELYRDVMRMNYELLASLGPAAAKPDLISKLERRAAPWI

SEQ ID NO: 5359 - protein, 81 aa, Macaca mulatta
EQLKPIEPRDCWREAWVKKKPVTFEDVAVNFTQEEWDCLDASQRVLYQDVMSEIFKNLASVARIFLHKPELITKLEQEEEQ

SEQ ID NO: 5360 - protein, 81 aa, Macaca mulatta
MAAGEPRSLLFFQKPVTFEDVAVNFTQEEWDCLDASQRVLYQDVMSEIFKNLASVARIFLHKPELITKLEQEEEQWRETQV

SEQ ID NO: 5361 - protein, 81 aa, Macaca mulatta
ATLQEAMKRDCWREAWVKKKPVTFEDVAVNFTQEEWDCLDASQRVLYQDVMSEIFKNLASVARIFLHKPELITKLEQEEEQ

SEQ ID NO: 5362 - protein, 81 aa, Macaca mulatta
GSQGNLLQADITLMSQAQESVTFEDVAVNFTNREWQSLTYAQRHLYKHVMLENYGNMLSLGFPFPKPPLISHLERGVEPCV

SEQ ID NO: 5363 - protein, 81 aa, Macaca mulatta
GGCCREDTVVASRLTPESQGLLKVEDVALTVTPEWTQQDSSQGNLCRDEKQENHGSLVSLGGEKQTKGRDLPPAEKLQEKE

SEQ ID NO: 5364 - protein, 81 aa, Macaca mulatta
GGCCREDTVVASRLTPESQGLLKVEDVALTVTPEWTQQDSSQGNLCRDEKQENHGSLVSLEMGFHHVDQAGFELLTSSDLP

SEQ ID NO: 5365 - protein, 81 aa, Macaca mulatta
GGCCREDAMVASRLTPGSQGLLKMEDVALTLSPGWTQLDSSQVNIYRDEKQENHSSLVSLGGEKQTESRDLPPVKKLSKKE

SEQ ID NO: 5366 - protein, 81 aa, Macaca mulatta
MNLWDPSPYKTEGLLKMEDVALTLSPGWTQLDSSQVNIYRDEKQENHSSLVSLGGEKQTESRDLPPVKKLSKKEHGKICHL

SEQ ID NO: 5367 - protein, 81 aa, Macaca mulatta
GSSGDQEMTATLLTAGFQTLEKIEDMAVSLIREEWLLDPSQKDLSRDNRPENFRNVFSLGGETRNENRELASKQVISTGIQ

SEQ ID NO: 5368 - protein, 81 aa, Macaca mulatta
DSTLHQGGHNLLSSASFQESVTFKDVIVDFTQEEWKQLDPGQRDLFRDVTLENYTHLVSIGLQDSKPDVISQLEQGTEPWI

SEQ ID NO: 5369 - protein, 81 aa, Macaca mulatta
MELLTFRDVAIEFSPEEWKCLDPAQQNLYKDVMLENYRNLVSLAMCSPFSQDLSPVQGIEDSFQKLVLRKYEKCGYENLQL

SEQ ID NO: 5370 - protein, 81 aa, Macaca mulatta
MELLTFRDVAIEFSPEEWKCLDPAQQNLYKDVMLENYRNLVSLGFVISNPDLVTCLEQIKEPYNLKIHETAAKPPAMCSPF

SEQ ID NO: 5371 - protein, 81 aa, Macaca mulatta
MEHLTFRDVAIEFSPEEWKCLDPAQQNLYRDVMLENYRNLVSLGVAISNPDLVTFLEQRKEPYNVKIHETVAKHPGNWKHQ

SEQ ID NO: 5372 - protein, 81 aa, Macaca mulatta
MELLTFRDVAIEFSPEEWKCLDPAQQNLYRDVMLENYRNLVSLGVAISNPDLVTCLEQRKEPYNVKIRKIVARPPAVRSHF

SEQ ID NO: 5373 - protein, 81 aa, Macaca mulatta
MEPLTFRDVAIEFSPEEWKCLDPAQQNLYRDVMLENYRNLVSLAVCSYFTQDFLPVQGIEDSFHKCILRRYEKCGHENLQL

SEQ ID NO: 5374 - protein, 81 aa, Macaca mulatta
SQEESPEEDTERTERKPTVKDAFKDISIYFTKEEWAEMGDWEKTRYRNVKRNYNALITIGLRATRPAFMCHRRQAIKLQVD

SEQ ID NO: 5375 - protein, 81 aa, Macaca mulatta
YNALITIGLRATRPAFMCHRRQAIKLQVDDTEDSDEEWTPRQQELRRKETEGKMYSLRERKGHAYKEVSEPQDDDYLYCEM

SEQ ID NO: 5376 - protein, 81 aa, Macaca mulatta
PAGALFGNPAPPPPRVSVDSVAFEDVAVNFTHEKWVLPNSSQKILYREVMQETCRNLASVGNKWKDQNIENHFEKPGKDIR

SEQ ID NO: 5377 - protein, 81 aa, Macaca mulatta
MMKSQGLVSFKDVAVDFTQEEWQQLDPAQRTLYRDVMLENYSHLVSMGYPVSKPDVISKLEQGEEPWIIKRDISNWIYPDE

SEQ ID NO: 5378 - protein, 81 aa, Macaca mulatta
MLENYSHLVSMGYPVSKPDVISKLEQGEEPWIIKRDISNWIYPDEYQADGRQDRKSNLHNSQSCILGTVSFHHKILKGVTK

SEQ ID NO: 5379 - protein, 81 aa, Macaca mulatta
ADPSSSGLLEKQKMMKSQGLVSFKDVAVDFTQEEWQQLDPAQRTLYRDVMLENYSHLVSMGYPVSKPDVISKLEQGEEPWI

SEQ ID NO: 5380 - protein, 81 aa, Macaca mulatta
MAAGRREARPQVSLTFEDVAVLFTRDEWRKLVPSQRNLYRDVMLENYRNLVALGLPFTKPKVISLLQQGEDPWKVEKDSSG

SEQ ID NO: 5381 - protein, 81 aa, Macaca mulatta
MAAGRREARPQVSLTFEDVAVLFTRDEWRKLVPSQRNLYRDVMLENYRNLVSLGLPFTKPKVISLLQQGEDPWKVEKDSSG

SEQ ID NO: 5382 - protein, 81 aa, Macaca mulatta
MAVSHLPTMDQESVTFKDVAVLFTQEEWGQLSPAQRALYRDVMLENYSNLVSLGLLGPKPDMFSQLEKREVWMPEDTPGGF

SEQ ID NO: 5383 - protein, 81 aa, Macaca mulatta
MARRLLPAQVQESVTFRDVAVFFSQDEWLHLGSAQRALYREVMLENYSSLVSLGILFSKPKVISQLEQGEDPWMVESGVPQ

SEQ ID NO: 5384 - protein, 81 aa, Macaca mulatta
MAVDLLPAQESVTFRDVAVFFSQDEWLHLDSAQRALYREVMLENYSSLVSLGIPFSMPKLIHQLQQGEDPCLEEREVPSDT

SEQ ID NO: 5385 - protein, 81 aa, Macaca mulatta
QWGNELKNSMSSFRPGRGHNDGRRTVFYTNEEWELLDPTPKDLEESVVQEEKKKLTPEGNKGVTGSGFPFDFGRNPYKGKR

SEQ ID NO: 5386 - protein, 81 aa, Macaca mulatta
SGDPSSEGTSGSGSISIRKLGSEMQLQIQSQQEELERLKKDLCSQKELVRLLQQTVRSSQYDKYFTSSRLCEGVPKDTLEL

SEQ ID NO: 5387 - protein, 81 aa, Macaca mulatta
MPSLDSMTFEDIVVDFTREEWALLDTSQRKLFQDVMLENISHLVSIGKRLCKSVVLSHLQHVEKLSTQGMSLLQGREGDIK

SEQ ID NO: 5388 - protein, 81 aa, Macaca mulatta
DFTREEWALLDTSQRKLFQDVMLENISHLVSIGKRLCKSVVLSHLQHVEKLSTQGMSLLQGREGDIKHQEIPFIQHTYQKG

SEQ ID NO: 5389 - protein, 81 aa, Macaca mulatta
FTREEWALLDTSQRKLFQDVMLENISHLVSIGKRLCKSVVLSHLQHVEKLSTQGMSLLQGREGDIKHQEIPFIQHTYQKGT

SEQ ID NO: 5390 - protein, 81 aa, Macaca mulatta
MPSLDSMTFEDIVVDFTREEWALLDTSQRKLFQDVMLENISHLVSIGREGDIKHQEIPFIQHTYQKGTSTISTMRSHTQED

SEQ ID NO: 5391 - protein, 81 aa, Macaca mulatta
MQPQESLTFEDIAVDFTQEEGALLNTSQKKLYKDVMLEITSHLVSIGGESALESQMTSTHHVSRRGTTVIILMEISFLRGS

SEQ ID NO: 5392 - protein, 81 aa, Macaca mulatta
MQPQESLTFEDIAVDFTQEEGALLNTSQKKLYKDVMLEITSHLVSIGYPLHKLGVIFQPEQGKELWKERTFFQDLRTSGES

SEQ ID NO: 5393 - protein, 81 aa, Macaca mulatta
MQPQESLTFEDIAVDFTQEEGALLNTSQKKLYKDVMLEITSHLVSIGGESALESQMTSTHHVSRRGTTVIILMAKLPSFQL

SEQ ID NO: 5394 - protein, 81 aa, Macaca mulatta
KTLGEESLAACLWELPWKKKVTFEDVAIDFTQEEWAMMDTSKRKLYRDVILENVSHLVSLGYQISKSYITLQLEQGKELWR

SEQ ID NO: 5395 - protein, 81 aa, Macaca mulatta
MDMAQEPVTFRDVAIYFSREEWACLEPSQRALYRDVMLDNFSSMAALGFCSPRPDLVSRLEQWEEPWVEDRERPELQAVQR

SEQ ID NO: 5396 - protein, 81 aa, Macaca mulatta
MDMAQEPVTFRDVAIYFSREEWACLEPSQRALYRDVMLDNFSSMAALAPDQTSSLAWNSGRSRGLKIGRDLSSRQCRGATG

SEQ ID NO: 5397 - protein, 81 aa, Macaca mulatta
MSATVQLPGHQEMPLTFQDVAVYFSQAEGQQLGPQQRALYRDVMLENYGNVASLGFPVPKPELISQLEQGKELWVLNLLGA

SEQ ID NO: 5398 - protein, 81 aa, Macaca mulatta
VMLENYGNVASLGFPVPKPELISQLEQGKELWVLNLLGAEEPEILKSCQKETGFHHVAQASLKLLRSNDPCRPPRVLRLQA

SEQ ID NO: 5399 - protein, 81 aa, Macaca mulatta
AAHAHRMSATVQLPGHQEMPLTFQDVAVYFSQAEGQQLGPQQRALYRDVMLENYGNVASLGFPVPKPELISQLEQGKELWV

SEQ ID NO: 5400 - protein, 81 aa, Macaca mulatta
RKPSPAMAAWFLSAPPQAEVTFEDVAVFLSREEWGRLGPAQRGLYRDVMLETYGNLVSLGVGPAGPKPGVISQLERGDEPW

SEQ ID NO: 5401 - protein, 81 aa, Macaca mulatta
MAAWFLSAPPQAEVTFEDVAVFLSREEWGRLGPAQRGLYRDVMLETYGNLVSLGVGPAGPKPGVISQLERGDEPWVLDVQG

SEQ ID NO: 5402 - protein, 81 aa, Macaca mulatta
MAAWFLSAPPQAEVTFEDVAVFLSREEWGRLGPAQRGLYRDVMLETYGNLVSLALGTRTEYKELTSRETFGKEELGQLRGI

SEQ ID NO: 5403 - protein, 81 aa, Macaca mulatta
LRKPSPAMAAWFLSAPPQAEVTFEDVAVFLSREEWGRLGPAQRGLYRDVMLETYGNLVSLALGTRTEYKELTSRETFGKEE

SEQ ID NO: 5404 - protein, 81 aa, Macaca mulatta
MTMALPMPGPQEAVVFEDVAVYFTRIEWSCLAPDQQALYRDVMLENYGNLASLGFLVAKPALISLLEQGEEPGALILQVAE

SEQ ID NO: 5405 - protein, 81 aa, Macaca mulatta
MTMALPMPGPQEAVVFEDVAVYFTRIEWSCLAPDQQALYRDVMLENYGNLASLALISLLEQGEEPGALILQVAEQSVAKAS

SEQ ID NO: 5406 - protein, 81 aa, Macaca mulatta
ENYGNLASLALISLLEQGEEPGALILQVAEQSVAKASLCTDSRMEAGIVESPLQRKLSRQAGLPGTVWGRLPGGHPAPPHP

SEQ ID NO: 5407 - protein, 81 aa, Macaca mulatta
MTMALPMPGPQEAVVFEDVAVYFTRIEWSCLAPDQQALYRDVMLENYGNLASLDSRSETFLRGNWRLPKEPLSAFCWAATA

SEQ ID NO: 5408 - protein, 81 aa, Macaca mulatta
MGFLGCWCMSFQEVVTFGDVAVHFSREEWQCLDPGQRALYREVMLENHSSVAGLAGFLVFKPELISRLEQGEEPWVLDLQG

SEQ ID NO: 5409 - protein, 81 aa, Macaca mulatta
MEVVTFGDVAVHFSREEWQCLDPGQRALYREVMLENHSSVAGLAFSDTLWVGYLCPYFPRDGNLWAWPSRGAAAFPGFLVF

SEQ ID NO: 5410 - protein, 81 aa, Macaca mulatta
AAARLLPVPAGPQPLSFAKLTFEDVAVLLSQDEWDRLCPAQRGLYRNVMMETYGNVVSLGLPGSKPDIISQLERGEDPWVL

SEQ ID NO: 5411 - protein, 81 aa, Macaca mulatta
MGSVSFRDVTVGFTQEEWQHLDPAQRTLYRDVMLENYSHLVSVGYCIPKPEVILKLEKGEEPWILEEKFPSQRHLELINTS

SEQ ID NO: 5412 - protein, 81 aa, Macaca mulatta
MLENYSHLVSVGYCIPKPEVILKLEKGEEPWILEEKFPSQRHLELINTSRNYSRMKFNEFNKGGKCLCDEKHEIIHSEEEP

SEQ ID NO: 5413 - protein, 81 aa, Macaca mulatta
MITSQGSVSFRDVTVGFTQEEWQHLDPAQRTLYRDVMLENYSHLVSVGYCIPKPEVILKLEKGEEPWILEEKFPSQRHLEL

SEQ ID NO: 5414 - protein, 81 aa, Macaca mulatta
HLDPSQRALYRDVMLENYSNLVSVGYCVHKPEVISRLEQGEEPWRLEEEFPSQSFPEVWTADHLKERSQENQSKHLWEVVF

SEQ ID NO: 5415 - protein, 81 aa, Macaca mulatta
MNKVEQKFQGSISFKDVTVGFTQEEWQHLDPSQRALYRDVMLENYSNLVSVGYCVHKPEVISRLEQGEEPWRLEEEFPSQS

SEQ ID NO: 5416 - protein, 81 aa, Macaca mulatta
TANATRESEVEQKFQGSISFKDVTVGFTQEEWQHLDPSQRALYRDVMLENYSNLVSVGYCVHKPEVISRLEQGEEPWRLEE

SEQ ID NO: 5417 - protein, 81 aa, Macaca mulatta
SYWMSSPMYSTDVEQKFQGSISFKDVTVGFTQEEWQHLDPSQRALYRDVMLENYSNLVSVGYCVHKPEVISRLEQGEEPWR

SEQ ID NO: 5418 - protein, 81 aa, Macaca mulatta
MNKFQGPVTLKDVIVEFTKEEWKLLTPAQRTLYKDVMLENYSHLVSVGYHVNKPNAVFKLKQGREPWILEVEYPHRGFPED

SEQ ID NO: 5419 - protein, 81 aa, Macaca mulatta
MKKSYGSLSFEDVTVGFTQEEWQHLDPAQRTLYRDVMIENYSHLVSVGYCIPKQEVIFKLEQGEQPWILEEELPGQRYPDE

SEQ ID NO: 5420 - protein, 81 aa, Macaca mulatta
MNKSQEQVSFKDVCVDFTQEEWYLLDPAQKILYRDVILENYSNLVSVGYCITKPEVVFKIEQGEEPWILEKGFPSQCHPER

SEQ ID NO: 5421 - protein, 81 aa, Macaca mulatta
MLENYSNLVSVGYCVYKPEVIFRLEQGEEPWRLEEEFPSQSFPEVWTADHLKERSQENLSKHLWEIVFINDEMLTKEQGNV

SEQ ID NO: 5422 - protein, 81 aa, Macaca mulatta
MNKVEQKFQGSVSFEDVTVGFSQEEWQHLDLSQRALYRDVMLENYSNLVSVGYCVYKPEVIFRLEQGEEPWRLEEEFPSQS

SEQ ID NO: 5423 - protein, 81 aa, Macaca mulatta
MTLKDVIVEFTKEEWKLLTFAQRTLYKDVMLENYGHLVSVGYHVNKPNAVFKLKQGKEPWILEVEFPHRVLPCELEEIISH

SEQ ID NO: 5424 - protein, 81 aa, Macaca mulatta
MQYVMLLLHKPSHLTQRELCSSCQRGVAASGPCPEDPVQRCDAGELQPPPLYRDVMLENYSLLLSVGYCITKPVVICKLEH

SEQ ID NO: 5425 - protein, 81 aa, Macaca mulatta
LCSSCQRGVAASGPCPEDPVQRCDAGELQPPPLYRDVMLENYSLLLSVGYCITKPVVICKLEHGEVLWILEEESPSQSHLD

SEQ ID NO: 5426 - protein, 81 aa, Macaca mulatta
VMLENYSLLLSVGYCITKPVVICKLEHGEVLWILEEESPSQSHLDCCIDDNLLEKRQENQDQHLQKVDFFSNKTLTMDRNG

SEQ ID NO: 5427 - protein, 81 aa, Macaca mulatta
MAPRAQIQGLLTFGDVAVAFTRIEWRHLDAAQRALYRDVMLENYGNLVSVGLLSSKPKLITQLEEGAEPWMEVREAPSGTR

SEQ ID NO: 5428 - protein, 81 aa, Macaca mulatta
RDVMLENYGNLVSVGLLSSKPKLITQLEEGAEPWMEVREAPSGTRAVQDYWFETKMSALKQSTSAGSVVGERRKSVMMEKG

SEQ ID NO: 5429 - protein, 81 aa, Macaca mulatta
MAPRAQIQGLLTFGDVAVAFTRIEWRHLDAAQRALYRDVMLENYGNLVSVVQDYWFETKMSALKQSTSAGSVVGERRKSVM

SEQ ID NO: 5430 - protein, 81 aa, Macaca mulatta
TLLNRMGVPRDRMPAVTLRKDSMAFEDVAVNFTQEEWALVDSSQKNLCREVMQETCRNLASVEIMWYRDCVKAKKVDSMDK

SEQ ID NO: 5431 - protein, 81 aa, Macaca mulatta
MHSLNKVTFEDVAIDFTQEEWAMMDTSKRKLSRDVMLENVSHLVSLGESLNIHIRYRISKSYITLQLEQGKELWREGREFL

SEQ ID NO: 5432 - protein, 81 aa, Macaca mulatta
MRLLTFRDVAIEFSVEEWQCLDTAQQDLYRNVMLENYRNLVSLGIAVSKPELITCLEERKEPWNVKRHETVAKHPAMYSQY

SEQ ID NO: 5433 - protein, 81 aa, Macaca mulatta
MAMSQESLTFKDVFVDFTLEEWQQLDSAQKNLYRDVMLENYSHLVSVGYLVAKPDVIFRLGPGEESWMADGGTPVRTCADV

SEQ ID NO: 5434 - protein, 81 aa, Macaca mulatta
MAMSQESLTFKDVFVDFTLEEWQQLDSAQKNLYRDVMLENYSHLVSVGYLVAKPDVIFRLGPGEESWMADGGTPVRTCAGK

SEQ ID NO: 5435 - protein, 81 aa, Macaca mulatta
SPQGFPALIPGEPGRSFEGSVSFEDVAVDFTRQEWHRLDPAQRTMHKDVMLETYSNLASVGLCVAKPEMIFKLERGEELWI

SEQ ID NO: 5436 - protein, 81 aa, Macaca mulatta
SPPWYPVVAAEGRGSSCEASVSFEDVTVDFSREEWQHLDPAQRRLYWDVTLENYSHLLSVGYQVPKSEAAFKLEQGEGPWT

SEQ ID NO: 5437 - protein, 81 aa, Macaca mulatta
RSWLQRDVAAHVRIVSLQASVSFEDVTVDFSREEWQHLDPAQRRLYWDVTLENYSHLLSVGYQVPKSEAAFKLEQGEGPWT

SEQ ID NO: 5438 - protein, 81 aa, Macaca mulatta
AGEAPHQSCSGEAIEKMQQQGIPGEIFFHCERFDQPIGEDSLCSILEALWQDNDQLERCQENQNNLLSHVKVLIKERGYER

SEQ ID NO: 5439 - protein, 81 aa, Macaca mulatta
MAKPQGLVTFEDVAVDFTQEEWQYLNPPQRTLYRDVMLETYSNLVFVGQQVTKPNLILKLEVEEYPAEGKIPFWNFPEVCQ

SEQ ID NO: 5440 - protein, 81 aa, Macaca mulatta
SGEASGSFYSWQKAKREQGLVTFEDVAVDFTQEEWQYLNPPQRTLYRDVMLETYSNLVFVGQQVTKPNLILKLEVEEYPAE

SEQ ID NO: 5441 - protein, 81 aa, Macaca mulatta
MAKPQGLVTFEDVAVDFTQEEWQYLNPPQRTLYRDVMLETYSNLVFVGQQVTKPNLILKLEVEEYPAEGKIPFWNFPETES

SEQ ID NO: 5442 - protein, 81 aa, Macaca mulatta
MIESQEPVTFEDVAVDFTKEEWQQLNPAQKTLHRDVMLETYSHLVSVGCSGIKPDVIFKLEHGKDPWIIESELSRWIYSGI

SEQ ID NO: 5443 - protein, 81 aa, Macaca mulatta
MIESQEPVTFEDVAVDFTKEEWQQLNPAQKTLHRDVMLETYSHLVSVGCSGIKPDVIFKLEHGKDPWIIESELSRWIYSDR

SEQ ID NO: 5444 - protein, 80 aa, Macaca mulatta
MIESQEPVTFEDVAVDFTKEEWQQLNPAQKTLHRDVMLETYSHLVSVGCSGIKPDVIFKLEHGKDPWIIESELSRWIYSE

SEQ ID NO: 5445 - protein, 81 aa, Macaca mulatta
MIESQEEWQQLNPAQKTLHRDVMLETYSHLVSVGCSGIKPDVIFKLEHGKDPWIIESELSRWIYSDRVKGLESSQQIISGE

SEQ ID NO: 5446 - protein, 81 aa, Macaca mulatta
NRDNAFAKRPRDDAKTSEKRSKAFDDIAKYFSKKEWEKMKYSEKISCVHMKRKYEAMTKLGFNVTLPPFMRNKQATDFQGN

SEQ ID NO: 5447 - protein, 81 aa, Macaca mulatta
SDDAFARRPNVGAQIPEKIQKAFDDIAKCFSKKEWEKMKYSQKIIYVYMKRKYEAMTKLGFRVTLPPFMHNKRATDFQRND

SEQ ID NO: 5448 - protein, 81 aa, Macaca mulatta
APGAMNGDDAFARRPRVGAQIPEKIQKAFDDIAKYFPKKEWEKMKTSEKIIYVYKKRKYEAMNKLGFKATLPPFMRNKWAT

SEQ ID NO: 5449 - protein, 81 aa, Macaca mulatta
MNGDDAFARRPRVGAQIPEKIQKAFDDIAKYFPKKEWEKMKTSEKIIYVYKKRKYEAMNKLGFKATLPPFMRNKWATDFQG

SEQ ID NO: 5450 - protein, 81 aa, Macaca mulatta
GDNTFARRPRDDAQISEKIQKAFDDIAQYFSKKEWEKMKASEKIIYVYMKINYEVMTKLGFKVTLPPFMCSKRAADFHRND

SEQ ID NO: 5451 - protein, 81 aa, Macaca mulatta
MNGDDAFARRPRVGAQIPEKIQKAFDDIAKYFSKKEWERMKVSEKIVYVYKKRKYEAMSKLGFKVTLPPFMRNKRATDFQG

SEQ ID NO: 5452 - protein, 81 aa, Macaca mulatta
KRTKDKMASKLILPESPSLLTFEDVAVYFSEEEWQLLDPPEKTLYNDVMQDIYETVISLGLKLKNDIGNDHPISVSTSEIQ

SEQ ID NO: 5453 - protein, 81 aa, Macaca mulatta
ALVLVEFLQREPDGTKNESLLTFEDVAVYFSEEEWQLLDPPEKTLYNDVMQDIYETVISLGLKLKNDIGNDHPISVSTSEI

SEQ ID NO: 5454 - protein, 81 aa, Macaca mulatta
KNSWAGTLTKKPSLYMKESLLTFEDVAVYFSEEEWQLLDPPEKTLYNDVMQDIYETVISLGLKLKNDIGNDHPISVSTSEI

SEQ ID NO: 5455 - protein, 81 aa, Macaca mulatta
QLLCALGMAAILLTTRPKVPVSFEDVSVYFTKTEWKLLDLRQKVLYKRVMLENYSHLVSLGFSFSKPHLISQLERGEGPWV

SEQ ID NO: 5456 - protein, 81 aa, Callithrix jacchus
MAKRPGPPGSPEMGLLTFRDVAVEFSLEEWQCLNHAQQNLYRDVMFENYRNLVTLGIAVSKPELITCLEGNKESWNIKRNE

SEQ ID NO: 5457 - protein, 81 aa, Callithrix jacchus
MGLLTFRDVAVEFSLEEWQCLNHAQQNLYRDVMFENYRNLVTLGIAVSKPELITCLEGNKESWNIKRNEMVAKHPVTYSYL

SEQ ID NO: 5458 - protein, 81 aa, Callithrix jacchus
GLLTFRDVAVEFSLEEWQCLNHAQQNLYRDVMFENYRNLVTLGIAVSKPELITCLEGNKESWNIKRNEMVAKHPVTYSYLT

SEQ ID NO: 5459 - protein, 81 aa, Callithrix jacchus
MTKSLESVSFKDVTVDFSRDEWQRLNIAQKSLYRDVMLENYFNLISVGCQVPKPEVIFNLEQEEPCMLNGGISSQSCPDGK

SEQ ID NO: 5460 - protein, 81 aa, Callithrix jacchus
MSVVSHPESVSFKDVTVDFSRDEWQRLNIAQKSLYRDVMLENYFNLISVGCQVPKPEVIFNLEQEEPCMLNGGISSQSCPD

SEQ ID NO: 5461 - protein, 81 aa, Callithrix jacchus
PLRFSTLFEEQQKMNISQESVSFKDVTIEFTQEEWQQMAPVQRNLYRDVMLENYSHLVSVGYCLFKPEVIFKLEQGAEPWF

SEQ ID NO: 5462 - protein, 81 aa, Callithrix jacchus
NLYRDVMLENYSHLVSVGYCLFKPEVIFKLEQGAEPWFSEEEFSNKSHPKDYRGDDLIKQNTNIKDKHLQQVENWHRGETS

SEQ ID NO: 5463 - protein, 81 aa, Callithrix jacchus
QMAPVQRNLYRDVMLENYSHLVSVGYCLFKPEVIFKLEQGAEPWFSEEEFSNKSHPSELLSSSKQSSAGVVRLQVTLEVNT

SEQ ID NO: 5464 - protein, 81 aa, Callithrix jacchus
EFTQEEWQQMAPVQRNLYRDVMLENYSHLVSVGYCLFKPEVIFKLEQGAEPWFSEEEFSNKSHPSELLSSSKQSSAGVVRL

SEQ ID NO: 5465 - protein, 81 aa, Callithrix jacchus
MNTFQASVSFKDVTVEFTQEEWQHMGPVERTLYRDVMLENYSHLVSVGYCFTKPELIFTLEQGEDPWLLEKEKGFLSRTSP

SEQ ID NO: 5466 - protein, 81 aa, Callithrix jacchus
MNVSQASVSFQDVAVEFTQEEWQHLGLVEWTLYRDVMLENYSHLVSVGYCITKPKVISQLEQGEEPWSLEDEFLNQKYPGH

SEQ ID NO: 5467 - protein, 81 aa, Callithrix jacchus
MLENYSHLVSVGYCITKPKVISQLEQGEEPWSLEDEFLNQKYPGHFKVDDHIKGIWEKQEKPLWKEIFIDDADETWSKEGQ

SEQ ID NO: 5468 - protein, 81 aa, Callithrix jacchus
MASPSPPPEPKEEWDYLDPAQRSLYKDVMMENYGNLVSLDVLNRDKDEEPTVKQEIEEIEEEVEPQGVIVTRIKSEIDQDP

SEQ ID NO: 5469 - protein, 81 aa, Callithrix jacchus
MASPSPPPEPKGLLTFEDVAVFFTQEEWDYLDPAQRSLYKDVMMENYGNLVSLDVLNRDKDEEPTVKQEIEEIEEEVEPQG

SEQ ID NO: 5470 - protein, 81 aa, Callithrix jacchus
MASPSPPPEPKEWDYLDPAQRSLYKDVMMENYGNLVSLDVLNRDKDEEPTVKQEIEEIEEEVEPQGVIVTRIKSEIDQDPM

SEQ ID NO: 5471 - protein, 81 aa, Callithrix jacchus
ENSKENKVVAICPNTESCESITLNDVAVNFSRGEWKKLEPFQKELYKEVLLENFRNLEFLDFPVSKLELISQLKWVELSWL

SEQ ID NO: 5472 - protein, 81 aa, Callithrix jacchus
ETRRPLEMAVSKPEASAAGSVTFKDVTMAFTQKEWEQLDPAQRNLYKDVMLENYSNLASMGCQAPKPDMISKLEKGEAPCL

SEQ ID NO: 5473 - protein, 81 aa, Callithrix jacchus
RRRSAGTTKETRRPLEMAVSKPEASAAKEWEQLDPAQRNLYKDVMLENYSNLASMGCQAPKPDMISKLEKGEAPCLGKGKR

SEQ ID NO: 5474 - protein, 81 aa, Callithrix jacchus
MAAGLLTAGPRGSTSFSSVTVAFAQEGWRYLVSTSRDRFKDRIPEKSRNLVLLGLPVSQPGMNSQLELREGAWMLESEDLR

SEQ ID NO: 5475 - protein, 81 aa, Callithrix jacchus
ENTGEEGMAAGLLTAGPRGSTSFSSVTVAFAQEGWRYLVSTSRDRFKDRIPEKSRNLVLLGLPVSQPGMNSQLELREGAWM

SEQ ID NO: 5476 - protein, 81 aa, Callithrix jacchus
KENPEDISGWGLPETRSKESVSFRDVAVDFTQEEWGQLDSPQRALYRDVMLENYQNLLALGPPLHKPDVISHLERGEEPWC

SEQ ID NO: 5477 - protein, 81 aa, Callithrix jacchus
KENPEDISGWGLPETRSKESVSFRDVAVDFTQEEWGQLDSPQRALYRDVMLENYQNLLALEWEMKEVPSQQQGMCKEEPAQ

SEQ ID NO: 5478 - protein, 81 aa, Callithrix jacchus
KENPEDISGWGLPETRSKESVSFRDVAVDFTQEEWGQLDSPQRALYRDVMLENYQNLLALGAGPPLHKPDVISHLERGEEP

SEQ ID NO: 5479 - protein, 81 aa, Callithrix jacchus
LKQWGNELKNSMSSFRPGRGHNDSRRTVFYTNEEWELLDPTPKDLEESIVQEEKKKPTPEGNKGVTGSGFPFDFGRNPYKG

SEQ ID NO: 5480 - protein, 81 aa, Callithrix jacchus
GDPSSEGTPGSGSVSISIRKPASEMQLQVQSQQEELERLKKDLSSQKELVRLLQQTVRSSQYDKYFTSSRLCEGVPKDTLE

SEQ ID NO: 5481 - protein, 81 aa, Callithrix jacchus
ERSSGDSEMVALLTALSQGLVTFKDVAVCFSQDQWSDLDPTQKEFYGEYVLEEDCGIVVSLDRSKDEEECVEQEDLSLEDI

SEQ ID NO: 5482 - protein, 81 aa, Callithrix jacchus
QKASIKDKMKADSLTGKPQEPVTFKDVVVEFSKEEWGQLDSAVKNLYRDVMLENFRNLNSLRKAHLLSKPVESLELKNKKK

SEQ ID NO: 5483 - protein, 81 aa, Callithrix jacchus
MAVTFEDVTIIFTQEEWKFLDSSQKRLYREVMWENYTNVMSVGNWNESYKSQEEKFRYLEYENFSCCQGWWNAGTQIYEIQ

SEQ ID NO: 5484 - protein, 81 aa, Callithrix jacchus
RKNLSTEKEQKLIVQHSYIPMEEALPQYIGVICQKDLLKDSMEEKYSGCNKCKEIYYWNSQCVFHQRNQPGENLYQCSISK

SEQ ID NO: 5485 - protein, 81 aa, Callithrix jacchus
NVHCFPYSLIPESLIFGQMAVTFEDVTIIFTQEEWKFLDSSQKRLYREVMWENYTNVMSVGNWNESYKSQEEKFRYLEYEN

SEQ ID NO: 5486 - protein, 81 aa, Callithrix jacchus
EHKGGRNVHCFPYSLIPESLIFGQMAVTFEDVTIIFTQEEWKFLDSSQKRLYREVMWENYTNVMSETGMRATNPKKKNSDI

SEQ ID NO: 5487 - protein, 81 aa, Callithrix jacchus
KFQPSCLVTVGLWARLFEKVLTFRDVAIEFSLEEWKFLDAAQQNLYRDVMLENYRNLFSIGLTVSKPGLITCLEQRKAPWN

SEQ ID NO: 5488 - protein, 81 aa, Callithrix jacchus
MAGAQKVLTFRDVAIEFSLEEWKFLDAAQQNLYRDVMLENYRNLFSIGLTVSKPGLITCLEQRKAPWNLKRREAADGHPEL

SEQ ID NO: 5489 - protein, 81 aa, Callithrix jacchus
EGRTRDRQMAAALLTAWSQMPVTFEDVALYLSREEWGRLDHTQQSFYREVLQKRNGLSLGFPFSRPFWAPQVPGKGEASGS

SEQ ID NO: 5490 - protein, 81 aa, Callithrix jacchus
EGRTRDRQMAAALLTAWSQMPVTFEDVALYLSREEWGRLDHTQQSFYREVLQKRNGLSLGPIQGVQGVPTPPVAALEDVKP

SEQ ID NO: 5491 - protein, 81 aa, Callithrix jacchus
PHSHGAQLPALLREGQTREPMDTCFVSGVHEEWGTLDPAQRDLFWDIKRENSRNTTLGLGLKGQSERSRPEEVVPALPGQA

SEQ ID NO: 5492 - protein, 81 aa, Callithrix jacchus
LREGQTREPMDTCFVSGVHGPVASADIPFYFSQEEWGTLDPAQRDLFWDIKRENSRNTTLGLGLKGQSERSRPEEVVPALP

SEQ ID NO: 5493 - protein, 81 aa, Callithrix jacchus
MAEEWGTLDPAQRDLFWDIKRENSRNTTLGLGLKGQSERSRPEEVVPALPGQAALGPVVGARRGRPPTRRRQFRDLAAEKP

SEQ ID NO: 5494 - protein, 81 aa, Callithrix jacchus
PLLNLLPKGIQEKEEAVSLCLKANPEELVVFEDLNVFHCQEECVSLDPTQQLTSEKEDDSSVGEMMLLVNGSNPEGEDSEK

SEQ ID NO: 5495 - protein, 81 aa, Callithrix jacchus
SLFPPEGNMEDKMTGPQLPESLEDVAVYISQEEWGHQDPSKRALSRDTVQESYENVDSLESHIPSQEVPSTQVGQGGKLWD

SEQ ID NO: 5496 - protein, 81 aa, Callithrix jacchus
QTNTKDWTVAPEHVLPESQSLLTFEEVAMYFSQEEWELLDPTQKALYNDVMQENYETVISLALFVLPKPKVISCLEQGEEP

SEQ ID NO: 5497 - protein, 81 aa, Callithrix jacchus
MYFSQEEWELLDPTQKALYNDVMQENYETVISLALFVLPKPKVISCLEQGEEPWVQVSPEFKDSARGSSTGLKLKNDTENH

SEQ ID NO: 5498 - protein, 81 aa, Callithrix jacchus
MCDDRAASLCQQEWMHPGPAQRAVYRDATQRKNRHALLATGVPWGCEETRTLLAVLSSSQFYGKLQTCQQNSQIYRAIAER

SEQ ID NO: 5499 - protein, 81 aa, Callithrix jacchus
QNTGLHDQETGAVVWTAGFQGPAMCDDRAASLCQQEWMHPGPAQRAVYRDATQRKNRHALLATGVPWGCEETRTLLAVLSS

SEQ ID NO: 5500 - protein, 81 aa, Callithrix jacchus
MLVFLSEEGPAMCDDRAASLCQQEWMHPGPAQRAVYRDATQRKNRHALLGFEIKNEIENVKWDDLEEVEMNKALQRKSRGE

SEQ ID NO: 5501 - protein, 81 aa, Callithrix jacchus
QNTGLHDQETGAVVWTAGFQGPAMCDDRAASLCQQEWMHPGPAQRAVYRDATQRKNRHALLGFEIKNEIENVKWDDLEEVE

SEQ ID NO: 5502 - protein, 81 aa, Callithrix jacchus
NTGLHDQETGAVVWTAGFQGPAMCDDRAASLCQQEWMHPGPAQRAVYRDATQRKNRHALLATGVPWGCEETRTLLAVLSSS

SEQ ID NO: 5503 - protein, 81 aa, Callithrix jacchus
SQACLAPQAPRNLPQNTGLHDQETGAVVWTAGFQGPAMCDDRAASLCQQEWMHPGPAQRAVYRDATQRKNRHALLGTPGSL

SEQ ID NO: 5504 - protein, 81 aa, Callithrix jacchus
MASVLPTPEAQGPMLFEDLAVYFSQEECVTLHPAQRSLSRDATQECLEDAALMGEEGKPEINQQLSLESMELDELALEKYP

SEQ ID NO: 5505 - protein, 81 aa, Callithrix jacchus
WPERGPPAPQHQEMASASPLLSAWSQAPVNLEDVAVYLSGEELGCLDPAQQDAPLENEGPVIQLVDGGDGREDAPVRMEWY

SEQ ID NO: 5506 - protein, 81 aa, Callithrix jacchus
NILDQEVTTTRLPTGSQEPVKDVHVTRGFSYKKSVHQIPAHRGLYRDFRKENVGNVVSLGSTVSASNRITRLEQRKEPWTL

SEQ ID NO: 5507 - protein, 81 aa, Callithrix jacchus
EAGSLHSGHQEQLNRKREHRPLPKNARPSPWVPDLADEWNILDQEVTTTRLPTGSQEPVKDVHVTRGFSYKKSVHQIPAHR

SEQ ID NO: 5508 - protein, 81 aa, Callithrix jacchus
APLPSWDSNRAGPECRKPGAVSFGDVAVYFSREEWGCLRPAQRALYRDVMRETYSHLSALGVGGSMQALISWVKEAELWGP

SEQ ID NO: 5509 - protein, 81 aa, Callithrix jacchus
APLPSWDSNRAGPECRKPGAVSFGDVAVYFSREEWGCLRPAQRALYRDVMRETYSHLSALGESPTCSPGPCAPTSPAAPQG

SEQ ID NO: 5510 - protein, 81 aa, Callithrix jacchus
ATLYSQDPNGAGSEWREPGPVTFGDVAVYFSREEWGCLRPAQRALYRDVMRETYSHLGALGVEGSKPALISWVEEEAELWG

SEQ ID NO: 5511 - protein, 81 aa, Callithrix jacchus
APLLARRPGETRPGCRKPGAVSFADVAVYFSPEEWGCLRPAQRALYRDVMRETYGHLGALGFPGPKPALISWMEQESEAWS

SEQ ID NO: 5512 - protein, 81 aa, Callithrix jacchus
PAHVLWETRPPPRRDSRPGALSFADVAVYFSPEWGCLRPAQRALYRDVMRETCGHLGALGFSGPKSAFISWVEGEMEAWSP

SEQ ID NO: 5513 - protein, 81 aa, Callithrix jacchus
PVRGPGEARPSRKRGRRPRALKFVDVAVYFSSEEWGCLRPAQRALYRDVMRETYGHLGALGCAGPKPALISWLERNTDDWE

SEQ ID NO: 5514 - protein, 81 aa, Callithrix jacchus
MRLLTFRDVAIEFSLEEWEHLDSDQKNLYGDVMLENYRNLVCLGLAVSKPDLITFLEQRKEPWNVKSAETVAIQPDIFSHD

SEQ ID NO: 5515 - protein, 81 aa, Callithrix jacchus
MLENYRNLVCLGLAVSKPDLITFLEQRKEPWNVKSAETVAIQPDIFSHDTQALLRKKQIEASFQKVILDGYGSCGLQNLHL

SEQ ID NO: 5516 - protein, 81 aa, Callithrix jacchus
HCAVTEHLTGAPAVPSVERLLTFRDVAIEFSLEEWEHLDSDQKNLYGDVMLENYRNLVCLGLAVSKPDLITFLEQRKEPWN

SEQ ID NO: 5517 - protein, 81 aa, Callithrix jacchus
MGLLTFRDVAIEFSLEEWEHLDSNQKNLYRDVMLENYRNLVCLGFAVSKPDLITFLEQRKEPCNVKSIETVAIQPDVFSHD

SEQ ID NO: 5518 - protein, 81 aa, Callithrix jacchus
KEPCNVKSIETVAIQPDVFSHDTQAFLRKKHIEASFQKVMLDGYESCGLQNLHLRKECESDENNQYNKSDTTVGQGISPRR

SEQ ID NO: 5519 - protein, 81 aa, Callithrix jacchus
MGLVTFRDVAIEFSLEEWKHLEPAQKNLYWDVMLENYRNLVSLGLTISKPDLITFLEQRKEPWNVKSAETVATQPDIFLHH

SEQ ID NO: 5520 - protein, 81 aa, Callithrix jacchus
MLENYRNLVSLGLTISKPDLITFLEQRKEPWNVKSAETVATQPDIFLHHNKDLLTEHCTEASFQKVILRRHESCDLENLHI

SEQ ID NO: 5521 - protein, 81 aa, Callithrix jacchus
MNKFQEQVSFKDVCVDFTEEEWYLLDPAQKMLYRDVILENYSNLVSVGYCITKPEVIFKIEQGEEPWILEKGFPSQCHPER

SEQ ID NO: 5522 - protein, 81 aa, Callithrix jacchus
MGFTQEEWQHLDPAQRTLYKDVMLENYSPVVSVGYYIPKPGVIVKLEQGEHPWILEEELPGHKYPRQVSPCWLVWSRTPDL

SEQ ID NO: 5523 - protein, 81 aa, Callithrix jacchus
MNKFQVPVTLKDVIVEFTKEEWKLLTPAQRTLYKDVMLENYSHLVSVGYRVNKPNVVFKLKQGKEPWMLEVEFPHRGLPED

SEQ ID NO: 5524 - protein, 81 aa, Callithrix jacchus
MNKVEQKFQGSISFKDVTVGFTQEEWHHLDPSQRALYRDVMLENYSNLVSVGYCVHKPEVIFRLEQGEEPWRLEEEFPSQS

SEQ ID NO: 5525 - protein, 81 aa, Callithrix jacchus
VGYLLCAPQIFQVEQKFQGSISFKDVTVGFTQEEWHHLDPSQRALYRDVMLENYSNLVSVGYCVHKPEVIFRLEQGEEPWR

SEQ ID NO: 5526 - protein, 81 aa, Callithrix jacchus
RANATRGSGVEQKFQGSISFKDVTVGFTQEEWHHLDPSQRALYRDVMLENYSNLVSVGYCVHKPEVIFRLEQGEEPWRLEE

SEQ ID NO: 5527 - protein, 81 aa, Callithrix jacchus
MSAVEQKFQGSISFKDVTVGFTQEEWHHLDPSQRALYRDVMLENYSNLVSVGYCVHKPEVIFRLEQGEEPWRLEEEFPSQS

SEQ ID NO: 5528 - protein, 81 aa, Callithrix jacchus
HLDPSQRALYRDVMLENYSNLVSVGYCVHKPEVIFRLEQGEEPWRLEEEFPSQSFPEIWTADHLKERSQENQSKHLWEVVF

SEQ ID NO: 5529 - protein, 81 aa, Callithrix jacchus
PSQFSLLFQHQGKMITAQGPVSFRDVTVGFTQEEWQHLDPAQRTLYRDVMMENYSHLVSVGYCIPKPEVILKLEKGEEPWI

SEQ ID NO: 5530 - protein, 81 aa, Callithrix jacchus
MITAQGPVSFRDVTVGFTQEEWQHLDPAQRTLYRDVMMENYSHLVSVGYCIPKPEVILKLEKGEEPWILEENFPSQSHLGS

SEQ ID NO: 5531 - protein, 81 aa, Callithrix jacchus
MITAQGPVSFRDVTVGFTQEEWQHLDPAQRTLYRDVMMENYSHLVSVGYCIPKPEVILKLEKGEEPWILEENFPSQSHLEL

SEQ ID NO: 5532 - protein, 81 aa, Callithrix jacchus
MGPLTFMDVAIEFSPEEWQCLDTAQQNLYRDVMLENYRNLVFLGTAFSKPDLITYLEQGKEPWNMKRHETLAKPPVTCSYF

SEQ ID NO: 5533 - protein, 81 aa, Callithrix jacchus
MAPRAQIQGLLTFGDVAVAFTRIEWRHLDAAQRALYRDVMLENYGNLVSVGLLSSKPKLIAQLEQGAEPWMEVREAPSGTR

SEQ ID NO: 5534 - protein, 81 aa, Callithrix jacchus
RDVMLENYGNLVSVGLLSSKPKLIAQLEQGAEPWMEVREAPSGTRAVPDYWFETKMSALKQSTSEGSVLGERMKSVMMEKG

SEQ ID NO: 5535 - protein, 81 aa, Callithrix jacchus
MPSQDFMTFEDIIIDFTREEWALLDTSQRKLFRDVMLENISHLVSIGNEFCKSVVFSQGISLLQGKEGDIKHQEIPFIQHI

SEQ ID NO: 5536 - protein, 81 aa, Callithrix jacchus
DIKHQEIPFIQHIYQKDTSTISTMRSHTQDDPFLCNDLGEDFTQHIPLTQNMVTYMSKKQFERRSSEHQSVVTATSIKTWL

SEQ ID NO: 5537 - protein, 81 aa, Callithrix jacchus
LVSIGNEFCKSVVFSQGISLLQGKEGDIKHQEIPFIQHIYQKDTSTISTMRSHTQDDPFLCNDLGEDFTQHIPLTQNMVTY

SEQ ID NO: 5538 - protein, 81 aa, Callithrix jacchus
MMPSQDFMTFEDIIIDFTREEWALLDTSQRKLFRDVMLENISHLVSIGKEGDIKHQEIPFIQHIYQKDTSTISTMRSHTQD

SEQ ID NO: 5539 - protein, 81 aa, Callithrix jacchus
RFLGEKRTTNSFLKARPQDLMTFEDVAVEFTQWEWGQLNPAQKDLYREVMLENFRNLTLLGLLVSKPYVICQLEEGGEPFM

SEQ ID NO: 5540 - protein, 81 aa, Callithrix jacchus
MTFEDVAVEFTQWEWGQLNPAQKDLYREVMLENFRNLTLLGLLVSKPYVICQLEEGGEPFMVKREISIGVHSDWERRSKSK

SEQ ID NO: 5541 - protein, 81 aa, Callithrix jacchus
MLENYKSVVSLGLPVPQPDMIFQLKRGEEPWMVDLHGSEEREWPESVSLDWETKPEIYDASEEKAEGSLRESLGKQSPLCP

SEQ ID NO: 5542 - protein, 81 aa, Callithrix jacchus
MAAVSPTTRCQESVTFEDVAVVFTDEEWSHLVPIQRDLYKEVMLENYKSVVSLGLPVPQPDMIFQLKRGEEPWMVDLHGSE

SEQ ID NO: 5543 - protein, 81 aa, Callithrix jacchus
LGPALELLPGQPTLPRTCLESVTFEDVAVYFSENEWIGLGPAQRALYRDVMLENYGSVASLAFPFPKPALISQLEQGKAPW

SEQ ID NO: 5544 - protein, 81 aa, Callithrix jacchus
TMTTVSSTARPQESVAFDDVAVYFTKKEWAIMVPDQRALYRDVMLENYEAVAFVVPPTSKPALISHLEQGKEPCFTQPQGV

SEQ ID NO: 5545 - protein, 81 aa, Callithrix jacchus
QILELLVLEQFLSILPGELRVWVQLHNPESGDEAVALLEELQRDLDGTSHRDPGPVQSPDVHWMGTGALRSAQIWSLASPL

SEQ ID NO: 5546 - protein, 81 aa, Callithrix jacchus
EGCPGDQVTATRSLTAQLQETMTFKDVEVTFSQDEWGLLDSAQRNLYRDVMLENYRNMAFLVGPFTKPALISWLEAREPWG

SEQ ID NO: 5547 - protein, 81 aa, Callithrix jacchus
AQILELLVLEQFLSILPGELRVWVQLHNPESGDEAVALLEELQRDLDGTSHRDPGPVQSPDVHWMGTGALRSAQIWSLASP

SEQ ID NO: 5548 - protein, 81 aa, Callithrix jacchus
PPAAQMPALFQREGCPGDQETMTFKDVEVTFSQDEWGLLDSAQRNLYRDVMLENYRNMAFLVGPFTKPALISWLEAREPWG

SEQ ID NO: 5549 - protein, 81 aa, Callithrix jacchus
LAGQSDPPAAQMPALFQREGCPGDQVTATRSLTAQLQETMTFKDVEVTFSQDEWGLLDSAQRNLYRDVMLENYRNMAFLGK

SEQ ID NO: 5550 - protein, 81 aa, Callithrix jacchus
VGNSGDQAGATVLRMVRPQDTVAFEDLCVDYTQKNQKCPALSQRAMHCNVMPDNDHSMASLAGENKLESSELTPKQEIFKG

SEQ ID NO: 5551 - protein, 81 aa, Callithrix jacchus
GNSGDQAGATVLRMVRPQDTVAFEDLCVDYTQKNQKCPALSQRAMHCNVMPDNDHSMASLGENKLESSELTPKQEIFKGSK

SEQ ID NO: 5552 - protein, 81 aa, Callithrix jacchus
TLPQVGNSGDQAGATVLRMVRPQDTVAFEDLCVDYTQKNQKCPALSQRAMHCNVMPDNDHSMASLDGETGTEEVLIPKLHS

SEQ ID NO: 5553 - protein, 81 aa, Callithrix jacchus
APEASALSQEENPRNQLMALMLLTAQPQELVMFEEVSVCFTSEEWACLGPIQRALYWDVMLENYGNVTSLGYRKYGRQKNK

SEQ ID NO: 5554 - protein, 81 aa, Callithrix jacchus
PALPSKVSAWPWEEKPGYLGPVTFKDVAVVFTEAEWKRLSLEQRNLYREVMLENLRNLVSLARSPSCPSCPVVFGSQQFLS

SEQ ID NO: 5555 - protein, 81 aa, Callithrix jacchus
LPSKVSAWPWEEKPGYLGPVTFKDVAVVFTEAEWKRLSLEQRNLYREVMLENLRNLVSLAESKPEVHCPSCPVVFGSQQFL

SEQ ID NO: 5556 - protein, 81 aa, Callithrix jacchus
GFSSLFQRPPTSSGGNRILEIQLSPAQDASSEEVYRISKRAKTPGFGAVRFGECALAFSQKSNLFGQKAVTVEKSSDKRQS

SEQ ID NO: 5557 - protein, 81 aa, Callithrix jacchus
MAAARLLPVPAGPQAKLTFEDVAVLLSQDEWDRLGPAQRGLYRNVMMETYGNVVSLGLPISKPDLISQLERGEDPWVLDGK

SEQ ID NO: 5558 - protein, 81 aa, Callithrix jacchus
AAARLLPVPAGPQPLSFQAKLTFEDVAVLLSQDEWDRLGPAQRGLYRNVMMETYGNVVSLGLPISKPDLISQLERGEDPWV

SEQ ID NO: 5559 - protein, 81 aa, Callithrix jacchus
MSFQEVVTFGDVAVHFSREEWQCLDPGQRALYREVMLENHSSVAGLAGFLVFKPELISRLEQGQEPWVLDLQGAEGTEAPK

SEQ ID NO: 5560 - protein, 81 aa, Callithrix jacchus
MEVVTFGDVAVHFSREEWQCLDPGQRALYREVMLENHSSVAGLAGFLVFKPELISRLEQGQEPWVLDLQGAEGTEAPKTFK

SEQ ID NO: 5561 - protein, 81 aa, Callithrix jacchus
MGFLGCWCMSFQEVVTFGDVAVHFSREEWQCLDPGQRALYREVMLENHSSVAGLAGFLVFKPELISRLEQGQEPWVLDLQG

SEQ ID NO: 5562 - protein, 81 aa, Callithrix jacchus
MEVVTFGDVAVHFSREEWQCLDPGQRALYREVMLENHSSVAGLGFLVFKPELISRLEQGQEPWVLDLQGAEGTEAPKTFKT

SEQ ID NO: 5563 - protein, 81 aa, Callithrix jacchus
MEVVTFGDVAVHFSREEWQCLDPGQRALYREVMLENHSSVAGLAFSHTVWVGYLCPCFPHDGNLWAWSRGAVASGFLVFKP

SEQ ID NO: 5564 - protein, 81 aa, Callithrix jacchus
MVMALPMPGPQEAVVFEDVAVYFTRIEWSCLAPDQQVLYRDVMLENYRNLASLGFLVAKPALISLLEQGEEPGALILQVAE

SEQ ID NO: 5565 - protein, 81 aa, Callithrix jacchus
MVMALPMPGPQEAVVFEDVAVYFTRIEWSCLAPDQQVLYRDVMLENYRNLASLALISLLEQGEEPGALILQVAEQRGAKTS

SEQ ID NO: 5566 - protein, 81 aa, Callithrix jacchus
ENYRNLASLALISLLEQGEEPGALILQVAEQRGAKTSLCTDSRMEAGIMESSLQRKLSRQAGLSGTVWRCLPEEDPAPPHP

SEQ ID NO: 5567 - protein, 81 aa, Callithrix jacchus
ALKPKTQAMAALFLSAPPQTEVTFEDVAVLLSREEWGRLGPAQRGLYRDVMLETYGNLVSLALGTSTEYKELTSRETFDEE

SEQ ID NO: 5568 - protein, 81 aa, Callithrix jacchus
AQRGLYRDVMLETYGNLVSLALGTSTEYKELTSRETFDEEELGHLRGIFPQGSEPVDASNRARKPEGSLEKLVEQNRPVTL

SEQ ID NO: 5569 - protein, 81 aa, Callithrix jacchus
MAALFLSAPPQTEVTFEDVAVLLSREEWGRLGPAQRGLYRDVMLETYGNLVSLGVGPAGPKPGVISQLERGDEPWVLDVQG

SEQ ID NO: 5570 - protein, 81 aa, Callithrix jacchus
GKPKTQAMAALFLSAPPQTEVTFEDVAVLLSREEWGRLGPAQRGLYRDVMLETYGNLVSLGVGPAGPKPGVISQLERGDEP

SEQ ID NO: 5571 - protein, 81 aa, Callithrix jacchus
MAALFLSAPPQTEVTFEDVAVLLSREEWGRLGPAQRGLYRDVMLETYGNLVSLALGTSTEYKELTSRETFDEEELGHLRGI

SEQ ID NO: 5572 - protein, 81 aa, Callithrix jacchus
MAATLQLRGHQEMPLTFQDVAVYFSQAEGQQLGPQQRALYRDVMLENYGNVASLGFPVPKPELISQLEQGKELWVLNLLGA

SEQ ID NO: 5573 - protein, 81 aa, Callithrix jacchus
AAHAHRMAATLQLRGHQEMPLTFQDVAVYFSQAEGQQLGPQQRALYRDVMLENYGNVASLGFPVPKPELISQLEQGKELWV

SEQ ID NO: 5574 - protein, 81 aa, Callithrix jacchus
FEGTSGHGPGSGDVLLQEMPLTFQDVAVYFSQAEGQQLGPQQRALYRDVMLENYGNVASLGFPVPKPELISQLEQGKELWV

SEQ ID NO: 5575 - protein, 81 aa, Callithrix jacchus
MDVAQEQVTFWDVAIYFSREEWECLEPSQRALYRDVMLDTFSNVAALGFCSPRPDLISRLEQWEEPWVEDRERPELQAVQR

SEQ ID NO: 5576 - protein, 81 aa, Callithrix jacchus
MDVAQEQVTFWDVAIYFSREEWECLEPSQRALYRDVMLDTFSNVAALAPDQTSSPAWNSGRSRGLKTGRDLSCRQCRGAPA

SEQ ID NO: 5577 - protein, 81 aa, Callithrix jacchus
MLQTLWFQGSSRNLFQKPVTFEDVAVYFTQNEWASLHPTQRALYREVMLENYANVTSFYLIGGFPGTERTEKVPGALPSFL

SEQ ID NO: 5578 - protein, 81 aa, Callithrix jacchus
MLQTLWFQGSSRNLFQKPVTFEDVAVYFTQNEWASLHPTQRALYREVMLENYANVTSFSAFPFPKPDLVFQLDQGEAAWGP

SEQ ID NO: 5579 - protein, 81 aa, Callithrix jacchus
MLQTLWFQGSSRNLFQKPVTFEDVAVYFTQNEWASLHPTQRALYREVMLENYANVTSFSLSSSLIPNGDLMQGGFPGYREN

SEQ ID NO: 5580 - protein, 81 aa, Callithrix jacchus
MLQTAWRQEPVTFEDVAVYFTQNEWTSLDPVQRALYREVMLENYANVASLAFPFTTPVLVSQLEQGERPWGLDPWEPVGRE

SEQ ID NO: 5581 - protein, 81 aa, Callithrix jacchus
MLQTAWPQESVAFEDVAVYFTQNQWASLDPAQRALYREVMLENYANVTSLVAFPFPKPALISHLEKGEAPWGPDPWDAEIP

SEQ ID NO: 5582 - protein, 81 aa, Callithrix jacchus
MLQTAWPQRLSRNLWFQESVAFEDVAVYFTQNQWASLDPAQRALYREVMLENYANVTSLVAFPFPKPALISHLEKGEAPWG

SEQ ID NO: 5583 - protein, 81 aa, Callithrix jacchus
EDGPVVMQKVRICSEGGWVPALFDEVAIYFSDEEWEVLTEQQKALYREVMRMNYETVLSLEFPFPKPDMITRLEGEEESQN

SEQ ID NO: 5584 - protein, 81 aa, Callithrix jacchus
QKALYREVMRMNYETVLSLEFPFPKPDMITRLEGEEESQNSDEWQLQGGTSAENEESDVKPPDWPSPVNATSHFPQPQHFD

SEQ ID NO: 5585 - protein, 81 aa, Callithrix jacchus
QEENVRDTQQVVTTLQLPPNRVSPFKDMILCFSEEDWSLLDPAQTGFYGEFIIGEDCGVSMPPNDLAAQPDLSQGEENEPR

SEQ ID NO: 5586 - protein, 81 aa, Callithrix jacchus
LGSGGKKAQAISVLSQIYVNRVSPFKDMILCFSEEDWSLLDPAQTGFYGEFIIGEDCGVSMPPNDLAAQPDLSQGEENEPR

SEQ ID NO: 5587 - protein, 81 aa, Callithrix jacchus
MGLLIFRDVAIEFSPEEWSYLNPAQQNLYRDVMLENYRNLVSLGIAISKPDLITCLEQRNEPWSVKKCETVAKQPAISSHF

SEQ ID NO: 5588 - protein, 81 aa, Callithrix jacchus
MNPVAFEDVAVNFTQEEWALLDPSQKNLYRDVMQETFRNLASIGNKGEDQSFEDRYKKSWRNLRHSISHSGNNPHSCEESR

SEQ ID NO: 5589 - protein, 81 aa, Callithrix jacchus
MYSVSFEDVAVTFTQEEWALLDLSQKSLYRDVMQEIFRNLASVGNKSENQNMQDDFKSPGRNLSSHMVERLFEIKEGSQYG

SEQ ID NO: 5590 - protein, 81 aa, Callithrix jacchus
TCHFDFCVAESIFAEAAEDSAAFKDVAVNFTQEEWALLDSSQKNLYREVMEETCRNLAIVGNKWKDQNTEDYFKKPGKDIR

SEQ ID NO: 5591 - protein, 81 aa, Callithrix jacchus
MDSAAFKDVAVNFTQEEWALLDSSQKNLYREVMEETCRNLAIVGNKWKDQNTEDYFKKPGKDIRNHMVQRLCERKEGNQYG

SEQ ID NO: 5592 - protein, 81 aa, Callithrix jacchus
PAALGSGWASRKVVTRAKDSAAFKDVAVNFTQEEWALLDSSQKNLYREVMEETCRNLAIVGNKWKDQNTEDYFKKPGKDIR

SEQ ID NO: 5593 - protein, 81 aa, Callithrix jacchus
MGPLTFRDVKIEFSLEEWQCLDTVQRNLYRDVMLENYRNLVFLGIAVSKPDLITWLEQGKEPWNMKSHAMVAKPPVICSHF

SEQ ID NO: 5594 - protein, 81 aa, Callithrix jacchus
LLDVSQNILLEPKTLSLLGPLTFRDVAIEFSLEEWQCLDTAQQNLYRHVMLENYRNLVFLGIAVSKPDLITCLEQGKEPWN

SEQ ID NO: 5595 - protein, 81 aa, Callithrix jacchus
MEPLTFRDVAIEFSLEEWQCLDTAQRDLYRNVLLENYRNLVFLGIAVSKPYLITCLEQKKEPWNMKRCEMVAKPPVMCFHF

SEQ ID NO: 5596 - protein, 81 aa, Callithrix jacchus
MEPLTFRDVAIEFSLEEWQCLDTAQRDLYRNVLLENYRNLVFLGIAVSKPYLITCLEQKKEPWNMKRCEMVAKPPVIFLQV

SEQ ID NO: 5597 - protein, 81 aa, Callithrix jacchus
MGPLTFRDVAIEFSLEEWQCLDTAQRNLYRKVMFENYRNLVFLGIAVSKPHLITCLEQGQEPWNRKRQEMVAKPPVMCSHV

SEQ ID NO: 5598 - protein, 81 aa, Callithrix jacchus
MGVLTFRDVAIEFSPEEWQCLDSAQQHLYRDVMLENYRNLVSLGLAIFKPDLITCLEQREEPWNLKKQETVAKHQAGSFHF

SEQ ID NO: 5599 - protein, 81 aa, Callithrix jacchus
MEEKEMNDGSQVVRSQESLTFQDVAVDFTREEWDRLYPAQKDLYRDVMLENYRNLVALGHQLYKPEVIAQLELEEEWVIER

SEQ ID NO: 5600 - protein, 81 aa, Callithrix jacchus
MPSQSAVFSQEENMEEKEMNDGSQVVRSQESLTFQDVAVDFTREEWDRLYPAQKDLYRDVMLENYRNLVALGHQLYKPEVI

SEQ ID NO: 5601 - protein, 81 aa, Callithrix jacchus
ENMEEKEMNDGSQVVRSQESLTFQDVAVDFTREEWDRLYPAQKDLYRDVMLENYRNLVALGHQLYKPEVIAQLELEEEWVI

SEQ ID NO: 5602 - protein, 81 aa, Callithrix jacchus
GGLWDFHYHPEFNQEDQQRYLGQVTLTHKKITQQRNLECNKFAENCNLNSTLRRQRIPSIKTPLNSDTQGNGIRHNSDLIF

SEQ ID NO: 5603 - protein, 81 aa, Callithrix jacchus
DSLGDEMLAAALLKAKSQELVTFEDVAVYFIRKEWKRLEPAQRDLYRDVMLENYGNVFSLDGETRTENDQAVSEDTRSHGV

SEQ ID NO: 5604 - protein, 81 aa, Callithrix jacchus
MLAAALLKAKSQELVTFEDVAVYFIRKEWKRLEPAQRDLYRDVMLENYGNVFSLDGETRTENDQAVSEDTRSHGVLLGRFQ

SEQ ID NO: 5605 - protein, 81 aa, Callithrix jacchus
DSLGDEMLAAALLKAKSQELVTFEDVAVYFIRKEWKRLEPAQRDLYRDVMLENYGNVFSLDQIQVSLTIQKVMLAWFTGTL

SEQ ID NO: 5606 - protein, 81 aa, Callithrix jacchus
VPAFSDKDSLGDEMLAAALLKAKSQELVTFEDVAVYFIRKEWKRLEPAQRDLYRDVMLENYGNVFSLDGETRTENDQAVSE

SEQ ID NO: 5607 - protein, 81 aa, Callithrix jacchus
GSPRDQAMASALFTADSQAMVKIEDMAVSLILEEWGCQNLARRNLSRDNRQENYGSAFSQGGENRNENEESTSKAETAEDS

SEQ ID NO: 5608 - protein, 81 aa, Callithrix jacchus
MASALFTADSQAMVKIEDMAVSLILEEWGCQNLARRNLSRDNRQENYGSAFSQGGENRNENEESTSKAETAEDSASHGETA

SEQ ID NO: 5609 - protein, 81 aa, Callithrix jacchus
GPGLPTMNPRDQEMAAGFFTAGPQGLGPFKDMALAFPEEEWRHVTPAQIDCFGEYVEPQDCRVSPGIGSKEKETKPPQEDL

SEQ ID NO: 5610 - protein, 81 aa, Callithrix jacchus
HEGSPGDQAAALLTARYQEFVTFEDVAVHLTREEWGYLDPVQRDLYREVMLENYGNVVSLGILLRLPTTRIHSVNSCPALS

SEQ ID NO: 5611 - protein, 81 aa, Callithrix jacchus
QVPALPHEGSPGDQAAALLTARYQSSQDVLFQEFVTFEDVAVHLTREEWGYLDPVQRDLYREVMLENYGNVVSLGTVGSWD

SEQ ID NO: 5612 - protein, 81 aa, Callithrix jacchus
LTGAPPVPQVPALPHEGSPGDQAAALLTARYQEFVTFEDVAVHLTREEWGYLDPVQRDLYREVMLENYGNVVSLGTVGSWD

SEQ ID NO: 5613 - protein, 81 aa, Callithrix jacchus
SQELTTSLLSTGSQKLVKIEEVADVAVSFILEEWGHLDQSQKSLYRDDRKENYGSITSMDYESRDNMELMVKQVSDDTESQ

SEQ ID NO: 5614 - protein, 81 aa, Callithrix jacchus
DSQELTTSLLSTGSQLVKIEEVADVAVSFILEEWGHLDQSQKSLYRDDRKENYGSITSMDYESRDNMELMVKQVSDDTESQ

SEQ ID NO: 5615 - protein, 81 aa, Callithrix jacchus
EAVAVVQALQRALDGTSPQGMMTFEDMAMSLTWEEWERLDPARKDFYRESMQKDSGSTVLPSLESRTENKELIPMQEILEA

SEQ ID NO: 5616 - protein, 81 aa, Callithrix jacchus
MFPPVSGKELLSFEDVAMYFTREEWGHLDWGQKDLYRDVMLENYRNMVFLGFQFPKPEVICQLENWDEQWILDLPRAGNRK

SEQ ID NO: 5617 - protein, 81 aa, Callithrix jacchus
MFPPVSGKELLSFEDVAMYFTREEWGHLDWGQKDLYRDVMLENYRNMVFLGSEARHKMKKLTSRQKFSEDLESYKISVVMQ

SEQ ID NO: 5618 - protein, 81 aa, Callithrix jacchus
MFPPVSGKELLSFEDVAMYFTREEWGHLDWGQKDLYRDVMLENYRNMVFLGRTRLEGSEARHKMKKLTSRQKFSEDLESYK

SEQ ID NO: 5619 - protein, 81 aa, Callithrix jacchus
MELLSFEDVAMYFTREEWGHLDWGQKDLYRDVMLENYRNMVFLGFQFPKPEVICQLENWDEQWILDLPRAGNRKASGSACP

SEQ ID NO: 5620 - protein, 81 aa, Callithrix jacchus
EEEDEDEDEDDLLMAGSQGLVTFEDVAVYFSLEEWERLEADQRGLYQEVMQENYGILVSLGYPIPKPDLIFRLEQGEEPWV

SEQ ID NO: 5621 - protein, 81 aa, Callithrix jacchus
MLENYSNLVSVGYHIIKPDVITKLEQGEEPWIVEGEFLLQSYPDKVWQTDDLIERVQEDENKPSRQTVFIKTLTEEREYIS

SEQ ID NO: 5622 - protein, 81 aa, Callithrix jacchus
MNKSLGPVSFKDVAVDFTQEEWQQLDPEQKITYRDVMLENYSNLVSVGYHIIKPDVITKLEQGEEPWIVEGEFLLQSYPDK

SEQ ID NO: 5623 - protein, 81 aa, Callithrix jacchus
MNKLQGPVSFKDVAVDFTQEEWQQLDPDEKIIYRDVMLENYSHLVSVGCDITKPNVIIKLEQGEEPWIMEDEFPCQHSPEV

SEQ ID NO: 5624 - protein, 81 aa, Callithrix jacchus
MNKLQGPVSFKDVAVDFTQEEWQQLDPDEKIIYRDVMLENYSHLVSVGCDITKPNVIIKLEQGEEPWIMEDEFPCQHSPAA

SEQ ID NO: 5625 - protein, 81 aa, Callithrix jacchus
MMKSQGLVSFKDVAVDFTQEEWQQLDPAQRTLYRDVMLENYSHLVSMGYPVSKPDVICKLEQGEEPWILKTDISNWIYPDE

SEQ ID NO: 5626 - protein, 81 aa, Callithrix jacchus
MLENYSHLVSMGYPVSKPDVICKLEQGEEPWILKTDISNWIYPDEYQADGRQDRKSNLHNSESYILETVFSQHKILKGITK

SEQ ID NO: 5627 - protein, 81 aa, Callithrix jacchus
ADPSSSGLLEEQKMMKSQGLVSFKDVAVDFTQEEWQQLDPAQRTLYRDVMLENYSHLVSMGYPVSKPDVICKLEQGEEPWI

SEQ ID NO: 5628 - protein, 81 aa, Callithrix jacchus
MAAGQWEARPQVSLTFEDVAVLFTRDEWRKLAPSQRNLYRDVMLENYRNLVSLGLPFTKPKVISLLQQGEDPWKVEKGSSG

SEQ ID NO: 5629 - protein, 81 aa, Callithrix jacchus
MAVDLLSAQESMTFRDVAVFFSQDEWLHLDSAQRALYREVMLENYSTLVSLGIPFSMPKVIHQLQQGQDPCTVEGDVPSNT

SEQ ID NO: 5630 - protein, 81 aa, Callithrix jacchus
ISWLLDSEMAGMFPDFVQESMTFRDVAVFFSQDEWLHLDSAQRALYREVMLENYSTLVSLGIPFSMPKVIHQLQQGQDPCT

SEQ ID NO: 5631 - protein, 81 aa, Callithrix jacchus
MARRLLPAQVQESVTFRDVAVFFSPDEWLHLDSAQRALYREVMLENYSSLVSLGILFSKPKVISHLEQGENPWMVESGVPQ

SEQ ID NO: 5632 - protein, 81 aa, Callithrix jacchus
MALSHLPTMVQESVTFKDVAVLFTQEEWGQLSPAQRALYRDVMLENYSNLVSLGLLGPKSDIFSQLEKREEWMPEDPSGGF

SEQ ID NO: 5633 - protein, 81 aa, Callithrix jacchus
MLENYRNLVSLGLPFTKPKVISLLQQGEDPWKVEKDCFGGSFLGCKSNPKMTKTTQTQDSFQELMRKRLKRDEPWNFISER

SEQ ID NO: 5634 - protein, 81 aa, Callithrix jacchus
MAAGQPEARPQVSLTFEDVAVLFTRDEWRKLAPSQRNLYRDVMLENYRNLVSLGLPFTKPKVISLLQQGEDPWKVEKDCFG

SEQ ID NO: 5635 - protein, 81 aa, Callithrix jacchus
MAAIPLKAQCQETVTFEDVAVHFTKTEWTGLSPAQRALYRSVMLENYGNLTAMGYLVPKPALISLLEGGDMAWGLEAQDDP

SEQ ID NO: 5636 - protein, 80 aa, Callithrix jacchus
VTFEDVAVHFTKTEWTGLSPAQRALYRSVMLENYGNLTAMGYLVPKPALISLLEGGDMAWGLEAQDDPLAEGTKNICKGR

SEQ ID NO: 5637 - protein, 81 aa, Callithrix jacchus
TVTFEDVAVHFTKTEWTGLSPAQRALYRSVMLENYGNLTAMGYLVPKPALISLLEGGDMAWGLEAQDDPLAEGTKNICKVI

SEQ ID NO: 5638 - protein, 81 aa, Callithrix jacchus
MLENYGNVASLGFPLLKPAVISQLEGGGELGGPSPLAAGTGLHVLRTDIQTDSDFTKEMYDRKEDVSFELQRDFSQETGFL

SEQ ID NO: 5639 - protein, 81 aa, Callithrix jacchus
VLRTDIQTDSDFTKEMYDRKEDVSFELQRDFSQETGFLETSLLEKQQELYSAGNIKKEKSNTIDGTVTDETSPMAECFFSQ

SEQ ID NO: 5640 - protein, 81 aa, Callithrix jacchus
MLENYGNVASLGFPLLKPAVISQLEGGGELGGPSPLAAGTGLHVLRTARVSLCLPGWSAVATWLTATSVSWVQAILLPQPS

SEQ ID NO: 5641 - protein, 81 aa, Callithrix jacchus
MLENYGNVASLGFPLLKPAVISQLEGGVDIQTDSDFTKEMYDRKEDVSFELQRDFSQETGFLETSLLEKQQELYSAGNIKK

SEQ ID NO: 5642 - protein, 81 aa, Callithrix jacchus
QLEGGVDIQTDSDFTKEMYDRKEDVSFELQRDFSQETGFLETSLLEKQQELYSAGNIKKEKSNTIDGTVTDETSPMAECFF

SEQ ID NO: 5643 - protein, 81 aa, Callithrix jacchus
IHLTAWPQKSVTFEDVAVYFTQAEWDGLSPAQRTLYRDVMLENYGNVASLGFPLLKPAVISQLEGGGELGGPSPLAAGTGL

SEQ ID NO: 5644 - protein, 81 aa, Callithrix jacchus
LRTVDIQTDSDFTKEMYDRKEDVSFELQRDFSQETGFLETSLLEKQQELYSAGNIKKEKSNTIDGTVTDETSPMAECFFSQ

SEQ ID NO: 5645 - protein, 81 aa, Callithrix jacchus
MNKSQGSVSFTDVTVDFTQEEWEQLDPSQRILYMDVMLENYSNLLSVEVWKADDQMERDHRNPDEQPRQFIILKNQTPMEE

SEQ ID NO: 5646 - protein, 81 aa, Callithrix jacchus
MDVMLENYSNLLSVEVWKADDQMERDHRNPDEQPRQFIILKNQTPMEERGDLFGKTLNLNTDFVSLRQVPYKYDLYEKTLK

SEQ ID NO: 5647 - protein, 81 aa, Callithrix jacchus
EQTQAAGMLAGWLIESYQDSVTFDDVAVAFTQEEWTLLDPSQRDLYRDVMLENYENLASVGHHLFKPSVICWLEEEGPSRA

SEQ ID NO: 5648 - protein, 81 aa, Callithrix jacchus
MAAPDLAHRGRVSKDLVCLHEEQTQAAGMLAGWLIESYQDSVTFDDVAVAFTQEEWTLLDPSQRDLYRDVMLENYENLASV

SEQ ID NO: 5649 - protein, 81 aa, Callithrix jacchus
MLENYENLASVGHHLFKPSVICWLEEEGPSRAGQRGVLQEWRLKSKGSALQQDRAWFHSASDETQTARSHNGGQPCDRMQC

SEQ ID NO: 5650 - protein, 81 aa, Callithrix jacchus
SQEESPEGDTGRTEQKPMVKDAFKDISMYFSKEEWAEMGDWEKTRYRNMKRNYNALITIGLRATRPAFMCHRRQAIKLQVD

SEQ ID NO: 5651 - protein, 81 aa, Callithrix jacchus
MKRNYNALITIGLRATRPAFMCHRRQAIKLQVDDTEDSDEEWTPRQQVKPPGMAFRVGQSKHQKIVRCVRTSSLTAVLLMG

SEQ ID NO: 5652 - protein, 81 aa, Callithrix jacchus
QKPMVKDAFKDISMYFSKEEWAEMGDWEKTRYRNMKRNYNALITIGLRATRPAFMCHRRQAIKLQVDDTEDSDEEWTPRQQ

SEQ ID NO: 5653 - protein, 81 aa, Callithrix jacchus
CFSGEERMAAGHPPRWPQELVTFEDVSVDFSQEEWELLDPAQKELYREVTLENYRNLVSLEALKNPCADAGMEEGPFSTAH

SEQ ID NO: 5654 - protein, 81 aa, Callithrix jacchus
HLRLQPVASAHVEQSEALWMEERGTPRASCSDWTTVLKNQDSTYKKVVLQEEPASGISIIRLIREDGGWRQLEESPDGPQG

SEQ ID NO: 5655 - protein, 81 aa, Callithrix jacchus
MDSVVFEDVAVDFTLEEWALLDSAQRDLYRDVMLETFWNLASVDDETRFKASGSVSQQDIYGEEIPKESEIAEFTRNVSWA

SEQ ID NO: 5656 - protein, 81 aa, Callithrix jacchus
MDSVVFEEVAVRFTPEEWALLSHAQRRLYRDVMLEICRNLASLGSCIYVRTSGSSSQRDVFGNKISNEEEMAKFTRSESWC

SEQ ID NO: 5657 - protein, 81 aa, Callithrix jacchus
GHTEGGGLVNELLRSWLQGVTFKDVAVEFTQEDWALLDPAQKTLYRNVMLEDSWNLSSSLDVETPLKASGLTSKLRVFREQ

SEQ ID NO: 5658 - protein, 81 aa, Callithrix jacchus
GHTEGGGLVNELLTSWLQGLVTFEDVAVEFTQEEWALLDPAQRTLYKDVMLENCRNLASLGCHVNKPRLISQWEQDKKVMT

SEQ ID NO: 5659 - protein, 81 aa, Callithrix jacchus
DPAQRTLYKDVMLENCRNLASLGCHVNKPRLISQWEQDKKVMTEERGILPSTCPDLETLLKAKWLTPKKHVFKKEQSKRVK

SEQ ID NO: 5660 - protein, 81 aa, Callithrix jacchus
MLENCRNLASLDLETLLKAKWLTPKKHVFKKEQSKRVKTERSHRGVKLNECNQCFKVFSTKSNLTQHKRIHTGEKPYDCNQ

SEQ ID NO: 5661 - protein, 81 aa, Callithrix jacchus
DLFACSGLEPHTPSIGSQESVTFQDVAVDFTEKEWPLLDSSQRKLYKDVMLENYSNLTSLGYQVGKPSLISHLEQEEEPRT

SEQ ID NO: 5662 - protein, 81 aa, Callithrix jacchus
DLFACSGLEPHTPSIGSQESVTFQDVAVDFTEKEWPLLDSSQRKLYKDVMLENYSNLTSLDWETPSKTKWSLLMEDIFGKE

SEQ ID NO: 5663 - protein, 81 aa, Callithrix jacchus
SSKDCSCPQNLDLFACSGLEPHTPSIGSQESVTFQDVAVDFTEKEWPLLDSSQRKLYKDVMLENYSNLTSLEMLASSCCCS

SEQ ID NO: 5664 - protein, 81 aa, Callithrix jacchus
MEEERTTAELQKNRIQDSVVFQDVAVDFTQEEWALLDLAQRNLYRDVMLENFQNLASLGYLLHTPHLISQWEQEEDLQTVK

SEQ ID NO: 5665 - protein, 81 aa, Callithrix jacchus
AKFEEERMVAGWLTNYSQDSVTFEDVAVDFTPEEWTLLDQTQRNLYGDVMLENYKNLIAVDWESHINTKWTAPQQNFFQEK

SEQ ID NO: 5666 - protein, 81 aa, Callithrix jacchus
MAAGWLTAWSQNSVSFQEVAVDFSQEEWALLDLAQKNLYKDVMLENFRNLTSVGYELCRHNLISKVDQEELKTDERGILES

SEQ ID NO: 5667 - protein, 81 aa, Callithrix jacchus
MVAGWLTNYSQDSVTFEDVAVDFTPEEWTLLDQTQRNLYGDVMLENYKNLIAVDWESHINTKWTAPQQNFFQEKTFSMVEM

SEQ ID NO: 5668 - protein, 81 aa, Callithrix jacchus
MLENFRNLTSVGYELCRHNLISKVDQEELKTDERGILESDCAEWETQLKSKDVIAMQNIPGGKTSNDMKMAQTQPGKNPLE

SEQ ID NO: 5669 - protein, 81 aa, Callithrix jacchus
EKTEVERMVADCLTNCYQDSVTFDDLAVDFTPEEWTLLDPTQRNLYRDVMLENYKNLATVGCQLFKPSLISWLEQEESRTV

SEQ ID NO: 5670 - protein, 81 aa, Callithrix jacchus
VEVLILVKDYLEKRFSISDSVTFEDVSVDFTQEEWTLLDPLQRNFYRDVMLENYENLAKVGFQLLKPSLISWLEEEELRTL

SEQ ID NO: 5671 - protein, 81 aa, Callithrix jacchus
SAVQQNFCKIQTSNGIQTDLIIFDSVAVEFTQEEWTLLDPTERNLYRDVMLENYKNLFSVGYQLFKPSLISWMEEEEELST

SEQ ID NO: 5672 - protein, 81 aa, Callithrix jacchus
MAYCLTDCYQDSVTFEDVSVDFTQEEWTLLDPLQRNFYRDVMLENYENLAKVGFQLLKPSLISWLEEEELRTLQQGLLQEC

SEQ ID NO: 5673 - protein, 81 aa, Callithrix jacchus
EKTAAGRIVAGCLTNCYQDSVTFDDVAVDFTQEEWTLLDPTQRSLYSDVMLENYKNLATVGGQIIKPSLISWLEQEESRTV

SEQ ID NO: 5674 - protein, 81 aa, Callithrix jacchus
MDSVTFDDVAVDFTQEEWTLLDPTQRSLYSDVMLENYKNLATVGWELQLETQWSTLQQNCLRGQTSIGVQLEGNHNGGKLL

SEQ ID NO: 5675 - protein, 81 aa, Callithrix jacchus
LSGDPVCLHEEKTAAGRIVAGCLTNCYQDSVTFDDVAVDFTQEEWTLLDPTQRSLYSDVMLENYKNLATVGRKPQWRETFG

SEQ ID NO: 5676 - protein, 81 aa, Callithrix jacchus
EKTKVERTVVDYLANGYQDSVTFDDVAVEFTPEEWALLDTTQKYLYRDVMLENYKNLASVEWEIQPRSQGPSHQQGFLKNE

SEQ ID NO: 5677 - protein, 81 aa, Callithrix jacchus
EKTKVERTVVDYLANGYQDSVTFDDVAVEFTPEEWALLDTTQKYLYRDVMLENYKNLASMGCQLFIPNLTSWLKQEELKTM

SEQ ID NO: 5678 - protein, 81 aa, Callithrix jacchus
EKTKVERTVVDYLANGYQDSVTFDDVAVEFTPEEWALLDTTQKYLYRDVMLENYKNLASMDYFFCLTSEWEIQPRTQGLSL

SEQ ID NO: 5679 - protein, 81 aa, Callithrix jacchus
FFPREAICPLEEKTKVERTVVDYLANGYQDSVTFDDVAVEFTPEEWALLDTTQKYLYRDVMLENYKNLASMADKLQWMETL

SEQ ID NO: 5680 - protein, 81 aa, Callithrix jacchus
VDSVTFDDVAVEFTPEEWALLDTTQKYLYRDVMLENYKNLASMDYFFCLTSEWEIQPRTQGLSLQQRFLKNEIFNGIQMQT

SEQ ID NO: 5681 - protein, 81 aa, Callithrix jacchus
MDSVAFEDVAVNFTLEEWALLDPSQKNLYRDVMRETFRNLASIGKQWEDQNTEDPFKLPRRNTSHIPQRIGEETFSQIPDG

SEQ ID NO: 5682 - protein, 81 aa, Callithrix jacchus
MDSVAFEDVAVNFTQEEWALLGPSQKSLYRNVMQETIRNLDCIGHTCEIIDNSQCGETFSQIPESIVNKNTPGVDPCDSSE

SEQ ID NO: 5683 - protein, 81 aa, Callithrix jacchus
MDSVAFEDVAVNFTQEEWALLGPSQKSLYRNVMQETIRNLDCIEMKWEDQNIEDQCQNHRRNLRSHTCEIIDNSQCGETFS

SEQ ID NO: 5684 - protein, 81 aa, Callithrix jacchus
MDSVAFEDVAINFTCEEWALLGPSQKSLYRDVMQETIRNLDCIGMKWQNLDIEEDKYRNPGRNLRYYMVKRAREIKDNSQC

SEQ ID NO: 5685 - protein, 81 aa, Callithrix jacchus
MMFQDPVAFEDVAVNFTQEEWALLDISQKNLYREVMLETFRNLTSIGKKWKDKSIEDECQIHRRNLRSLIEEKVYEIKKDS

SEQ ID NO: 5686 - protein, 81 aa, Callithrix jacchus
MDPVAFEDVAVNFTQEEWALLDISQKNLYREVMLETFRNLTSIGKKWKDKSIEDECQIHRRNLRSLIEEKVYEIKKDSHSE

SEQ ID NO: 5687 - protein, 81 aa, Callithrix jacchus
MFQDPVAFEDVAVNFTQEEWALLDISQKNLYREVMLETFRNLTSIGKKWKDKSIEDECQIHRRNLRSLIEEKVYEIKKDSH

SEQ ID NO: 5688 - protein, 81 aa, Callithrix jacchus
MDSVAFEDVAVSFTQEEWALLNPSKKNLYRDVMKETFKNLASVGKTWKVQDIKGMYKNSRRNIRWSLAFARAGVQRDLGSL

SEQ ID NO: 5689 - protein, 81 aa, Callithrix jacchus
MMFQDSVAFEDVAVSFTQEEWALLNPSKKNLYRDVMKETFKNLASVGKTWKVQDIKGMYKNSRRNISLLIKEKLFETKDSN

SEQ ID NO: 5690 - protein, 81 aa, Callithrix jacchus
LLVLSLSPVLHTRGMFQDPVAFEDVAVNFTQEEWALLDISQKNLYREVMLETFRNLTSIGKKWKDKSIEDECQIHRRNLRS

SEQ ID NO: 5691 - protein, 81 aa, Callithrix jacchus
VPCCSHRSCREDSGTSENWEMEEWALLDISQKNLYREVMLETFRNLTSIGKKWKDKSIEDECQIHRRNLRSLIEEKVYEIK

SEQ ID NO: 5692 - protein, 81 aa, Callithrix jacchus
MQENFRNLASVGKKWKAQNIYVEYKNLRRNLRNLMGKRLFESKEDHQHGEILTQVPDDVLKKKTTGVKSCESSVCGEVGSG

SEQ ID NO: 5693 - protein, 81 aa, Callithrix jacchus
MFQDSVAFEDVAVTFTQEEWALLDPSQKTLYRDVMQENFRNLASVGKKWKAQNIYVEYKNLRRNLRNLMGKRLFESKEDHQ

SEQ ID NO: 5694 - protein, 81 aa, Callithrix jacchus
MDSVAFEDVAVTFTQEEWALLDPSQKTLYRDVMQENFRNLASVGKKWKAQNIYVEYKNLRRNLRNLMGKRLFESKEDHQHG

SEQ ID NO: 5695 - protein, 81 aa, Callithrix jacchus
MFQDSVAFEDVTVLVSPILLYICGMFQDSVAFEDVAVTFTQEEWALLDPSQKTLYRDVMQENFRNLASVGKKWKAQNIYVE

SEQ ID NO: 5696 - protein, 81 aa, Callithrix jacchus
DVTVLVSPILLYICGMFQDSVAFEDVAVTFTQEEWALLDPSQKTLYRDVMQENFRNLASVGKKWKAQNIYVEYKNLRRNLR

SEQ ID NO: 5697 - protein, 81 aa, Callithrix jacchus
MDSVAFEDVAVNFTQEEWALLDRSQKKLYREVMQETLRNLTSIGKTWSNQNAEERHQNPRRNLRRLIGERLFQILEVVESV

SEQ ID NO: 5698 - protein, 81 aa, Callithrix jacchus
VMAELAVNTARHPVSSLQLDSVAFEDVAVTFTQEEWALLDPSQKTLYRDVMQENFRNLASVGKKWKAQNIYVEYKNLRRNL

SEQ ID NO: 5699 - protein, 81 aa, Callithrix jacchus
DSVAFEDVAVNFTQEEWALLDRSQKKLYREVMQETLRNLTSIGKTWSNQNAEERHQNPRRNLRRLIGERLFQSKESHQHAE

SEQ ID NO: 5700 - protein, 81 aa, Callithrix jacchus
MDSVAFEDVDVNFTQDEWALLDPSQKNLYRDVMQETFRNLASVGKKWKDQKIEDEYKNPRSNLRGLMGERLLESKTGHQLG

SEQ ID NO: 5701 - protein, 81 aa, Callithrix jacchus
RRHLRADTGHKPYEYQEYGQKPYKCTYCKKAFSDLPYFRTHEWAHTGGKPYDCEECGKSFISRSSIRRHRIMHSGDGPYKC

SEQ ID NO: 5702 - protein, 81 aa, Callithrix jacchus
MDLVAFEDIDVNFTQEEWALLDPSQKNLYRDVMWETMRNLASIGKKWKDQKIKDHYKHQGRNLRRHMVERLYQSRDGGQHG

SEQ ID NO: 5703 - protein, 81 aa, Callithrix jacchus
TLRRGQPKVLGWGLPKDQDSVAFEDVAVNFTHEEWALLGPTQKNLYRDVMQETIRNLNCIGMKWENQNTDDWYQNLRRNLR

SEQ ID NO: 5704 - protein, 81 aa, Callithrix jacchus
MLGHPEVQEMDPVTFEDVAVNFTQEEWALLDPSQKKLYRDVMWETFRNLASIGKQKEWNIDEEYKNQGKSLRSHMVERLFE

SEQ ID NO: 5705 - protein, 81 aa, Callithrix jacchus
EVQEMDPVTFEDVAVNFTQEEWALLDPSQKKLYRDVMWETFRNLASIGKQKEWNIDEEYKNQGKSLRSHMVERLFESKEVS

SEQ ID NO: 5706 - protein, 81 aa, Callithrix jacchus
MDSVAFEDVAVNFTHEEWALLGPTQKNLYRDVMQETIRNLNCIGMKWENQNTDDWYQNLRRNLRCDVVERFGKSKDGSQCG

SEQ ID NO: 5707 - protein, 81 aa, Callithrix jacchus
LGPTQKNLYRDVMQETIRNLNCIGMKWENQNTDDWYQNLRRNLRCDVVERFGKSKDGSQCGETLSQIRNSIVNKNTPARVD

SEQ ID NO: 5708 - protein, 81 aa, Callithrix jacchus
MDTVALEDVAVNFTQEEWALLGPSQKKLYRDVMQETIRNLDCIKMISEDQNIEDQYKNPKKNLRCRMAERLSESKDNSQCG

SEQ ID NO: 5709 - protein, 81 aa, Callithrix jacchus
PHTHKQCGKTFSYHHSFQSHGRPLTGKRCFECKECGKTFSSRRNLRRHMVLQGGNRPYKCKLCGKAFYWPSLLRMHERTHT

SEQ ID NO: 5710 - protein, 81 aa, Callithrix jacchus
MDSVAFEDVAVNFTQEEWALLGPSQKSLYRDVMWETIRNLDYIGMKWEDTNTEDQHKNPRRSLRCHIVERFRESNWISDSI

SEQ ID NO: 5711 - protein, 81 aa, Callithrix jacchus
MASVALEDVAVNFTREEWALLGPCQKNLYKDVMQETIRNLDCVGMKWKDQNIEDQYTYLRKNLRCYMLERFGESKDGRQCG

SEQ ID NO: 5712 - protein, 81 aa, Callithrix jacchus
MDSVVFEDVAVNFTQEEWALLGPSQKKLYRDVMQETFVNLASIGENWEDKNIEDHRNQGRKLRSHTVERLCERKEGNQLGE

SEQ ID NO: 5713 - protein, 81 aa, Callithrix jacchus
SDQRSRNKEARTPGSREMDSVVFEDVAVNFTQEEWALLGPSQKKLYRDVMQETFVNLASIGENWEDKNIEDHRNQGRKLRS

SEQ ID NO: 5714 - protein, 81 aa, Callithrix jacchus
MDSVASEDVAVNFTLEEWALLDPSQKKLYRDVMRETFRNLACVGKKWEDQSIEDWYKNQGRILSNHVEVGLSESKEHDQCG

SEQ ID NO: 5715 - protein, 81 aa, Callithrix jacchus
DSISLEDVAVNFTLEEWALLDPGQRNIYRDVMRATFKNLACIGEKWKDQDIEDDPKNQGRNLRGPMVETLCENKEDRECGK

SEQ ID NO: 5716 - protein, 81 aa, Callithrix jacchus
VLQMQNSVHHGQNIKTQTDSISLEDVAVNFTLEEWALLDPGQRNIYRDVMRATFKNLACIGEKWKDQDIEDDPKNQGRNLR

SEQ ID NO: 5717 - protein, 81 aa, Callithrix jacchus
MDSISLEDVAVNFTLEEWALLDPGQRNIYRDVMRATFKNLACIGEKWKDQDIEDDPKNQGRNLRGPMVETLCENKEDRECG

SEQ ID NO: 5718 - protein, 81 aa, Callithrix jacchus
MDSVAFEDVSVNFSQEEWALLAPSQKKLYRDVMQETFKNLASIGKKWENQNVEDQHKNQGKNLRSHTVERLCESKEGSQCG

SEQ ID NO: 5719 - protein, 81 aa, Callithrix jacchus
MESVTFGDVAVEFIQEWMLLDSVRRNLCRYGMLDKCRSLASRAWESQLKPKELPSMRDILEEASSRDMQMGPGLFLRMQLV

SEQ ID NO: 5720 - protein, 81 aa, Callithrix jacchus
RDILEEASSRDMQMGPGLFLRMQLVPSMEERETPSTQEDWPALQEPPWFPGCMGPKAAVQIQRTVMPVPTLGHPDPWVAGN

SEQ ID NO: 5721 - protein, 81 aa, Callithrix jacchus
DRVEEETMAPGLPTACSQEPVTFADVAVVFTPEEWVFLDSTQRSLYRDVMLENYRNLASVGDQLCKPNALSYLEQRGEQWT

SEQ ID NO: 5722 - protein, 81 aa, Callithrix jacchus
MESVTFGDVAVEFIQEWMLLDSVRRNLCRYGMLDKCRSLASRETPLFWESQLKPKELPSMRDILEEASSRDMQMGPGLFLR

SEQ ID NO: 5723 - protein, 81 aa, Callithrix jacchus
MESVTFGDVAVEFIQEWMLLDSVRRNLCRYGMLDKCRSLASRGARAVPEDAAGAVHGREGDTIDSRGLASSPGATLVSRMH

SEQ ID NO: 5724 - protein, 81 aa, Callithrix jacchus
EDRVEEETMAPGLPTACSQEPVTFADVAVVFTPEEWVFLDSTQRSLYRDVMLENYRNLASVAGDQLCKPNALSYLEQRGEQ

SEQ ID NO: 5725 - protein, 81 aa, Callithrix jacchus
MQMGPGLFLRMQLVPSMEERETPSTQEDWPALQEPPWFPGCMGPKAAVQIQRTVMPVPTLGHPDPWVAGNSAVSPGCPAWL

SEQ ID NO: 5726 - protein, 81 aa, Callithrix jacchus
MLENYRNLVFLAGIAVSKADLVTCLQQGKDPWNIKRHSMAATPPVINPPLAQDLWPVQGIKDSFQEVMLRRYGKCGTEDLQ

SEQ ID NO: 5727 - protein, 81 aa, Callithrix jacchus
GKDPWNIKRHSMAATPPVINPPLAQDLWPVQGIKDSFQEVMLRRYGKCGTEDLQLTTDCESVEECNLYKEGYNELNQCLTT

SEQ ID NO: 5728 - protein, 81 aa, Callithrix jacchus
MLENYRNLVFLGIAVSKADLVTCLQQGKDPWNIKRHSMAATPPVINPPLAQDLWPVQGIKDSFQEVMLRRYGKCGTEDLQL

SEQ ID NO: 5729 - protein, 81 aa, Callithrix jacchus
MDSVAFEDVAVNFTQEEWALLSPSRKQLYRDVMLETFKNLASVGIRWKDQDMENLYQNLGIEPRSLVERLCGRKEGSDHRE

SEQ ID NO: 5730 - protein, 81 aa, Callithrix jacchus
MNSVSFEDVAVNFTLEEWALLDSSQKKLYKDVMRETFKNLVCLGKRWEDQHIEDDHRNLGRNRRGHMVERLCESGKGSKCR

SEQ ID NO: 5731 - protein, 81 aa, Callithrix jacchus
MELLTFRDVTIEFSLEEWEFLNPAQQNLYRNVMLENYRNLVSLGLTISKPELISCLEQRQEPWSVKRHETVAKPPAISCHY

SEQ ID NO: 5732 - protein, 81 aa, Callithrix jacchus
MELLTFRDVTIEFSLEEWEFLNPAQQNLYRNVMLENYRNLVSLGLTISKPELISCLEQRQEPWSVKRHETVAKPPDILSLH

SEQ ID NO: 5733 - protein, 81 aa, Callithrix jacchus
MLENYRNLVSLGLTISKPELISCLEQRQEPWSVKRHETVAKPPAISCHYTEDSLTEQGVKDSFQKVILRRYGSCGLENLYL

SEQ ID NO: 5734 - protein, 81 aa, Callithrix jacchus
IFCFIFQELLTFRDVTIEFSLEEWEFLNPAQQNLYRNVMLENYRNLVSLGLTISKPELISCLEQRQEPWSVKRHETVAKPP

SEQ ID NO: 5735 - protein, 81 aa, Callithrix jacchus
MRPLEFMDVAVEFSLEEWHCLDTAQRNLYRDVMLENYRNLVFLGIAVSEPDLITRLEKGKKPLTVKRHEMIATPPVMRSHF

SEQ ID NO: 5736 - protein, 81 aa, Callithrix jacchus
MRPLEFMDVAVEFSLEEWHCLDTAQRNLYRDVMLENYRNLVFLGIAVSEPDLITRLEKGKKPLTVKRHEMIATPPDGVSLL

SEQ ID NO: 5737 - protein, 81 aa, Callithrix jacchus
MGPLTFRDVAIEFSLEEWQCLDTAQQDLYRKVMLENYRNLAFLGIAVSKPDLITCLEQGKEPWNMKRLEMVDEPPVTCSYF

SEQ ID NO: 5738 - protein, 81 aa, Callithrix jacchus
MGPLTFRDVAIEFSLEEWQCLDTAQQDLYRKVMLENYRNLAFLAGIAVSKPDLITCLEQGKEPWNMKRLEMVDEPPVTCSY

SEQ ID NO: 5739 - protein, 81 aa, Callithrix jacchus
MGPLTFRDVAIEFSLEEWQCLDTAQQDLYRKVMLENYRNLAFLGIAVSKPDLITCLEQGKEPWNMRRLEMVDEPPVIYSHF

SEQ ID NO: 5740 - protein, 81 aa, Callithrix jacchus
MPESPGSLEMGPLTFRDVAIEFSLEEWQCLDTAQQDLYRKVMLENYRNLAFLAGIAVSKPDLITCLEQGKEPWNMRRLEMV

SEQ ID NO: 5741 - protein, 81 aa, Callithrix jacchus
MGPLTFSDVAIEFSLEEWQCLDAAQQNLYRNVMLENYRNLVFLGIAVCKPDLIISLEQEKEVWSRKRQEIMVAKPPVMHSH

SEQ ID NO: 5742 - protein, 81 aa, Callithrix jacchus
MEPLGFRDVAIEFSLEEWHCLDTAQRNLYWDVMLENYRNLVFLVMHSHFAQDLWPEQGIKDSFQKMILRKYEKCEHDNLQL

SEQ ID NO: 5743 - protein, 81 aa, Callithrix jacchus
MEPLGFRDVAIEFSLEEWHCLDTVQRNLYWDVMLENYRNLVFLVMHSHFAQDLWPEQGIKDSFQKMILRRYEKCEHDNLQL

SEQ ID NO: 5744 - protein, 81 aa, Callithrix jacchus
MGPLTFMDVAIEFSLEEWQCLDTAQQNLYRNVMLENYRNFVFLGIAVSNLDLITCLEQGKEPWNMKRHEMVAKSPVIYSDF

SEQ ID NO: 5745 - protein, 81 aa, Callithrix jacchus
MLENYRNLVFLGIAVSKQNPVTCLEQGKEPRNMIRYEIMAKPKAMCYFPKNLWPEQDMKGSSKQVILRRYGKCGHENLQLR

SEQ ID NO: 5746 - protein, 81 aa, Callithrix jacchus
METLTFRDVAIEFSLEEWQCLDTAQQNLYRNVMLENYRNLVFLAGIAVSKQNPVTCLEQGKEPRNMIRYEIMAKPKAMCYF

SEQ ID NO: 5747 - protein, 81 aa, Callithrix jacchus
METLTFRDVAIEFSLEEWQCLDTAQQNLYRNVMLENYRNLVFLGIAVSKQNPVTCLEQGKEPRNMIRYEIMAKPKAMCYFP

SEQ ID NO: 5748 - protein, 81 aa, Callithrix jacchus
METLTFRDVAIEFSLEEWQCLDTAQQSLYRNVMLENYRNLVFLAGIAVSKQNPVTCLEQGKEPQNMIRYEIMAKPTAMCYF

SEQ ID NO: 5749 - protein, 81 aa, Callithrix jacchus
METLTFRDVAIEFSLEEWQCLDTAQQSLYRNVMLENYRNLVFLGIAVSKQNPVTCLEQGKEPQNMIRYEIMAKPTAMCYFP

SEQ ID NO: 5750 - protein, 81 aa, Callithrix jacchus
MGPLTFRDVAIEFSLEEWQCLDTAQQDLYRKVMLENYRNLVFLGIAVSKADLITCLQQGKDPWNMKRHSMAATPPVLCSHF

SEQ ID NO: 5751 - protein, 81 aa, Callithrix jacchus
MGPLTFRDVAIEFSLEEWQCLDTAQQDLYRKVMLENYRNLVFLAGIAVSKADLITCLQQGKDPWNMKRHSMAATPPVLCSH

SEQ ID NO: 5752 - protein, 81 aa, Callithrix jacchus
MGPLTFRDVAIEFSLEEWQCLDTAQQDLYRKVMLENYRNLAFLAGIAVSKADPITFLQQGKDPWNMKRHSMAATPPVLCSH

SEQ ID NO: 5753 - protein, 81 aa, Callithrix jacchus
MGPLTFRDVAIEFSLEEWQCLDTAQQDLYRKVMLENYRNLAFLGIAVSKADPITFLQQGKDPWNMKRHSMAATPPVLCSHF

SEQ ID NO: 5754 - protein, 81 aa, Callithrix jacchus
MGPLTFRDVAIEFSLEEWQCLDTAQQDLYRKVMLENYRNLVFLGIAVSKADPITCLQQEKDPWNMKRHSMAATPPVLCSHF

SEQ ID NO: 5755 - protein, 81 aa, Callithrix jacchus
LVFLGIAVSKADPITCLQQEKDPWNMKRHSMAATPPVLCSHFGQDLWPKLGIKDSFQEVTLREMENVDIRIYSYEKVVKSE

SEQ ID NO: 5756 - protein, 81 aa, Callithrix jacchus
MGPLTFRDVAIEFSLEEWQCLDTAQQDLYRKVMLENYRNLVFLAGIAVSKADPITCLQQEKDPWNMKRHSMAATPPVLCSH

SEQ ID NO: 5757 - protein, 81 aa, Callithrix jacchus
VFLAGIAVSKADPITCLQQEKDPWNMKRHSMAATPPVLCSHFGQDLWPKLGIKDSFQEVTLREMENVDIRIYSYEKVVKSE

SEQ ID NO: 5758 - protein, 81 aa, Callithrix jacchus
GPLTFRDVAIEFSLEEWQCLDTAQKELYRKVMLENYRNLAFLAGIAVSKADPITCLQQEKDPWNMKRHSMVATPPVLCSHF

SEQ ID NO: 5759 - protein, 81 aa, Callithrix jacchus
MGPLTFRDVAIEFSLEEWQCLDTAQKELYRKVMLENYRNLAFLGIAVSKADPITCLQQEKDPWNMKRHSMVATPPVLCSHF

SEQ ID NO: 5760 - protein, 81 aa, Callithrix jacchus
MGPLTFRDVAIEFSLEEWQCLDTAQKELYRKVMLENYRNLAFLAGIAVSKADPITCLQQEKDPWNMKRHSMVATPPVLCSH

SEQ ID NO: 5761 - protein, 81 aa, Callithrix jacchus
MGPLTFRDVAIEFSLEEWQCLNPAQQDLYRKVMLENYRNLVFLGRSDHLSAGRKRSLEYEETQYGSHTPRISLLLSRLECN

SEQ ID NO: 5762 - protein, 81 aa, Callithrix jacchus
LLGSSNSPASASRIAGTTVIYSRFAQDLWPEQGIKDSFQEVMLRRYRKCGHEDLQLRTGCKSVEECNLHKEGYNELNQCLT

SEQ ID NO: 5763 - protein, 81 aa, Callithrix jacchus
MGPLTFRDVAIEFSLEEWQCLNPAQQDLYRKVMLENYRNLVFLDLITCLQEEKDPWNMKRHSMAATPPVIYSRFAQDLWPE

SEQ ID NO: 5764 - protein, 81 aa, Callithrix jacchus
EEKDPWNMKRHSMAATPPVIYSRFAQDLWPEQGIKDSFQEVMLRRYRKCGHEDLQLRTGCKSVEECNLHKEGYNELNQCLT

SEQ ID NO: 5765 - protein, 81 aa, Callithrix jacchus
MGPLTFRDVAIEFSLEEWQCLNPAQQDLYRKVMLENYRNLVFLAGIAVSKADLITCLQEEKDPWNMKRHSMAATPPVIYSR

SEQ ID NO: 5766 - protein, 81 aa, Callithrix jacchus
MGPLTFRDVAIEFSLEEWQCLNPAQQDLYRKVMLENYRNLVFLGIAVSKADLITCLQEEKDPWNMKRHSMAATPPVIYSRF

SEQ ID NO: 5767 - protein, 81 aa, Callithrix jacchus
MGSLTFRDVAIEFSLEEWQCLDTAQQDLYRKVMLENYANLAFLGIAVSKADLITCLQQEKDPWNVKRHSMAATPPVLCSHF

SEQ ID NO: 5768 - protein, 81 aa, Callithrix jacchus
MGSLTFRDVAIEFSLEEWQCLDTAQQDLYRKVMLENYANLAFLAGIAVSKADLITCLQQEKDPWNVKRHSMAATPPVLCSH

SEQ ID NO: 5769 - protein, 81 aa, Callithrix jacchus
METLTFRDVAIEFSLEEWQCLNPAQQDLYRNVMLENYRNLVFLGITVCKENPITCLVQGKEPCNVKRHEMVARPNAMCSYF

SEQ ID NO: 5770 - protein, 81 aa, Callithrix jacchus
METLTFRDVAIEFSLEEWQCLNPAQQDLYRNVMLENYRNLVFLAGITVCKENPITCLVQGKEPCNVKRHEMVARPNAMCSY

SEQ ID NO: 5771 - protein, 81 aa, Callithrix jacchus
METLTFRDVAIEFSLEEWQCLNPAQQDLYRNVMLENYRNLVFLGITVCKENPITCLVQGKEPCNVKRHEMVARPNAICSYF

SEQ ID NO: 5772 - protein, 81 aa, Callithrix jacchus
METLTFRDVAIEFSLEEWQCLNPAQQDLYRNVMLENYRNLVFLAGITVCKENPITCLVQGKEPCNVKRHEMVARPNAICSY

SEQ ID NO: 5773 - protein, 81 aa, Callithrix jacchus
KWMPWGSEESSGVLFFFEKETLTFRDVAIEFSLEEWQCLNPAQQDLYRNVMLETYRNLVFLAMCSYFPKYFWPEQHIKGSF

SEQ ID NO: 5774 - protein, 81 aa, Callithrix jacchus
AAIGSSTAMTPGPPGAIEMETLTFRDVAIEFSLEEWQCLNPAQQDLYRNVMLETYRNLVFLAMCSYFPKYFWPEQHIKGSF

SEQ ID NO: 5775 - protein, 81 aa, Callithrix jacchus
MPGDSESCETGPLTFRDVAIEFSLEEWQCLDTAQQDLYRKVMLENYRNLVFLGIAVSTPDWITCLEQGKDPWNMKRHSVVV

SEQ ID NO: 5776 - protein, 81 aa, Callithrix jacchus
MPGDSESCETGPLTFRDVAIEFSLEEWQCLDTAQQDLYRKVMLENYRNLVFLAGIAVSTPDWITCLEQGKDPWNMKRHSVV

SEQ ID NO: 5777 - protein, 81 aa, Callithrix jacchus
MLENYRNLVFLGIAVSTPDWITCLEQGKDPWNMKRHSVVVTPPVLCSHFGQDLGQRPGIKDSFQKVILREYVKCGHKDLQL

SEQ ID NO: 5778 - protein, 81 aa, Callithrix jacchus
MGPLTFMDVAIEFCLEEWQCLDTAQQNLYRNVMLENYRNLVFLGIAVSKPDLITCLEQEKEPWNMKRHEMVAKSSVMCSHF

SEQ ID NO: 5779 - protein, 81 aa, Callithrix jacchus
LRRYKNGEHKNLHLKKDCKSMDECKVHREGCNGFNQCLPPTQRKTFLFDKCVKAFHKFSNSNRHKISHTEKKLFKCKECGK

SEQ ID NO: 5780 - protein, 81 aa, Callithrix jacchus
APLTFRDVTVEFSLEEWQCLDTAQQNLYRDVMLENYRNLAFLGIAVSKPDMITCLEQGKEPWNMKRPEMVAKPPVICSHFA

SEQ ID NO: 5781 - protein, 81 aa, Callithrix jacchus
MAPLTFRDVTVEFSLEEWQCLDTAQQNLYRDVMLENYRNLAFLGIAVSKPDMITCLEQGKEPWNMKRPEMVAKPPVICSHF

SEQ ID NO: 5782 - protein, 81 aa, Callithrix jacchus
MTPGPPGSLEMEPLTFKDVAIEFSLEEWQCLDTAQQDLYRNVMLENYGNLVFLGIAVSKPDLITCLEQGKVPWNRKRHEMV

SEQ ID NO: 5783 - protein, 81 aa, Callithrix jacchus
MTPGPPGSLEMEPLTFKDVAIEFCLEEWQCLDTAQQDLYRNVMLENYGNLVFLGIAVSKPDLITCLEQRKVPWNRKRHEMV

SEQ ID NO: 5784 - protein, 81 aa, Callithrix jacchus
MTPGPPGSLEMEPLTFKDVAIEFCLEEWQCLDTAQQDLYRNVMLENYRNLVFLGIAVSKPDLITCLEQGKVPWNRKRHEMV

SEQ ID NO: 5785 - protein, 81 aa, Callithrix jacchus
WTPVKHAVFEIHLLKLKKKIYASNRTTETWSSWRPLTFMDVAIEFSLEEWQCLNTAQKNLYRNVMLRTTETWFSWVLQCLM

SEQ ID NO: 5786 - protein, 81 aa, Callithrix jacchus
RRWGFFLLVQLVSDSQHQGVLTFREVAIEFCLEEWQCLDTAQRNLYRNVMLENYRNLVFLGIAASKPDLITCLEQGKEPWN

SEQ ID NO: 5787 - protein, 81 aa, Callithrix jacchus
WYWRSTPKMSGPPGSLEMGVLTFREVAIEFCLEEWQCLDTAQRNLYRNVMLENYRNLVFLGIAASKPDLITCLEQGKEPWN

SEQ ID NO: 5788 - protein, 81 aa, Callithrix jacchus
MGLLTFRDVAIEFSLTEWQFLDTAQRNLYRNVMLENYENLVFLGIAVSKPDLITCLEQEKEFWNMKRHEMVDKPPVMCSHI

SEQ ID NO: 5789 - protein, 81 aa, Callithrix jacchus
MLENYENLVFLGIAVSKPDLITCLEQEKEFWNMKRHEMVDKPPVMCSHIIQDLLPEKNIEDSFHKVTLTRDEKYEHTNFLL

SEQ ID NO: 5790 - protein, 81 aa, Callithrix jacchus
MGQLTFNDVIIEFSLEEWQCLDKTQQNFYRDVMLENYRNLVFVGIAVSKPDLITCLKEGKEPWSMRRHEMVTKPPAPSESA

SEQ ID NO: 5791 - protein, 81 aa, Callithrix jacchus
MDVAIEFSLEEWQCLDTAQQNLYRNVMLENYRNLVFLGIAVSKPDLITFLDQEKKPWNIKRREMVPKPSVICSHFSQDLWE

SEQ ID NO: 5792 - protein, 81 aa, Callithrix jacchus
MGPLTFMDVAIEFSLEEWQCLDTAQQNLYRNVMLENYRNLVFLGIAVSKPDLITFLDQEKKPWNIKRREMVPKPSVICSHF

SEQ ID NO: 5793 - protein, 81 aa, Callithrix jacchus
MGPLTFMDVTVEFSLEEWQCLDIAQQNLYRDVMLENYRNLVFLSIVSKPDMITCLEQGIEPWNIKRYKLVAKPPGSVNQAS

SEQ ID NO: 5794 - protein, 81 aa, Callithrix jacchus
MRPLTFMDVAIEFSLEEWQCLDTTQQNLYRNVMLENYRNMVFLGIAVSKPDLIACLEQGKEPWNLKRQEMVAKPPGMRSYF

SEQ ID NO: 5795 - protein, 81 aa, Callithrix jacchus
MGLLTFRDVAIEFSLEEWQCLDAAQRNLYKNVILENYRNLVFLGIAVSKPDLIACLEQEKEPLIMKRDEMADEPPVMCSHF

SEQ ID NO: 5796 - protein, 81 aa, Callithrix jacchus
MGLLTFRDVAIEFSLEEWQCLDTAQRNLYKNVILENYRNLVFLGIAVSKPDLIACLEQEKEPLIMKRDEMADEPPVMCSHF

SEQ ID NO: 5797 - protein, 81 aa, Callithrix jacchus
MGLLTFRDVAIEFSLEEWQCLDTAQRNLYKNVILENYRNLVFLGIAVSKPDLITCLEQEKEPLIMKRDEMADEPPVMCSHF

SEQ ID NO: 5798 - protein, 81 aa, Callithrix jacchus
GLLTFRDVAIEFSLEEWQCLDTAQRNLYKNVILENYRNLVFLGIAVSKPDLITCLEQEKEPLIMKRDEMADEPPESCSVAH

SEQ ID NO: 5799 - protein, 81 aa, Callithrix jacchus
MGLLTFRDVAIEFSLEEWQCLDTAQRNLYKNVILENYRNLVFLGIAVSKPDLITCLEQEKEPLIMKREEMADEPPVMCSQF

SEQ ID NO: 5800 - protein, 81 aa, Callithrix jacchus
MGLLTFRDVAIEFSLGEWQCLDTAQRNLYKNVILENYRNLVFLGIAISKPDLIACLEQEKEPLIMKRDEMADEPPVICSHF

SEQ ID NO: 5801 - protein, 81 aa, Callithrix jacchus
AIEFSLGEWQCLDTAQRNLYKNVILENYRNLVFLGIAISKPDLIACLEQEKEPLIMKRDEMADEPPVICSHFAQDFSQSRT

SEQ ID NO: 5802 - protein, 81 aa, Callithrix jacchus
MGLLTFRDVAIEFSLGEWQCLDTAQRNLYKNVILENYRNLVFLGIAISKPDLIACLEQEKEPLIMKRDEMADEPPGIAVSK

SEQ ID NO: 5803 - protein, 81 aa, Callithrix jacchus
GLLTFRDVAIEFSLGEWQCLDTAQRNLYKNVILENYRNLVFLGIAISKPDLIACLEQEKEPLIMKRDEMADEPPVMCSHFA

SEQ ID NO: 5804 - protein, 81 aa, Callithrix jacchus
MGLLTFRDVAIEFSLEEWQCLDTAQWNLYKNVILENYRNLVFLGIAVSKPDLIAGLEQEKEPLIMKRDEMAGEPPVMCSHF

SEQ ID NO: 5805 - protein, 81 aa, Callithrix jacchus
MEPLKFRDLVIEFSLEEWQCLDSAQRNLYRNVMLENYRNLVFLGIAVSKPDLITWLEQEKEAWTIERHEMVAKPPEKKQHK

SEQ ID NO: 5806 - protein, 81 aa, Callithrix jacchus
MPGPPGSLEMDPLTFRDVAIEFSLEEWQCLDTAQQNLYRNVMLENYKNLAFLGIAVSKPDLITRLEKEKEPWKMKRHRMVD

SEQ ID NO: 5807 - protein, 81 aa, Callithrix jacchus
MGLLTFRDVAIEFSLEEWQCLDTAQQNLYRNVMLENYRNLAFLGIAASKPDLITCLEKAKEPWKMKRHVMVDELPVICPHF

SEQ ID NO: 5808 - protein, 81 aa, Callithrix jacchus
WYWRSTAEMPGPPGSLKMGVLTFRDVAIEFSRKEWQCLDTAQRNLYRNVMLENYGNLVFLGIAASKPDLITCLEQGQEPWN

SEQ ID NO: 5809 - protein, 81 aa, Callithrix jacchus
MLENYGNLVFLGIAASKPDLITCLEQGQEPWNVKRHEFEAKLPVASSYFAQDFWPKQDIKNHFQKLILRRYKKCGHENFQL

SEQ ID NO: 5810 - protein, 81 aa, Callithrix jacchus
MGVLTFRDVAIEFSQKEWQCLDTAQRNLYRNVMLENYGNLVYLGIATSKPDLITCLEQGQEPWNVKRHEFEAKLPVASSYF

SEQ ID NO: 5811 - protein, 81 aa, Callithrix jacchus
HPKPEPKPKKAPAKKGEKGVLTFRDVAIEFSRKEWQCLDTAQRNLYSNVMLENYGNLVFLGIAASKPDLITCLEQGKEPWN

SEQ ID NO: 5812 - protein, 81 aa, Callithrix jacchus
MLENYGNLVFLGIAASKPDLITCLEQGKEPWNVKRHEFEAKLPVASSYFAQDLWPKQGIQNHFQKVILRRYKKYGHENFQL

SEQ ID NO: 5813 - protein, 81 aa, Callithrix jacchus
MSQVTFSDVAIDFSHEEWEWLDSAQRDLYKDVMVQNYENLASLGLSITKPHVITLLEDGKEPWMVEEKMSKGVTPDWESRL

SEQ ID NO: 5814 - protein, 81 aa, Callithrix jacchus
MSQVTFSDVAIDFSHEEWEWLDSAQRDLYKDVMVQNYENLASLAGLSITKPHVITLLEDGKEPWMVEEKMSKGVTPDWESR

SEQ ID NO: 5815 - protein, 81 aa, Callithrix jacchus
MSQVTFSDVAIDFSHEEWEWLDSAQRDLYKDVMVQNYENLASLGLSITKPHVITLLEDGKEPWMVEEKLSKGVTPDWESRW

SEQ ID NO: 5816 - protein, 81 aa, Callithrix jacchus
ESPAFLTPEVTFSDVAIDFSHEEWEWLDSAQRDLYKDVMVQNYENLASLGLSITKPHVITLLEDGKEPWMVEEKLSKGVTP

SEQ ID NO: 5817 - protein, 81 aa, Callithrix jacchus
ILAHHNLRLPGSSHSASAYQVTFSDVAIDFSHEEWEWLDSAQRDLYKDVMVQNYENLASLGLSITKPHVITLLEDGKEPWM

SEQ ID NO: 5818 - protein, 81 aa, Callithrix jacchus
MSQVTFSDVAIDFSHEEWEWLDSAQRDLYKDVMVQNYENLASLGLSITKPHVITLLEDGKEPWMVEEKMSKGVTPDWESRW

SEQ ID NO: 5819 - protein, 81 aa, Callithrix jacchus
MAAPALALVSFEDVVVTFTGEEWGHLDLAQRTLYQEVMLETFRLLISLGHPVPKPEMIYLLEHGQEPWTEKRGLSQSTCAG

SEQ ID NO: 5820 - protein, 81 aa, Callithrix jacchus
MAAPALALVSFEDVVVTFTGEEWGHLDLAQRTLYQEVMLETFRLLISLGHPVPKPEMIYLLEHGQEPWTEKRGLSQSTCAA

SEQ ID NO: 5821 - protein, 81 aa, Callithrix jacchus
MAAAAAALRDPAQGCVTFKDVTIYFSKEEWGLLDEAQRLLYCDVMLENFALIASLGLISFRSHIVSQLEMGKEPWVPDSMD

SEQ ID NO: 5822 - protein, 81 aa, Callithrix jacchus
MAQGLVTFRDVAIEFSLEEWKCLEPAQRDLYREVTLENFGHLVSLGLSIPKPDVISLLEQGKEPWIIANDVTGPWCPDLES

SEQ ID NO: 5823 - protein, 81 aa, Callithrix jacchus
EFREIRAGQIVLKAMAQGLVTFRDVAIEFSLEEWKCLEPAQRDLYREVTLENFGHLVSLGLSIPKPDVISLLEQGKEPWII

SEQ ID NO: 5824 - protein, 81 aa, Callithrix jacchus
MNMEGLVMFQDLSIDFSQEEWECLNPAQKDLYRDVMMENYSSLLSLGLSIPKPDVISLLEQGKEPWMVSRDILGGWCPDRL

SEQ ID NO: 5825 - protein, 81 aa, Callithrix jacchus
MNMEGLVMFQDLSIDFSQEEWECLNPAQKDLYRDVMMENYSSLLSLGLSIPKPDVISLLEQGKEPWMVSRDILGGWCPDLE

SEQ ID NO: 5826 - protein, 81 aa, Callithrix jacchus
MDVMLENYCHLISVGCHMTKPDVILKLERGEEPWTSFAGHTRLEENWKAEDFLVKFREHREKYSRSDVSINHKKLVKEKNK

SEQ ID NO: 5827 - protein, 81 aa, Callithrix jacchus
MAQGSVSFNDVTVDFTQEEWQHLDHAQKTLYMDVMLENYCHLISVGCHMTKPDVILKLERGEEPWTSFAGHTRLEENWKAE

SEQ ID NO: 5828 - protein, 81 aa, Callithrix jacchus
MAHELVMFRDVAIDVSQEEWECLNPAQRNLYKDVMLENYSNLVSLGLSVSKPAIISSLEQGKEPWMVVREESGRWCPDLAS

SEQ ID NO: 5829 - protein, 81 aa, Callithrix jacchus
MAHELVMFRDVAIDVSQEEWECLNPAQRNLYKDVMLENYSNLVSLGLSVSKPAIISSLEQGKEPWMVVREESGRWCPGTWK

SEQ ID NO: 5830 - protein, 81 aa, Callithrix jacchus
MAHELVMFRDVAIDVSQEEWECLNPAQRNLYKDVMLENYSNLVSLGLSVSKPAIISSLEQGKEPWMVVREESGRWCPGILK

SEQ ID NO: 5831 - protein, 81 aa, Callithrix jacchus
LTHELVMFRDVAIDVSQEEWECLNPAQRNLYKDVMLENYSNLVSLGLSVSKPAIISSLEQGKEPWMVVREESGRWCPGTWK

SEQ ID NO: 5832 - protein, 81 aa, Callithrix jacchus
MPLQGSVSFKDVTVDFTQEEWQQLDPAQKALYRDVMLENYCHFISVGFHMAKPDMIRKLEQGEELWTQRIFPSYSYLEADG

SEQ ID NO: 5833 - protein, 81 aa, Callithrix jacchus
FHMAKPDMIRKLEQGEELWTQRIFPSYSYLEADGKTEDVLVKFKEYQDRHSRSLILINHKKLIKERSNIYGKTLTLGKNHI

SEQ ID NO: 5834 - protein, 81 aa, Callithrix jacchus
MSQGSVSFKDVTVDFTQEEWQQLDPAQKALYRDVMLENYCHFISVGFHMAKPDMIRKLEQGEELWTQRIFPSYSYLEADGK

SEQ ID NO: 5835 - protein, 81 aa, Callithrix jacchus
MPLQGSVSFKDVTVDFTQEEWQQLDPAQKALYRDVMLENYCHFISVGFHMAKPDMIRKLEQGEELWTQRIFPSYSYLADGK

SEQ ID NO: 5836 - protein, 81 aa, Callithrix jacchus
GFHMAKPDMIRKLEQGEELWTQRIFPSYSYLADGKTEDVLVKFKEYQDRHSRSLILINHKKLIKERSNIYGKTLTLGKNHI

SEQ ID NO: 5837 - protein, 81 aa, Callithrix jacchus
MMENYSNLLSLDLESKYDTKLLSVGTDIIKNTGSQWEVMESSKLCGLENSIFRNDWQSKNKAEVQGPKVGYFSQMKTNSQN

SEQ ID NO: 5838 - protein, 81 aa, Callithrix jacchus
YSNLLSLDLESKYDTKLLSVGTDIIKNTGSQWEVMESSKLCGLENSIFRNDWQSKNKAEVQGPKVGYFSQMKTNSQNVPSY

SEQ ID NO: 5839 - protein, 81 aa, Callithrix jacchus
MPEVKFPDQFFTVLTMDHELVTFRDVLINFSQEEWEYLDSAQRNLYWDVMMENYSNLLSLDLESKYDTKLLSVGTDIIKNT

SEQ ID NO: 5840 - protein, 81 aa, Callithrix jacchus
TVLTMDHELVTFRDVLINFSQEEWEYLDSAQRNLYWDVMMENYSNLLSLDLESKYDTKLLSVGTDIIKNTGSQWEVMESSK

SEQ ID NO: 5841 - protein, 81 aa, Callithrix jacchus
MALRSVIFSDISIDFSPEEWEYLDLEQKDLYRDVMLENYSNLVSLGCFISKPDVISLLEQGKEPWKVVRKRRRQYPDLETK

SEQ ID NO: 5842 - protein, 81 aa, Callithrix jacchus
MAHGSVTFRDVAIDFSQEEWEFLDPAQRDLYRDVMWENYSNFISLGPSISKPDVITLLGEEGKEPGMVVREGIGRYCPDLD

SEQ ID NO: 5843 - protein, 81 aa, Callithrix jacchus
MAHGSVTFRDVAIDFSQEEWEFLDPAQRDLYRDVMWENYSNFISLAGPSISKPDVITLLGEEGKEPGMVVREGIGRYCPGE

SEQ ID NO: 5844 - protein, 81 aa, Callithrix jacchus
MAHGSVTFRDVAIDFSQEEWEFLDPAQRDLYRDVMWENYSNFISLDLDSRYRTSTLSLEKDVYEIYSFQWDIMERIKSYSL

SEQ ID NO: 5845 - protein, 81 aa, Callithrix jacchus
CSQEFALSEEEEDTTRSLETVTFKDVAVDLTQEEWEQMKPAQRNLYRDVMLENYSNLVTVGCQVTKPDVIFKLEQEEEPWV

SEQ ID NO: 5846 - protein, 81 aa, Callithrix jacchus
QEEWEQMKPAQRNLYRDVMLENYSNLVTVGCQVTKPDVIFKLEQEEEPWVMEEEMFGRHCPEPRRGENCCASEVMVEVEFH

SEQ ID NO: 5847 - protein, 81 aa, Callithrix jacchus
VDLTQEEWEQMKPAQRNLYRDVMLENYSNLVTVGCQVTKPDVIFKLEQEEEPWVMEEEMFGRHCPEPRRGENCCASEVMVE

SEQ ID NO: 5848 - protein, 81 aa, Callithrix jacchus
EEWEQMKPAQRNLYRDVMLENYSNLVTVGCQVTKPDVIFKLEQEEEPWVMEEEMFGRHCPESCSVTQAGERWCHLGSLQPP

SEQ ID NO: 5849 - protein, 81 aa, Callithrix jacchus
DPEEEERMHDELLQAVSKGSVMFRDVSIDFSQEEWECLDSGQMNLYKEVMLENFSNLVSVGLSSSKPAVISLLEQGREPWM

SEQ ID NO: 5850 - protein, 81 aa, Callithrix jacchus
EEEERMHDELLQAVSKGSVMFRDVSIDFSQEEWECLDSGQMNLYKEVMLENFSNLVSVGLSSSKPAVISLLEQGREPWMVD

SEQ ID NO: 5851 - protein, 81 aa, Callithrix jacchus
MAHLMFRDVAIDFSQEEWEGLDLKQRDLYRDVMLENYSNMVSLGFCVYQPDVFSLLEKGKEPWKILRDETRGPCPDMQSRC

SEQ ID NO: 5852 - protein, 81 aa, Callithrix jacchus
CQVGLIRSYNSKTMTCFQELVTFRDVAIDFSGQEWEYLDPHQRDLYRDVMLENYRNLVSLGGHSISKPVLVDLLEQGKEPW

SEQ ID NO: 5853 - protein, 81 aa, Callithrix jacchus
CQVGLIRSYNSKTMTCFQELVTFRDVAIDFSGQEWEYLDPHQRDLYRDVMLENYRNLVSLEMRSYCVAQVGPKLLVSSDPP

SEQ ID NO: 5854 - protein, 81 aa, Callithrix jacchus
TCNWRRPLKCCPTKYVKFQELVTFRDVAIDFSGQEWEYLDPHQRDLYRDVMLENYRNLVSLGGHSISKPVLVDLLEQGKEP

SEQ ID NO: 5855 - protein, 81 aa, Callithrix jacchus
ELCQVGLIRSYNSKTMTCELVTFRDVAIDFSGQEWEYLDPHQRDLYRDVMLENYRNLVSLGGHSISKPVLVDLLEQGKEPW

SEQ ID NO: 5856 - protein, 81 aa, Callithrix jacchus
CNWRRPLKCCPTKYVKFQELVTFRDVAIDFSGQEWEYLDPHQRDLYRDVMLENYRNLVSLGGHSISKPVLVDLLEQGKEPW

SEQ ID NO: 5857 - protein, 81 aa, Callithrix jacchus
MLENYRNLVSLGGHSISKPVLVDLLEQGKEPWMILREETQFPDLDLQCEIFSYIEVPTYDTDISSIQHQTIYQREKLYECK

SEQ ID NO: 5858 - protein, 81 aa, Callithrix jacchus
MACRSITFRDVAIDFSHQEWEYLNLVQKTLYQEVMMENYDNLVSLGHSISKPDLITLLEQGKEPWMIVREETRGECTDLDS

SEQ ID NO: 5859 - protein, 81 aa, Callithrix jacchus
MAHDLVMFRDVAVDFSQEEWECLNSYQRNLYRDVILENYSNLVSLGCSISKPDVITLLEQGKEPWLVERDEKRRWSLDLES

SEQ ID NO: 5860 - protein, 81 aa, Callithrix jacchus
MAHDLVMFRDVAVDFSQEEWECLNSYQRNLYRDVILENYSNLVSLAGCSISKPDVITLLEQGKEPWLVERDEKRRWSLDLE

SEQ ID NO: 5861 - protein, 81 aa, Callithrix jacchus
MAHDLVMFRDVAVDFSQEEWECLNSYQRNLYRDVILENYSNLVSLGCSISKPDVITLLEQGKEPWLVERDEKRRWSLGPTF

SEQ ID NO: 5862 - protein, 81 aa, Callithrix jacchus
MAHALVTFRDVAINFSQKEWECLDPTQRKLYRDVMLENYSNLVSLGYSGSKPDVITLLEQGKEPCVAVRDMTGRQYPGLLS

SEQ ID NO: 5863 - protein, 81 aa, Callithrix jacchus
MAHALVTFRDVAINFSQKEWECLDPTQRKLYRDVMLENYSNLVSLGLLSRHKTKKLSSEKDIHEISFSKGNIIEKSKTLHL

SEQ ID NO: 5864 - protein, 81 aa, Callithrix jacchus
MAHALVTFRDVAINFSQKEWECLDPTQRKLYRDVMLENYSNLVSLAGYSGSKPDVITLLEQGKEPCVAVRDMTGRQYPGLL

SEQ ID NO: 5865 - protein, 81 aa, Callithrix jacchus
MPHLLVTFRDVAIDFSQEEWECLDPAQRDLYRDVMLENYSNLISLDLESSHEINELSPEKEIYEMESLQWENMGKFINHHL

SEQ ID NO: 5866 - protein, 81 aa, Callithrix jacchus
MDLLFQLLVTFRDVAIDFSQEEWECLDPAQRDLYRDVMLENYSNLISLDLESSHEINELSPEKEIYEMESLQWENMGKFIN

SEQ ID NO: 5867 - protein, 81 aa, Callithrix jacchus
MINYQTPVSFRDVVVGFTQEEWHRLNPTQRALYRDVMLETYSNLVSVGYEGTKPDVILRLEQEEAPWIGEAACLGCHCWED

SEQ ID NO: 5868 - protein, 81 aa, Callithrix jacchus
MINYQTPVSFRDVVVGFTQEEWHRLNPTQRALYRDVMLETYSNLVSVGYEGTKPDVILRLEQEEAPWIGEAACLGCHCWGI

SEQ ID NO: 5869 - protein, 81 aa, Callithrix jacchus
VVVGFTQEEWHRLNPTQRALYRDVMLETYSNLVSVGYEGTKPDVILRLEQEEAPWIGEAACLGCHCWGISKPWPADWPPAL

SEQ ID NO: 5870 - protein, 81 aa, Callithrix jacchus
MINYQTPVSFRDVVVGFTQEEWHRLNPTQRALYRDVMLETYSNLVSVGYEGTKPDVILRLEQEEAPWIGEAACLGCHCWGK

SEQ ID NO: 5871 - protein, 81 aa, Callithrix jacchus
EWHRLNPTQRALYRDVMLETYSNLVSVGYEGTKPDVILRLEQEEAPWIGEAACLGCHCWGKCDKSGKRGPEGGHLWNFVQC

SEQ ID NO: 5872 - protein, 81 aa, Callithrix jacchus
EWHRLNPTQRALYRDVMLETYSNLVSVGYEGTKPDVILRLEQEEAPWIGEAACLGCHCWEDIWKVNIQRKRRQDVLLRQGA

SEQ ID NO: 5873 - protein, 81 aa, Callithrix jacchus
SFRDVVVGFTQEEWHRLNPTQRALYRDVMLETYSNLVSVGYEGTKPDVILRLEQEEAPWIGEAACLGCHCWALTYLRELQP

SEQ ID NO: 5874 - protein, 81 aa, Callithrix jacchus
RDVVVGFTQEEWHRLNPTQRALYRDVMLETYSNLVSVGYEGTKPDVILRLEQEEAPWIGEAACLGCHCWALTYLRELQPHE

SEQ ID NO: 5875 - protein, 81 aa, Callithrix jacchus
MAVGLLKAMYQELVTFRDVAVDFSQEEWDCLDSSQRHLYSNVMLENYRILVSLGLCFSKPGVILLLEQGKAPWMVKRELTK

SEQ ID NO: 5876 - protein, 81 aa, Callithrix jacchus
PLCETEELTPKQEFYEEHQSQQIIETLTRYNLEYSSLREEWKCKGYFERQPGNQKACFKEEIITHEEALVNEREQEYKSWG

SEQ ID NO: 5877 - protein, 81 aa, Callithrix jacchus
KSQQEGRMAVGLLKAMYQELVTFRDVAVDFSQEEWDCLDSSQRHLYSNVMLENYRILVSLGLCFSKPGVILLLEQGKAPWM

SEQ ID NO: 5878 - protein, 81 aa, Callithrix jacchus
QGKAPWMVKRELTKGLCSGWAPLCETEELTPKQEFYEEHQSQQIIETLTRYNLEYSSLREEWKCKGYFERQPGNQKACFKE

SEQ ID NO: 5879 - protein, 81 aa, Callithrix jacchus
ASAGPIPSQKEEEMTESQGTVTFKDVAIDFTQEEWKRLDPAQRNLYRNVMLENYNNLITVGYPFTKPDVIFKLEQEEEPWV

SEQ ID NO: 5880 - protein, 81 aa, Callithrix jacchus
LCRGPIPSQKEEEMTESQGTVTFKDVAIDFTQEEWKRLDPAQRNLYRNVMLENYNNLITVGYPFTKPDVIFKLEQEEEPWV

SEQ ID NO: 5881 - protein, 81 aa, Callithrix jacchus
MTESQEEWKRLDPAQRNLYRNVMLENYNNLITVGYPFTKPDVIFKLEQEEEPWVMEEEVLRRHWQGEIWGVDEHQKSQDRL

SEQ ID NO: 5882 - protein, 81 aa, Callithrix jacchus
MAVGLCKAMSQGLVTFRDVALDFSQEEWEWLKPSQKDLYRDVMLENYRNLVWLGLSFSKPNMISLLEQGKEPWMVERKMSQ

SEQ ID NO: 5883 - protein, 81 aa, Callithrix jacchus
MAVGLCKAMSQGLVTFRDVALDFSQEEWEWLKPSQKDLYRDVMLENYRNLVWLGDGCSCCSTLRTTGMAEASSSSSSIQVS

SEQ ID NO: 5884 - protein, 81 aa, Callithrix jacchus
MAVGLCKAMSQGLVTFRDVALDFSQEEWEWLKPSQKDLYRDVMLENYRNLPNMISLLEQGKEPWMVERKMSQGHCADWESW

SEQ ID NO: 5885 - protein, 81 aa, Callithrix jacchus
MAVGLCKAMSQGLVTFRDVALDFSQEEWEWLKPSQKDLYRDVMLENYRNLVWLDWESWCDVKELSPKWFTEEDEISQEVVM

SEQ ID NO: 5886 - protein, 81 aa, Callithrix jacchus
TPQETRKMATELLRAKKEAFVAFRDVAVDFTQEEWRLLSPAQRTLHREVMLETYNHLVSLEIPSSKPKLIVQLKRGEEPWR

SEQ ID NO: 5887 - protein, 81 aa, Callithrix jacchus
PCVVLRQTMNCSRAGGITAFVAFRDVAVDFTQEEWRLLSPAQRTLHREVMLETYNHLVSLEIPSSKPKLIVQLKRGEEPWR

SEQ ID NO: 5888 - protein, 81 aa, Callithrix jacchus
MATELLRAKKEAFVAFRDVAVDFTQEEWRLLSPAQRTLHREVMLETYNHLVSLEIPSSKPKLIVQLKRGEEPWREERKCSL

SEQ ID NO: 5889 - protein, 81 aa, Callithrix jacchus
MATELLRAKKEEEWRLLSPAQRTLHREVMLETYNHLVSLEIPSSKPKLIVQLKRGEEPWREERKCSLDLRPAGSKPEIQLC

SEQ ID NO: 5890 - protein, 81 aa, Callithrix jacchus
MAEGSVMFSDVSIDFSQEEWDCLDPVQRALYRDVMLENYSNLVLMGLHTPKPQVISLLEQGKEPWMVGRELTRGLCSDLES

SEQ ID NO: 5891 - protein, 81 aa, Callithrix jacchus
MAEGSVMFSDVSIDFSQEEWDCLDPVQRALYRDVMLENYSNLVLMGKGIHTNASQFSSGMSASSTVSFSAAFQDFILLSLR

SEQ ID NO: 5892 - protein, 81 aa, Callithrix jacchus
SPQKSPALAPEDHGSSYEGSVSFRDVAINFSREEWRHLDLSQRNLYWDVMLETYSHLLSVGYQFPKPEVVMLEQGNEPWAL

SEQ ID NO: 5893 - protein, 81 aa, Callithrix jacchus
HGSSYEGSVSFRDVAINFSREEWRHLDLSQRNLYWDVMLETYSHLLSVGYQFPKPEVVMLEQGNEPWALQGERPRHSCPGE

SEQ ID NO: 5894 - protein, 81 aa, Callithrix jacchus
GSVSFRDVAINFSREEWRHLDLSQRNLYWDVMLETYSHLLSVGYQFPKPEVVMLEQGNEPWALQGERPRHSCPGEKLWDHN

SEQ ID NO: 5895 - protein, 81 aa, Callithrix jacchus
REEWRHLDLSQRNLYWDVMLETYSHLLSVGYQFPKPEVVMLEQGNEPWALQGERPRHSCPGEKLWDHNLRRKILSYKPASS

SEQ ID NO: 5896 - protein, 81 aa, Callithrix jacchus
SPQKSPALALEDHGNSYEGSVSFRDVAIDFSREEWRHLDPSQRNLYRDVMLETYSHLLSVGYQVPEAEVVMLEQGNEPWAL

SEQ ID NO: 5897 - protein, 81 aa, Callithrix jacchus
LAPEDHGSSYEGSVSFRDVAIDFSREEWRHLDPSQRNLYRDVMLETYSHLLSVGYQVPEAEVVMLEQGNEPWALQGERPHQ

SEQ ID NO: 5898 - protein, 81 aa, Callithrix jacchus
REEWRHLDPSQRNLYRDVMLETYSHLLSVGYQVPEAEVVMLEQGNEPWALQGERPHQSCPVTHWLPFPSTMTKSFLGLTRR

SEQ ID NO: 5899 - protein, 81 aa, Callithrix jacchus
MAWKVVMFRDVAIDFSQEEWECLDAAQRDLYRDVMLENYSNLVSLDLPLRCARKDLSPEKNTYETELSQWEVSDRLEKCDL

SEQ ID NO: 5900 - protein, 81 aa, Callithrix jacchus
YETELSQWEVSDRLEKCDLEESNSRDYLEAKAEMERQQENQREYFRQGMIIYDKMSIFNQHTYLSQHSKCHSTEKPYKCKE

SEQ ID NO: 5901 - protein, 81 aa, Callithrix jacchus
MAVSVAMSKKVVMFRDVAIDFSQEEWECLDAAQRDLYRDVMLENYSNLVSLDLPLRCARKDLSPEKNTYETELSQWEVSDR

SEQ ID NO: 5902 - protein, 81 aa, Callithrix jacchus
EEAQGELTSSCGAKTMAHVSLAFRDVSIDLSQEEWECLDPAQRDLYKDVMFENYSNLVSLGYTIPKPDVITLLEQEKEPWI

SEQ ID NO: 5903 - protein, 81 aa, Callithrix jacchus
GRSTRKIDQFCNSKNMVHGSVTFRDVAIDFSQEEWECLQPAQKTLYRDVMLENYSHLISLGSSVSKPDVITLLEQEKEPWM

SEQ ID NO: 5904 - protein, 81 aa, Callithrix jacchus
MLENYSHLISLGSSVSKPDVITLLEQEKEPWMVVRKETSRWYPDLESKCGPEKISLENDISEINLPKQFIKQISKTLGLEA

SEQ ID NO: 5905 - protein, 81 aa, Callithrix jacchus
MVHGSVTFRDVAIDFSQEEWECLQPAQKTLYRDVMLENYSHLISLAGSSVSKPDVITLLEQEKEPWMVVRKETSRWYPDLE

SEQ ID NO: 5906 - protein, 81 aa, Callithrix jacchus
MVHGSVTFRDVAIDFSQEEWECLQPAQKTLYRDVMLENYSHLISLGSSVSKPDVITLLEQEKEPWMVVRKETSRWYPDLES

SEQ ID NO: 5907 - protein, 81 aa, Callithrix jacchus
MVHGSVTFRDVAIDFSQEEWECLQPAQRTLYRDVMLENYSHLISLGSSISKPDVITLLEQEKEPWMVIRKETNRWYPDLES

SEQ ID NO: 5908 - protein, 81 aa, Callithrix jacchus
IEESHGALINCWNSRTMTDGLVTFRDVAIDFSQEEWECLDPAQRDLYVDVMLENYSNLVSLVSLKNVPLASELYCIWSQQH

SEQ ID NO: 5909 - protein, 81 aa, Callithrix jacchus
EESHGALINCWNSRTMTDGLVTFRDVAIDFSQEEWECLDPAQRDLYVDVMLENYSNLVSLDLESTTYDAKKIFSEKDIFEI

SEQ ID NO: 5910 - protein, 81 aa, Callithrix jacchus
MTARKKLLTGEVLEENFDSEHVSLPRVTATGCSRADGVLLFLSSSWNYSSGFSGLCASPIEESHGALINCWNSRTMTDGLV

SEQ ID NO: 5911 - protein, 81 aa, Callithrix jacchus
KSCSGFSGLCASPIEESHGALINCWNSRTMTDGLVTFRDVAIDFSQEEWECLDPAQRDLYVDVMLENYSNLVSLGKVICLK

SEQ ID NO: 5912 - protein, 81 aa, Callithrix jacchus
MTKSGEAVTFKDVAVVFSEEELRLLDLTQRKLYRDVMLENFRNVVSVGHQSIPDGLLQSEREEKLWMMKTATQRDKSSGGK

SEQ ID NO: 5913 - protein, 81 aa, Callithrix jacchus
ATGENPYKYEECGRNVGKSSHCQTPLIVHTGEKPYKCEDCGVSFSQRSYLQVHLKVHTGKKPYKCEECGKSFSWRSRLQAH

SEQ ID NO: 5914 - protein, 81 aa, Callithrix jacchus
STNLALLQKEEDKMTKSGEAVTFKDVAVVFSEEELRLLDLTQRKLYRDVMLENFRNVVSVGHQSIPDGLLQSEREEKLWMM

SEQ ID NO: 5915 - protein, 81 aa, Callithrix jacchus
MLENFRNVVSVGHQSIPDGLLQSEREEKLWMMKTATQRDKSSGGKHLKEMETLQEVGLRYLPHEELFCSQIWQQITRELTK

SEQ ID NO: 5916 - protein, 81 aa, Callithrix jacchus
MTTIKEAVTFKDVTVVFTEEELGLLDPAQRKLYRDVMLENFRNLLSIGNQPFHEDTFHFLRKEKFWMMKTTSQREGNLGGK

SEQ ID NO: 5917 - protein, 81 aa, Callithrix jacchus
HFLRKEKFWMMKTTSQREGNLGGKIQIETVPEAGPHEEWSCQQIWEQITSDLTRSQDPLINSSQFFKEGDIPCQIEADLSI

SEQ ID NO: 5918 - protein, 81 aa, Callithrix jacchus
MTSFKEAVTFKDVAVFFTEEELGLLDLAQRKLYRDVMLENFRNLLSVGHQPFHQDVFHFLREEKFWMMETATQREGNSGGK

SEQ ID NO: 5919 - protein, 81 aa, Callithrix jacchus
FKDVAVFFTEEELGLLDLAQRKLYRDVMLENFRNLLSVGHQPFHQDVFHFLREEKFWMMETATQREGNSGGKIQTELESVP

SEQ ID NO: 5920 - protein, 81 aa, Callithrix jacchus
LREEKFWMMETATQREGNSGGKIQTELESVPEAGTHEEWSCQQIWEQTTSDLTRSQDSIINNSQFFAHGDLPSQVEAGLYI

SEQ ID NO: 5921 - protein, 81 aa, Callithrix jacchus
VMKRTVLVFYKIMEEAVTFKDVAVFFTEEELGLLDLAQRKLYRDVMLENFRNLLSVGHQPFHQDVFHFLREEKFWMMETAT

SEQ ID NO: 5922 - protein, 81 aa, Callithrix jacchus
EEKFWMMETATQREGNSGGKIQTELESVPEAGTHEEWSCQQIWEQTTSDLTRSQDSIINNSQFFAHGDLPSQVEAGLYIIH

SEQ ID NO: 5923 - protein, 81 aa, Callithrix jacchus
LDLAQRKLYRDVMLENFRNLLSVGHQPFHQDVFHFLREEKFWMMETATQREGNSGGKIQTELESVPEAGTHEEWSCQQIWE

SEQ ID NO: 5924 - protein, 81 aa, Callithrix jacchus
DVMLENFRNLLSVGHQPFHQDVFHFLREEKFWMMETATQREGNSGGKIQTELESVPEAGTHEEWSCQQIWEQTTSDLTRSQ

SEQ ID NO: 5925 - protein, 81 aa, Callithrix jacchus
EAVTFKDVAVFFTEEELGLLDLAQRKLYRDVMLENFRNLLSVGHQPFHQDVFHFLREEKFWMMETATQREGNSGENASVHP

SEQ ID NO: 5926 - protein, 81 aa, Callithrix jacchus
VTFKDVAVFFTEEELGLLDLAQRKLYRDVMLENFRNLLSVGHQPFHQDVFHFLREEKFWMMETATQREGNSGENASVHPYT

SEQ ID NO: 5927 - protein, 81 aa, Callithrix jacchus
HSGLCKFPEVGGKMTTSKEAVTFKDVAVVFTEEELGLLDPAQRRLYRDVMLENFRNLLSVGHQPFNRDTFYFLREEKFWMM

SEQ ID NO: 5928 - protein, 81 aa, Callithrix jacchus
MTTSKEAVTFKDVAVVFTEEELGLLDPAQRRLYRDVMLENFRNLLSVGHQPFNRDTFYFLREEKFWMMDIATQREGNSGGK

SEQ ID NO: 5929 - protein, 81 aa, Callithrix jacchus
MYPTCTRAEAPQKEAVTFKDVAVVFTEEELGLLDPAQRRLYRDVMLENFRNLLSVGHQPFNRDTFYFLREEKFWMMDIATQ

SEQ ID NO: 5930 - protein, 81 aa, Callithrix jacchus
MFKEAVTFKDVAVVFTEEELGLLGPAQRKLYRDVMLENFRNLLSVGHQPFHRDTFHLQREEKFWMMETATQREGNSGGKIQ

SEQ ID NO: 5931 - protein, 81 aa, Callithrix jacchus
QREEKFWMMETATQREGNSGGKIQTELESVPETGPHEEWSCQQIWEQIAGNLTRPQDSMISSSQFYTQGDVPSQADAGLSI

SEQ ID NO: 5932 - protein, 81 aa, Callithrix jacchus
HSVLRKFPEVRGKMTTFTEAVTFKDVAVVFTEEELGLLDPAQRKLYRDVMLENFGNLLSVGQQAFNRDTFQFLREEKVWMM

SEQ ID NO: 5933 - protein, 81 aa, Callithrix jacchus
FLREEKVWMMKTATQREGNSGGKIQTEMKPVSEAGTHQEWSCQQIWEKIVSDLTRSQASVIHSSQFSKQSDLPCQTEAGLS

SEQ ID NO: 5934 - protein, 81 aa, Callithrix jacchus
MTTFTEAVTFKDVAVVFTEEELGLLDPAQRKLYRDVMLENFGNLLSVGQQAFNRDTFQFLREEKVWMMKTATQREGNSGGK

SEQ ID NO: 5935 - protein, 81 aa, Callithrix jacchus
MGIIKQIRTELLNVAKEAVTFKDVAVVFTEEELGLLDPAQRKLYRDVMLENFGNLLSVGQQAFNRDTFQFLREEKVWMMKT

SEQ ID NO: 5936 - protein, 81 aa, Callithrix jacchus
KYIFLWRNKFISGYSTIKETVTFKDVAVVFTEEELQLLDPAQKKLYQDVMLENFRNLLSVGHQPFHGDTFHFPREEKFWMV

SEQ ID NO: 5937 - protein, 81 aa, Callithrix jacchus
MTTLKETVTFKDVAVVFTEEELQLLDPAQKKLYQDVMLENFRNLLSVGHQPFHGDTFHFPREEKFWMVETATQKEGNLGGK

SEQ ID NO: 5938 - protein, 81 aa, Callithrix jacchus
DPAQKKLYQDVMLENFRNLLSVGHQPFHGDTFHFPREEKFWMVETATQKEGNLGGKIQTEMETVPEQGTHEGLFSHQTWEQ

SEQ ID NO: 5939 - protein, 81 aa, Callithrix jacchus
RNLLSVGHQPFHGDTFHFPREEKFWMVETATQKEGNLGGKIQTEMETVPEQGTHEGLFSHQTWEQISSDLTRFQDSMVNSS

SEQ ID NO: 5940 - protein, 81 aa, Callithrix jacchus
MTTLKETVTFKDVAVVFTEEELQLLDPAQKKLYQDVMLENFRNLLSVGHQPFHGDTFHFPREEKFWMVETATQKEGNLGPA

SEQ ID NO: 5941 - protein, 81 aa, Callithrix jacchus
KDVAVVFTEEELQLLDPAQKKLYQDVMLENFRNLLSVGHQPFHGDTFHFPREEKFWMVETATQKEGNLGPAFQIPIKTEGF

SEQ ID NO: 5942 - protein, 81 aa, Callithrix jacchus
MTTLKETVTFKDVAVVFTEEELQLLDPAQKKLYQDVMLENFRNLLSVGHQPFHGDTFHFPREEKFWMVETATQKEGNLDGV

SEQ ID NO: 5943 - protein, 81 aa, Callithrix jacchus
NSGLCKFPETGGKMTTFKEGLTFKDVAVVFTEEELGLLDPVQRNLYRDVMLENFRNLLSVERRGNVAKKILRRKMRGWSCW

SEQ ID NO: 5944 - protein, 81 aa, Callithrix jacchus
MTTFKEGLTFKDVAVVFTEEELGLLDPVQRNLYRDVMLENFRNLLSVADKIQSEMEAGPHEELSWGQIWKQIASDLVKYED

SEQ ID NO: 5945 - protein, 81 aa, Callithrix jacchus
MTTFKEGLTFKDVAVVFTEEELGLLDPVQRNLYRDVMLENFRNLLSVERRGNVAKKILRRKMRGWSCWLRDDRDRRKSMSD

SEQ ID NO: 5946 - protein, 81 aa, Callithrix jacchus
MNMFKEAVTFKDVAVAFTEEELGLLGPAQRKLYQEVMVENFRNLLSVGHQPFKRDVSPIERKEQLCIMKTATQRQRNLGEN

SEQ ID NO: 5947 - protein, 81 aa, Callithrix jacchus
VGHQPFKRDVSPIERKEQLCIMKTATQRQRNLGENNQSKLMTVEDRESEEELSCWQIWQQIASDLTRCQDFMINNSQFHKQ

SEQ ID NO: 5948 - protein, 81 aa, Callithrix jacchus
MNMFKEAVTFKDVAVAFTEEELGLLGPAQRKLYQEVMVENFRNLLSVGHQPFKRDVSPIERKEQLCIMKTATQRQRNLGKN

SEQ ID NO: 5949 - protein, 81 aa, Callithrix jacchus
VTFKDVAVAFTEEELGLLGPAQRKLYQEVMVENFRNLLSVGHQPFKRDVSPIERKEQLCIMKTATQRQRNLGKNTVVSSYS

SEQ ID NO: 5950 - protein, 81 aa, Callithrix jacchus
MNMFKEAVTFKDVAVAFTEEELGLLGPAQRKLYQEVMVENFRNLLSVGHQPFKRDVSPIERKEQLCIMKTATQRQRNLDTL

SEQ ID NO: 5951 - protein, 81 aa, Callithrix jacchus
AVAFTEEELGLLGPAQRKLYQEVMVENFRNLLSVGHQPFKRDVSPIERKEQLCIMKTATQRQRNLDTLLVKAVLFYDLAQT

SEQ ID NO: 5952 - protein, 81 aa, Callithrix jacchus
MVENFRNLLSVGHQPFKRDVSPIERKEQLCIMKTATQRQRNLGENNQSKLMTVEDRESEEELSCWQIWQQIASDLTRCQDF

SEQ ID NO: 5953 - protein, 81 aa, Callithrix jacchus
RKEQLCIMKTATQRQRNLGENNQSKLMTVEDRESEEELSCWQIWQQIASDLTRCQDFMINNSQFHKQDDFHCQVGAGLSIQ

SEQ ID NO: 5954 - protein, 81 aa, Callithrix jacchus
IERKEQLCIMKTATQRQRNLGENNQSKLMTVEDRESEEELSCWQIWQQIASDLTRCQDFMINNSQFHKQDDFHCQVGAGLS

SEQ ID NO: 5955 - protein, 81 aa, Callithrix jacchus
SQDYDFPQKQQEKMTKFQEAVTFKDVAVVFSSEELRLLDLTQRKLYRDVMVENFKNLVAVGHLPFQSDMVSQLEAEEKLWM

SEQ ID NO: 5956 - protein, 81 aa, Callithrix jacchus
SQDYDFPQKQQEKMTKFQEAVTFKDVAVVFSSEELRLLDLTQRKLYRDVMVENFKNLVAVGSKHQNKVETLRKFALKYLSN

SEQ ID NO: 5957 - protein, 81 aa, Callithrix jacchus
LSQDYDFPQKQQEKMTKFQEAVTFKDVAVVFSSEELRLLDLTQRKLYRDVMVENFKNLVAVGHLPFQSDMVSQLEAEEKLW

SEQ ID NO: 5958 - protein, 81 aa, Callithrix jacchus
MTKFQEAVTFKDVAVVFSSEELRLLDLTQRKLYRDVMVENFKNLVAVGHLPFQSDMVSQLEAEEKLWMMEAETQRSRYSGE

SEQ ID NO: 5959 - protein, 81 aa, Callithrix jacchus
MTKFQEAVTFKDVAVAFTEEELGLLDSAQRKLYRDVMLENFRNLVSVGRQSFKPDMISQLEREEKLWMKEFQTQRGDRNQN

SEQ ID NO: 5960 - protein, 81 aa, Callithrix jacchus
MVTFKDVAVVFTEEELGLLDCVQRKLYRDVMLENFRNLLLVAHQPFKPDLISQLEREEKLLMVETETPRDGCSGRKNQQMM

SEQ ID NO: 5961 - protein, 81 aa, Callithrix jacchus
MIKFQEMVTFKDVAVVFTEEELGLLDCVQRKLYRDVMLENFRNLLLVAHQPFKPDLISQLEREEKLLMVETETPRDGCSGR

SEQ ID NO: 5962 - protein, 81 aa, Callithrix jacchus
MIKLQMVTFKDVAVVFTEEELGLLDCVQRKLYRDVMLENFRNLLLVAHQPFKPDLISQLEREEKLLMVETETPRDGCSGRK

SEQ ID NO: 5963 - protein, 81 aa, Callithrix jacchus
MIKLQEGVTFKDVAVVFTKEELALLDKTQINLYQDVMLENFRNLISVGDRIENNILNLQEKGLSYLSQEVLHCWQIWKQRI

SEQ ID NO: 5964 - protein, 81 aa, Callithrix jacchus
LTQVLTPQSWRKVNIMTKPQNSQGRFKGIYMEEKLYRRVWHDDYLNWTSHDHEESQECKGEDPGRLPNCGKNLGVKSTVEQ

SEQ ID NO: 5965 - protein, 81 aa, Callithrix jacchus
EIIIKVEGEDTESLTIPSQEGVNFKIVTVDFTQEEQGTWNPAQRSLDRDILESHRDLVSWDLATAVGKEDSTSKQNIFDEE

SEQ ID NO: 5966 - protein, 81 aa, Callithrix jacchus
ESMEEQDEKPPEPPKACAQEGVNFKIVTVDFTQEEQGTWNPAQRSLDRDILESHRDLVSWDLATAVGKEDSTSKQNIFDEE

SEQ ID NO: 5967 - protein, 81 aa, Callithrix jacchus
AQDSLLPQEIIIKVEGEDTESLTIPSQEEQGTWNPAQRSLDRDILESHRDLVSWDLATAVGKEDSTSKQNIFDEEPANGVK

SEQ ID NO: 5968 - protein, 81 aa, Callithrix jacchus
MAEEFVTLKDVAMDFALEDWEQFGLDQGDLFWDTALENYQNLFLLNPPRPNLTSHADGSEDLEPLARGSPEAMGPDLAETT

SEQ ID NO: 5969 - protein, 81 aa, Callithrix jacchus
MDFALEDWEQFGLDQGDLFWDTALENYQNLFLLNPPRPNLTSHADGSEDLEPLARGSPEAMGPDLAETTTNSLMQDFLEEG

SEQ ID NO: 5970 - protein, 81 aa, Callithrix jacchus
MANRTLMAAGQESVTFKDVAVDFTLEEWGWLEPGQRELYRDVMLENYRNLLSLGAGLPGSKPDVISRLERGEEPRPEEREA

SEQ ID NO: 5971 - protein, 81 aa, Callithrix jacchus
FSQKPQVLGPEEQDGSCEASVSFEDVTMAFSREEWQQLDPAQKRLYQDVMLELYSHLFSVGYQIPNPDVIFRRLKEKEPCT

SEQ ID NO: 5972 - protein, 81 aa, Callithrix jacchus
NAVIVMSVRSEQGSSSGEGLLSFEDVAVDFTREEWQFLDPSQKVLYKEVMSENYRNLVSVGYQGTKPDSLFKLERGKPPWI

SEQ ID NO: 5973 - protein, 81 aa, Callithrix jacchus
MLENYSNLVSVGYQASKPDALSKLEQGEPWTIENEIHSQVCPENKKVDNHLQMHSRNQRCLKRVEQCHKHNAFGSIIHQRK

SEQ ID NO: 5974 - protein, 81 aa, Callithrix jacchus
MITSQESLTLEDVAVEFTWEEWQLLGPSQKDLYRDVMLENYSNLVSVGYQASKPDALSKLEQGEPWTIENEIHSQVCPENK

SEQ ID NO: 5975 - protein, 81 aa, Callithrix jacchus
MKKLRRGKAKESGMALPQGPLTFRDVAIEFSQEEWRCLDPTQKALYKDVMLENYRNLVFLGISPKCMIKELPPTENSNTRE

SEQ ID NO: 5976 - protein, 81 aa, Callithrix jacchus
MALTQGSLTFKDVAIEFSQEEWKCLDPVQKALYRDVMLENYRNLGFLGLCLPDLDIISMLEQGKEPWTVVSQVKITRNPNC

SEQ ID NO: 5977 - protein, 81 aa, Callithrix jacchus
KITRNPNCGECMKGVITGISPKCVIKELPPIHNSNTRETFQMVMLEGHESGDIENFYFREIQKNLQDLDFQRKDGEVNYKE

SEQ ID NO: 5978 - protein, 81 aa, Callithrix jacchus
EAQKRKKKEKESGMALTQGSLTFKDVAIEFSQEEWKCLDPVQKALYRDVMLENYRNLGFLGLCLPDLDIISMLEQGKEPWT

SEQ ID NO: 5979 - protein, 81 aa, Callithrix jacchus
VYPGADRFPQQKKMLNAQESLTLEDVMVEFTWEEWQLLDPSQKDLYRDVMLEIYSNLVSVGFQVSKPDALSKLERGEEPWT

SEQ ID NO: 5980 - protein, 81 aa, Callithrix jacchus
MLNAQESLTLEDVMVEFTWEEWQLLDPSQKDLYRDVMLEIYSNLVSVGFQVSKPDALSKLERGEEPWTIGDERHSRICPEN

SEQ ID NO: 5981 - protein, 81 aa, Callithrix jacchus
MIKTQESLTLEDVAVEFSWEEWQLLDTAQKDLYRDVMVENYNHLVSLGYQTSKPDALSKLAHGQEPWITDAKIQNKNCPGI

SEQ ID NO: 5982 - protein, 81 aa, Callithrix jacchus
MRPELTNFWEESLTLEDVAVGFTREEWQLLGPAQKDLYRDVMLENYSNLVAVGYPASKPDALLKLERGEEPCCTTEDEIYT

SEQ ID NO: 5983 - protein, 81 aa, Callithrix jacchus
MESLTLEDVAVGFTREEWQLLGPAQKDLYRDVMLENYSNLVAVGYPASKPDALLKLERGEEPCCTTEDEIYTQICSEIRKI

SEQ ID NO: 5984 - protein, 81 aa, Callithrix jacchus
MIQTQESLTLEDVAVDFTREEWQLLGPAQKDLYRDVMLENYSNLVAVGYQASKPDALFKLGQGQPPWTVKDGIHSGACSEI

SEQ ID NO: 5985 - protein, 81 aa, Callithrix jacchus
AYMSCLVKHKRIHTREKQEAATVENPPAERHSLLHTSDVMQEKSSASMVTTQLPSMAPQTSFNISGLLANRNVVLVGQPVV

SEQ ID NO: 5986 - protein, 81 aa, Callithrix jacchus
MIQTQESLTLEDVAVDFTREEWQLLGPAQKDLYRDVMLENYSNLVAVGYQASKPDALFKLGQGQPPWTVKDGIHSGACSGS

SEQ ID NO: 5987 - protein, 81 aa, Callithrix jacchus
MALTQGPLTFRDVTIQFSQEEWRCLDPAQKALYKDVMLENYRNLVFLGIIPKCTTKELPPTGNSNTGEKFRTMTLERHECC

SEQ ID NO: 5988 - protein, 81 aa, Callithrix jacchus
LCKVQGPLTFRDVTIQFSQEEWRCLDPAQKALYKDVMLENYRNLVFLGIIPKCTTKELPPTGNSNTGEKFRTMTLERHECC

SEQ ID NO: 5989 - protein, 81 aa, Callithrix jacchus
LDPAQKALYKDVMLENYRNLVFLGIIPKCTTKELPPTGNSNTGEKFRTMTLERHECCDIEDIYSRETQKNLQDLEFQWKDG

SEQ ID NO: 5990 - protein, 81 aa, Callithrix jacchus
MAQLRRGPLTFRDVAIEFSQEEWKCLDPAQRTLYRDVMLENYRNLVSLGMCLPDLSIISMMKQRTEPWTVESEMKVAKHPA

SEQ ID NO: 5991 - protein, 81 aa, Callithrix jacchus
GPLTFRDVAIEFSQEEWKCLDPAQRTLYRDVMLENYRNLVSLGMCLPDLSIISMMKQRTEPWTVESEMKVAKHPARWEGMK

SEQ ID NO: 5992 - protein, 81 aa, Callithrix jacchus
EKFISHSSSVSPLPNISYGVKTCIFNKLRNDFVDFPLLSPEQKARIRSKPDKCKEQSKVFRVSSSFPNPQAVHTADKANRC

SEQ ID NO: 5993 - protein, 81 aa, Callithrix jacchus
MLENYRNLVSLGMCLPDLSIISMMKQRTEPWTVESEMKVAKHPARWEGMKDISTGRRCAVSSKTGNNRVTNPLGLTFRLPL

SEQ ID NO: 5994 - protein, 81 aa, Callithrix jacchus
AQKRRKRKAKEAGMALPQGHLTFTDVAIEFSQEEWKCLEPTQKALYKDVMLENYRNLVSLGISLPDLNINSMLERRRELLS

SEQ ID NO: 5995 - protein, 81 aa, Callithrix jacchus
EWKCLEPTQKALYKDVMLENYRNLVSLGISLPDLNINSMLERRRELLSGESEVKIAKRSDRRERIEVVNRVQGAAVHWEAV

SEQ ID NO: 5996 - protein, 81 aa, Callithrix jacchus
AQKRRKRKAKEAGMALPQGHLTFTDVAIEFSQEEWKCLEPTQKALYKDVMLENYRNLVSLGSSCALGGSAENKPIKTQLGG

SEQ ID NO: 5997 - protein, 81 aa, Callithrix jacchus
MGHLTFMDVAIEFSQEEWTCLDPAQQALYRDVMLENYRNLVSLGICLPDLSIISMLEQRREPSTLQGELKIVKIQDGRERI

SEQ ID NO: 5998 - protein, 81 aa, Callithrix jacchus
RSCILRSNAGNKPIKNQLGLILESHLPELQLFQAGRKIYRSNRGETFTNHSSSVSPLQKISSHFTTHIFNKYRNGLIDFPL

SEQ ID NO: 5999 - protein, 81 aa, Callithrix jacchus
VSWRPGSGLRGVTVMLRRGHLTFRDVAIEFSQEEWKCLELAQRALYRDVMLENYRNLVSLGICPYDLSIISTLEQSGGPWN

SEQ ID NO: 6000 - protein, 81 aa, Callithrix jacchus
MLRRGHLTFRDVAIEFSQEEWKCLELAQRALYRDVMLENYRNLVSLGICPYDLSIISTLEQSGGPWNLQSEVKIANTPDGR

SEQ ID NO: 6001 - protein, 81 aa, Callithrix jacchus
EEATQKREGKKSGMARSQGPLTFIDVAIEFSQEEWKCLDPAQRTLYKDVMLENYRNLVSLGVDLPDLSFISMLEQKREPWT

SEQ ID NO: 6002 - protein, 81 aa, Callithrix jacchus
MALPQPPEQLGLQGLLTFRDVTIEFSQDEWRCLHPAQKTLYRDVMLENYRNLVSLDISSKYKMKGLLSTAQGDTEGFHTGI

SEQ ID NO: 6003 - protein, 81 aa, Callithrix jacchus
MALPQGLLTFRDVTIEFSQDEWRCLHPAQKTLYRDVMLENYRNLVSLDISSKYKMKGLLSTAQGDTEGFHTGILDRHESHH

SEQ ID NO: 6004 - protein, 81 aa, Callithrix jacchus
MLENYRNLVSLDISSKYKMKGLLSTAQGDTEGFHTGILDRHESHHMGDFCFQEIDRDIRDFECRNSHEALMRKVEKLPCGT

SEQ ID NO: 6005 - protein, 81 aa, Callithrix jacchus
MALPQGLLTFRDVTIEFSQEEWRCLDPAQKTLYRDVMLENYRNLVSLATYLQSGKVFNQKRQLFRHRRPHTGERPYKCNEC

SEQ ID NO: 6006 - protein, 81 aa, Callithrix jacchus
MALPQGLLTFRDVTIEFSQEEWRCLDPAQKTLYRDVMLENYRNLVSLDVSSKCMMKATCTGQPTYLQSGKVFNQKRQLFRH

SEQ ID NO: 6007 - protein, 81 aa, Callithrix jacchus
EEAAQKRKEKEPGMALPQGCLTFRDVAVEFSLAEWKCLTPAQRALYRDVMLENYRNLESVDISFKCMMKKFSLTAQGTTEM

SEQ ID NO: 6008 - protein, 81 aa, Callithrix jacchus
EKQYECDVCGKAFNQKRYLGRHGRCHTGEKPYQCHECGVNFTQQSILTRHSRLHTGEKPSKCNKCSKTFGRNSALVIPKAV

SEQ ID NO: 6009 - protein, 81 aa, Callithrix jacchus
MALPQGCLTFRDVAVEFSLAEWKCLTPAQRALYRDVMLENYRNLESVDISFKCMMKKFSLTAQGTTEMLHTGTLETHESHH

SEQ ID NO: 6010 - protein, 81 aa, Callithrix jacchus
MALPQGLLTFRDVTIEFSQDEWRCLHPAQKTLYRDVMLENYRNLVSLDISSKYKMKGLLSTAQGNTEGFHTGILDRHESHH

SEQ ID NO: 6011 - protein, 81 aa, Callithrix jacchus
MALPQGLLTFRDVTIEFSQEEWRCLDPAQKTLYRDVMLENYRNLVSLDISSKYKMKGLLSTAQGDTDGFHTGILDRHESHH

SEQ ID NO: 6012 - protein, 81 aa, Callithrix jacchus
EPRKRKRKAKESGMALPQGLLTFRDVAIEFSQEEWRCLDPAQRTLYRDVMLENYRNLVSLDIFSKCETKELPPEEKSNTGE

SEQ ID NO: 6013 - protein, 81 aa, Callithrix jacchus
MPVAQGRLTFRDVAVEFSLAEWKCLTPAQRAVYRDVMLENYRNLESVGEEPVPPDTRNLPLSILALPDSFLKSMMEFSSTG

SEQ ID NO: 6014 - protein, 81 aa, Callithrix jacchus
MALPQGLLTFRDVTIEFSQEEWRCLDPAQRILYWNVMLENYRNLVSLDISSKYKMKGLLSTAQGDTDGFHTGILDRHESHH

SEQ ID NO: 6015 - protein, 81 aa, Callithrix jacchus
MALPQGLLTFRDVTIEFSQEEWRCLDPAQRTLYRDVMLENYRNLVSLDISSKYKMKGLLSTAQGDTDGFHTGILDRHESHH

SEQ ID NO: 6016 - protein, 81 aa, Callithrix jacchus
MLENYRNLVSLDISSKYKMKGLLSTAQGDTDGFHTGILDRHESHHMGDFCFQEIDRDIHDFECRNSHEALMRKVEKLPCGT

SEQ ID NO: 6017 - protein, 81 aa, Callithrix jacchus
EAATRKAKEKEPGMPPPQGRLTFRDVAIEFSLAEWKCLTPAQRALYRDVMLENYRNLESVGEENIPPDTRNLPLSILALPD

SEQ ID NO: 6018 - protein, 81 aa, Callithrix jacchus
GRLTFRDVAIEFSLAEWKCLTPAQRALYRDVMLENYRNLESVDSFLKSMMKFSSTGQGSTGEGIHTATLGKCTSHHIGDSC

SEQ ID NO: 6019 - protein, 81 aa, Callithrix jacchus
MPVAQGHLTFRDVAVEFSLAEWKCLTSVQRALYRDVMMENYRNLEYVGEENVPPHTRNLPLSIWALPDSFLKSIMEFSSTG

SEQ ID NO: 6020 - protein, 81 aa, Callithrix jacchus
MTLPQGLLTFRDVAIEFSQEEWRCLDPAQKTLHRDVMLENYRNLVSLDISSICMMKEFSSTGPGNTDVFHTGTLQRHEIHQ

SEQ ID NO: 6021 - protein, 81 aa, Callithrix jacchus
EEAARKRKEKEPGMALPQGRLTFRDVAIEFSLAEWKCLTPAQRALYRDVMLENYRNLESVDISSKCMMKMVSSTGQGNTEV

SEQ ID NO: 6022 - protein, 81 aa, Callithrix jacchus
MALPQGRLTFRDVAVEFSLAEWKCLTPAQRALYRDVMLENYRNLESVGEENVPPDTRNLPLSILALPANGNLNCSSFLRKR

SEQ ID NO: 6023 - protein, 81 aa, Callithrix jacchus
EEAAQKRKEKEPGMALPQGRLTFRDVAVEFSLAEWKCLTPAQRALYRDVMLENYRNLESVGEENVPPDTRNLPLSILALPA

SEQ ID NO: 6024 - protein, 81 aa, Callithrix jacchus
MALPQGRLTFRDVAIEFSLAEWKCLTPAQRALYRDVMLENYRNLESVGEEPVPPDTRNLPLSILAFPDDSNLNYSSFLRKY

SEQ ID NO: 6025 - protein, 81 aa, Callithrix jacchus
MALPQGRLTFKDVSVEFSSAEWKCLTPAQRALYRDVMLENYRNLESVAAGNLNCSSLLKKHQINHLGKNKYKCDVCGKVIN

SEQ ID NO: 6026 - protein, 81 aa, Callithrix jacchus
MALPQGRLTFKDVSVEFSSAEWKCLTPAQRALYRDVMLENYRNLESVGEENVPPDTSNPSLFIWALPAAGNLNCSSLLKKH

SEQ ID NO: 6027 - protein, 81 aa, Callithrix jacchus
MALPQGRLTFKDVAIEFSSAEWKCLTPAQRALYRDVMLENYRNLESVAAGNLNCSSLLKKHQINHLGKNKYKCDVCGKVIN

SEQ ID NO: 6028 - protein, 81 aa, Callithrix jacchus
MALPQGRLTFKDVAVEFSLAEWKCLTPAQRALYRDVMLENYRNLESVANGNLNSSSFLKKDQINHLGKKQYECDVCGRVLN

SEQ ID NO: 6029 - protein, 81 aa, Callithrix jacchus
MALTQVRLTFRDVAIEFSQEEWKCLDPTQRALYRDVMLENYWSLVSLGLCHFDMNIISMLEEGKEPWTVKNYMKIARKPRM

SEQ ID NO: 6030 - protein, 81 aa, Callithrix jacchus
MKESGMAPPQGHLTFRDVAIEFSQEEWKCLTSTQRTLYRDVMLENYRNLVSLDLSHNGVMKELAPKQKRNMGEVFHTVARE

SEQ ID NO: 6031 - protein, 81 aa, Callithrix jacchus
ADGDGLTFRDVAIEFSQEEWKCLTSTQRTLYRDVMLENYRNLVSLDLSHNGVMKELAPKQKRNMGEVFHTVAREQHETPDT

SEQ ID NO: 6032 - protein, 81 aa, Callithrix jacchus
MALTQGQVTFRDVAIEFSQEEWTCLDPAQRSLYRDVMLENYRNLASLGISCFDLSIISMLEQGKGPFALESQVQRAGNPDG

SEQ ID NO: 6033 - protein, 81 aa, Callithrix jacchus
GNPDGWEWIKALITALSSEFVMKDLPHKGKSSTGEVFQTVMLERHESHDIEGCFFREVQKNVHDLEYQRRDAEGNYKAVLM

SEQ ID NO: 6034 - protein, 81 aa, Callithrix jacchus
MAPPQGHLTFRDVAIEFSQEEWKCLTSTQRTLYRDVMLENYRNLVSLDLSHNGVMKELAPKQKRNMGEVFHTVAREQHETP

SEQ ID NO: 6035 - protein, 81 aa, Callithrix jacchus
MAPPQLTFRDVAIEFSQEEWKCLTSTQRTLYRDVMLENYRNLVSLDLSHNGVMKELAPKQKRNMGEVFHTVAREQHETPDT

SEQ ID NO: 6036 - protein, 81 aa, Callithrix jacchus
MALPQERLTFRDVAIEFSQEEWKYLDPAQRTLYRNVMLENYRNLVSLGISLSEMNLVSMLEQGKETRTVESEVKRTKTSNG

SEQ ID NO: 6037 - protein, 81 aa, Callithrix jacchus
MIVSQRLFTFNVTIEFSQEWECLDPAQRALHRDVMLQNCRNLDEENTPPENHISVGFASKGLSPKETNKEEFYHLVILERK

SEQ ID NO: 6038 - protein, 81 aa, Callithrix jacchus
VMLQNCRNLDEENTPPENHISVGFASKGLSPKETNKEEFYHLVILERKESHGINSFDLKEAWEHVHKCDSLWEYDAKNKGV

SEQ ID NO: 6039 - protein, 81 aa, Callithrix jacchus
MAQGLVTFADVAIDFSQEEWACLNSAQRDLYWDVMLENYSNVVSLDLESAYETKNLPTEKSLHEIRVSKRHSDRRSKSLGH

SEQ ID NO: 6040 - protein, 81 aa, Callithrix jacchus
MPLGSELFRDVAIVFSQEEWQWLAPAQRDLYRDVMLETYSNLVSLGLAISKPDVISFLEQGKEPWMVERVVAGGLCPEAEL

SEQ ID NO: 6041 - protein, 81 aa, Callithrix jacchus
MPLGSELFRDVAIVFSQEEWQWLAPAQRDLYRDVMLETYSNLVSLGLAISKPDVISFLEQGKEPWMVERVVAGGLCPVLES

SEQ ID NO: 6042 - protein, 81 aa, Callithrix jacchus
MSKDLVTFGDVAVNFSQEEWEWLNPAQRNLYRKVMLENYRTLVSLGVSVSKPDVISLLEQGKEPWMVKKEGTRSSCPDWEY

SEQ ID NO: 6043 - protein, 81 aa, Callithrix jacchus
PEVQSKEYDKPWQTLPQDTVFGTQQRFPTREKEHKHEAQKKGYRKKSVEMKQRKVYMEKKLLKCNDCEKVFNQSSSLTLHQ

SEQ ID NO: 6044 - protein, 81 aa, Callithrix jacchus
MPAARGKSKSKAPITFGDLAIYFSQEEWEWLSPIQKDLYEDVMLENYRNLVSLGLSFRRPNVITLLEKGKAPWMVEPARRR

SEQ ID NO: 6045 - protein, 81 aa, Callithrix jacchus
MNVEVLKVISQDLVTFKDVAIDFSQEEWQWMNPAQKRLYRSMMLENYQSLVSLGLCVSKPYVISLLEQGREPWEMTSEMRR

SEQ ID NO: 6046 - protein, 81 aa, Callithrix jacchus
DDACMEGMTSYGLECSTFEENWKWEDLFEKQMGSQEMFSQEETITHKETLTKETEFKYTKFGKCIHVENIEGNIYNHTSDK

SEQ ID NO: 6047 - protein, 81 aa, Callithrix jacchus
NQKLEAAGTGTEPKAMSQGLVTFGDVAIDFSQEEWEWLSPVQRNLYRKVMLENYRNLALLGLCVSKPDVISLLEQGKEPWT

SEQ ID NO: 6048 - protein, 81 aa, Callithrix jacchus
LEYSLLGEHWDCDALFETQPGLVTMKNLAIDFPQQLHPAQKNSCKNGLWENYSDVGSAGHCMAKPDLASLLEQEKETWMVK

SEQ ID NO: 6049 - protein, 81 aa, Callithrix jacchus
SQEEGKVTGITLLKAMSLGSVTFTDVAIDFSQDEWQWLNLAQRSLYKKVMLENYRNLVSVGLCISKPDVISLLEQEKDPWV

SEQ ID NO: 6050 - protein, 81 aa, Callithrix jacchus
MAAQLLTDEVLESVTFRDVTVDFTQEEWQQLEPAQKDLYRDVMLENYRNLVSLDWETRPEMKELDSKNDILEDKPSVVGVA

SEQ ID NO: 6051 - protein, 81 aa, Callithrix jacchus
RDSRAYESRSQDAESYQNMVNLTEDRKPHNTIQDNMENYRKLLSLGFLAHDSVPAEERNTEMVDSPPSARSQLLDLEHIRA

SEQ ID NO: 6052 - protein, 81 aa, Callithrix jacchus
ARSQLLDLEHIRAFLLFQELVTFKDVVVHFSLEELRSLSAAQRSLYREVTLENYRNLVSLGYRFSKPDIISRLEKEESRAV

SEQ ID NO: 6053 - protein, 81 aa, Callithrix jacchus
MKNSQRVTFEDVTVSFTKGEWQQLNPEQRELYRDVMLENYGNLVSVGLEETSKPSVILRLEEGKEPWSEEEVLRGGRPEKN

SEQ ID NO: 6054 - protein, 81 aa, Callithrix jacchus
MAAAVLTDRVQVSVTFDDVAVTFTEEEWGQLDLAQRTLYQEVMLENCGLLVSLGCPVPRPELICHLDHGQEPWTGKEDLSQ

SEQ ID NO: 6055 - protein, 81 aa, Callithrix jacchus
MAAAVLTDRVQVSVTFDDVAVTFTEEEWGQLDLAQRTLYQEVMLENCGLLVSLGDKGKPKTTEPTTCDPALSEGISLQGQL

SEQ ID NO: 6056 - protein, 81 aa, Callithrix jacchus
MATALTDPAQVSVTFDDVAVTFTQEEWGQLDLAQRTLYQEVMLENCGLLVSLGCPVPRPELICHLDHGQEPWTGKEDLSQG

SEQ ID NO: 6057 - protein, 81 aa, Callithrix jacchus
MAAAWMAPTQESVTFEDVAVTFTQEEWGQLDVTQRALYVEVMLETCGLLVALGDSTKPETLEPVPSHPALPEEVSLQEQLA

SEQ ID NO: 6058 - protein, 81 aa, Callithrix jacchus
MAGLAQVSVTFEDVAVTFTQEEWGQLDATQRTLYQEVMLETCGLLASLGCPLSKPELIYRLDHRQEPWMVKRDLSQSSYPG

SEQ ID NO: 6059 - protein, 81 aa, Callithrix jacchus
TAAAVLMDRVQSCVTFEDVFVYFSREEWELLEEAQRFLYRDVMLENFALVATLGFWCETENEEAPSEQSISLEGVSQVRTA

SEQ ID NO: 6060 - protein, 81 aa, Callithrix jacchus
TAAAVLMDRVQSCVTFEDVFVYFSREEWELLEEAQRFLYRDVMLENFALVATLGFIFPVSGSCPSGGGRRPWADISPATIR

SEQ ID NO: 6061 - protein, 81 aa, Callithrix jacchus
MAEMNPAQDRVVFEDVAIYFSQEEWGHLDEAQRLLYRDVMLENLALLSSLGCCHGAEDEEAPFQQGVSSGVLQAMAPKPRL

SEQ ID NO: 6062 - protein, 81 aa, Callithrix jacchus
MYSSFPIWQDRVVFEDVAIYFSQEEWGHLDEAQRLLYRDVMLENLALLSSLGCCHGAEDEEAPFQQGVSSGVLQAMAPKPR

SEQ ID NO: 6063 - protein, 81 aa, Callithrix jacchus
VSSGVLQAMAPKPRLSTQKSQRCETCSSLLKDILRLAEHDGTHPEQGLYMSPAHLHQHQKEQIREKLCRGDGGRPSFVKNH

SEQ ID NO: 6064 - protein, 81 aa, Callithrix jacchus
MDPVQDRVVFEDVAIYFSQEEWGHLDEAQRLLYRDVMLENLALLSSLGCWHGAEDEVAPSQQGFSAGVSEVTTSESCMFTQ

SEQ ID NO: 6065 - protein, 81 aa, Callithrix jacchus
MNLTEGPAAEMDPVQDRVVFEDVAIYFSQEEWGHLDEAQRLLYRDVMLENLALLSSLGKALTLAQCPGLGWVMPVHPKAAL

SEQ ID NO: 6066 - protein, 81 aa, Callithrix jacchus
MNLTEGPAAEMDPVQDRVVFEDVAIYFSQEEWGHLDEAQRLLYRDVMLENLALLSSLGYTAVAAMFMDAGQDCMVFEDVAI

SEQ ID NO: 6067 - protein, 81 aa, Callithrix jacchus
AIYFSQEEWGHLDEAQRLLYRDVMLENLALLSSLGYTAVAAMFMDAGQDCMVFEDVAIHFSQEEWGILNDVQRHLHSDVML

SEQ ID NO: 6068 - protein, 81 aa, Callithrix jacchus
MFMDAGQDCMVFEDVAIHFSQEEWGILNDVQRHLHSDVMLENFALLSSVGCWHGAKDEEAPSKQYVSMEVSQVTTLKPALS

SEQ ID NO: 6069 - protein, 81 aa, Callithrix jacchus
MNLIEDCMVFEDVAIHFSQEEWGILNDVQRHLHSDVMLENFALLSSVGCWHGAKDEEAPSKQYVSMEVSQVTTLKPALSTQ

SEQ ID NO: 6070 - protein, 81 aa, Callithrix jacchus
MAATHKDPAQDCMVFEDVAIYFSQEEWGILNDAQRHLHSNVMLENFALLSSVGCWHGANDKEASSKQCVSVRVLQVTTPKS

SEQ ID NO: 6071 - protein, 81 aa, Callithrix jacchus
MAAAAPMGQAQVPLNSEVIMDPKQGQVNFEDVFVYFSQEEWVLLDEAQRLLYRDVMLENFALMASLEKQAVSVSAVQHPTG

SEQ ID NO: 6072 - protein, 81 aa, Callithrix jacchus
AAAAPMGQAQVPLNSEVIMDPKQGQVNFEDVFVYFSQEEWVLLDEAQRLLYRDVMLENFALMASLEKQAVSVSAVQHPTGW

SEQ ID NO: 6073 - protein, 81 aa, Callithrix jacchus
MGQAQVPLNSEVIMDPKQGQVNFEDVFVYFSQEEWVLLDEAQRLLYRDVMLENFALMASLGCWPGMKDEEIPFEQSFSIGL

SEQ ID NO: 6074 - protein, 81 aa, Callithrix jacchus
MDPKQGQVNFEDVFVYFSQEEWVLLDEAQRLLYRDVMLENFALMASLGHTSFTSHIVASPGLLSGSCWPGMKDEEIPFEQS

SEQ ID NO: 6075 - protein, 81 aa, Callithrix jacchus
MGQAQVPLNSEVIMDPKQGQVNFEDVFVYFSQEEWVLLDEAQRLLYRDVMLENFALMASLGHTSFTSHIVASPVMGCWPGM

SEQ ID NO: 6076 - protein, 81 aa, Callithrix jacchus
MGQAQVPLNSEVIMDPKQGQVNFEDVFVYFSQEEWVLLDEAQRLLYRDVMLENFALMASLGHTSFTSHIVASPVMVGVALA

SEQ ID NO: 6077 - protein, 81 aa, Callithrix jacchus
EPAQVLTAAELLTDNEKQGYVTFEDVAVYFSQEEWRLLDEAQRLLYRNVMLENFSLMASLGLASSKTHEITQLESWEEPFM

SEQ ID NO: 6078 - protein, 81 aa, Callithrix jacchus
MAAAAMREPAQQGYVTFEDVAVYFSQEEWRLLDEAQRLLYRNVMLENFSLMASLGLASSKTHEITQLESWEEPFMPAWEVV

SEQ ID NO: 6079 - protein, 81 aa, Callithrix jacchus
MAAAAMREPAQGYVTFEDVAVYFSQEEWRLLDEAQRLLYRNVMLENFSLMASLGLASSKTHEITQLESWEEPFMPAWEVVT

SEQ ID NO: 6080 - protein, 81 aa, Callithrix jacchus
MAAAAMREPAQQGYVTFEDVAVYFSQEEWRLLDEAQRLLYRNVMLENFSLMASLGCWHGVEAKKAPKQSASVGVLTSNVQQ

SEQ ID NO: 6081 - protein, 81 aa, Callithrix jacchus
MDAAALVNLPQGHVTFEDIAVYFSREEWGLLDEAQRCLYHDVMLENFSLMTSVGCLHGIGAEEAPSEQIVSVETVSQARTP

SEQ ID NO: 6082 - protein, 81 aa, Callithrix jacchus
VNLPQIPVATEEFVKPSQGHVTFEDIAVYFSREEWGLLDEAQRCLYHDVMLENFSLMTSVGCLHGIGAEEAPSEQIVSVET

SEQ ID NO: 6083 - protein, 81 aa, Callithrix jacchus
LVNLPQIPVATEEFVKPSQGHVTFEDIAVYFSREEWGLLDEAQRCLYHDVMLENFSLMTSVAGLSQNNHKDSCLWKVPVSM

SEQ ID NO: 6084 - protein, 81 aa, Callithrix jacchus
MAEGKEAAQMLVSFKDVAVTFTQEEWRQLDPAQRTLYQEVMLETCGLLVSLGYWVPKAELVHLLEHGQELWTVKSGRSHPT

SEQ ID NO: 6085 - protein, 81 aa, Callithrix jacchus
LSWEFAFLLPGTISLYQKMLVSFKDVAVTFTQEEWRQLDPAQRTLYQEVMLETCGLLVSLGYWVPKAELVHLLEHGQELWT

SEQ ID NO: 6086 - protein, 81 aa, Callithrix jacchus
MLVSFKDVAVTFTQEEWRQLDPAQRTLYQEVMLETCGLLVSLGYWVPKAELVHLLEHGQELWTVKSGRSHPTCVGDKAQVQ

SEQ ID NO: 6087 - protein, 81 aa, Callithrix jacchus
RALTPVSMTAEAKCTGFTQGSVTFEDVAIYFSQEEWGLLDEAQRLLYRDVMLENFALLTSLVCWHGMEDEETPEQSVSVNG

SEQ ID NO: 6088 - protein, 81 aa, Callithrix jacchus
MDLTKGCVTFEDIAIYFSQEEWGLLDEAQRLLFLEVMLENFALVASLGCGHGTEDEKTPSEQNVSIGVSQSKAGSSAQKTQ

SEQ ID NO: 6089 - protein, 81 aa, Callithrix jacchus
RAPTQVTVTPETHMDLTKGCVTFEDIAIYFSQEEWGLLDEAQRLLFLEVMLENFALVASLGCGHGTEDEKTPSEQNVSIGV

SEQ ID NO: 6090 - protein, 81 aa, Callithrix jacchus
MAAAALRAPTQEEWGLLDEAQRLLFLEVMLENFALVASLGCGHGTEDEKTPSEQNVSIGVSQSKAGSSAQKTQPCEMCVPI

SEQ ID NO: 6091 - protein, 81 aa, Callithrix jacchus
PPGRPPTRMATALTDPAPGSVTFEDVAVYFSWEEWDLLDETQKHLYFDVMLENFVLTSSLGYWCGLEHEEAPSSSVGTDVL

SEQ ID NO: 6092 - protein, 81 aa, Callithrix jacchus
TDPAPVPIATEVLSEPTGSVTFEDVAVYFSWEEWDLLDETQKHLYFDVMLENFVLTSSLGYWCGLEHEEAPSSSVGTDVLQ

SEQ ID NO: 6093 - protein, 81 aa, Callithrix jacchus
GSVTFEDVAVYFSWEEWDLLDETQKHLYFDVMLENFVLTSSLGYWCGLEHEEAPSSSVGTDVLQRISLKGAPQFRTSKEGS

SEQ ID NO: 6094 - protein, 81 aa, Callithrix jacchus
MAAFTMRDPAQRTTFEDVAIYFSQEEWELLDEAQRFLYCDVMLENFAHVTSLGYCHGTQNEAIASEHTASVGGKLQVRTSK

SEQ ID NO: 6095 - protein, 81 aa, Callithrix jacchus
MAAATPRAPAPGTVTFEDVAVHFSWEEWGLLDEAQRCLYRDVMLENLALLTSLDVHYQKENLGEKHFRSNVDQALFVNTCI

SEQ ID NO: 6096 - protein, 81 aa, Callithrix jacchus
TTFEDVAIYFSQEEWELLDEAQRFLYCDVMLENFAHVTSLGYCHGTQNEAIASEHTASVGGKLQVRTSKGDTPTQKTHLSA

SEQ ID NO: 6097 - protein, 81 aa, Callithrix jacchus
MAAAALRLPAQGTVTFEDVAVKFSQEEWSILTEAQRCLYHDVMLENLALISSLGCWYGAKDETPSKQTLSIQQQSPLRSHW

SEQ ID NO: 6098 - protein, 81 aa, Callithrix jacchus
MAAPAQSCVTFEDVAVKFSLEEWNLLNDAQRCLYGDVMLETMTLISSLGCWHGGEEEAAPSKQSTCVHVYRDQRVHSGERP

SEQ ID NO: 6099 - protein, 81 aa, Callithrix jacchus
MAAAAPRLPAQGTVTFEDVAVNFTWEEWNLLSEAQRCLYRDVMLENLALTSSLGCWCGVEDEEAPSKQSIYVQKETQVRTP

SEQ ID NO: 6100 - protein, 81 aa, Callithrix jacchus
MAAATLRLSAQGTVTFEDVAVNFTWEEWNLLSEAQRCLYRDVMLENLALTSSLGCWCGVEDEEAPSKQSIYVQKETQVRTP

SEQ ID NO: 6101 - protein, 81 aa, Callithrix jacchus
MAAATLRLSAQGTVTFEDVAVNFTWEEWNLLSEAQRCLYRDVMLENLALTSSLGCWCGVEDEEAPSKQSIYVQKETQRRGF

SEQ ID NO: 6102 - protein, 81 aa, Callithrix jacchus
VTFEDVAVNFTWEEWNLLSEAQRCLYRDVMLENLALTSSLGCWCGVEDEEAPSKQSIYVQKETQRRGFNHVEQDSLDLLTS

SEQ ID NO: 6103 - protein, 81 aa, Callithrix jacchus
MAAAAPRLPAQGTVTFEDVAVNFSKEEWCLLSEAQRCLYRDVMLENLALISSLGCWCGLKDEAAPSKQSMIVQTESQDRTP

SEQ ID NO: 6104 - protein, 81 aa, Callithrix jacchus
VKKTKSESKHGSPFQEGKTNYRRGERTKVFSTKHSLTPHQKLFTRDGCYVCSDCGKSFSKYDSFRNHQRIHTGKGPYECGE

SEQ ID NO: 6105 - protein, 81 aa, Callithrix jacchus
MAAAAPRLPAQQGTVTFEDVAVNFSKEEWCLLSEAQRCLYRDVMLENLALISSLGCWCGLKDEAAPSKQSMIVQTESQDRT

SEQ ID NO: 6106 - protein, 81 aa, Callithrix jacchus
MQGTVTFEDVAVNFSREEWSLLSEVQRCLYHDVMLENWVLTSSLGCWCESEYEEAPSKQNISIQRVSPVSSPRAGVSLKKA

SEQ ID NO: 6107 - protein, 81 aa, Callithrix jacchus
HRMTWDCIAIGNHGNSVQGTVTFEDVAVNFSREEWSLLSEVQRCLYHDVMLENWVLTSSLGCWCESEYEEAPSKQNISIQR

SEQ ID NO: 6108 - protein, 81 aa, Callithrix jacchus
MQQGTVTFEDVAVNFSREEWSLLSEVQRCLYHDVMLENWVLTSSLGCWCESEYEEAPSKQNISIQRVSPVSSPRAGVSLKK

SEQ ID NO: 6109 - protein, 81 aa, Callithrix jacchus
MAAAALRLPAQQGTVTFEDVAVNFSREEWSLLSEVQRCLYHDVMLENWVLTSSLGCWCESEYEEAPSKQNISIQRVSPVSS

SEQ ID NO: 6110 - protein, 81 aa, Callithrix jacchus
MAAAELTAPALGIVTFEDVAVYFSWKEWSLLDEAQKCLYHHVMLENLTLTTSLGGCGTEDEEAPYQQSTSPQRGSQVRIPK

SEQ ID NO: 6111 - protein, 81 aa, Callithrix jacchus
GSPEEGRRAAGLPAAQEQEPVTFKDVAVDFTQEEWGQLDLVQRTLYRDVMLETYGHLLSVGNQTAKPEVISLLEQGEEPWS

SEQ ID NO: 6112 - protein, 81 aa, Callithrix jacchus
ARRRSGGCRRRGLLAVRWEQVTFEDVVVDFTQEEWGQLEPAQRTLYYDVILGTFRLLVAVGHWLPKLNIISLLEQEAELRA

SEQ ID NO: 6113 - protein, 81 aa, Callithrix jacchus
VDPALCASGDPEQVTFEDVVVDFTQEEWGQLEPAQRTLYYDVILGTFRLLVAVGHWLPKLNIISLLEQEAELRAVDPGVPQ

SEQ ID NO: 6114 - protein, 81 aa, Callithrix jacchus
QQEKQEDAAICPVTVLPEEPVTFQDVAVDFSREEWGLLGPTQRTEYRDVMLETFGHLVSVGWETTLENKQLAPNSGIPGEE

SEQ ID NO: 6115 - protein, 81 aa, Callithrix jacchus
MASRLPTVWSCEPVTFEDVTLGFNPEEWGLLDLKQKSLYREVMLENYRNLVSVEHQLSKPDVVSQLEEAEDFWPVERGIPQ

SEQ ID NO: 6116 - protein, 81 aa, Callithrix jacchus
MASRLPTVWSCEPVTFEDVTLGFNPEEWGLLDLKQKSLYREVMLENYRNLVSVEYSELQLDPKLDPLSAESPLMNIEVVEV

SEQ ID NO: 6117 - protein, 81 aa, Callithrix jacchus
MLENYRNLVSVEHQLSKPDVVSQLEEAEDFWPVERGIPQDTIPEYSELQLDPKLDPLSAESPLMNIEVVEVLTLNQEVAGP

SEQ ID NO: 6118 - protein, 81 aa, Callithrix jacchus
DEAVAAVMSVGPPAAQLQEPVTFRDVAVDFTQEEWGQLDPTQRILYRDVMLETFGHLLSIGPELPKPEVISHLEQGTEPWV

SEQ ID NO: 6119 - protein, 81 aa, Callithrix jacchus
CNHCGKGFRHSSSLAQHQRKHAGEKPFECRQRLTFEQTAALTKQEWAEALGCDPPLRQDDRTHRSDRPFKCNQCGKCFIQS

SEQ ID NO: 6120 - protein, 81 aa, Callithrix jacchus
MAGEVQAQLDPSLQGLVMFEDVAVYFSREEWGLLNVTQKGLYRDVMLENFALLSSLGLAPSRSPVFTQLVDDEQSCVTSWV

SEQ ID NO: 6121 - protein, 81 aa, Callithrix jacchus
MAGEVQGLVMFEDVAVYFSREEWGLLNVTQKGLYRDVMLENFALLSSLGLAPSRSPVFTQLVDDEQSCVTSWVDVTLVSRT

SEQ ID NO: 6122 - protein, 81 aa, Callithrix jacchus
GPVQHTCWPCGSAVPSLKSLVTFEDVAVYFSQEEWGLLDVAQRHLYHNVMVENFELITSLGCWHGVEGEEAHPKKNASVEE

SEQ ID NO: 6123 - protein, 81 aa, Callithrix jacchus
PSLKSLVTFEDVAVYFSQEEWGLLDVAQRHLYHNVMVENFELITSLGNALPQHDVSVGADLPNSFPNWLPHFTSLSAVCKC

SEQ ID NO: 6124 - protein, 81 aa, Callithrix jacchus
MAFEDVAVYFSEEEWGLLDTAQRALYRHVMLENFTLVTSLGLSTSRPLVVIQLERGEDPWVPSVKDMTLARNAYGRRTTGS

SEQ ID NO: 6125 - protein, 81 aa, Callithrix jacchus
MAFEDVAVYFSQEEWGLLDTAQRALYRRVMLDNFALVASLGLSTSRPRVVIQLERGEEPWVPSETDMTMSRNTHRRRNPGS

SEQ ID NO: 6126 - protein, 81 aa, Callithrix jacchus
TLAAQSPEGHHGHQEPGSTSFHPPRIQEEWGLLDRSQKELYWDAMLEKYGTVVSLGLPTHQPEAQAQSELGMLLTGAGVCR

SEQ ID NO: 6127 - protein, 81 aa, Callithrix jacchus
MKLLTLRDVTIEFSPEEWRCLDPAQQNLYRDVMLENYRNLVSLGAALSNPDLVTCLEQRKEPYNVKIHQTVARSPAMCSPF

SEQ ID NO: 6128 - protein, 81 aa, Callithrix jacchus
MKLLTFRDVTIEFSPEEWRCLDPAQQNLYRDVMLENYRNLVSLGVALSNPDLVTCLEQRKEPYNVKIHQTVARSPAMCSPF

SEQ ID NO: 6129 - protein, 81 aa, Callithrix jacchus
MELLTFRDVAIEFSPEEWRCLDPAQQNLYRDVMLENYRNLVSLGVAISNPDLVTCLEQRKEPCNVKIRETVAKPPAVCSHF

SEQ ID NO: 6130 - protein, 81 aa, Callithrix jacchus
MELLTFRDVAIEFSSEEWKCLDPAQQNLYRDVMLENYRNLVSLGVVISNPDLVTYLEQRKEPYNLKIHETAAKLPATCSFT

SEQ ID NO: 6131 - protein, 81 aa, Callithrix jacchus
GSQGNLPQADITRMNQAQESVTFEDVAVNFTDREWQCLTDAQRHLYKDVMLENYGHVVSLGFPFPKPPLISHLERGVEPCV

SEQ ID NO: 6132 - protein, 81 aa, Callithrix jacchus
GGYCRGDAVTASRVPPESQGLLKVEDVALSLAPEWTQLDSSQVNLYRDEKQENHGSLASLGGEIQTQSRDLPPAEELPEKE

SEQ ID NO: 6133 - protein, 81 aa, Callithrix jacchus
DEAAMPVFNPVRSQTLVKTEEGTAQALAKEKWPHLSLAQRNLCGNSAQETVRSLSLMTEEIVTKDRLFNAKQETSEEIEKG

SEQ ID NO: 6134 - protein, 81 aa, Callithrix jacchus
KPRDEAAMPVFNPVRSQTLVKTEEGTAQALAKEKWPHLSLAQRNLCGNSAQETVRSLSLMKGVHSRFLVVLLSLLKGQLHI

SEQ ID NO: 6135 - protein, 81 aa, Callithrix jacchus
GGHCREDAMVASRLTPGPQGLLKMEDVALALSPGWTQLDSSQVNLYRDEKQENHGSLVSLGGEIQTQSRDLPPAEELPEKE

SEQ ID NO: 6136 - protein, 81 aa, Callithrix jacchus
GSSGNQEMTATLLTAGFQTLEKIEDMAVSLIREEWLLDPSQKDLSRDNRPENVRNMFSLGGETRSENRELASKQVISTGIQ

SEQ ID NO: 6137 - protein, 81 aa, Callithrix jacchus
DSTLLQGGHTLLSSASFQESVTFKDVIVDFTQEEWKQLDPGQRDLFRDVTLENYTHLVSIGLQVSKPDVISQLEQGTEPWI

SEQ ID NO: 6138 - protein, 81 aa, Callithrix jacchus
TTPQEAMKRDCWWEAWVKKKPVTFEDLAVNFTQEEWDCLDASQRVLYQDVMSETFKNLASVARMFLHKPELITKLEHQEKQ

SEQ ID NO: 6139 - protein, 81 aa, Callithrix jacchus
EQLKPIAPRDCWWEAWVKKKPVTFEDLAVNFTQEEWDCLDASQRVLYQDVMSETFKNLASVARMFLHKPELITKLEHQEKQ

SEQ ID NO: 6140 - protein, 81 aa, Callithrix jacchus
MAAGERRSLLFFQKPVTFEDLAVNFTQEEWDCLDASQRVLYQDVMSETFKNLASVARMFLHKPELITKLEHQEKQWRVTRV

SEQ ID NO: 6141 - protein, 81 aa, Callithrix jacchus
AQNRKAKGLPSNDTDWPQEKEEKVQIVVPVTFRGVTVIFTEAEWKRLSPEQRNLYKEVMLENYRNLLSLDGGQEQQDAAAY

SEQ ID NO: 6142 - protein, 81 aa, Callithrix jacchus
LPSNDTDWPQEKEEKVQIVVPVTFRGVTVIFTEAEWKRLSPEQRNLYKEVMLENYRNLLSLAEPKQEIYPCSSCLLAFSCQ

SEQ ID NO: 6143 - protein, 81 aa, Callithrix jacchus
PSNDTDWPQEKEEKVQIVVPVTFRGVTVIFTEAEWKRLSPEQRNLYKEVMLENYRNLLSLDGVLLLLPRLECNGMISTHCN

SEQ ID NO: 6144 - protein, 81 aa, Callithrix jacchus
ENIETMKKLAQNRKAKGLPSNDTDWPQEKEEKVQIVVPVTFRGVTVIFTEAEWKRLSPEQRNLYKEVMLENYRNLLSLGTE

SEQ ID NO: 6145 - protein, 81 aa, Callithrix jacchus
KNGENIETMKKLAQNRKAKGLPSNDTDWPQEKEEKVQIVVPVTFRGVTVIFTEAEWKRLSPEQRNLYKEVMLENYRNLLSL

SEQ ID NO: 6146 - protein, 81 aa, Callithrix jacchus
MAFRDVAVDFTQDEWRLLSPAQRTLYREVMLENYSNLVSLGISFSKPEIITQLEQGKETWREEKKCPPATCPDPEPELCLD

SEQ ID NO: 6147 - protein, 81 aa, Callithrix jacchus
PLFFGGADPFLMALTQLQAHMAFRDVAVDFTQDEWRLLSPAQRTLYREVMLENYSNLVSLGISFSKPEIITQLEQGKETWR

SEQ ID NO: 6148 - protein, 81 aa, Callithrix jacchus
MAFRDVAVDFTQDEWRLLSPAQRTLYREVMLENYSNLVSLGISFSKPEIITQLEQGKETWREEKKCPPATCPADPEPELCL

SEQ ID NO: 6149 - protein, 81 aa, Callithrix jacchus
MAFRDVAVDFTQDEWRLLSPAQRTLYREVMLENYSNLVSLGISFSKPEIITQLEQGKETWREEKKCPPATCPDHQEYGNNC

SEQ ID NO: 6150 - protein, 81 aa, Callithrix jacchus
MAHMAFRDVAVDFTQDEWRLLSPAQRTLYREVMLENYSNLVSLGISFSKPEIITQLEQGKETWREEKKCPPATCPDPEPEL

SEQ ID NO: 6151 - protein, 81 aa, Callithrix jacchus
MESQGAKTESFMAFGDVTVDFTQKEWRLLSPAQRALYREVTLENYSHLISLGILHSKPELIRRLEQGEAPWGEERRHQPGP

SEQ ID NO: 6152 - protein, 81 aa, Callithrix jacchus
MNTSQGSVLFEDVSVYFTQEEWQLLDPAQRFLYRDVMLENYRHLVSLGHCATKPELIVKLKQGDEPWILKRELPSQSHSDF

SEQ ID NO: 6153 - protein, 81 aa, Callithrix jacchus
PKMNKFQRSVSFQDLTVNFTQEEWQQLDPAQRLLYRDVMLENYSNLVSVGYHVSKPDVIFKLEQGEEPWIVEEFSNQNYPE

SEQ ID NO: 6154 - protein, 81 aa, Callithrix jacchus
MLENYSNLVSVGYHVSKPDVIFKLEQGEEPWIVEEFSNQNYPEVDDALEKNKEIQTVFFSNKTLITERENVFGTTFNLGMN

SEQ ID NO: 6155 - protein, 81 aa, Callithrix jacchus
ALFPEATAFEDMTKDWNYLEASQKDYYRDTMLDSYENMVPQGSFLEFSMMPQRAGNDPPGASNASEMEMEMSNMREKFLMS

SEQ ID NO: 6156 - protein, 81 aa, Callithrix jacchus
LQGKYGNVTKEVIVLYLTLCKQCHQKNPVPKRGLAPKPLTFKDIDSTCQVEILDMQSSADGEFKFILYYQDHLTKFIILRP

SEQ ID NO: 6157 - protein, 81 aa, Callithrix jacchus
MTKDWNYLEASQKDYYRDTMLDSYENMVPQGSFLEFSMMPQRAGNDPPGASNASEMEMEMSNMREKFLMSVTKLVESKSYN

SEQ ID NO: 6158 - protein, 81 aa, Callithrix jacchus
PVLLKLLLSPGLQQPALFPEATAFEDMTKDWNYLEASQKDYYRDTMLDSYENMVPQGSFLEFSMMPQRAGNDPPGASNASE

SEQ ID NO: 6159 - protein, 81 aa, Callithrix jacchus
QGKYGNVTKEVIVLYLTLCKQCHQKNPVPKRGLAPKPLTFKDIDSTCQVEILDMQSSADGEFKFILYYQDHLTKFIILRPL

SEQ ID NO: 6160 - protein, 81 aa, Callithrix jacchus
ASQPAGLAERLIRDQDLGTTLLPAAPQEQWRHLDSTQKEQYWDLMLETYGKMVSGAGISHSKPDLTNSIEYGEELAGLYLH

SEQ ID NO: 6161 - protein, 81 aa, Callithrix jacchus
ASQPAGLAERLIRDQDLGTTLLPAAPQEQWRHLDSTQKEQYWDLMLETYGKMVSGGISHSKPDLTNSIEYGEELAGLYLHV

SEQ ID NO: 6162 - protein, 81 aa, Callithrix jacchus
ASQPAGLAERLIRDQDLGTTLLPAAPQEQWRHLDSTQKEQYWDLMLETYGKMVSGGDRQENDKENLNLENHRDQELLHASC

SEQ ID NO: 6163 - protein, 81 aa, Callithrix jacchus
AASQPAGLAERLIRDQDLGTTLLPAAPQWRHLDSTQKEQYWDLMLETYGKMVSGGISHSKPDLTNSIEYGEELAGLYLHVN

SEQ ID NO: 6164 - protein, 81 aa, Callithrix jacchus
FQEKSTEEGEVAALRLTARSQETVTFKDVAMDFTPEEWGKLDPAQRDMMLENYRNLVSLWLPVSKLENYTLENGKEPLKLE

SEQ ID NO: 6165 - protein, 81 aa, Callithrix jacchus
RSQETVTFKDVAMDFTPEEWGKLDPAQRDMMLENYRNLVSLWLPVSKLENYTLENGKEPLKLERKAPKNSYSVTVAVIILY

SEQ ID NO: 6166 - protein, 81 aa, Callithrix jacchus
LRLTARSQETVTFKDVAMDFTPEEWGKLDPAQRDMMLENYRNLVSLWLPVSKLENYTLENGKEPLKLERKAPKNSYSELPF

SEQ ID NO: 6167 - protein, 81 aa, Callithrix jacchus
EGEVAALRLTARSQETVTFKDVAMDFTPEEWGKLDPAQRDMMLENYRNLVSLWLPVSKLENYTLENGKEPLKLERKAPKNS

SEQ ID NO: 6168 - protein, 81 aa, Callithrix jacchus
SQETVTFKDVAMDFTPEEWGKLDPAQRDMMLENYRNLVSLWLPVSKLENYTLENGKEPLKLERKAPKNSYSGESDRWESSE

SEQ ID NO: 6169 - protein, 81 aa, Callithrix jacchus
TFKDVAMDFTPEEWGKLDPAQRDMMLENYRNLVSLWLPVSKLENYTLENGKEPLKLERKAPKNSYSGAVAHTCNPCTLGGR

SEQ ID NO: 6170 - protein, 81 aa, Callithrix jacchus
TQPDEDLHLQAEETELVKESVTFKDVAIDFTLEEWRLMDPIQRNLHKDVMLENYRNLVFVGLAVSKPDMISHLENGKGPWV

SEQ ID NO: 6171 - protein, 81 aa, Callithrix jacchus
PEVTQPDEDLHLQAEETELVKESVTFKDVAIDFTLEEWRLMDPIQRNLHKDVMLENYRNLVFVGLAVSKPDMISHLENGKG

SEQ ID NO: 6172 - protein, 81 aa, Callithrix jacchus
LRGKHAFQAGWLNDLVTKESMTFKDVAVDITQEDWELMRPVQKELYKTVTLQNYWNMVSLGLTVYRPTVIPILEEPWMVIK

SEQ ID NO: 6173 - protein, 81 aa, Callithrix jacchus
LWSKQEGSFCHRSLVKLHEGLVSFEDVAVHFTWEEWQDLGDAQRTLYRDVMLETYTSLLSLAIQTVNDLIERNQESHDRFF

SEQ ID NO: 6174 - protein, 81 aa, Callithrix jacchus
WSKQEGSFCHRSLVKLHEGLVSFEDVAVHFTWEEWQDLGDAQRTLYRDVMLETYTSLLSLGHCITKPEMIFKLEQGAGPWM

SEQ ID NO: 6175 - protein, 81 aa, Callithrix jacchus
EWQDLGDAQRTLYRDVMLETYTSLLSLGHCITKPEMIFKLEQGAGPWMVEEAPNRDFQLSRLLMTLLKGTRKVMIDFSGKL

SEQ ID NO: 6176 - protein, 81 aa, Callithrix jacchus
LCFQCPLGVSKSNKKCINLWSKQEGSFCHRSLVKLHEGLVSFEDVAVHFTWEEWQDLGDAQRTLYRDVMLETYTSLLSLGV

SEQ ID NO: 6177 - protein, 81 aa, Callithrix jacchus
MAATLLMAGSQAPVTFEDMAMYLTREEWRPLDPAQRDLYRDVMQENYGNVVSLDFEIRSDSEVNPKQEISEDVQFGTASER

SEQ ID NO: 6178 - protein, 81 aa, Callithrix jacchus
FGTASERPAENAEENPESEEVFESRDRSERQWGDLTAEEWVSYPLQQVTDLLVHKEVHTGIRYHICSHCGKAFSQISDLNR

SEQ ID NO: 6179 - protein, 81 aa, Callithrix jacchus
GENLESRVTLGSPAAESQELLTFKDVSVDFTQEEWGQLAPAHRNLYREVMLENYGNLVSVGYQLSKPGLISQLEKGEEPWL

SEQ ID NO: 6180 - protein, 81 aa, Callithrix jacchus
EESLEDEVNPGLPTAESQELLTFKDISIDFTQEEWGQLTPAYQNLYREVMLENYSNLVSVGYQLSKPSVISQLEKGEEPWM

SEQ ID NO: 6181 - protein, 81 aa, Callithrix jacchus
EEPWMTEKEGSGDPSSDLKSNTETTESTAKNTISQEQLYHGIMMERFMRDDIIYSTLRKVSTYDDVLERHQETCVRDVRQA

SEQ ID NO: 6182 - protein, 81 aa, Callithrix jacchus
MINFQESVTFQDVAVDFTPEEWQLLDCAERTLYWDVMLENYRNFISVGCPVTKTKVIIKAEQGQEPWMVERVNPHQSSPES

SEQ ID NO: 6183 - protein, 81 aa, Callithrix jacchus
MINFQESVTFQDVAVDFTPEEWQLLDCAERTLYWDVMLENYRNFISVGCPVTKTKVIIKAEQGQEPWMVERVNPHQSSPDK

SEQ ID NO: 6184 - protein, 81 aa, Callithrix jacchus
MEPRESGKAPVTFDDITVYLLQEEWVLLSQQQKELCGSDKLVPPLGPTVANPELFRKFRRGPEPWLGSVQGQRSLLEHHPG

SEQ ID NO: 6185 - protein, 81 aa, Callithrix jacchus
QDPSAERLMEEVPVVFEELPVVFEDVAVYFTREEWGMLDKRQKELYRDVMRMNYELLASLGPAAAKPDLISKLERRAAPWI

SEQ ID NO: 6186 - protein, 81 aa, Callithrix jacchus
MARKVSITFKDLAVRFSEEEWRLLEEGQREFYRDVMRENYETLVSVGTAELLPLSAFLSPSEPGGAIGGGSRTDEGQEPAG

SEQ ID NO: 6187 - protein, 81 aa, Callithrix jacchus
MRENYETLVSVGTAELLPLSAFLSPSEPGGAIGGGSRTDEGQEPAGCGGPQGGQPRHSLHLTALVQLVKEIPEFLFGEVKG

SEQ ID NO: 6188 - protein, 81 aa, Callithrix jacchus
KKLADCEKTAVEFGNQLEGKWAVLGTLLQEYGLLQRRLENVENLLRNRNFWILRLPPGSKGEAPKVPVTFDDVAVYFSEQE

SEQ ID NO: 6189 - protein, 81 aa, Callithrix jacchus
RNFWILRLPPGSKGEAPKVPVTFDDVAVYFSEQEWGKLEDWRKELYKHVMRGNYETLVSLDYAISKPEVLSQIEQGKEPCS

SEQ ID NO: 6190 - protein, 81 aa, Callithrix jacchus
KKLADCEKTAVEFGNQLEGKWAVLGTLLQEYGLLQRRLENVENLLRNRNFWILRLPPGSKGEAPKEWGKLEDWRKELYKHV

SEQ ID NO: 6191 - protein, 81 aa, Callithrix jacchus
LENVENLLRNRNFWILRLPPGSKGEAPKEWGKLEDWRKELYKHVMRGNYETLVSLDYAISKPEVLSQIEQGKEPCSWRCPG

SEQ ID NO: 6192 - protein, 81 aa, Callithrix jacchus
RNFWILRLPPGSKGEAPKVPVTFDDVAVYFSEQEWGKLEDWQKELYKHVMRGNYETLVSLDYAISKPEVLSQIEQGKEPCS

SEQ ID NO: 6193 - protein, 81 aa, Callithrix jacchus
KKLADCEKTAVEFGNQLEGKWAVLGTLLQEYGLLQRRLENVENLLRNRNFWILRLPPGSKGEAPKEWGKLEDWQKELYKHV

SEQ ID NO: 6194 - protein, 81 aa, Callithrix jacchus
LENVENLLRNRNFWILRLPPGSKGEAPKEWGKLEDWQKELYKHVMRGNYETLVSLDYAISKPEVLSQIEQGKEPCSWRRPG

SEQ ID NO: 6195 - protein, 81 aa, Callithrix jacchus
KKLADCEKTAMEFRNQLEGKWAVLGTLLQEYGLLQRRLENMENLLRNRNFWILRLPPGSKGEAPKVPVTFDDVAVYFSELE

SEQ ID NO: 6196 - protein, 81 aa, Callithrix jacchus
RNFWILRLPPGSKGEAPKVSRSLENDGVCFTEQEWENLEDWQKELYRNVMESNYETLVSLKVLGQPEGEAELGTGMLGDLE

SEQ ID NO: 6197 - protein, 81 aa, Callithrix jacchus
PGGAHPAGGVMIKQELQYTQEGPADLPGEFSCIAEEQAFLSPEQTELWDGQGGSVLLETSPGDSTLEEPVGSGDPSSGRTL

SEQ ID NO: 6198 - protein, 81 aa, Callithrix jacchus
NFWILRLPPGSKGEAPKVSRSLENDGVCFTEQEWENLEDWQKELYRNVMESNYETLVSLSGVLLCRPGWSAMAGSWLTATT

SEQ ID NO: 6199 - protein, 81 aa, Callithrix jacchus
NFWILRLPPGSKGEAPKVSRSLENDGVCFTEQEWENLEDWQKELYRNVMESNYETLVSLSSSDSPTSASIAGITEVLGQPE

SEQ ID NO: 6200 - protein, 81 aa, Callithrix jacchus
LEEEGPGGAHPAGGVMIKQELQYTQEGPADLPGEFSCIAEEQAFLSPEQTELWDGQGGSVLLETSPGDSTLEEPVGSGDPS

SEQ ID NO: 6201 - protein, 81 aa, Callithrix jacchus
KKLADCEKTAVEFGNHMESKWAMLGTLLQEYGLLQRRLENLENLLRNRNFWVLRLPPGSKGEAPKVPVTFVDIAVYFSEDE

SEQ ID NO: 6202 - protein, 81 aa, Callithrix jacchus
RNFWVLRLPPGSKGEAPKVPVTFVDIAVYFSEDEWKNLDEWQKELYNNLVKENYKTLMSLDADGPVPKPDAPAQAEPREEP

SEQ ID NO: 6203 - protein, 81 aa, Callithrix jacchus
EEALCVRGQRSLEERAIPTESITDSPVCAQDLLSRIKQEEHQCVWDQQDLADREIPTDPNSESLISAHDILSWIKQEEQPY

SEQ ID NO: 6204 - protein, 81 aa, Callithrix jacchus
MAEPASGTLTFDDVALYFSEQEWEILEKWQKQMYKQEMKTNYETLDSLGYAFSKPDLITWMEKGRMLLISDQGRLHKTKRT

SEQ ID NO: 6205 - protein, 81 aa, Callithrix jacchus
QGRLHKTKRTAGPPTDEQLVMKNTEKLPCFDDRGTLGTKEEDCHLNGPQKQDLCAALPRRERKILSAQRASFQSPNLQETE

SEQ ID NO: 6206 - protein, 81 aa, Callithrix jacchus
GRGCRLCRNSGPCRGWSGGTLTFDDVALYFSEQEWEILEKWQKQMYKQEMKTNYETLDSLGYAFSKPDLITWMEKGRMLLI

SEQ ID NO: 6207 - protein, 81 aa, Callithrix jacchus
SLGYAFSKPDLITWMEKGRMLLISDQGRLHKTKRTAGPPTDEQLVMKNTEKLPCFDDRGTLGTKEEDCHLNGPQKQDLCAA

SEQ ID NO: 6208 - protein, 81 aa, Callithrix jacchus
MTEPLRLPLTFEDVAIYFSEQEWQDLQAWQKELYKRVMRSNYETLISLDDGLPKPELIAWIEQGEEPFRNWRESQKSGNII

SEQ ID NO: 6209 - protein, 81 aa, Callithrix jacchus
MIQSQISFEDVAVDFTLEEWQLLNPTQKNLYREVMLENYSNLVFLGYQIIKPDAISKWEQQDPWIIDQEILSQNFSEVWLD

SEQ ID NO: 6210 - protein, 81 aa, Callithrix jacchus
MIQSQISFEDVAVDFTLEEWQLLNPTQKNLYREVMLENYSNLVFLEVWLDNPKMWLQDNQDNLKSMERGNKYGVFGNIFKS

SEQ ID NO: 6211 - protein, 81 aa, Callithrix jacchus
MATSFRIASWWGWLSFKDISMEFTWDEWQLLDSTQKYLYREVILENYHNLISVGYHGAKPDLIFKLEQGEDPWIVNAKISR

SEQ ID NO: 6212 - protein, 80 aa, Callithrix jacchus
MATSFRIASWWGWLSFKDISMEFTWDEWQLLDSTQKYLYREVILENYHNLISVDGWEEWYQKNQDELESVERSYACSVLG

SEQ ID NO: 6213 - protein, 81 aa, Callithrix jacchus
TFRNLGGTPWPQGNSALPGWLSFKDISMEFTWDEWQLLDSTQKYLYREVILENYHNLISVGYHGAKPDLIFKLEQGEDPWI

SEQ ID NO: 6214 - protein, 81 aa, Callithrix jacchus
REVILENYHNLISVGYHGAKPDLIFKLEQGEDPWIVNAKISRESCPDGWEEWYQKNQDELESVERSYACSVLGRLNLSKTH

SEQ ID NO: 6215 - protein, 81 aa, Callithrix jacchus
MTMLQDSFSFDDLSVDFTQKEWQLLDPSQKNLYKDVMLENYSSLVSLGYEAMKPDVIFKLEQGEEPWIGDEEIPSSWSPDI

SEQ ID NO: 6216 - protein, 81 aa, Callithrix jacchus
MTMLQDSFSFDDLSVDFTQKEWQLLDPSQKNLYKDVMLENYSSLVSLGYEAMKPDVIFKLEQGEEPWIGDEEIPSSWSPVW

SEQ ID NO: 6217 - protein, 81 aa, Callithrix jacchus
MTMLQDSFSFDDLSVDFTQKEWQLLDPSQKNLYKDVMLENYSSLVSLGYEAMKPDVIFKLEQGEEPWIGDEEIPSSWSPGT

SEQ ID NO: 6218 - protein, 81 aa, Callithrix jacchus
MSQGSVTFRDVAIDFSQEEWKWLQPAQRDLYRCVMLENYGHLVSLGLSISKPDVVSLLEQGKEPWLGKRDVKRDLFPVSES

SEQ ID NO: 6219 - protein, 81 aa, Callithrix jacchus
MLENYGHLVSLGLSISKPDVVSLLEQGKEPWLGKRDVKRDLFPVSESNGEIKDFSSKNVIYDDSSQYLIMEGILSQGPVYS

SEQ ID NO: 6220 - protein, 81 aa, Callithrix jacchus
MSQGSVTFRDVAIDFSQEEWKWLQPAQRDLYRCVMLENYGHLVSLAGLSISKPDVVSLLEQGKEPWLGKRDVKRDLFPVRV

SEQ ID NO: 6221 - protein, 81 aa, Callithrix jacchus
MSQGSVTFRDVAIDFSQEEWKWLQPAQRDLYRCVMLENYGHLVSLGLSISKPDVVSLLEQGKEPWLGKRDVKRDLFPVLKE

SEQ ID NO: 6222 - protein, 81 aa, Callithrix jacchus
IREFGGMGAGIANIWSFQGSVTFRDVAIDFSQEEWKWLQPAQRDLYRCVMLENYGHLVSLGLSISKPDVVSLLEQGKEPWL

SEQ ID NO: 6223 - protein, 81 aa, Callithrix jacchus
RSADEERMIAVFLTTWLQEPMTFKDIAVEFTQEEWIMLDSSQRSLYKDVMLENYRNLTSVEYQLCKLTVISPLHQEEIRSM

SEQ ID NO: 6224 - protein, 81 aa, Callithrix jacchus
SMNKINPQAICPDQKIQPKTKESTMQNILGEEPFNAVKIKFTMDNWSSTLREDWECHKIRKQHKIPGVHWRQVTYAPKETV

SEQ ID NO: 6225 - protein, 81 aa, Callithrix jacchus
MDAKSLTAWSQTLVTFKDVFVDFTREEWKLLDTAQQIVYRNVMLENYKNLVSLGYQLTKPDVILRLEKGEEPWVVERGIHQ

SEQ ID NO: 6226 - protein, 81 aa, Callithrix jacchus
VLECLFISQEQTQITRSWGPLSFMDVFVDFTWEEWQLLDPAQKCLYRSVMLENYSNLVSLGYQHTKPDIIFKLEQGEELCM

SEQ ID NO: 6227 - protein, 81 aa, Callithrix jacchus
MDVFVDFTWEEWQLLDPAQKCLYRSVMLENYSNLVSLGYQHTKPDIIFKLEQGEELCMVQAPIPNQCCPNKVWKIDDLMEW

SEQ ID NO: 6228 - protein, 81 aa, Callithrix jacchus
QRQKSHRTEKVLECLFISQEQTQITRSWEWQLLDPAQKCLYRSVMLENYSNLVSLGYQHTKPDIIFKLEQGEELCMVQAPI

SEQ ID NO: 6229 - protein, 81 aa, Callithrix jacchus
MATRVRTASVWGPLSFMDVFVDFTWEEWQLLDPAQKCLYRSVMLENYSNLVSLGYQHTKPDIIFKLEQGEELCMVQAPIPN

SEQ ID NO: 6230 - protein, 81 aa, Callithrix jacchus
SFMDVFVDFTWEEWQLLDPAQKCLYRSVMLENYSNLVSLGYQHTKPDIIFKLEQGEELCMVQAPIPNQCCPILEAGKLEAK

SEQ ID NO: 6231 - protein, 81 aa, Callithrix jacchus
MGPLTFRDVAIEFSLEEWQCLDTAQQDLYRKVMLENYRNLVFLAGIAVSKADLITCLQQEKVPWNMKRHSMAATPPVLCSH

SEQ ID NO: 6232 - protein, 81 aa, Callithrix jacchus
MGPLTFRDVAIEFSLEEWQCLDTAQQDLYRKVMLENYRNLVFLGIAVSKADLITCLQQEKVPWNMKRHSMAATPPVLCSHF

SEQ ID NO: 6233 - protein, 81 aa, Callithrix jacchus
MAMSQESLTFKDVFVDFTLEEWQQLDSAQKNLYRDVMLENYSHLVSVGYLLAKPDMIFRLGPGEESWRADGGTPVRTCAEV

SEQ ID NO: 6234 - protein, 81 aa, Callithrix jacchus
MAMSQESLTFKDVFVDFTLEEWQQLDSAQKNLYRDVMLENYSHLVSVGYLLAKPDMIFRLGPGEESWRADGGTPVRTCAGE

SEQ ID NO: 6235 - protein, 81 aa, Callithrix jacchus
MAMSQESLTFKDVFVDFTLEEWQQLDSAQKNLYRDVMLENYSHLVSVGYLLAKPDMIFRLGPGEESWRADGGTPVRTCAGK

SEQ ID NO: 6236 - protein, 81 aa, Callithrix jacchus
MAMSQESLTFKDVFVDFTLEEWQQLDSAQKNLYRDVMLENYSHLVSVGYLLAKPDMIFRLGPGEESWRADGGTPVRTCAGN

SEQ ID NO: 6237 - protein, 81 aa, Callithrix jacchus
MATSQESLTFKDVFVDFTLEEWQQLDSAQKNLYRDVMLENYSHLVSVGYLLAKPDMIFRLGPGEESWRADGGTPVRTCAGE

SEQ ID NO: 6238 - protein, 81 aa, Callithrix jacchus
MATSQESLTFKDVFVDFTLEEWQQLDSAQKNLYRDVMLENYSHLVSVGYLLAKPDMIFRLGPGEESWRADGGTPVRTCAVW

SEQ ID NO: 6239 - protein, 81 aa, Callithrix jacchus
MKTKTFKESLTFKDVFVDFTLEEWQQLDSAQKNLYRDVMLENYSHLVSVGYLLAKPDMIFRLGPGEESWRADGGTPVRTCA

SEQ ID NO: 6240 - protein, 81 aa, Callithrix jacchus
MATSQESLTFKDVFVDFTLEEWQQLDSAQKNLYRDVMLENYSHLVSVGYLLAKPDMIFRLGPGEESWRADGGTPVRTCAVF

SEQ ID NO: 6241 - protein, 81 aa, Callithrix jacchus
SPQAFPALIPGEHGRSFEGSVSFEDVAVDFTRQEWHRLDPAQRTMHKDVMLETYSNLASVGLCVAKPEMIFKLERGEELWI

SEQ ID NO: 6242 - protein, 81 aa, Callithrix jacchus
SSPWSLALATEGRGSSYEISVSFEDVTVDFSKEEWQHLDPAQRRLYWDVTLENYSHLLSVGYHIPKSEATFKLEQGEGPWT

SEQ ID NO: 6243 - protein, 81 aa, Callithrix jacchus
EAHMSADHAALNRIVSLQISVSFEDVTVDFSKEEWQHLDPAQRRLYWDVTLENYSHLLSVGYHIPKSEATFKLEQGEGPWT

SEQ ID NO: 6244 - protein, 81 aa, Callithrix jacchus
MPANEDTPQPGGHGSACEVSVSFEDVTVDFSREEWQQLDSTQRRLYQDVMLENYSHLLSVGFEVPKPEVIFKLEQGEGPWT

SEQ ID NO: 6245 - protein, 81 aa, Callithrix jacchus
MAKPQGLVTFEDVAVAFTQEEWQYLNPLQRTLYRDVMLETYSNLVFVGQQVTKPDLILKLEVEECPVEEKIPFWSFPEICQ

SEQ ID NO: 6246 - protein, 81 aa, Callithrix jacchus
GLVTFEDVAVAFTQEEWQYLNPLQRTLYRDVMLETYSNLVFVGQQVTKPDLILKLEVEECPVEEKIPFWSFPEICQVNEQI

SEQ ID NO: 6247 - protein, 81 aa, Callithrix jacchus
MIESQESVTFEDVAVDFTQEEQQLNPAQKTLHRDVMLETYSHLVSVGCSGIKPDVIFKVEHEKDPWTKDSVLSRWIYPGRL

SEQ ID NO: 6248 - protein, 81 aa, Callithrix jacchus
MIESQESVTFEDVAVDFTQEEQQLNPAQKTLHRDVMLETYSHLVSVGCSGIKPDVIFKVEHEKDPWTKDSVLSRWIYPDRE

SEQ ID NO: 6249 - protein, 81 aa, Callithrix jacchus
MVEGEEEQQLNPAQKTLHRDVMLETYSHLVSVGCSGIKPDVIFKVEHEKDPWTKDSVLSRWIYPDREKGLKSSQQIISGEL

SEQ ID NO: 6250 - protein, 80 aa, Callithrix jacchus
MIESQESVTFEDVAVDFTQEEQQLNPAQKTLHRDVMLETYSHLVSVGCSGIKPDVIFKVEHEKDPWTKDSVLSRWIYPER

SEQ ID NO: 6251 - protein, 81 aa, Callithrix jacchus
MIESQEEQQLNPAQKTLHRDVMLETYSHLVSVGCSGIKPDVIFKVEHEKDPWTKDSVLSRWIYPDREKGLKSSQQIISGEL

SEQ ID NO: 6252 - protein, 81 aa, Callithrix jacchus
GDGSFAKNPSDDEQISENKRKAFADIAQYFSKKDWKKLKYSEKITYVYMKRNYEAMRTLGFQVTIPLFMRDKQAEDSQEDD

SEQ ID NO: 6253 - protein, 81 aa, Callithrix jacchus
QAPDMLHRFYGKNSSYVHGGLDSNGKPADAIYGQKEIHRKVMSENFTNCHTKIRHVDAHAMLNDGVVVQVMGLLSNNNQAL

SEQ ID NO: 6254 - protein, 81 aa, Callithrix jacchus
KSTKDWKMASEFILPASQSLLTFEDVAVYFSEEEWQLLDPPEKTLYNDVMQDIYETVISLGLKLKSDTGNDHPVSVSTSEM

SEQ ID NO: 6255 - protein, 81 aa, Callithrix jacchus
MAAILLTTRPKVPVSFEDVSLYFTKTEWKLLDLRQKVLYKRVMLENYSHLVSLGFSFSKPHLISQLERGEGPWVADIPRTR

SEQ ID NO: 6256 - protein, 81 aa, Aotus trivirgatus
MGVLTFRDVAIEFSPEEWECLDSAQQHLYRDVMLENYRNLVSLGLAIFKPDLITCLEQRKEPWNLKKQETLAKYPAKHKII

SEQ ID NO: 6257 - protein, 81 aa, Aotus trivirgatus
MGVLTFRDVAIEFSPEEWECLDSAQQHLYRDVMLENYRNLVSLGLAIFKPDLITCLEQRKEPWNLKKQETLAKYPDLAKHK

SEQ ID NO: 6258 - protein, 80 aa, Aotus trivirgatus
MGVLTFRDVAIEFSPEEWECLDSAQQHLYRDVMLENYRNLVSLGLAIFKPDLITCLEQRKEPWNLKKQETLAKYPVNIRL

SEQ ID NO: 6259 - protein, 81 aa, Aotus trivirgatus
MEEKEMNDGSQMVRSQESLTFQDVAVDFTREEWDQLYPAQKDLYRDVMLENYRNLVALGHQLYKPEVIAQLELEEEWMIER

SEQ ID NO: 6260 - protein, 81 aa, Aotus trivirgatus
MPSQSAVFSQEENMEEKEMNDGSQMVRSQESLTFQDVAVDFTREEWDQLYPAQKDLYRDVMLENYRNLVALGHQLYKPEVI

SEQ ID NO: 6261 - protein, 81 aa, Aotus trivirgatus
ENMEEKEMNDGSQMVRSQESLTFQDVAVDFTREEWDQLYPAQKDLYRDVMLENYRNLVALGHQLYKPEVIAQLELEEEWMI

SEQ ID NO: 6262 - protein, 81 aa, Aotus trivirgatus
GGLWDFDYHPEFNQEDQQRYLGQVTLTHKKITHQRNLECNKFTENCNLNSTLRHQRIPSIKIPLNSDTQGSNIKHNSDLIY

SEQ ID NO: 6263 - protein, 81 aa, Aotus trivirgatus
DSLGDEMLAAALLKAKSQELVTFEDVAVYFIRKEWKRLEPAQRDLYRDVMLENYGNVFSLDRIRVSLTIQKVMLAWFTGTL

SEQ ID NO: 6264 - protein, 81 aa, Aotus trivirgatus
EGSPRDQAMASALFTADSQAMVKIEDMAVSLILEEWGCQNLARRNLSRDNRQENYGSAFPQGGENRNENEESTSKAETAKD

SEQ ID NO: 6265 - protein, 81 aa, Aotus trivirgatus
MASALFTADSQAMVKIEDMAVSLILEEWGCQNLARRNLSRDNRQENYGSAFPQGGENRNENEESTSKAETAKDSASRGETA

SEQ ID NO: 6266 - protein, 81 aa, Aotus trivirgatus
GPGLPTMNPRDQEMAAGFFTAGSQGLGPFKDMALAFPEEEWRHVTPAQIDCFGEYVEPQDCRVSPGIGSKEKEAKPPQEDL

SEQ ID NO: 6267 - protein, 81 aa, Aotus trivirgatus
SQELTTSLLSTGSQKLVKIEEVADVAVSFILEEWGHLDQSQKSLYRDDRKENYGSITSMDYESRDNMDLMVKQVSDDTESH

SEQ ID NO: 6268 - protein, 81 aa, Aotus trivirgatus
HLKRHFREKSQRCSDKRSKNAKLSVKKKISEFSEADMDLSGKTQRNISQDQDFGECCELQGKLDRKQGIPMKEILGQPSSK

SEQ ID NO: 6269 - protein, 81 aa, Aotus trivirgatus
EEAVAVVQALQRALDGTSPQGMMTFEDMAMSLTWEEWERLDPARKDFYRESMQKDSGSTVPPSLESRTENKELIPVQEILE

SEQ ID NO: 6270 - protein, 81 aa, Aotus trivirgatus
GEEHGNTCNQSFHVVTWHVLKPHKSHSGDSFHHSSLFKTQRQLHEERPYKCDNCGKSFKQRSDLFRHQRIHTGEKPYGCQE

SEQ ID NO: 6271 - protein, 81 aa, Aotus trivirgatus
MFPPVCGKELLSFEDVAMYFTREEWGHLDWGQKDLYRDVMLENYRNMVLLGFQFPKPEVICQLENWDEQWILDLPRAGNRK

SEQ ID NO: 6272 - protein, 81 aa, Aotus trivirgatus
MELLSFEDVAMYFTREEWGHLDWGQKDLYRDVMLENYRNMVLLGFQFPKPEVICQLENWDEQWILDLPRAGNRKASGSACP

SEQ ID NO: 6273 - protein, 81 aa, Aotus trivirgatus
EDEDEDEDEDDLLTAGSQGLVTFEDVAVYFSLEEWERLEADQRGLYQEVMQENYGILVSLGYPIPKPDLIFRLEQGEEPWV

SEQ ID NO: 6274 - protein, 81 aa, Aotus trivirgatus
MLENYSNLVSVGYHIIKPDVITKLEQGEEPWIVEGEFLLQSYPDEVWQTDDLIERVQEDENKPSRQTVFIKTLTEEREYIS

SEQ ID NO: 6275 - protein, 81 aa, Aotus trivirgatus
MNKSLGPVSFKDVAVDFTQEEWQQLDPEQKITYRDVMLENYSNLVSVGYHIIKPDVITKLEQGEEPWIVEGEFLLQSYPDE

SEQ ID NO: 6276 - protein, 81 aa, Aotus trivirgatus
MNKLQGPMSFKDVAVDFTQEEWQQLDPDEKITYRDVMLENYSHLVSVGCNITKPNVIIKLEQGEEPWIMEDEFPCQHSPEV

SEQ ID NO: 6277 - protein, 81 aa, Aotus trivirgatus
MNKLQGPMSFKDVAVDFTQEEWQQLDPDEKITYRDVMLENYSHLVSVGCNITKPNVIIKLEQGEEPWIMEDEFPCQHSPAA

SEQ ID NO: 6278 - protein, 81 aa, Aotus trivirgatus
MLENYSNLVSVGYHVSKPDVIFKLEQGEEPWIVEEFSNQNYPEVDHTLEKNREIQDKHLRPTAFFSNKTLITERENVFGTT

SEQ ID NO: 6279 - protein, 81 aa, Aotus trivirgatus
LAQNHKAKGLPSNDTDWPQEKERKAIVVPVTFRDVTVIFTEAEWKRLSPEQRNLYKEVMLESYRNLLSLDGGQEQQDAAAY

SEQ ID NO: 6280 - protein, 81 aa, Aotus trivirgatus
LPSNDTDWPQEKERKAIVVPVTFRDVTVIFTEAEWKRLSPEQRNLYKEVMLESYRNLLSLAELKPEIYPCSSCLLAFSCQQ

SEQ ID NO: 6281 - protein, 81 aa, Aotus trivirgatus
PSNDTDWPQEKERKAIVVPVTFRDVTVIFTEAEWKRLSPEQRNLYKEVMLESYRNLLSLDRVLLLLPRLQCNGIILTHCNL

SEQ ID NO: 6282 - protein, 81 aa, Aotus trivirgatus
SKSGENIETMKKLAQNHKAKGLPSNDTDWPQEKERKAIVVPVTFRDVTVIFTEAEWKRLSPEQRNLYKEVMLESYRNLLSL

SEQ ID NO: 6283 - protein, 81 aa, Aotus trivirgatus
EKETWKRKRRAKESVALPQGLLTFRDVAIEFSQEEWKSDPAQRTLYRDAMLENYRNLVSLDLSSKCVKKFLSMGQGNTVVF

SEQ ID NO: 6284 - protein, 81 aa, Aotus trivirgatus
MAATLLMAGSQAPVTFEDMAMYLTREEWRPLDPAQRDLYRDVMQENYGNVVSLDFEIRSESEVNPKQEISEDVQFGTTSER

SEQ ID NO: 6285 - protein, 81 aa, Aotus trivirgatus
FGTTSERPVENAEENPESEEPFESRDRSERQWGDLTAEEWVSYPLQQVTDLLVHKEVHTGIRYHICSHCGKAFSQISDLNR

SEQ ID NO: 6286 - protein, 81 aa, Aotus trivirgatus
MAVTFEDVTIIFTWEEWKFLDSSQKRLYREVMWENYTNVMSVGNWNESYKSQEEKFRYLEYENFSCWQAWWNAGTQIYEIQ

SEQ ID NO: 6287 - protein, 81 aa, Aotus trivirgatus
RKNLSMEKEQKLRVQHSYIPMEEALPQYIGVICQKDLLKDSMEEKYCRCNKCKEIYYWNSQCVFHKRNQPGENLYQCSISK

SEQ ID NO: 6288 - protein, 81 aa, Aotus trivirgatus
QKGSIKDKMKADSQTGKPQEPVTFKDVVVEFSKEEWGQLDSAVKNLYRDVMLENFRNVNSLRKAHLLSKPVESLELTKKKK

SEQ ID NO: 6289 - protein, 81 aa, Aotus trivirgatus
GPLEHLCCNLEEEPQSLQEKAQSAPWVPAIPQEGNTGDWEMAAALLAAGSQGLVTIKDVSLCFSQEEWRSLDPSQTDFYGE

SEQ ID NO: 6290 - protein, 81 aa, Aotus trivirgatus
MMKSQGLVSFKDVAVDFTQEEWQQLDPTQRTLYRDVMLENYSHLVSMGYPVSKPDVISKLEQGEEPWIVKRDISNWIYPDE

SEQ ID NO: 6291 - protein, 81 aa, Aotus trivirgatus
MLENYSHLVSMGYPVSKPDVISKLEQGEEPWIVKRDISNWIYPDEYQADGIQDRKSNLHNSESCILGTVFSQHKILKGVTK

SEQ ID NO: 6292 - protein, 81 aa, Aotus trivirgatus
ADPSSSGLLEEQKMMKSQGLVSFKDVAVDFTQEEWQQLDPTQRTLYRDVMLENYSHLVSMGYPVSKPDVISKLEQGEEPWI

SEQ ID NO: 6293 - protein, 81 aa, Aotus trivirgatus
NILDQEVTTTRLPSGSQEAVKDVHVARGFSYKKSVHQIPVHRGLYRDFRKENVGNMVSLGSTVSTSNRITRLEQRKEPWTL

SEQ ID NO: 6294 - protein, 81 aa, Aotus trivirgatus
APLPSWDPNRAGTDWREPGTVSFGDVAVYFSREEWGCLRPAQRALYRDVMRETYSHLGALGVGGSKPALISWVEEEAELWG

SEQ ID NO: 6295 - protein, 81 aa, Aotus trivirgatus
APLPSWDPNRAGTDWREPGTVSFGDVAVYFSREEWGCLRPAQRALYRDVMRETYSHLGALGESPTCSPGPCAFTSPAAPQE

SEQ ID NO: 6296 - protein, 81 aa, Aotus trivirgatus
ATLYSRDPNGAGPEWREPGAVTFGDVAVYFSREEWGCLRPAQRALYRDVTRETYSHLGALGVGGSKPALISWMEEEAELWG

SEQ ID NO: 6297 - protein, 81 aa, Aotus trivirgatus
PAHVTGETRPRLTRESRPGAVSFADVAVYFSPEEWGCMRPAQRALYRDVMRETCGHLGALGFSGPKSAFISWVEGEVEAWS

SEQ ID NO: 6298 - protein, 81 aa, Aotus trivirgatus
FISWVEGEVEAWSPEVQDPEGSRDGNEEKERVKNCPKQKEVAHEVALKEWLPSATFPELCSSPRQSPIKPWLMDTVTRRPP

SEQ ID NO: 6299 - protein, 81 aa, Aotus trivirgatus
VQDPEGESPGTVSRGQGQKAGSRDGNEEKERVKNCPKQKEVAHEVALKEWLPSATFPELCSSPRQSPIKPWLMDTVTRRPP

SEQ ID NO: 6300 - protein, 81 aa, Aotus trivirgatus
PARGPGEARPSRKRGRRPRALKFVDVAVYFSSEEWGCLRPAQRALYRDVMRETYGHLGALGCAGPKPALISWLERNTDDWE

SEQ ID NO: 6301 - protein, 81 aa, Aotus trivirgatus
MGLLTFRDVAIEFSLEEWEHLDSDQKNLYGDVMLENYRNLVCLGLAVSKPDLITFLEQRKEPWNVKSGETVETVAIQPDIF

SEQ ID NO: 6302 - protein, 81 aa, Aotus trivirgatus
HCAVTEHLTGAPAVPSVEGLLTFRDVAIEFSLEEWEHLDSDQKNLYGDVMLENYRNLVCLGLAVSKPDLITFLEQRKEPWN

SEQ ID NO: 6303 - protein, 81 aa, Aotus trivirgatus
MGLLTFRDVAIEFSVEEWEYLEPAQKNLYWDVMLENYRNLVSLGLAVSKPDLITFLEQRKEPWNVKSAETVAIQPDIFSHY

SEQ ID NO: 6304 - protein, 81 aa, Aotus trivirgatus
MLENYRNLVSLGLAVSKPDLITFLEQRKEPWNVKSAETVAIQPDIFSHYNKDLLTQHCTEASFQKVILRRHESCDLENLHI

SEQ ID NO: 6305 - protein, 81 aa, Aotus trivirgatus
MITAQGPVSFRDVTVGFTQEEWQHLDPAQRTLYRDVMIENYSHLVSVGYCIPKPEVILKLEKGEEPWISEEKFPSQSHLGC

SEQ ID NO: 6306 - protein, 81 aa, Aotus trivirgatus
MITAQGPVSFRDVTVGFTQEEWQHLDPAQRTLYRDVMIENYSHLVSVGYCIPKPEVILKLEKGEEPWISEEKFPSQSHLGS

SEQ ID NO: 6307 - protein, 81 aa, Aotus trivirgatus
MITAQGPVSFRDVTVGFTQEEWQHLDPAQRTLYRDVMIENYSHLVSVGYCIPKPEVILKLEKGEEPWISEEKFPSQSHLEL

SEQ ID NO: 6308 - protein, 81 aa, Aotus trivirgatus
MNKFQEQVSFKDVCVDFTQEEWYLLDPAQKILYRDVILENYSNLVSVGYCITKPEVIFKIEQGEEPWILEKGFPSQCHPER

SEQ ID NO: 6309 - protein, 81 aa, Aotus trivirgatus
MNKFQGPVTLKDVTVEFTKEEWKLLTPAQRTLYKDVMLENYSHLASVGYRVNKPNVVFKLKQGKEPWMLVVEFPHRGLPED

SEQ ID NO: 6310 - protein, 81 aa, Aotus trivirgatus
SSWISSPVCSTDVEQKFQGSISFKDVTVGFTQEEWQHLDLSQRALYRDVMLENYSNLVSVGYCLHKPEVIFRLEQGEEPWR

SEQ ID NO: 6311 - protein, 81 aa, Aotus trivirgatus
RANATRGSGVEQKFQGSISFKDVTVGFTQEEWQHLDLSQRALYRDVMLENYSNLVSVGYCLHKPEVIFRLEQGEEPWRLEE

SEQ ID NO: 6312 - protein, 81 aa, Aotus trivirgatus
MNKVEQKFQGSISFKDVTVGFTQEEWQHLDLSQRALYRDVMLENYSNLVSVGYCLHKPEVIFRLEQGEEPWRLEEEFPCQS

SEQ ID NO: 6313 - protein, 81 aa, Aotus trivirgatus
MSAVEQKFQGSISFKDVTVGFTQEEWQHLDLSQRALYRDVMLENYSNLVSVGYCLHKPEVIFRLEQGEEPWRLEEEFPCQS

SEQ ID NO: 6314 - protein, 81 aa, Aotus trivirgatus
HLDLSQRALYRDVMLENYSNLVSVGYCLHKPEVIFRLEQGEEPWRLEEEFPCQSFPEVWTAHHLKEQSQENQSKHLWEVVF

SEQ ID NO: 6315 - protein, 81 aa, Aotus trivirgatus
MNTFQASVSFKDVTVEFTQEEWQHMGPVERTLYRDVMLENYSHLISVGCCFTKPELIFTLEQGEDPWLLEKEKGFLSRTSP

SEQ ID NO: 6316 - protein, 81 aa, Aotus trivirgatus
PLRFSTLVEEQQKMNISQESVSFKDVTIEFTQEEWQQMAPVQRNLYRDVMLENYSHLVSVGYCLFKPEVIFKLEQGAEPWF

SEQ ID NO: 6317 - protein, 81 aa, Aotus trivirgatus
EFTQEEWQQMAPVQRNLYRDVMLENYSHLVSVGYCLFKPEVIFKLEQGAEPWFSEEEFSNKSHPSELLSSSKQNSAGVVRL

SEQ ID NO: 6318 - protein, 81 aa, Aotus trivirgatus
MLENYGNVASLGFPLLKPAVISQLEGGGELGGPSPLAAGTGLHGLWTDIQTDSDFTKEMYDGKEDVSFELQRDFSQETGFL

SEQ ID NO: 6319 - protein, 81 aa, Aotus trivirgatus
MLENYGNVASLGFPLLKPAVISQLEGGGELGGPSPLAAGTGLHGLWTARVSLCLPGWSAVACTWLTATSASWVQTILLSQP

SEQ ID NO: 6320 - protein, 81 aa, Aotus trivirgatus
MHLTAWPQKSVTFEDVAVYFTQAEWDGLSPAQRTLYRDVMLENYGNVASLGFPLLKPAVISQLEGGGELGGPSPLAAGTGL

SEQ ID NO: 6321 - protein, 81 aa, Aotus trivirgatus
MLENYGNVASLGFPLLKPAVISQLEGGVDIQTDSDFTKEMYDGKEDVSFELQRDFSQETGFLETSLLEKQQEVYSAGNIKK

SEQ ID NO: 6322 - protein, 81 aa, Aotus trivirgatus
ISQLEGGVDIQTDSDFTKEMYDGKEDVSFELQRDFSQETGFLETSLLEKQQEVYSAGNIKKEKSNTIDGTVTDETSPMEEC

SEQ ID NO: 6323 - protein, 81 aa, Aotus trivirgatus
MAAIPLKAQCQETVTFRDVAVYFTKTEWTGLSPAQRALYRSVMLENYGNLTAVGYPVPKPALISLLEGGDMAWGLEAQDDP

SEQ ID NO: 6324 - protein, 81 aa, Aotus trivirgatus
TVTFRDVAVYFTKTEWTGLSPAQRALYRSVMLENYGNLTAVGYPVPKPALISLLEGGDMAWGLEAQDDPLAEGTKNICKVI

SEQ ID NO: 6325 - protein, 80 aa, Aotus trivirgatus
VTFRDVAVYFTKTEWTGLSPAQRALYRSVMLENYGNLTAVGYPVPKPALISLLEGGDMAWGLEAQDDPLAEGTKNICKGR

SEQ ID NO: 6326 - protein, 81 aa, Aotus trivirgatus
ESVTFKDVSVDFTQEEWYHVDPAQRSLYRDVMLENYSHLVSLGYQVSKPEVIFKLEQGEEPWISEGEIQRPFCPGLVCLLL

SEQ ID NO: 6327 - protein, 81 aa, Aotus trivirgatus
DRRISTGTTKETRRPLEMAVSEPEASAAEWEQLDPAQRNLYKDVMLENYSNLASMGCQAPKPDLISKLEKGEAPCLGKGKR

SEQ ID NO: 6328 - protein, 81 aa, Aotus trivirgatus
RRISTGTTKETRRPLEMAVSEPEASAAKEWEQLDPAQRNLYKDVMLENYSNLASMGCQAPKPDLISKLEKGEAPCLGKGKR

SEQ ID NO: 6329 - protein, 81 aa, Aotus trivirgatus
ETRRPLEMAVSEPEASAAGSVTFKDVTMAFTQKEWEQLDPAQRNLYKDVMLENYSNLASMGCQAPKPDLISKLEKGEAPCL

SEQ ID NO: 6330 - protein, 81 aa, Aotus trivirgatus
EQFLTILPGEIRIWVKSQHPESSEEVVTLIEDLTQMLEEKEDLVSQDSVSQEENSKENKVVAICPNTESCESITLNDVAVN

SEQ ID NO: 6331 - protein, 81 aa, Aotus trivirgatus
ENSKENKVVAICPNTESCESITLNDVAVNFSRGEWKKLEPFQKELYKEVLLENFRNLEFLDFPVSKLELISQLKWVELPWL

SEQ ID NO: 6332 - protein, 81 aa, Aotus trivirgatus
MASPSPPPEPKELLTFEDVAVFFTQEEWDYLDPAQRSLYKDVMMENYGNLVSLDVLNRDKDEEPTVKQEIEEIEEEVEPQG

SEQ ID NO: 6333 - protein, 81 aa, Aotus trivirgatus
MASPSPPPEPKEEWDYLDPAQRSLYKDVMMENYGNLVSLGLTLLPRLECSDTIMPRCSFDLLGLSDQSCCYLSSWDYTCFE

SEQ ID NO: 6334 - protein, 81 aa, Aotus trivirgatus
MAFRDVAVDFTQDEWRLLSPAQRTLYREVMLENYSNLVSLGISFSKPEIITQLEQGKETWREEKKCPPATCPADPEPELYL

SEQ ID NO: 6335 - protein, 81 aa, Aotus trivirgatus
MAFRDVAVDFTQDEWRLLSPAQRTLYREVMLENYSNLVSLGISFSKPEIITQLEQGKETWREEKKCPPATCPDPEPELYLD

SEQ ID NO: 6336 - protein, 81 aa, Aotus trivirgatus
MAHMAFRDVAVDFTQDEWRLLSPAQRTLYREVMLENYSNLVSLGISFSKPEIITQLEQGKETWREEKKCPPATCPADPEPE

SEQ ID NO: 6337 - protein, 81 aa, Aotus trivirgatus
GLLTFRDVAIEFSLEEWQCLDTAQRNLYRNVILENYRNLVFLGIAVSKPDLITCLEQEKEPLIMKRDETADEPPESCSGSL

SEQ ID NO: 6338 - protein, 81 aa, Aotus trivirgatus
SNEELVGQNHGMEGEACTGGDVTFSDVAIDFSHEEWGWLDSAQRDLYKDVMVQNYENLVSLAGLSWESGWENKELSTKKDI

SEQ ID NO: 6339 - protein, 81 aa, Aotus trivirgatus
MPQVTFSDVAIDFSHEEWGWLDSAQRDLYKDVMVQNYENLVSLAGLSITKPYVITLLEDGKEPWMMEKKLSKGVTPDWESG

SEQ ID NO: 6340 - protein, 81 aa, Aotus trivirgatus
MPQVTFSDVAIDFSHEEWGWLDSAQRDLYKDVMVQNYENLVSLGLSWESGWENKELSTKKDIYDEDPLPTVIIEKVIKQSY

SEQ ID NO: 6341 - protein, 80 aa, Aotus trivirgatus
MPQVTFSDVAIDFSHEEWGWLDSAQRDLYKDVMVQNYENLVSLAGLSITKPYVITLLEDGKEPWMMEKKLSKGVTPGESW

SEQ ID NO: 6342 - protein, 81 aa, Aotus trivirgatus
MPQVTFSDVAIDFSHEEWGWLDSAQRDLYKDVMVQNYENLVSLGLSITKPYVITLLEDGKEPWMMEKKLSKGVTPVVKTMC

SEQ ID NO: 6343 - protein, 81 aa, Aotus trivirgatus
MPQVTFSDVAIDFSHEEWGWLDSAQRDLYKDVMVQNYENLVSLAGLSITKPYVITLLEDGKEPWMMEKKLSKGVTPGESCS

SEQ ID NO: 6344 - protein, 81 aa, Aotus trivirgatus
MPQVTFSDVAIDFSHEEWGWLDSAQRDLYKDVMVQNYENLVSLAGLSITKPYVITLLEDGKEPWMMEKKLSKGVTPVVKTM

SEQ ID NO: 6345 - protein, 81 aa, Aotus trivirgatus
MPQVTFSDVAIDFSHEEWGWLDSAQRDLYKDVMVQNYENLVSLAGLSITKPYVITLLEDGKEPWMMEKKLSKGVTPVKKNK

SEQ ID NO: 6346 - protein, 81 aa, Aotus trivirgatus
NEELVGQNHGMEGEACTGGDVTFSDVAIDFSHEEWGWLDSAQRDLYKDVMVQNYENLVSLGLSITKPYVITLLEDGKEPWM

SEQ ID NO: 6347 - protein, 81 aa, Aotus trivirgatus
VTFSDVAIDFSHEEWGWLDSAQRDLYKDVMVQNYENLVSLGLSITKPYVITLLEDGKEPWMMEKKLSKDWESGWENKELST

SEQ ID NO: 6348 - protein, 81 aa, Aotus trivirgatus
VTFSDVAIDFSHEEWGWLDSAQRDLYKDVMVQNYENLVSLGLSITKPYVITLLEDGKEPWMMEKKLSKVYPFLLSHSVSAS

SEQ ID NO: 6349 - protein, 81 aa, Aotus trivirgatus
VTFSDVAIDFSHEEWGWLDSAQRDLYKDVMVQNYENLVSLAGLSITKPYVITLLEDGKEPWMMEKKLSKDWESGWENKELS

SEQ ID NO: 6350 - protein, 81 aa, Aotus trivirgatus
MEAPALALISFEDVVVTFTGEEWGHLDLAQRTLYQEVMLETCRLLISLGHPVPKPELIYLLEHGQEPWTVKRGLSQSTCAG

SEQ ID NO: 6351 - protein, 81 aa, Aotus trivirgatus
MAAALRDPAQGCVTFEDVTIYFSKEEWGLLDEAQRLLYCDVMLENFALIASLGLISFRSHIVSQLEMGKEPWVPDSMDMTS

SEQ ID NO: 6352 - protein, 81 aa, Aotus trivirgatus
MAQGLVTFRDVAIEFSLEEWKCLEPAQRDLYREVTLENFGHLVSLGLSIPKPDVISLLEQGKEPWMIANDVTGPWCPDLES

SEQ ID NO: 6353 - protein, 81 aa, Aotus trivirgatus
ESREIRAGQIVLKAMAQGLVTFRDVAIEFSLEEWKCLEPAQRDLYREVTLENFGHLVSLGLSIPKPDVISLLEQGKEPWMI

SEQ ID NO: 6354 - protein, 81 aa, Aotus trivirgatus
MNMEGLVMFQDLSIDFSQEEWECLNPTQKDLYRDVMMENYSSLLSLGLSIPKPDVISLLEQGKEPWMVSRDVLGGWCPDRL

SEQ ID NO: 6355 - protein, 81 aa, Aotus trivirgatus
MNMEGLVMFQDLSIDFSQEEWECLNPTQKDLYRDVMMENYSSLLSLDLEFRCKTKYSCLPKEIYEVTSSQWVRMEKRHSLV

SEQ ID NO: 6356 - protein, 81 aa, Aotus trivirgatus
MNMEGLVMFQDLSIDFSQEEWECLNPTQKDLYRDVMMENYSSLLSLGLSIPKPDVISLLEQGKEPWMVSRDVLGGWCPDLE

SEQ ID NO: 6357 - protein, 81 aa, Aotus trivirgatus
MDVMLENYCHLISVGCHMTKPDVILKLERGEEPWTSFAGHTYLEENWKAEDFLVKFREQREKYSRSVVSINHKKLVKEKSK

SEQ ID NO: 6358 - protein, 81 aa, Aotus trivirgatus
MAQGSVSFNDVTVDFTQEEWQHLDHAQKTLYMDVMLENYCHLISVGCHMTKPDVILKLERGEEPWTSFAGHTYLEENWKAE

SEQ ID NO: 6359 - protein, 81 aa, Aotus trivirgatus
QWVNMEEFESRNLERSIFRDIWEGNCHIEQHQGQKEGYFRQFLINYENMTIFSQHTLLTPEFYDREKISECKKCRKNFSYH

SEQ ID NO: 6360 - protein, 81 aa, Aotus trivirgatus
FHMTKPDMIRKLEQGEELWTQRIFPSYSYLEEDGKTEDVLVKFKEYQDRHSRSLILINHKKLIKQRSNIYGKTLTLGKNHI

SEQ ID NO: 6361 - protein, 81 aa, Aotus trivirgatus
GFHMTKPDMIRKLEQGEELWTQRIFPSYSYLEDGKTEDVLVKFKEYQDRHSRSLILINHKKLIKQRSNIYGKTLTLGKNHI

SEQ ID NO: 6362 - protein, 81 aa, Aotus trivirgatus
MMENYSNLLSLDLESKYETKLLSVETDIIKNTCSQWEVMESSNLCENSIFRNDWQSKSTIEVQGPKVGYFSQMKTISQNVP

SEQ ID NO: 6363 - protein, 81 aa, Aotus trivirgatus
MPEVKFPDQFFTVLSMDHELVTFRDVLINFSQEEWEYLDSAQRNLYWDVMMENYSNLLSLDLESKYETKLLSVETDIIKNT

SEQ ID NO: 6364 - protein, 81 aa, Aotus trivirgatus
TVLSMDHELVTFRDVLINFSQEEWEYLDSAQRNLYWDVMMENYSNLLSLDLESKYETKLLSVETDIIKNTCSQWEVMESSN

SEQ ID NO: 6365 - protein, 81 aa, Aotus trivirgatus
MAQESVMFSDVSIDFSQEEWECLNDDQRDLYRDVMLENYSNLVSMAGHSISKPNVISYLEQGKEPWLVDRELTRGQWPALE

SEQ ID NO: 6366 - protein, 81 aa, Aotus trivirgatus
MAQESVMFSDVSIDFSQEEWECLNDDQRDLYRDVMLENYSNLVSMGHSISKPNVISYLEQGKEPWLVDRELTRGQWPALES

SEQ ID NO: 6367 - protein, 81 aa, Aotus trivirgatus
MAHRSVMFSDISIDFSPEEWEYLDLEQKDLYRDVMLENYSNLVSLGCFISKPDVISLLEQGKEPWKVVRKRRRQYPDLETK

SEQ ID NO: 6368 - protein, 81 aa, Aotus trivirgatus
MAHGSVTFRDVAIDFSQEEWEFLDPAQRDLYRDVMWENYSNFISLGPSISKPDVITLLDEEGKEPGMVVREGIRRYCPDLD

SEQ ID NO: 6369 - protein, 81 aa, Aotus trivirgatus
MAHGSVTFRDVAIDFSQEEWEFLDPAQRDLYRDVMWENYSNFISLAGPSISKPDVITLLDEEGKEPGMVVREGIRRYCPGE

SEQ ID NO: 6370 - protein, 81 aa, Aotus trivirgatus
CSQESALSEEEEDTTRSLETVTFKDVAVDLTQEEWEQMKPAQRNLYRDVMLENYSNLVTVGCQVTKPDVIFKLEQEEEPWV

SEQ ID NO: 6371 - protein, 81 aa, Aotus trivirgatus
EEWEQMKPAQRNLYRDVMLENYSNLVTVGCQVTKPDVIFKLEQEEEPWVMEEEMFGRHCPVDFLFCYSGQSASRLTVTSAC

SEQ ID NO: 6372 - protein, 81 aa, Aotus trivirgatus
MKPAQRNLYRDVMLENYSNLVTVGCQVTKPDVIFKLEQEEEPWVMEEEMFGRHCPEVWKVDEQIKKQQETLVRKVTSISKK

SEQ ID NO: 6373 - protein, 81 aa, Aotus trivirgatus
EDTTRSLETVTFKDVAVDLTQEEWEQMKPAQRNLYRDVMLENYSNLVTVGCQVTKPDVIFKLEQEEEPWVMEEEMFGRHCP

SEQ ID NO: 6374 - protein, 81 aa, Aotus trivirgatus
HPEEEERMHDELLQAVSKGSLMFRDVSIDFSQEEWECLDSGQMNLYKEVMLENFSNLVSVGLSSSKPAVISLLEQGREPWM

SEQ ID NO: 6375 - protein, 81 aa, Aotus trivirgatus
EEEERMHDELLQAVSKGSLMFRDVSIDFSQEEWECLDSGQMNLYKEVMLENFSNLVSVGLSSSKPAVISLLEQGREPWMVD

SEQ ID NO: 6376 - protein, 81 aa, Aotus trivirgatus
MAHLMLFRDVAVDFSQEEWEGLDLKQRDLYRDVMLENYSNMVSLGLCIYQPDVFSLLETGKEPWKILRDETRGPCPDMQSR

SEQ ID NO: 6377 - protein, 81 aa, Aotus trivirgatus
MNCFQELVTFRDVAIDFSRQEWEYLDPHQRDLYRDVMLENYRNLVSLGGHSISKPVLVDLLEQGKEPWMILREETQFPDLD

SEQ ID NO: 6378 - protein, 81 aa, Aotus trivirgatus
CRVGLIRSYNSKTMNCFQELVTFRDVAIDFSRQEWEYLDPHQRDLYRDVMLENYRNLVSLEMRSHCVAQVGLKLLVSSDPP

SEQ ID NO: 6379 - protein, 81 aa, Aotus trivirgatus
NCNWRRPLKCCPTKYVKFQELVTFRDVAIDFSRQEWEYLDPHQRDLYRDVMLENYRNLVSLGGHSISKPVLVDLLEQGKEP

SEQ ID NO: 6380 - protein, 81 aa, Aotus trivirgatus
ELCRVGLIRSYNSKTMNCELVTFRDVAIDFSRQEWEYLDPHQRDLYRDVMLENYRNLVSLGGHSISKPVLVDLLEQGKEPW

SEQ ID NO: 6381 - protein, 81 aa, Aotus trivirgatus
CNWRRPLKCCPTKYVKFQELVTFRDVAIDFSRQEWEYLDPHQRDLYRDVMLENYRNLVSLGGHSISKPVLVDLLEQGKEPW

SEQ ID NO: 6382 - protein, 81 aa, Aotus trivirgatus
MNCFQELVTFRDVAIDFSRQEWEYLDPHQRDLYRDVMLENYRNLVSLGGHSISKPVLVDLLEQGKEPWMILREETQFPEMG

SEQ ID NO: 6383 - protein, 81 aa, Aotus trivirgatus
MLENYRNLVSLDLDLQCEIISYIEVPTYDTDISSTQHQSIYQREKLYECKKCQKKFSSGYQLILHDRFHIIQRPYKCKECG

SEQ ID NO: 6384 - protein, 81 aa, Aotus trivirgatus
MAHDLVMFRDVAVDFSQEEWECLNSYQRNLYKDVILENYSNLVSLAGCSISKPDVITLLEQGKEPWLVVRDEKRRWSLDLE

SEQ ID NO: 6385 - protein, 81 aa, Aotus trivirgatus
MAHDLVMFRDVAVDFSQEEWECLNSYQRNLYKDVILENYSNLVSLGCSISKPDVITLLEQGKEPWLVVRDEKRRWSLDLES

SEQ ID NO: 6386 - protein, 81 aa, Aotus trivirgatus
MAHDLVMFRDVAVDFSQEEWECLNSYQRNLYKDVILENYSNLVSLGCSISKPDVITLLEQGKEPWLVVRDEKRRWSLAPTF

SEQ ID NO: 6387 - protein, 81 aa, Aotus trivirgatus
MAHALVTFTDVAIDFSQKEWECLDPTQRKLYRDVMLENYSNLVSLGYSGSKPDVITLLEQGKEPCMAVRDMTGRQYPGLLS

SEQ ID NO: 6388 - protein, 81 aa, Aotus trivirgatus
MAHALVTFTDVAIDFSQKEWECLDPTQRKLYRDVMLENYSNLVSLGLLSRHKTKKLSSEKDIHEISFSKGNIIEKSKTLHL

SEQ ID NO: 6389 - protein, 81 aa, Aotus trivirgatus
MAHALVTFTDVAIDFSQKEWECLDPTQRKLYRDVMLENYSNLVSLAGYSGSKPDVITLLEQGKEPCMAVRDMTGRQYPGLL

SEQ ID NO: 6390 - protein, 81 aa, Aotus trivirgatus
MPHLLVTFRDVAIDFSQEEWECLDPAQRDLYRDVMLENYSNLISLDLESSCEINKLSPEKEIYEVESFQWENMGKFINHHL

SEQ ID NO: 6391 - protein, 81 aa, Aotus trivirgatus
MDLLFQLLVTFRDVAIDFSQEEWECLDPAQRDLYRDVMLENYSNLISLDLESSCEINKLSPEKEIYEVESFQWENMGKFIN

SEQ ID NO: 6392 - protein, 81 aa, Aotus trivirgatus
MINYQTPVSFKDVVVGFTQEEWHRLNPTQRALYRDVMLETYSNLVSVGYEGTKPDVILRLEQEEAPWIGEAACLGCHCWED

SEQ ID NO: 6393 - protein, 81 aa, Aotus trivirgatus
MINYQTPVSFKDVVVGFTQEEWHRLNPTQRALYRDVMLETYSNLVSVGYEGTKPDVILRLEQEEAPWIGEAACLGCHCWGI

SEQ ID NO: 6394 - protein, 81 aa, Aotus trivirgatus
DVVVGFTQEEWHRLNPTQRALYRDVMLETYSNLVSVGYEGTKPDVILRLEQEEAPWIGEAACLGCHCWGISKLPADWPLAL

SEQ ID NO: 6395 - protein, 81 aa, Aotus trivirgatus
MINYQTPVSFKDVVVGFTQEEWHRLNPTQRALYRDVMLETYSNLVSVGYEGTKPDVILRLEQEEAPWIGEAACLGCHCWGK

SEQ ID NO: 6396 - protein, 81 aa, Aotus trivirgatus
EWHRLNPTQRALYRDVMLETYSNLVSVGYEGTKPDVILRLEQEEAPWIGEAACLGCHCWGKCDKSSKRGPEAGWHLWNFVQ

SEQ ID NO: 6397 - protein, 81 aa, Aotus trivirgatus
EWHRLNPTQRALYRDVMLETYSNLVSVGYEGTKPDVILRLEQEEAPWIGEAACLGCHCWEDIWQVNIQRKRRQDMPLRQGA

SEQ ID NO: 6398 - protein, 81 aa, Aotus trivirgatus
SFKDVVVGFTQEEWHRLNPTQRALYRDVMLETYSNLVSVGYEGTKPDVILRLEQEEAPWIGEAACLGCHCWALTFLRELQP

SEQ ID NO: 6399 - protein, 81 aa, Aotus trivirgatus
KDVVVGFTQEEWHRLNPTQRALYRDVMLETYSNLVSVGYEGTKPDVILRLEQEEAPWIGEAACLGCHCWALTFLRELQPHE

SEQ ID NO: 6400 - protein, 81 aa, Aotus trivirgatus
PLCETEELTSKQDFYEEHQSQQIIETLTRYNLEYSSLREEWKCEGYFERQTGNQKACFKEEIITHEEALVDEREQEYKSWG

SEQ ID NO: 6401 - protein, 81 aa, Aotus trivirgatus
KSQEEGRMAVGLLKAMYQELVTFRDVAVDFSQEEWDCLDSSQRHLYSNVMLENYRILVSLGLCFSKPSVILLLEQGKAPWM

SEQ ID NO: 6402 - protein, 81 aa, Aotus trivirgatus
QGKAPWMVKRELTKGLCSGWEPLCETEELTSKQDFYEEHQSQQIIETLTRYNLEYSSLREEWKCEGYFERQTGNQKACFKE

SEQ ID NO: 6403 - protein, 81 aa, Aotus trivirgatus
MAVGLCKAMSQGLVTFRDVALDFSQEEWEWLKPSQKDLYRDVMLENYRNLVWLGDGCSCYSTLRTTGMAEASSSSSSIQVS

SEQ ID NO: 6404 - protein, 81 aa, Aotus trivirgatus
MAVGLCKAMSQGLVTFRDVALDFSQEEWEWLKPSQKDLYRDVMLENYRNLVWLDWESWCEIKELSPKWFTDEDEISQEVVM

SEQ ID NO: 6405 - protein, 81 aa, Aotus trivirgatus
MTEGSVMFSDVSIDFSQEEWDCLDPVQRDLYRDVMLENYSNLVSMGLYTPKPQVISLLEQGKEPWMVGRELTRGLCSDLES

SEQ ID NO: 6406 - protein, 81 aa, Aotus trivirgatus
MTEGSVMFSDVSIDFSQEEWDCLDPVQRDLYRDVMLENYSNLVSMGKGIHTTDSQFSSGMSASSTVNFSAAFQDFTLLSLK

SEQ ID NO: 6407 - protein, 81 aa, Aotus trivirgatus
GSVSFRDVAINFSREEWRHLDLSQRNLYRDVMLETYSHLLSVGYQGKEPWTLQGERPRHSCPGEKLWDHNLRRKILSYKPA

SEQ ID NO: 6408 - protein, 81 aa, Aotus trivirgatus
SPQKSPALAPEDHGSSYEGSVSFRDVAINFSREEWRHLDLSQRNLYRDVMLETYSHLLSVGYQGKEPWTLQGERPRHSCPA

SEQ ID NO: 6409 - protein, 81 aa, Aotus trivirgatus
LAPEDHGSSYEGSVSFRDVAIDFSREEWRHLDLSQRNLYRDVMLETYSHLLSVGYQVPEAEVVMLEQGNEPWSLQGERPHQ

SEQ ID NO: 6410 - protein, 81 aa, Aotus trivirgatus
REEWRHLDLSQRNLYRDVMLETYSHLLSVGYQVPEAEVVMLEQGNEPWSLQGERPHQSCPVTHWLPFPSTMTKSFLGLTRS

SEQ ID NO: 6411 - protein, 81 aa, Aotus trivirgatus
SPSKSPALALEDHGSSYTGSVSFRDVAIDFSREEWRHLDLSQRNLYRDVMLETYSHLLSVGYQVPEAEVVMLEQGNEPWSL

SEQ ID NO: 6412 - protein, 81 aa, Aotus trivirgatus
DVAIDFSREEWRHLDLSQRNLYRDVMLETYSHLLSVGYQVPEAEVVMLEQGNEPWSLQGERPHQSCPAQCLVNSHQLQESF

SEQ ID NO: 6413 - protein, 81 aa, Aotus trivirgatus
MAWKVVMFRDVAIDFSQEEWECLDAAQRDLYRDVMLENYSNLVSLDLPSRCARKDLSPEKNTYETELPQWEMSDRLEKCDL

SEQ ID NO: 6414 - protein, 81 aa, Aotus trivirgatus
TELPQWEMSDRLEKCDLEESNSRNYLEAKGKMEKQQENQKEYFRQGMIIYDKMSIFNQHTYLSQHSKCHSTEKPYKCKECG

SEQ ID NO: 6415 - protein, 81 aa, Aotus trivirgatus
DLYKDVMFENYSNLVSLGYTIPKPDVITLLEQEKEPWIVMREGTRSWYTGSRCVTQAGEQWRDLSSLQRPPAGFKFFCLSL

SEQ ID NO: 6416 - protein, 81 aa, Aotus trivirgatus
MQVDPHGPLNELLIFQIIPLHSLSMMPWLLWILCFSMEEAQGELTSSCGAKTMAHVSLAFRDVSIDLSQEEWECLDPAQRD

SEQ ID NO: 6417 - protein, 81 aa, Aotus trivirgatus
MVHGSVTFRDVAIDFSQEEWECLQPAQRTLYRDVMLENYSHLISLGSSISKPDVITLLEQEKEPWMVIRKETNRWYPDECK

SEQ ID NO: 6418 - protein, 81 aa, Aotus trivirgatus
GRSPRKTDQFCNSKNMVPGSVTFRDVAIDFSQEEWECLQPAQRTLYRDVMLENYSHLISLGSSISKPDVITLLEQEKEPWM

SEQ ID NO: 6419 - protein, 81 aa, Aotus trivirgatus
MLENYSHLISLGSSISKPDVITLLEQEKEPWMVIRKETNRWYPDLESKYGPEKVSSENDISEVNLPKQVIKQISKTVGLEA

SEQ ID NO: 6420 - protein, 81 aa, Aotus trivirgatus
LLQRQLEPSRNFWILRLPPGSKREAPKVPVTFDDVAVFFSEQEWGKLEDWQKELYKHVMRGNYETLVSLDYAISKPEILSD

SEQ ID NO: 6421 - protein, 81 aa, Aotus trivirgatus
MFPGLLTTREEALMAFWDVAVAFTQKEWQLLSSAQRTLYREVMLENYSHLVSLGIVFSKPKLITQLEQGDEPWGEENKHLL

SEQ ID NO: 6422 - protein, 81 aa, Aotus trivirgatus
AASQSAGLAERLIRDQDLGTSLLPAAPQQWRHLDSTQKEQYWDLMLETYGKMVSGAGISHSKPDLTNSIEYGEELAGLYLH

SEQ ID NO: 6423 - protein, 81 aa, Aotus trivirgatus
AASQSAGLAERLIRDQDLGTSLLPAAPQQWRHLDSTQKEQYWDLMLETYGKMVSGGISHSKPDLTNSIEYGEELAGLYLHV

SEQ ID NO: 6424 - protein, 81 aa, Aotus trivirgatus
AASQSAGLAERLIRDQDLGTSLLPAAPQRHLDSTQKEQYWDLMLETYGKMVSGGISHSKPDLTNSIEYGEELAGLYLHVNE

SEQ ID NO: 6425 - protein, 81 aa, Aotus trivirgatus
AASQSAGLAERLIRDQDLGTSLLPAAPQQWRHLDSTQKEQYWDLMLETYGKMVSGGDRQENDKENLNLENHRDQELLHASV

SEQ ID NO: 6426 - protein, 81 aa, Aotus trivirgatus
MVAGWRVMGEDSVTFEDVAVDFTPEEWTLLDQTQRHLYRDVMLDELQESSCSRLRDHISTKWTSTAAEFFQEENISMVKMR

SEQ ID NO: 6427 - protein, 81 aa, Aotus trivirgatus
LDQTQRHLYRDVMLDELQESSCSRLRDHISTKWTSTAAEFFQEENISMVKMRCSLAVLPSLLSNSCYQVILLPEPPECVYI

SEQ ID NO: 6428 - protein, 81 aa, Aotus trivirgatus
MAAGWLTARSQNSVTFQEVAVDFSQEEWALLDLAQKNLYKDVMLENFRNLTSVGYQLCRHNLISKVDQEELKTDERGILQS

SEQ ID NO: 6429 - protein, 81 aa, Aotus trivirgatus
MVAGWRVMGEDSVTFEDVAVDFTPEEWTLLDQTQRHLYRDVMLDELQESSCSRLRDHISTKWTSTAAEFFQEENISMVKMV

SEQ ID NO: 6430 - protein, 81 aa, Aotus trivirgatus
VDFTPEEWTLLDQTQRHLYRDVMLDELQESSCSRLRDHISTKWTSTAAEFFQEENISMVKMVRFRRYNFLACKLEEDLEIP

SEQ ID NO: 6431 - protein, 81 aa, Aotus trivirgatus
EKTEVERMVADCLTNCYQDSVTFDDLAVDFTPEEWTLLDPTQRNLYRDVMLENYKNLSTVGCQLFKPSLISWLEQEESRTV

SEQ ID NO: 6432 - protein, 81 aa, Aotus trivirgatus
MTYCLTNCYQESVTFEDVSVDFTQEEWTLLDPLQRNFYRDVMLENYENLAKVGFQLLKPSLISWLEEEEELRTLQQEVLQE

SEQ ID NO: 6433 - protein, 81 aa, Aotus trivirgatus
SAVQQDFCKIQTSNGIQTDLVTFDSVAVEFTQEEWTLLDPTERNLYRDMMLENYKNLSSVGYQLFKPSLISWMEEEEELST

SEQ ID NO: 6434 - protein, 81 aa, Aotus trivirgatus
EKTAAGRIVADCLTNCYQDSVTFDDVAVDFTQEEWTLLDPTQRSLYSDVMLENYKNLATVGWELQLETQWSTLQQNCLRGQ

SEQ ID NO: 6435 - protein, 81 aa, Aotus trivirgatus
MDSVTFDDVAVDFTQEEWTLLDPTQRSLYSDVMLENYKNLATVGWELQLETQWSTLQQNCLRGQTSIGVQLEGNHNGGKLC

SEQ ID NO: 6436 - protein, 81 aa, Aotus trivirgatus
YLSGDPVCLHEEKTAAGRIVADCLTNCYQDSVTFDDVAVDFTQEEWTLLDPTQRSLYSDVMLENYKNLATVGRKPQWRETL

SEQ ID NO: 6437 - protein, 81 aa, Aotus trivirgatus
EKTKVERTVVDYLANGYQDSVTFDDVAVEFTPEEWALLDTTQKYLYRDVMLENYKNLASVEWEIQPRTQGLSLQQSLLKNE

SEQ ID NO: 6438 - protein, 81 aa, Aotus trivirgatus
EKTKVERTVVDYLANGYQDSVTFDDVAVEFTPEEWALLDTTQKYLYRDVMLENYKNLASVDYFFCLTSEWEIQPRTQGLSL

SEQ ID NO: 6439 - protein, 81 aa, Aotus trivirgatus
GFFSREAICPFEEKTKVERTVVDYLANGYQDSVTFDDVAVEFTPEEWALLDTTQKYLYRDVMLENYKNLASVADKLWMETL

SEQ ID NO: 6440 - protein, 81 aa, Aotus trivirgatus
VDSVTFDDVAVEFTPEEWALLDTTQKYLYRDVMLENYKNLASVDYFFCLTSEWEIQPRTQGLSLQQSLLKNELFNGIQMQT

SEQ ID NO: 6441 - protein, 81 aa, Aotus trivirgatus
GYQDSVTFDDVAVEFTPEEWALLDTTQKYLYRDVMLENYKNLASVDYFFCLTSEWEIQPRTQGLSLQQSLLKNELFNGIQM

SEQ ID NO: 6442 - protein, 81 aa, Aotus trivirgatus
MDSVAFEDVAVNFTLEEWALLDPSQKNLYRDVMRETFRNLASIGKQWEDQNIEDPFKLPGRNTSHTSERICEHKEGSQGEE

SEQ ID NO: 6443 - protein, 81 aa, Aotus trivirgatus
MDSVAFEDVAVNFTQEEWALLGPSQKSLYRNVMQETIRNLDCIGHTCEIIDNSQCGETFSQIPESIVNKNTPGVNPCDSSE

SEQ ID NO: 6444 - protein, 81 aa, Aotus trivirgatus
MDSVAFEDVAINFTCEEWALLGPSQKSLYRDVMQETIRNLDCIGMKWQNLDVEEDKYKNPGRNLRCYMVERSCEIKDNSQC

SEQ ID NO: 6445 - protein, 81 aa, Aotus trivirgatus
MDPVAFEDVAVKFTQEEWALLDISQKNLYREVMLETFRNLTSIGKKWKDKSIEDECQNPRRNLRSLIEEKVNEIKEDSHCE

SEQ ID NO: 6446 - protein, 81 aa, Aotus trivirgatus
MMFQDPVAFEDVAVKFTQEEWALLDISQKNLYREVMLETFRNLTSIGKKWKDKSIEDECQNPRRNLRSLIEEKVNEIKEDS

SEQ ID NO: 6447 - protein, 81 aa, Aotus trivirgatus
MFQDPVAFEDVAVKFTQEEWALLDISQKNLYREVMLETFRNLTSIGKKWKDKSIEDECQNPRRNLRSLIEEKVNEIKEDSH

SEQ ID NO: 6448 - protein, 81 aa, Aotus trivirgatus
MDSVAFEDVAVSFTQEEWALLDPSQKNLYRDVMQEIFKNLASVGKTWQVQNIEDKYKNSRRNLRWESSFVAQAGVQWCDLG

SEQ ID NO: 6449 - protein, 81 aa, Aotus trivirgatus
MDSVAFEDVAVSFTQEEWALLDPSQKNLYRDVMQEIFKNLASVGKTWQVQNIEDKYKNSRRNLSLLIREKLFESKESNHCG

SEQ ID NO: 6450 - protein, 81 aa, Aotus trivirgatus
CSHRSCREDSGTSENWEMDPVAFEDVAVKFTQEEWALLDISQKNLYREVMLETFRNLTSIGKKWKDKSIEDECQNPRRNLR

SEQ ID NO: 6451 - protein, 81 aa, Aotus trivirgatus
MSCCSHRSCREDSGTSENWEMEEWALLDISQKNLYREVMLETFRNLTSIGKKWKDKSIEDECQNPRRNLRSLIEEKVNEIK

SEQ ID NO: 6452 - protein, 81 aa, Aotus trivirgatus
LVLSLSPILLHTCGMFQDPVAFEDVAVKFTQEEWALLDISQKNLYREVMLETFRNLTSIGKKWKDKSIEDECQNPRRNLRS

SEQ ID NO: 6453 - protein, 81 aa, Aotus trivirgatus
MMFQVSVAFEDVAVTFTQEEWALLDPSQKTLYRDVMQENFRNLASVGKKWKAQNIYVEYKNLRRNLRNLRGKRLFESKEDH

SEQ ID NO: 6454 - protein, 81 aa, Aotus trivirgatus
MVSVAFEDVAVTFTQEEWALLDPSQKTLYRDVMQENFRNLASVGKKWKAQNIYVEYKNLRRNLRNLRGKRLFESKEDHQDG

SEQ ID NO: 6455 - protein, 81 aa, Aotus trivirgatus
MQENFRNLASVGKKWKAQNIYVEYKNLRRNLRNLRGKRLFESKEDHQDGEILTQVPDDMLKKTTTGVKSCESSVCGEVGSG

SEQ ID NO: 6456 - protein, 81 aa, Aotus trivirgatus
CGMFQVSVAFEDVAVTFTQEEWALLDPSQKTLYRDVMQENFRNLASVGKKWKAQNIYVEYKNLRRNLRNLRGKRLFESKED

SEQ ID NO: 6457 - protein, 81 aa, Aotus trivirgatus
MQIIYLVLTCVSISSSLSLYHSVMAELAANTARHPVSSLQAVSVAFEDVAVTFTQEEWALLDPSQKTLYRDVMQENFRNLA

SEQ ID NO: 6458 - protein, 81 aa, Aotus trivirgatus
IIYLVLTCVSISSSLSLYHSVMAELAANTARHPVSSLQAVSVAFEDVAVTFTQEEWALLDPSQKTLYRDVMQENFRNLASV

SEQ ID NO: 6459 - protein, 81 aa, Aotus trivirgatus
LGSLQLLPPSHVKIILLKKDSVAFEDVAVNFTQEEWALLDPSQKNLYREVMQETLRNLASIGQRWSNQNAEDKHQNPRRNL

SEQ ID NO: 6460 - protein, 81 aa, Aotus trivirgatus
MDSVAFEDVDVNFTQDEWALLDPSQKNLYRDVMQETFRNLASVGKKWKDQKIEDEYKNPRSNLRPSQKVELVAVPKTTNIG

SEQ ID NO: 6461 - protein, 81 aa, Aotus trivirgatus
QKNLYRDVMQETFRNLASVGKKWKDQKIEDEYKNPRSNLRPSQKVELVAVPKTTNIGAGLSISGPEEVVVNLPISCSERPG

SEQ ID NO: 6462 - protein, 81 aa, Aotus trivirgatus
DSVAFEDVDVNFTQDEWALLDPSQKNLYRDVMQETFRNLASVGKKWKDQKIEDEYKNPRSNLSLRRWSWLYPRQPTLGLDS

SEQ ID NO: 6463 - protein, 81 aa, Aotus trivirgatus
MDSVAFEDVDVNFTQDEWALLDPSQKNLYRDVMQETFRNLASVGKKWKDQKIEDEYKNPRSNLRGLMGERLLESKKDHQLE

SEQ ID NO: 6464 - protein, 81 aa, Aotus trivirgatus
MDLVAFEDIDVNFTQEEWALLDPSQKNLYRDVMWETMRNLASIGKKWKDQNIKDHYKHQGINLRRHMVERLYQSKDGSQHG

SEQ ID NO: 6465 - protein, 81 aa, Aotus trivirgatus
TLRRGQPKVLEWGFPKDQDSVAFEDVAVNFTHEEWALLGPSQKNLYRDVMQETIRNLNCIGMKWENQNADDQYQNLRRNLR

SEQ ID NO: 6466 - protein, 81 aa, Aotus trivirgatus
MDSVAFEDVAVNFTHEEWALLGPSQKNLYRDVMQETIRNLNCIGMKWENQNADDQYQNLRRNLRCDVVERFGKSKDGSQCG

SEQ ID NO: 6467 - protein, 81 aa, Aotus trivirgatus
GPSQKNLYRDVMQETIRNLNCIGMKWENQNADDQYQNLRRNLRCDVVERFGKSKDGSQCGETLSQIRSSIVNKNSPARVDA

SEQ ID NO: 6468 - protein, 81 aa, Aotus trivirgatus
RNDFFLPDSQTSEERKQYDSVAFEDVAVNFTQEEWALLGPSQKSLYRDVMWETIRNLDYIGHIVERFRKSSQISDSIVDEK

SEQ ID NO: 6469 - protein, 81 aa, Aotus trivirgatus
MDSVVFEDVAVNFTQEEWALLGPSQKKLYRDVMQETFVNLASIGENWEDKNIEDHRNQGRKLRSHMVERLCERKEGNQLGE

SEQ ID NO: 6470 - protein, 81 aa, Aotus trivirgatus
SDQRSRNKETRTPGSGEMDSVVFEDVAVNFTQEEWALLGPSQKKLYRDVMQETFVNLASIGENWEDKNIEDHRNQGRKLRS

SEQ ID NO: 6471 - protein, 81 aa, Aotus trivirgatus
VLQMQNSVHHGQNVKTQTDSISLEDVAVNFTLEEWALLDPGQRNIYRDVMRATFKNLACIGEKWKDQDIEDDHKNQGRNLR

SEQ ID NO: 6472 - protein, 81 aa, Aotus trivirgatus
MDSISLEDVAVNFTLEEWALLDPGQRNIYRDVMRATFKNLACIGEKWKDQDIEDDHKNQGRNLRGPMVETLCENKEDRQCR

SEQ ID NO: 6473 - protein, 81 aa, Aotus trivirgatus
MDSVAFEDVSVKFSQEEWALLAPSQKKLYRDVMQETFKNLASIGKKWEDQNIEDQHKNQGKNLRSHMVERLCESKEGSQCG

SEQ ID NO: 6474 - protein, 81 aa, Aotus trivirgatus
MESVTFEDVAVEFIQEWALLDSAQRNLCRYGMLDKCRSLASRGTPLFSLSPLFISAWESQLKPKELPSMRDILEEASSRDM

SEQ ID NO: 6475 - protein, 81 aa, Aotus trivirgatus
RDILEEASSRDMQMGPGLFLRMQLVPSMEDGETPSTQEDWPALQEPPWSLGCMRPKAAVQIQRTAMPVPTLGHPDLWVAGN

SEQ ID NO: 6476 - protein, 81 aa, Aotus trivirgatus
DRVEEEAMASGLPIACSQEPVTFADVAVVFTPEEWVFLDSTQRSLYRDVMLENYRNLASVDDQLCKPNALSYLEQRGEQWT

SEQ ID NO: 6477 - protein, 81 aa, Aotus trivirgatus
MESVTFEDVAVEFIQEWALLDSAQRNLCRYGMLDKCRSLASRGTPLFWESQLKPKELPSMRDILEEASSRDMQMGPGLFLR

SEQ ID NO: 6478 - protein, 81 aa, Aotus trivirgatus
ILEEASSRDMQMGPGLFLRMQLVPSMEDGETPSTQEDWPALQEPPWSLGCMRPKAAVQIQRTAMPVPTLGHPDLWVAGNSA

SEQ ID NO: 6479 - protein, 81 aa, Aotus trivirgatus
MESVTFEDVAVEFIQEWALLDSAQRNLCRYGMLDKCRSLASRGAGAVPEDATGAVHGRRGDTINSRGLASSPGATLVSGMH

SEQ ID NO: 6480 - protein, 81 aa, Aotus trivirgatus
ILEEASSRDMQMGPGLFLRMQLVPSMEDGETPSTQEDWPALQEPPWSLGCMRPKAAVQIQRTAMPVPTLGHPDLWVAGNSG

SEQ ID NO: 6481 - protein, 81 aa, Aotus trivirgatus
MAAGLLTAGPRGSTSFSSVTVAFAQEEWRCLVSTPRDRFKEGLPEKSRNLVLLGLPVSQPGMNSQLELREGAWMLEGEDLR

SEQ ID NO: 6482 - protein, 81 aa, Aotus trivirgatus
ENTGEEGMAAGLLTAGPRGSTSFSSVTVAFAQEEWRCLVSTPRDRFKEGLPEKSRNLVLLGLPVSQPGMNSQLELREGAWM

SEQ ID NO: 6483 - protein, 81 aa, Aotus trivirgatus
APEASALSQEENPRNQLMALMLLTAQPQELVMFEEVSVCFTSEEWACLGPIQRALYWDVMLENYGNVTSLGYRKYRRERNK

SEQ ID NO: 6484 - protein, 81 aa, Aotus trivirgatus
TLPQVGNSGDQAGATVLRMVRPQDTVVFEDLSVDYTQKKQKCPAVSQRAMHWNVMPENDHSMASLDGETGTEEVLIPKHHS

SEQ ID NO: 6485 - protein, 81 aa, Aotus trivirgatus
HHFASGDFAQCASPVPTLPQVGNSGDQAGATVLRMVRPQDTVVFEDLSVDYTQKKQKCPAVSQRAMHWNVMPENDHSMASL

SEQ ID NO: 6486 - protein, 81 aa, Aotus trivirgatus
GNSGDQAGATVLRMVRPQDTVVFEDLSVDYTQKKQKCPAVSQRAMHWNVMPENDHSMASLGENKLESSELTPKKEIFKSSN

SEQ ID NO: 6487 - protein, 81 aa, Aotus trivirgatus
VGNSGDQAGATVLRMVRPQDTVVFEDLSVDYTQKKQKCPAVSQRAMHWNVMPENDHSMASLAGENKLESSELTPKKEIFKS

SEQ ID NO: 6488 - protein, 81 aa, Aotus trivirgatus
AQILELLVLEQFLSILPGELRVWVQLHNPESGEEAVALLEELQRDLDGTSYRDPGPAQSPDVHWMGTGALRSAQIWSLASP

SEQ ID NO: 6489 - protein, 81 aa, Aotus trivirgatus
TMTTVSSTARPQESVAFDDVAVYFTKKEWAIMVPDQRALYRDVMLENYEAVAFVVPPTSKPALVSHLEQGKEPCFTQPQGV

SEQ ID NO: 6490 - protein, 81 aa, Aotus trivirgatus
LGSALELLPGQPTLSRACPSVTFEDVAVYFSENEWIGLGPAQTALYRDVMLENYGSVASLTFPFPKPALISQLEGKAPWCS

SEQ ID NO: 6491 - protein, 81 aa, Aotus trivirgatus
MTKSLESVSFKDVTVDFSRDEWQQLNVAQKSLYRDVMLENYFNLISVGCQVPKPEVIFNLEQEEPCMLNGGISSQSCPDGK

SEQ ID NO: 6492 - protein, 81 aa, Aotus trivirgatus
MSVVSHPESVSFKDVTVDFSRDEWQQLNVAQKSLYRDVMLENYFNLISVGCQVPKPEVIFNLEQEEPCMLNGGISSQSCPD

SEQ ID NO: 6493 - protein, 81 aa, Aotus trivirgatus
MAKRPRPPRSPEMGLLTFRDVAIEFSLEEWQCLNHAQQNLYRDVMFENYRNLVSLGIAVSKPELITCLEENNEPWNIKRNE

SEQ ID NO: 6494 - protein, 81 aa, Aotus trivirgatus
GLLTFRDVAIEFSLEEWQCLNHAQQNLYRDVMFENYRNLVSLGIAVSKPELITCLEENNEPWNIKRNEMVAKHPVTYSYLT

SEQ ID NO: 6495 - protein, 81 aa, Aotus trivirgatus
MNMSQASVSFQDVAVEFTQEEWQHLGPVEWTLYRDVMLENYRHLVSVGYCITKPKVISQLEQGEEPWSLEDEFLNQKYPGH

SEQ ID NO: 6496 - protein, 81 aa, Aotus trivirgatus
MLENYRHLVSVGYCITKPKVISQLEQGEEPWSLEDEFLNQKYPGHFEVDDYIKGIWEKQEKPLWKEIFIDDADKILSKEGQ

SEQ ID NO: 6497 - protein, 81 aa, Aotus trivirgatus
GDPSSEGTPGSGSVSISVRKPASEMQLQVQSQQEELERLKKDLSSQKELVRLLQQTVRSSQYDKYFTSSRLCEGVPKDTLE

SEQ ID NO: 6498 - protein, 81 aa, Aotus trivirgatus
CFYQEERMAAGHPPRWSQELVTFEDVSMDFSQEEWELLDPAQKNLYREVMLENYRNLVSLEALKNPRAHAGIEEGPFSTAH

SEQ ID NO: 6499 - protein, 81 aa, Aotus trivirgatus
HLLLQPVASAHVEQSEALWMEEKGTPQASCSDWTTVLKNQDSTYKKVVLQEEPAGGINIIRLIREDGGWKQSEESHEDPQG

SEQ ID NO: 6500 - protein, 81 aa, Aotus trivirgatus
MDSVVFEDVAVDFTLEEWALLDSAQRDLYRDVMLETFRNLASVDDETQFKASGSVSQQDIYGEEISKESKIAEFTRNVSWA

SEQ ID NO: 6501 - protein, 81 aa, Aotus trivirgatus
MDSVVFEDVAVDFTREEWALLDSAQRDLYRDVMLETFQNLASVACETWERTDRSVSQQDMYGAKISQEQTIPNFTRNNSCA

SEQ ID NO: 6502 - protein, 81 aa, Aotus trivirgatus
MDSVVFEDVAVDFTREEWALLDSAQRDLYRDVMLETFQNLASVDDETPCKADRSVSQQDMYGAKISQEQTIPNFTRNNSCA

SEQ ID NO: 6503 - protein, 81 aa, Aotus trivirgatus
MDSVVFEEVAVRFTPEEWALLSHAQRRLYRDVMLEICRNLASLDSCIYVRTSGSSSQREVFGNEISNEEEIAKFTRSDYWS

SEQ ID NO: 6504 - protein, 81 aa, Aotus trivirgatus
FQEKNTEEGEVAALRLTARSQETVTFKDVAMDFTPEEWGKLDPAQRDVMLENYRNLVSLWLPVSKPENYTLENGKEPLKLE

SEQ ID NO: 6505 - protein, 81 aa, Aotus trivirgatus
QEKNTEEGEVAALRLTARSQETVTFKDVAMDFTPEEWGKLDPAQRDVMLENYRNLVSLWLPVSKPENYTLENGKEPLKLER

SEQ ID NO: 6506 - protein, 81 aa, Aotus trivirgatus
EGEVAALRLTARSQETVTFKDVAMDFTPEEWGKLDPAQRDVMLENYRNLVSLWLPVSKPENYTLENGKEPLKLERKAPKNS

SEQ ID NO: 6507 - protein, 81 aa, Aotus trivirgatus
TQPDEDLHLQAEETELVKESVTFKDVAIDFTLEEWRLMDPTQRNLHKDVMLENYRNLVFVGLAVSKPDMISHLENGKGPWV

SEQ ID NO: 6508 - protein, 81 aa, Aotus trivirgatus
PEVTQPDEDLHLQAEETELVKESVTFKDVAIDFTLEEWRLMDPTQRNLHKDVMLENYRNLVFVGLAVSKPDMISHLENGKG

SEQ ID NO: 6509 - protein, 81 aa, Aotus trivirgatus
WPERGPPAPQHQEMASASPLLSAWSQAPVNLEDVAVYLSGEEPGCLGPTQQDAPLENEGPVIQLVDGGDGGEDAPVRMEWY

SEQ ID NO: 6510 - protein, 81 aa, Aotus trivirgatus
DDNSSAKKPGDDEQILEDKCEDFDDIAQYFSKNEWEKLKYSEKSTYAYIKENYESLRRLGFHIPLPLFMHSKWTENFWEDD

SEQ ID NO: 6511 - protein, 81 aa, Aotus trivirgatus
MLQTTWPQESVAFEDVAVYFTQNQWASLDPAQRALYREVMLENYANVASLVAFPFPKPALISHLEKGEAPWGPDPWDAEIP

SEQ ID NO: 6512 - protein, 81 aa, Aotus trivirgatus
EGRTRDRQMAAALLTAWSQMPVTFEDVALYLSREEWGRLDHTQQNFYRDVLQKRNGLSLGFPFSRPFWAPQVQGKGEASGS

SEQ ID NO: 6513 - protein, 81 aa, Aotus trivirgatus
EGRTRDRQMAAALLTAWSQMPVTFEDVALYLSREEWGRLDHTQQNFYRDVLQKRNGLSLGPIQEGQGVPIPPVAALGDVKP

SEQ ID NO: 6514 - protein, 81 aa, Aotus trivirgatus
LKEGQTREPMATCFVSGVHGPVASGDIPFYFSQEEWGTLDPAQRDLFWDIKRGNSRNTTLGLGLKGQSERSRLEEVVPALP

SEQ ID NO: 6515 - protein, 81 aa, Aotus trivirgatus
HPLVNLLPKGIQQKQETVSLCLKANPELVVFEDLNVFHCQEECVSLDPTQQLTSEKEDDSSVGEMMLLAVNGSNPEGEDSE

SEQ ID NO: 6516 - protein, 81 aa, Aotus trivirgatus
PLVNLLPKGIQQKQETVSLCLKANPEELVVFEDLNVFHCQEECVSLDPTQQLTSEKEDDSSVGEMMLLAVNGSNPEGEDSE

SEQ ID NO: 6517 - protein, 81 aa, Aotus trivirgatus
PLVNLLPKGIQQKQETVSLCLKANPEELVVFEDLNVFHCQEECVSLDPTQQLTSEKEDDSSVGEMMLLVNGSNPEGEDSEK

SEQ ID NO: 6518 - protein, 81 aa, Aotus trivirgatus
SLFPPEGNMEDKMTGPQLPESLEDVAMYISQEEWGHQDPSKRALSRDTVQESYENVDSLESHIPSQEIPSTQVGQGGKLWD

SEQ ID NO: 6519 - protein, 81 aa, Aotus trivirgatus
QTNSKDWTVAPEHVLPESQSLLTFEEVAMYFSQEEWELLDPTQKALYNDVMQENYETVISLALFVLPKPKVISCLEQGEEP

SEQ ID NO: 6520 - protein, 81 aa, Aotus trivirgatus
MYFSQEEWELLDPTQKALYNDVMQENYETVISLALFVLPKPKVISCLEQGEEPWVQVSQEFKDSARGSSTGLKLKNDTENH

SEQ ID NO: 6521 - protein, 81 aa, Aotus trivirgatus
TCDNRAVSLCQQEWMRPGPARRALYRDATQRKDRHVSLATGVPWGYEETRTLLAILSSSQFYGKLQTCQQNSQIYRAMAER

SEQ ID NO: 6522 - protein, 81 aa, Aotus trivirgatus
NTGLHDQETGAVVWTAEFQGPATCDNRAVSLCQQEWMRPGPARRALYRDATQRKDRHVSLATGVPWGYEETRTLLAILSSS

SEQ ID NO: 6523 - protein, 81 aa, Aotus trivirgatus
MASVFPTPEAQGPMLFEDLAVYFSQEECVTLHPAQRSLSRDATQECLEDAALMGEEGKPEINQQLSLESMELDELALEKYP

SEQ ID NO: 6524 - protein, 81 aa, Aotus trivirgatus
MALSQGPLTFMDVAIEFSQEEWRCLDPAQRTLYRDVMLENYRNLVSLGVGLPDLSFISMLEQKREPWTLQSEEKMARNPDG

SEQ ID NO: 6525 - protein, 81 aa, Aotus trivirgatus
GHLTFMDVAIEFSQEEWRCLDPAQQALYRDVMLENYRNLVSLGICLPDLSIISMLEQRREPSTLQGEVKIVKIQDGRECIR

SEQ ID NO: 6526 - protein, 80 aa, Aotus trivirgatus
MDVAIEFSQEEWRCLDPAQQALYRDVMLENYRNLVSLGICLPDLSIISMLEQRREPSTLQGEVKIVKIQDGRECIRSVNT

SEQ ID NO: 6527 - protein, 81 aa, Aotus trivirgatus
LYRDVMLENYRNLVSLGICLPDLSIISMLEQRREPSTLQGEVKIVKIQDGRECIRSVNTDSPLLQRISVPFVFCTASITVC

SEQ ID NO: 6528 - protein, 81 aa, Aotus trivirgatus
GHLTFRDVAIEFSQEEWECLEPAQRALYRDVMLENYRNLVSLGICLPDLSIISTLEQSRGPWNLQSEVKIANTSDVRECIK

SEQ ID NO: 6529 - protein, 81 aa, Aotus trivirgatus
GHLTFMDVAIEFSQEEWRCLDPAQQALYRDVMLENYRNLVSLGICLPDLSIISMLEQRREPSTLQGEVKIVKIQACCTITR

SEQ ID NO: 6530 - protein, 81 aa, Aotus trivirgatus
DEEAQKRKEKESGMALPQGHLTFMDVAIEFSQEEWRCLDPAQQALYRDVMLENYRNLVSLGICLPDLSIISMLEQRREPST

SEQ ID NO: 6531 - protein, 81 aa, Aotus trivirgatus
DEEAQKRKEKESGMALPQGHLTFMDVAIEFSQEEWRCLDPAQQALYRDVMLENYRNLVSLGRSCILRSNAGNKPIKNHLGL

SEQ ID NO: 6532 - protein, 81 aa, Aotus trivirgatus
EPRKRKRKAKESGMALPQGHLTFTDVAIEFSQEEWKCLDPAQRALYKDVMLENYRNLVSLGISLPDLNINSMLEQRRELWS

SEQ ID NO: 6533 - protein, 81 aa, Aotus trivirgatus
EPRKRKRKAKESGMALPQGHLTFTDVAIEFSQEEWKCLDPAQRALYKDVMLENYRNLVSLGSGCALGGNAENKPIETQLGV

SEQ ID NO: 6534 - protein, 81 aa, Aotus trivirgatus
EWKCLDPAQRALYKDVMLENYRNLVSLGISLPDLNINSMLEQRRELWSGESEVRIAKSADRRERIKVVNTGWSAMAPSKLT

SEQ ID NO: 6535 - protein, 81 aa, Aotus trivirgatus
LWSGESEVRIAKSADRRERIKVVNTGWSAMAPSKLTAASPSQIQAILLPQPPELVGLQGAAVHWEAMQKTSQLKHSLEYPF

SEQ ID NO: 6536 - protein, 81 aa, Aotus trivirgatus
MALTQGPLTFRDVTIEFSQEEWKCLDPAQKALYKDVMLENYRNLVFLGEDKFSLEVQICPCAFLYFLCCISWEPLHYLTET

SEQ ID NO: 6537 - protein, 81 aa, Aotus trivirgatus
MALTQGPLTFRDVTIEFSQEEWKCLDPAQKALYKDVMLENYRNLVFLGIIPKCTTKELPPIGNSNTGEKIQTMTLERHECY

SEQ ID NO: 6538 - protein, 81 aa, Aotus trivirgatus
LDPAQKALYKDVMLENYRNLVFLGIIPKCTTKELPPIGNSNTGEKIQTMTLERHECYDIEDIYLREIQKNLLDLEFQWKHG

SEQ ID NO: 6539 - protein, 81 aa, Aotus trivirgatus
LCKVQGPLTFRDVTIEFSQEEWKCLDPAQKALYKDVMLENYRNLVFLGIIPKCTTKELPPIGNSNTGEKIQTMTLERHECY

SEQ ID NO: 6540 - protein, 81 aa, Aotus trivirgatus
MESLTLEDVAVDFTWEEWQLLSPTQKDLYRDVMLENYSNLVAVGYQASKPNALLKLEREEPCCTTEDESYTQICSDSGSAY

SEQ ID NO: 6541 - protein, 81 aa, Aotus trivirgatus
ESLTLEDVAVDFTWEEWQLLSPTQKDLYRDVMLENYSNLVAVGYQASKPNALLKLEREEPCCTTEDESYTQICSEIRKIDD

SEQ ID NO: 6542 - protein, 81 aa, Aotus trivirgatus
ESLTLEDVAVDFTWEEWQLLSPTQKDLYRDVMLENYSNLVAVGYQASKPNALLKLEREEPCCTTEDESYTQICSDSGSAYA

SEQ ID NO: 6543 - protein, 81 aa, Aotus trivirgatus
MESLTLEDVAVDFTWEEWQLLSPTQKDLYRDVMLENYSNLVAVGYQASKPNALLKLEREEPCCTTEDESYTQICSEIRKID

SEQ ID NO: 6544 - protein, 81 aa, Aotus trivirgatus
MRPELTNFWEESLTLEDVAVDFTWEEWQLLSPTQKDLYRDVMLENYSNLVAVGYQASKPNALLKLEREEPCCTTEDESYTQ

SEQ ID NO: 6545 - protein, 81 aa, Aotus trivirgatus
ESLTLEDVAVDFTWEEWQLLSPTQKDLYRDVMLENYSNLVAVGYQASKPNALLKLEREEPCCTTEDESYTQICSGRGPPDG

SEQ ID NO: 6546 - protein, 81 aa, Aotus trivirgatus
ESLTLEDVAVDFTWEEWQLLSPTQKDLYRDVMLENYSNLVAVGYQASKPNALLKLEREEPCCTTEDESYTQICSDSGKIRK

SEQ ID NO: 6547 - protein, 81 aa, Aotus trivirgatus
MIKTQESLTLEDVAVEFSWEEWQLLDTAQKDLYRDVMVENYNHLVSLGYQTSKPDALSKLAHGQEPWMTDAKIQNKNCPGI

SEQ ID NO: 6548 - protein, 81 aa, Aotus trivirgatus
MALTQGSLTFKDVAIEFSQEEWKCLDPVQKALYRDVMLENYRNLGFLGLCLPDLNIISMLEQGKEPWTVVSQVKITRNPNW

SEQ ID NO: 6549 - protein, 81 aa, Aotus trivirgatus
FSQKPQVLGPEEQDGSCEASMSFEDVTMDFSREEWQQLDPAQKRLYQDVMLELYSHLFSVGYQIPNPDVIFRRLKEKEPCM

SEQ ID NO: 6550 - protein, 81 aa, Aotus trivirgatus
MPADVNFSQKPQVLGPEEQDGSCEASMSFEDVTMDFSREEWQQLDPAQKRLYQDVMLELYSHLFSVGYQIPNPDVIFRRLK

SEQ ID NO: 6551 - protein, 81 aa, Aotus trivirgatus
MAEEFVTLKDVAMDFTLEDWEQFGLDQGDLFWDTALDNYQNLFLLNPPRPNLTSHPDGSEDLEPLARGSPEATGPDLAETT

SEQ ID NO: 6552 - protein, 81 aa, Aotus trivirgatus
MDFTLEDWEQFGLDQGDLFWDTALDNYQNLFLLNPPRPNLTSHPDGSEDLEPLARGSPEATGPDLAETTNSPLMQDFLEEG

SEQ ID NO: 6553 - protein, 81 aa, Aotus trivirgatus
FQEESPEGDTGRTEQKPMVKDAFKDISIYFSKEEWAEMGDWEKTRYRNVKRNYNALITIGLRATRPAFMCHRRQAIKLQVD

SEQ ID NO: 6554 - protein, 81 aa, Aotus trivirgatus
QKPMVKDAFKDISIYFSKEEWAEMGDWEKTRYRNVKRNYNALITIGLRATRPAFMCHRRQAIKLQVDDTEDSDEEWTPRQQ

SEQ ID NO: 6555 - protein, 81 aa, Aotus trivirgatus
VKRNYNALITIGLRATRPAFMCHRRQAIKLQVDDTEDSDEEWTPRQQVKPPGTAFRVEQSKHQKIVRCVRTSSLAAVLLMG

SEQ ID NO: 6556 - protein, 81 aa, Aotus trivirgatus
VSLTFEDVAVLFTRDEWRKLAPSQRNLYRDVMLENYRNLVSLGLPFTKPKVISLLQQGEDPWKVEKDCSGGSSPGCKSNPK

SEQ ID NO: 6557 - protein, 81 aa, Aotus trivirgatus
MAVSHLPSMVQESVTFKDVAVLFTQEEWGQLSPAQRALYRDVMLENYSNLVSLGLLGPKPDIFSQLEKKEEWMPEDPSGGF

SEQ ID NO: 6558 - protein, 81 aa, Aotus trivirgatus
MARRLLPAQVQESVTFRDVAVFFSPDEWLHLDSAQRALYREVMLENYSSLVSLGILLSKPKVISHLEQGEDPWMVESGVPQ

SEQ ID NO: 6559 - protein, 81 aa, Aotus trivirgatus
MAVDLLPAQESMTFRDVAVFFSQDEWLHLDSAQRALYREVMLENYSTLVSLGIPFSMPKVIHQLQQGQDPCMVEGEVPSDI

SEQ ID NO: 6560 - protein, 81 aa, Aotus trivirgatus
PLAAQSPEGHHGHQEPGSTYFHPPRIQEEWGLLDRSQKELYWDAMLEKYGTVVSLGLPPHQPEAQAPSELGMLLTGAGVCR

SEQ ID NO: 6561 - protein, 81 aa, Aotus trivirgatus
MAFEDVAVYFSQDEWGLLDTAQRALYRHVMLENFTLVTSLGLSTSRPLVVIQLERGEDPWVPSVKDMTLARNAYGRRNTGS

SEQ ID NO: 6562 - protein, 81 aa, Aotus trivirgatus
MAFEDVAVYFSQDEWGLLDTAQRALYRHVMLENFTLVTSLGLSTSRPLVVIQLERGEDPWVPSVKDMTLARNAYGRRNTGE

SEQ ID NO: 6563 - protein, 81 aa, Aotus trivirgatus
GPARHTCWPCGSAVPSLKSLVIFEDVAVYFSQEEWGLLNAAQRHLYHNVMVENFELITSLGCWHGVEGEEPHPKKNASVEE

SEQ ID NO: 6564 - protein, 81 aa, Aotus trivirgatus
PSLKSLVIFEDVAVYFSQEEWGLLNAAQRHLYHNVMVENFELITSLGNALPQHDVFACSVGADLPNCFPNWLPHFTFLSAV

SEQ ID NO: 6565 - protein, 81 aa, Aotus trivirgatus
MAGEVQAQLDPSLQGLVMFEDVAVYFSREEWGLLNVTQKGLYRDVMLENFALLSSLGLAPSRSPVFTQLVDDEQSFVPSWV

SEQ ID NO: 6566 - protein, 81 aa, Aotus trivirgatus
MAGEVQGLVMFEDVAVYFSREEWGLLNVTQKGLYRDVMLENFALLSSLGLAPSRSPVFTQLVDDEQSFVPSWVDVTLVSRT

SEQ ID NO: 6567 - protein, 81 aa, Aotus trivirgatus
DEAAAAVMSVGPAAAQLQEPVTFRDVAVDFTQEEWGQLDPTQRILYRDVMLETFGHLLSIGSELPKPEVISHLEQGTEPWV

SEQ ID NO: 6568 - protein, 81 aa, Aotus trivirgatus
MEARSHQVPPQASVCFEDVAMAFTQEEWGQLDLAQRTLYREVTLETWEHLVSLGLLLSKPDVISQLEQEEDLCRAEQVALQ

SEQ ID NO: 6569 - protein, 81 aa, Aotus trivirgatus
MEARSHQVPPQASVCFEDVAMAFTQEEWGQLDLAQRTLYREVTLETWEHLVSLDWKATLEKNRLNSGKDQAWDEISHHVEV

SEQ ID NO: 6570 - protein, 81 aa, Aotus trivirgatus
EDVAMAFTQEEWGQLDLAQRTLYREVTLETWEHLVSLGLLLSKPDVISQLEQEEDLCRAEQVALQDGVSLSLPRLECNGAI

SEQ ID NO: 6571 - protein, 81 aa, Aotus trivirgatus
QEEKQEDAAICPVTVLPEEPVTFQDVAVDFSREEWGLLGPTQRTEYRDVMLETFGHLVSVGWETTLENKQLASNSGIPGEE

SEQ ID NO: 6572 - protein, 81 aa, Aotus trivirgatus
MASRLPTVWSCEPVTFEDVTLGFNPEEWGLLDLKQKSLYREVMLENYRNLVSVEHQLSKPDVVSQLEEAEDFWPVEKGIPQ

SEQ ID NO: 6573 - protein, 81 aa, Aotus trivirgatus
MASRLPTVWSCEPVTFEDVTLGFNPEEWGLLDLKQKSLYREVMLENYRNLVSVEYPELQLDAKLDPLSAESPLMNIEVVEV

SEQ ID NO: 6574 - protein, 81 aa, Aotus trivirgatus
MLENYRNLVSVEHQLSKPDVVSQLEEAEDFWPVEKGIPQDTIPEYPELQLDAKLDPLSAESPLMNIEVVEVLTLNQEVAGP

SEQ ID NO: 6575 - protein, 81 aa, Aotus trivirgatus
ARMRDVHCRRRGLLAVRREQVTFEDVVVDFTQEEWGQLELAERTLYCDVMLDTFRLLVAVGHWLPKPNIISLLEQEAKLWA

SEQ ID NO: 6576 - protein, 81 aa, Aotus trivirgatus
NPGLCAARDPEQVTFEDVVVDFTQEEWGQLELAERTLYCDVMLDTFRLLVAVGHWLPKPNIISLLEQEAKLWAVDPGVPRG

SEQ ID NO: 6577 - protein, 81 aa, Aotus trivirgatus
GSPEEGRRAAGLPAAQVQEPVTFKDVAVDFTQEEWGQLDLVQRTLYRDVMLETYGHLLSVGNQIAKPEVISLLEQGAEPWS

SEQ ID NO: 6578 - protein, 81 aa, Aotus trivirgatus
MAAAALMAPARGIVTFEDVAVYFSWKEWSLLDEAQKCLYHDVMLENLTLTTSLGGCGTEDEEAPYQQSTSPQRVSQVRIPK

SEQ ID NO: 6579 - protein, 81 aa, Aotus trivirgatus
MQQGTVTFEDVAVNFSREEWSLLSEVQRCLYHDVMLENWVLISSLGCWCESEDEEAPSKQNISILQRVSQVSTPRAGVSLK

SEQ ID NO: 6580 - protein, 81 aa, Aotus trivirgatus
HRMTWDCIAIGNHENSVQGTVTFEDVAVNFSREEWSLLSEVQRCLYHDVMLENWVLISSLGCWCESEDEEAPSKQNISILQ

SEQ ID NO: 6581 - protein, 81 aa, Aotus trivirgatus
MQGTVTFEDVAVNFSREEWSLLSEVQRCLYHDVMLENWVLISSLGCWCESEDEEAPSKQNISILQRVSQVSTPRAGVSLKK

SEQ ID NO: 6582 - protein, 81 aa, Aotus trivirgatus
MAAAALRLPAQGTVTFEDVAVKFSQEEWSLLSEAQRCLYHDVMLENLALISSLGCWYGANDETPSKQTLSIQQQSPLRSHW

SEQ ID NO: 6583 - protein, 81 aa, Aotus trivirgatus
MAALALRDPAQGTVTFEDVAVKFSQEEWSLLSEAQRCLYHDVMLENLALISSLGCWYGANDETPSKQTLSIQQQSPLRSHW

SEQ ID NO: 6584 - protein, 81 aa, Aotus trivirgatus
MAAAALRAPAPGTVTFEDVAVHFSWEEWGLLDEAQRCLYHDVMLENLALLTSLDVHYQKQHFGEKHFRSNVDRALFVKTCI

SEQ ID NO: 6585 - protein, 81 aa, Aotus trivirgatus
SQPGPQSSMAALALRDPAQGMTFEDVAIYFSQEEWELLDEAQRFLYCNVMLENFAHVTSLGFCHGTENEAIASEHSVSVGG

SEQ ID NO: 6586 - protein, 81 aa, Aotus trivirgatus
MTFEDVAIYFSQEEWELLDEAQRFLYCNVMLENFAHVTSLGFCHGTENEAIASEHSVSVGGKLQVRTSKGDTPTQNTHLTE

SEQ ID NO: 6587 - protein, 81 aa, Aotus trivirgatus
TDPAPVPIGTEVLSEPRGSVTFEDVAVYFSWEEWDLLDETQKHLYFDVMLENFVLTSSLGYWRGLEREEAPSSSVGTDIPQ

SEQ ID NO: 6588 - protein, 81 aa, Aotus trivirgatus
VQLRPPTRMATALTDPAPGSVTFEDVAVYFSWEEWDLLDETQKHLYFDVMLENFVLTSSLGYWRGLEREEAPSSSVGTDIP

SEQ ID NO: 6589 - protein, 81 aa, Aotus trivirgatus
VQLRPPTRMATALTDPAPGSVTFEDVAVYFSWEEWDLLDETQKHLYFDVMLENFVLTSSLGLTSSWSHVVAQLGLGEVSSV

SEQ ID NO: 6590 - protein, 81 aa, Aotus trivirgatus
TDPAPVPIGTEVLSEPRGSVTFEDVAVYFSWEEWDLLDETQKHLYFDVMLENFVLTSSLGLTSSWSHVVAQLGLGEVSSVL

SEQ ID NO: 6591 - protein, 81 aa, Aotus trivirgatus
GSVTFEDVAVYFSWEEWDLLDETQKHLYFDVMLENFVLTSSLGYWRGLEREEAPSSSVGTDIPQRISVKGVPQFRTSKEGS

SEQ ID NO: 6592 - protein, 81 aa, Aotus trivirgatus
MASALRVPTRQGFVTFEDVAIYFSQEEWELLSETQRLLYRDVMLENFAVMASLGCWCGAEDKEAPSAESISEEELSQGRTP

SEQ ID NO: 6593 - protein, 81 aa, Aotus trivirgatus
MAAAALRAPTQGCVTFEDIAIYFSQEEWGRLDEAQRLLYLEVMLENFALVASLGCGHGTEDEKTPSEQNVSIGVSQSKAGS

SEQ ID NO: 6594 - protein, 81 aa, Aotus trivirgatus
RAPTQVTVTPETHMDLTKGCVTFEDIAIYFSQEEWGRLDEAQRLLYLEVMLENFALVASLGCGHGTEDEKTPSEQNVSIGV

SEQ ID NO: 6595 - protein, 81 aa, Aotus trivirgatus
MAAAALRAPTQEEWGRLDEAQRLLYLEVMLENFALVASLGCGHGTEDEKTPSEQNVSIGVSQSKAGSSTQKTQPCEMCVPV

SEQ ID NO: 6596 - protein, 81 aa, Aotus trivirgatus
MDLTKGCVTFEDIAIYFSQEEWGRLDEAQRLLYLEVMLENFALVASLGCGHGTEDEKTPSEQNVSIGVSQSKAGSSTQKTQ

SEQ ID NO: 6597 - protein, 81 aa, Aotus trivirgatus
RALTPVPMTAEAKFTGFTQGSVTFEDVAIYFSQEEWGLLDEAQRLLYRDVMLENFALLTSLVCWHGMEDEETPQQSVSVKG

SEQ ID NO: 6598 - protein, 81 aa, Aotus trivirgatus
MAEGKDAAQLLVTFKDVAVTFTQEEWRQLDLAQRTLYQEVMLETCGLLVSLGYWVPKPELVHLLEHGQELWTVKRGRSHPT

SEQ ID NO: 6599 - protein, 81 aa, Aotus trivirgatus
LLVTFKDVAVTFTQEEWRQLDLAQRTLYQEVMLETCGLLVSLGDKAQVQTREPTTYLPVLSERAFLRGSLTLECSSDSKLG

SEQ ID NO: 6600 - protein, 81 aa, Aotus trivirgatus
LANPPQIPVATEEFVKPSQGHVTFEDIAVYFSQEEWGLLDEAQRCLYHDVMLENFSLMTSVAGLSQNNHKDSCLQWKVPVS

SEQ ID NO: 6601 - protein, 81 aa, Aotus trivirgatus
MDAAALANPPQGHVTFEDIAVYFSQEEWGLLDEAQRCLYHDVMLENFSLMTSVGCLHGIGAEEAPSEQIVSVEGVSQARTP

SEQ ID NO: 6602 - protein, 81 aa, Aotus trivirgatus
ANPPQIPVATEEFVKPSQGHVTFEDIAVYFSQEEWGLLDEAQRCLYHDVMLENFSLMTSVGCLHGIGAEEAPSEQIVSVEG

SEQ ID NO: 6603 - protein, 81 aa, Aotus trivirgatus
EPAQVLVAAESLIDNEEQGYVTFEDVAVYFSQEEWRLLDEAQRLLYRNVMLENFSLMASLGCWHGVEAKEAPKQSASVGVL

SEQ ID NO: 6604 - protein, 81 aa, Aotus trivirgatus
REPAQVLVAAESLIDNEEGYVTFEDVAVYFSQEEWRLLDEAQRLLYRNVMLENFSLMASLGLASSKTHEITQLESWEEPFV

SEQ ID NO: 6605 - protein, 81 aa, Aotus trivirgatus
MAAAALREPAQGYVTFEDVAVYFSQEEWRLLDEAQRLLYRNVMLENFSLMASLGCWHGVEAKEAPKQSASVGVLSSNTQQH

SEQ ID NO: 6606 - protein, 81 aa, Aotus trivirgatus
MAAAALREPAQQGYVTFEDVAVYFSQEEWRLLDEAQRLLYRNVMLENFSLMASLGLASSKTHEITQLESWEEPFVPAWDVM

SEQ ID NO: 6607 - protein, 81 aa, Aotus trivirgatus
EPAQVLVAAESLIDNEEQGYVTFEDVAVYFSQEEWRLLDEAQRLLYRNVMLENFSLMASLGLASSKTHEITQLESWEEPFV

SEQ ID NO: 6608 - protein, 81 aa, Aotus trivirgatus
MAAAALREPAQGYVTFEDVAVYFSQEEWRLLDEAQRLLYRNVMLENFSLMASLGLASSKTHEITQLESWEEPFVPAWDVMT

SEQ ID NO: 6609 - protein, 81 aa, Aotus trivirgatus
ALREPAQVLVAAESLIDNDYVTFEDVAVYFSQEEWRLLDEAQRLLYRNVMLENFSLMASLGCWHGVEAKEAPKQSASVGVL

SEQ ID NO: 6610 - protein, 81 aa, Aotus trivirgatus
MAAAALREPAQQGYVTFEDVAVYFSQEEWRLLDEAQRLLYRNVMLENFSLMASLGCWHGVEAKEAPKQSASVGVLSSNTQQ

SEQ ID NO: 6611 - protein, 81 aa, Aotus trivirgatus
FEDVAVYFSQEEWRLLDEAQRLLYRNVMLENFSLMASLGLASSKTHEITQLESWEEPFVPAWDVMTSAIPRGTRWVELREV

SEQ ID NO: 6612 - protein, 81 aa, Aotus trivirgatus
MAAAALREPAQGYVTFEDVAVYFSQEEWRLLDEAQRLLYRNVMLENFSLMASLGKVLTPRPSILGWAQLFLLFLGTSLFFP

SEQ ID NO: 6613 - protein, 81 aa, Aotus trivirgatus
REPAQVLVAAESLIDNEEGYVTFEDVAVYFSQEEWRLLDEAQRLLYRNVMLENFSLMASLGKVLTPRPSILGWAQLFLLFL

SEQ ID NO: 6614 - protein, 81 aa, Aotus trivirgatus
LREPAQVLVAAESLIDNEGYVTFEDVAVYFSQEEWRLLDEAQRLLYRNVMLENFSLMASLGKVLTPRPSILGWAQLFLLFL

SEQ ID NO: 6615 - protein, 81 aa, Aotus trivirgatus
LREPAQGYVTFEDVAVYFSQEEWRLLDEAQRLLYRNVMLENFSLMASLGLASSKTHEITQLESWEEPFVPAWDVMTSAIPR

SEQ ID NO: 6616 - protein, 81 aa, Aotus trivirgatus
MGQAQVPMNSEVIMDPIQGQVNFEDVFVYFSQEEWVLLDEAQRLLYRDVMLENFALMASLGCRPGMKDEEIPFEQSISIGL

SEQ ID NO: 6617 - protein, 81 aa, Aotus trivirgatus
MNSEVIMDPIQGQVNFEDVFVYFSQEEWVLLDEAQRLLYRDVMLENFALMASLGHTSFTSHTVASPVMVPDWVDVTPAVAT

SEQ ID NO: 6618 - protein, 81 aa, Aotus trivirgatus
MAAAAPMGQAQGQVNFEDVFVYFSQEEWVLLDEAQRLLYRDVMLENFALMASLGHTSFTSHTVASPVMVPDWVDVTPAVAT

SEQ ID NO: 6619 - protein, 81 aa, Aotus trivirgatus
VNLTEDCMVFEDVAIHFSQEEWGILNDAQRHLHSNVMLENFALLSSVGCWHGAKDKEAPSKQCVSVRVLQVTTPKPALSTL

SEQ ID NO: 6620 - protein, 81 aa, Aotus trivirgatus
MFMDAGQDCMVFEDVAIHFSQEEWGILNDVQRHLHSDVMLENFALLSSVGCWHGAKDEEAPSKQYVSVGVSQVTTLKPALS

SEQ ID NO: 6621 - protein, 81 aa, Aotus trivirgatus
VNLIEDCMVFEDVAIHFSQEEWGILNDVQRHLHSDVMLENFALLSSVGCWHGAKDEEAPSKQYVSVGVSQVTTLKPALSTQ

SEQ ID NO: 6622 - protein, 81 aa, Aotus trivirgatus
LTEVGVLVPWLAEMDPAQDRVVFEDVAIYFSQEEWGHLDEAQRLLYRDVMLENLALLSSLGFIAVAAMFMDAGQDCMVFED

SEQ ID NO: 6623 - protein, 81 aa, Aotus trivirgatus
RLLYRDVMLENLALLSSLGFIAVAAMFMDAGQDCMVFEDVAIHFSQEEWGILNDVQRHLHSDVMLENFALLSSVGFISIIH

SEQ ID NO: 6624 - protein, 81 aa, Aotus trivirgatus
MNLTEGPAAEMDPAQDCMVFEDVAIHFSQEEWGILNDVQRHLHSDVMLENFALLSSVGCWHGAKDEEAPSKQYVSVGVSQV

SEQ ID NO: 6625 - protein, 81 aa, Aotus trivirgatus
LTEVGVLVPWLAEMDPAQDRVVFEDVAIYFSQEEWGHLDEAQRLLYRDVMLENLALLSSLGCWHGAEDEVAPSQQDFSAGV

SEQ ID NO: 6626 - protein, 81 aa, Aotus trivirgatus
MNLTEDRVVFEDVAIYFSQEEWGHLDEAQRLLYRDVMLENLALLSSLGCWHGAEDEVAPSQQDFSAGVSEVTTSKSCMFTQ

SEQ ID NO: 6627 - protein, 81 aa, Aotus trivirgatus
AEMDPAQDRVVFEDVAIYFSQEEWGHLDEAQRLLYRDVMLENLALLSSLGCWHGAEDEVAPSQQDFSAGVSEVTTSKSCMF

SEQ ID NO: 6628 - protein, 81 aa, Aotus trivirgatus
MNLTEGPAAEMDPAQDRVVFEDVAIYFSQEEWGHLDEAQRLLYRDVMLENLALLSSLGKALTLVQCPGLGCVIPFPQAALR

SEQ ID NO: 6629 - protein, 81 aa, Aotus trivirgatus
MAEVNPAQDRVVFEDVAIYFSQEEWGHLDEAQRLLYRDVMLENLALLSSLGCWHGAEDEVAPSQQDFSAGVSEVTTSKSCM

SEQ ID NO: 6630 - protein, 81 aa, Aotus trivirgatus
MAEVNPAQDRVVFEDVAIYFSQEEWGHLDEAQRLLYRDVMLENLALLSSLGCCHGAEDEEAPLEQGVSVGLSQVMAPKPCL

SEQ ID NO: 6631 - protein, 81 aa, Aotus trivirgatus
TYSSFPFWQDRVVFEDVAIYFSQEEWGHLDEAQRLLYRDVMLENLALLSSLGCCHGAEDEEAPLEQGVSVGLSQVMAPKPC

SEQ ID NO: 6632 - protein, 81 aa, Aotus trivirgatus
VSVGLSQVMAPKPCLSTQKTQPCETCSSLLKDILRLAEHDGTHPQQGPYTCPAHLHQHQKEQMREKLCRGDGGRPSFVKKH

SEQ ID NO: 6633 - protein, 81 aa, Aotus trivirgatus
MAAAVLMDRVQRSVTFEDVFVYFSRDEWELLEEAQRFLYRDVMLENFALVATLGFWCEAENEEAPSEQSISVEGVSQVRTA

SEQ ID NO: 6634 - protein, 81 aa, Aotus trivirgatus
MAAAVLMDRVQRSVTFEDVFVYFSRDEWELLEEAQRFLYRDVMLENFALVATLAFIFQFHVVAHLERGRKPWVPNRADITP

SEQ ID NO: 6635 - protein, 81 aa, Aotus trivirgatus
MAGLAQVSVTFEDVAVTFTQEEWGQLDATQRTLYQEVMLEICGLLVSLGCPLSKPELIYQLDHRQELWMAKKDLSQSSYPG

SEQ ID NO: 6636 - protein, 81 aa, Aotus trivirgatus
MAAAWMAPTQESVTFEDVAVTFTQEEWGQLDVTQRALYVEVMLETCGLLVALGDSTKPETLEPNPSHPALPEEVSLQEQLA

SEQ ID NO: 6637 - protein, 81 aa, Aotus trivirgatus
MATALTDPAQVSVTFDDVAVTFTQEEWGQLDLAQRTLYQEVMLENCGLLVSLGCPVPRPELIYHLEHGQEPWTRKEDLSQG

SEQ ID NO: 6638 - protein, 81 aa, Aotus trivirgatus
MAAAVLTDRAQVSVTFDDVAVTFTKEEWGQLDLGQRTLYQEVMLENCGLLVSLGCPVPRPELIYHLEHGQEPWTRKEDLSQ

SEQ ID NO: 6639 - protein, 81 aa, Aotus trivirgatus
MAAAVLTDRAQVSVTFDDVAVTFTKEEWGQLDLGQRTLYQEVMLENCGLLVSLGDKGKPKTTEPTTCDPALSEGVSFQGQL

SEQ ID NO: 6640 - protein, 81 aa, Aotus trivirgatus
MKNSQGRVTFEDVTVTFTKGEWQQLNPEQRNLYRDVMLENYSNLVSVGREETTKPNVILRLEQGKEPWSEEEEVLRGGLAE

SEQ ID NO: 6641 - protein, 81 aa, Aotus trivirgatus
MAAQLLTDEVLESVTFRDVTVDFTQEEWQQLEPAQKDLYRDVMLENYRNLVSLDWETRPEMKELDPKNDILEDKPSVVGVA

SEQ ID NO: 6642 - protein, 81 aa, Aotus trivirgatus
SQEEGEVTGIKLLKAMSPGSVTFTDVAIDFSQDEWEWLNLAQRSLYKKVMLENYRNLVSVGLCISKPDVISLLEQEKDPWV

SEQ ID NO: 6643 - protein, 81 aa, Aotus trivirgatus
NQKLEAAGMGIEPKAVSQGLVTFGDVAIDFSQEEWEWLSPIQRNLYRKVMLENYRNLASLGLCVSKPDVISLLEQGKEPWT

SEQ ID NO: 6644 - protein, 81 aa, Aotus trivirgatus
LEYSLLGEHWDCDALFETQPGLVTMKNLAIDFPQQLHPALKNFCKNGLWENYSDLGSAGRCMAKPDLVSLLEQEKEPWMVK

SEQ ID NO: 6645 - protein, 81 aa, Aotus trivirgatus
LEYSLLGEHWDCDALFETQPGLVTMKNLAIDFPQQLHPALKNFCKNGLWENYSDLGSAGRCMAKPDLVSLLEQEKEPWMET

SEQ ID NO: 6646 - protein, 81 aa, Aotus trivirgatus
MNVEVLKVISQDLVTFKDVAIDFSQEEWQWMNPAQKRLYRSMMLENYQSLVSLGLCVSKPYVISLLEQGREPWEMTSEMTR

SEQ ID NO: 6647 - protein, 81 aa, Aotus trivirgatus
MSKDLVTFGDVAVNFSQEEWEWLNPAQRNLYRKVMLENYRTLVSLGVSVSKPDVISLLEQGKEPWMVKKEGTRGACPGWEH

SEQ ID NO: 6648 - protein, 81 aa, Aotus trivirgatus
EILPEVQSKEYDKSWQTLHQDTVFDIQQSFPTKEKEHKHEAQKKGYRKKSVEMKQRKVYMEKKLLKCNDCEKVFNQSSSLT

SEQ ID NO: 6649 - protein, 81 aa, Aotus trivirgatus
MSLGSELFRDVAIVFSQEEWQWLAPAQRDLYRDVMLETYSNLVSLGLAISKPDVISFLEQGREPWMVERVVAGGLCPVLES

SEQ ID NO: 6650 - protein, 81 aa, Aotus trivirgatus
MSLGSELFRDVAIVFSQEEWQWLAPAQRDLYRDVMLETYSNLVSLGLAISKPDVISFLEQGREPWMVERVVAGGLCPEAKD

SEQ ID NO: 6651 - protein, 81 aa, Aotus trivirgatus
MAAILLTARPKVPVSFEDVSVYFTKTEWKLLDLRQKVLYKRVMLENYSHLVSLGFSFSKPHLISQLERGEGPWVADIPRTW

SEQ ID NO: 6652 - protein, 81 aa, Aotus trivirgatus
MINFQESVTFQDVAVDFTPEEWQLLDCAERTLYWDVMLENYKNLISVGCPVTKTKVILKAEQGQEPWMVEGVNPHQSSPES

SEQ ID NO: 6653 - protein, 81 aa, Aotus trivirgatus
EESLENEVNPGLPTAESQELLTFKDISIDFTQEEWGQLTPAHQSLYREVMLENYSNLVSVGYQLSKPSVISQLEKGEEPWM

SEQ ID NO: 6654 - protein, 81 aa, Aotus trivirgatus
EEPWMTEKEGPGDPSSDLKSNTETTESTAKSTISQERLYHGIVMERFMRDDIIYSTLRKVSTYDDVLERYQETCVRDVRQA

SEQ ID NO: 6655 - protein, 81 aa, Aotus trivirgatus
EIIIKVEGEDTESLTIPSQEGVNFKIVTVDFTQEEQGTWNPAQRSLDRNILESHRDKVSWDLATAVGKEDSTSKQNIFDEE

SEQ ID NO: 6656 - protein, 81 aa, Aotus trivirgatus
ESMEEQDEKPPEPPKACAQEGVNFKIVTVDFTQEEQGTWNPAQRSLDRNILESHRDKVSWDLATAVGKEDSTSKQNIFDEE

SEQ ID NO: 6657 - protein, 81 aa, Aotus trivirgatus
MIKLQMVTFKDVAVVFTEEELGLLDSVQRKLYRDVMLENFRNLLLVAHQPFKPDLISQLEREEKLLMVDTETPRDGCSGRK

SEQ ID NO: 6658 - protein, 81 aa, Aotus trivirgatus
EKLLMVDTETPRDGCSGRKNQQKMETIQEVRVSYLSPRELSSCQTWQQSAGGLIRCQDFLNVFQGKNYQLQEQGESLCKVW

SEQ ID NO: 6659 - protein, 81 aa, Aotus trivirgatus
MIKFQEMVTFKDVAVVFTEEELGLLDSVQRKLYRDVMLENFRNLLLVAHQPFKPDLISQLEREEKLLMVDTETPRDGCSGR

SEQ ID NO: 6660 - protein, 81 aa, Aotus trivirgatus
MVTFKDVAVVFTEEELGLLDSVQRKLYRDVMLENFRNLLLVAHQPFKPDLISQLEREEKLLMVDTETPRDGCSGRKNQQKM

SEQ ID NO: 6661 - protein, 81 aa, Aotus trivirgatus
GLFLSLPSPRKRRKMIKFQEMVTFKDVAVVFTEEELGLLDSVQRKLYRDVMLENFRNLLLVAHQPFKPDLISQLEREEKLL

SEQ ID NO: 6662 - protein, 81 aa, Aotus trivirgatus
HQPFKPDLISQLEREEKLLMVDTETPRDGCSGRKNQQKMETIQEVRVSYLSPRELSSCQTWQQSAGGLIRCQDFLNVFQGK

SEQ ID NO: 6663 - protein, 81 aa, Aotus trivirgatus
REEKLLMVDTETPRDGCSGRKNQQKMETIQEVRVSYLSPRELSSCQTWQQSAGGLIRCQDFLNVFQGKNYQLQEQGESLCK

SEQ ID NO: 6664 - protein, 81 aa, Aotus trivirgatus
SQDYDFPQKEQEKMTKFQEAVTFKDVAVVFSSEELRLLDLTQRKLYRDVMVENFKNLVAVGHLPFQPDMVSQLEAEEKLWM

SEQ ID NO: 6665 - protein, 81 aa, Aotus trivirgatus
MLSQDYDFPQKEQEKMTKFQEAVTFKDVAVVFSSEELRLLDLTQRKLYRDVMVENFKNLVAVGSKHQNKMETLQKFALKYL

SEQ ID NO: 6666 - protein, 81 aa, Aotus trivirgatus
SQDYDFPQKEQEKMTKFQEAVTFKDVAVVFSSEELRLLDLTQRKLYRDVMVENFKNLVAVGSKHQNKMETLQKFALKYLSN

SEQ ID NO: 6667 - protein, 81 aa, Aotus trivirgatus
MLSQDYDFPQKEQEKMTKFQEAVTFKDVAVVFSSEELRLLDLTQRKLYRDVMVENFKNLVAVGHLPFQPDMVSQLEAEEKL

SEQ ID NO: 6668 - protein, 81 aa, Aotus trivirgatus
LSQDYDFPQKEQEKMTKFQEAVTFKDVAVVFSSEELRLLDLTQRKLYRDVMVENFKNLVAVGHLPFQPDMVSQLEAEEKLW

SEQ ID NO: 6669 - protein, 81 aa, Aotus trivirgatus
MNMFKEAVTFKDVAVAFTEEELGLLGPAQRKLYRDVMVENFRNLLSVGHQPFKGDVSPIERKEQLCIMKTATQRQRNLGKN

SEQ ID NO: 6670 - protein, 81 aa, Aotus trivirgatus
TFKDVAVAFTEEELGLLGPAQRKLYRDVMVENFRNLLSVGHQPFKGDVSPIERKEQLCIMKTATQRQRNLGKNQTVVSSYG

SEQ ID NO: 6671 - protein, 81 aa, Aotus trivirgatus
MNMFKEAVTFKDVAVAFTEEELGLLGPAQRKLYRDVMVENFRNLLSVGHQPFKGDVSPIERKEQLCIMKTATQRQRNLGEN

SEQ ID NO: 6672 - protein, 81 aa, Aotus trivirgatus
RKEQLCIMKTATQRQRNLGENNQSKLMTVQDRESEEELSCWQIWQQIASDLTRCQDFMINNSQFHKQGDFPCQVGAGLSIQ

SEQ ID NO: 6673 - protein, 81 aa, Aotus trivirgatus
MVENFRNLLSVGHQPFKGDVSPIERKEQLCIMKTATQRQRNLGENNQSKLMTVQDRESEEELSCWQIWQQIASDLTRCQDF

SEQ ID NO: 6674 - protein, 81 aa, Aotus trivirgatus
IERKEQLCIMKTATQRQRNLGENNQSKLMTVQDRESEEELSCWQIWQQIASDLTRCQDFMINNSQFHKQGDFPCQVGAGLS

SEQ ID NO: 6675 - protein, 81 aa, Aotus trivirgatus
VGHQPFKGDVSPIERKEQLCIMKTATQRQRNLGENNQSKLMTVQDRESEEELSCWQIWQQIASDLTRCQDFMINNSQFHKQ

SEQ ID NO: 6676 - protein, 81 aa, Aotus trivirgatus
MNMFKEAVTFKDVAVAFTEEELGLLGPAQRKLYRDVMVENFRNLLSVGHQPFKGDVSPIERKEQLCIMKTATQRQRNLDTL

SEQ ID NO: 6677 - protein, 81 aa, Aotus trivirgatus
AVAFTEEELGLLGPAQRKLYRDVMVENFRNLLSVGHQPFKGDVSPIERKEQLCIMKTATQRQRNLDTLLVKAVLFYDLAQT

SEQ ID NO: 6678 - protein, 81 aa, Aotus trivirgatus
MVENFRNLLSVGHQPFKGDVSPIERKEQLCIMKTATQRQRNLGKNQTVVEFLWLTVHLLCFPPALLPSPGPNCQISFLDYC

SEQ ID NO: 6679 - protein, 81 aa, Aotus trivirgatus
EAVTFKDVAVAFTEEELGLLGPAQRKLYRDVMVENFRNLLSVGHQPFKGDVSPIERKEQLCIMKTATQRQRNLGKNQTVVS

SEQ ID NO: 6680 - protein, 81 aa, Aotus trivirgatus
MVENFRNLLSVGHQPFKGDVSPIERKEQLCIMKTATQRQRNLGKNQTVVSSYGLSIALLPSSLVAIMAQTAKSLPGLLQHP

SEQ ID NO: 6681 - protein, 81 aa, Aotus trivirgatus
MTTFKEGLTFKDVAVVFTEEELGLLDPLQRNLYRDVMLENFRNLLSVADKIQSEMEAGPHEELSWGQIWKQIASDLVKYED

SEQ ID NO: 6682 - protein, 81 aa, Aotus trivirgatus
MTTLKEALTFKDVAVVFTEEELGLLDPAQRKLYRDVMLENFRNLLSVGHQPLHGDTFHFPREEKFWMVKTATRRKGNLGGK

SEQ ID NO: 6683 - protein, 81 aa, Aotus trivirgatus
MTTLKEALTFKDVAVVFTEEELGLLDPAQRKLYRDVMLENFRNLLSVGHQPLHGDTFHFPREEKFWMVKTATRRKGNLGPA

SEQ ID NO: 6684 - protein, 81 aa, Aotus trivirgatus
KDVAVVFTEEELGLLDPAQRKLYRDVMLENFRNLLSVGHQPLHGDTFHFPREEKFWMVKTATRRKGNLGPAFQILIKTEGF

SEQ ID NO: 6685 - protein, 81 aa, Aotus trivirgatus
RNLLSVGHQPLHGDTFHFPREEKFWMVKTATRRKGNLGGKIQTEMETVPEQGTHEGLFSHQTWEQISGDLTRFQDSMVNSS

SEQ ID NO: 6686 - protein, 81 aa, Aotus trivirgatus
RTMFKEAVTFKDVAVVFTEEELGLLGPAQRKLYRDVMLENFRNLLSVGHQPFHRDTFHLQTEEKFWMMETATQREGNSGGK

SEQ ID NO: 6687 - protein, 81 aa, Aotus trivirgatus
QTEEKFWMMETATQREGNSGGKIQTELESVPETGPHEEWSCQQIWEQIASNLTRPQDSMISSSQFYTQGDVPSQVDAGLSI

SEQ ID NO: 6688 - protein, 81 aa, Aotus trivirgatus
MTSFQEAMTFKDVTVVFTEEELGLLDLAQRLYRDVMLENFRNLLSVGHQLFHQDVFHFLREEKFWVMETATQREGNSDTCG

SEQ ID NO: 6689 - protein, 81 aa, Aotus trivirgatus
IIQRTVLVFYNIMEEAMTFKDVTVVFTEEELGLLDLAQRLYRDVMLENFRNLLSVGHQLFHQDVFHFLREEKFWVMETATQ

SEQ ID NO: 6690 - protein, 81 aa, Aotus trivirgatus
NIMEEAMTFKDVTVVFTEEELGLLDLAQRLYRDVMLENFRNLLSVGHQLFHQDVFHFLREEKFWVMETATQREGNSDTCGK

SEQ ID NO: 6691 - protein, 81 aa, Aotus trivirgatus
EAMTFKDVTVVFTEEELGLLDLAQRLYRDVMLENFRNLLSVGHQLFHQDVFHFLREEKFWVMETATQREGNSGENASVHPY

SEQ ID NO: 6692 - protein, 81 aa, Aotus trivirgatus
AMTFKDVTVVFTEEELGLLDLAQRLYRDVMLENFRNLLSVGHQLFHQDVFHFLREEKFWVMETATQREGNSGENASVHPYT

SEQ ID NO: 6693 - protein, 81 aa, Aotus trivirgatus
HSELCKFTEVEGKMTTIKEAVTFKDVAVVFTEEELELLDPAQRKLYRDIMLENFRNLLSIGNQPFHQDTFHFLRKKKFWMM

SEQ ID NO: 6694 - protein, 81 aa, Aotus trivirgatus
HFLRKKKFWMMKTTSQREGNLGGKIQIETVPEAGPHEEWSCQQIWEQIVSDLTRSQDPIINSSQFFKEGDVPCQIEADLSI

SEQ ID NO: 6695 - protein, 81 aa, Aotus trivirgatus
DPAQRKLYRDIMLENFRNLLSIGNQPFHQDTFHFLRKKKFWMMKTTSQREGNLGGKIQIETVPEAGPHEEWSCQQIWEQIV

SEQ ID NO: 6696 - protein, 81 aa, Aotus trivirgatus
MTKSEEAVTFKDVAVVFSDEELRLLDLTQRKLYRDVMLENFRNVVSVGHQSIPGGLPQSEREEKLWMMKTATQRDNSSGGK

SEQ ID NO: 6697 - protein, 81 aa, Aotus trivirgatus
ATGENPYKYEECGRNVGKSSHCQSPLIVHTGEKPYKCEDCGVSFSQRSYLQVHLKVHTGKKPYKCEECEKSFSWRSRLQAH

SEQ ID NO: 6698 - protein, 81 aa, Aotus trivirgatus
MLENFRNVVSVGHQSIPGGLPQSEREEKLWMMKTATQRDNSSGGKHLKEMETLQEVGLRYLPHEELFCSQIWQQITRELTK

SEQ ID NO: 6699 - protein, 81 aa, Aotus trivirgatus
EESYGALINSCNSRTMTDGLVTFRDVAIDFSQEEWECLDPAQRDLYVDVMLENYSNLVSLDLESTTYDTKKIFSEKDIFEI

SEQ ID NO: 6700 - protein, 81 aa, Aotus trivirgatus
KSCSGFSGFCASPIEESYGALINSCNSRTMTDGLVTFRDVAIDFSQEEWECLDPAQRDLYVDVMLENYSNLVSLGKVICLK

SEQ ID NO: 6701 - protein, 81 aa, Aotus trivirgatus
MDSVGFEDVAVNFTQEEWALLSPSRKQLYRDVMLETCRNLASVGIQWKDQDIENLYQHLGIKLRSLVERLCGRKEGSDHRE

SEQ ID NO: 6702 - protein, 81 aa, Aotus trivirgatus
MNSVSFEDVAVNFTLEEWALLDSSQKKLYKDVMQETFKNLVCLGKRWEDQDVEDDHRNLGRNRRGHMVERLCESRKGSKCR

SEQ ID NO: 6703 - protein, 81 aa, Aotus trivirgatus
MELLTFRDVTIEFSLEEWEYLKPAQQNLYRNVMLENYRNLVSLGLTVSKPELISCLEQRQEPWSVKRHETVAKPPAMSCHY

SEQ ID NO: 6704 - protein, 81 aa, Aotus trivirgatus
MELLTFRDVTIEFSLEEWEYLKPAQQNLYRNVMLENYRNLVSLGLTVSKPELISCLEQRQEPWSVKRHETVAKPPDVLSLH

SEQ ID NO: 6705 - protein, 81 aa, Aotus trivirgatus
MLENYRNLVSLGLTVSKPELISCLEQRQEPWSVKRHETVAKPPAMSCHYTEDFLPEQGMKDSFQKVILRRYGSCGLENLHL

SEQ ID NO: 6706 - protein, 81 aa, Aotus trivirgatus
MFCFIFQELLTFRDVTIEFSLEEWEYLKPAQQNLYRNVMLENYRNLVSLGLTVSKPELISCLEQRQEPWSVKRHETVAKPP

SEQ ID NO: 6707 - protein, 81 aa, Aotus trivirgatus
SGCPGPERNFLVYSFFEKETLTFRDVAIEFSLEEWQCLNPAQQNLYRNVMLENYRNLVFLDIAVSKQNPITCLEQKKEPCN

SEQ ID NO: 6708 - protein, 81 aa, Aotus trivirgatus
GPLTFMDVAIEFCLEEWQCLDTAQQNLYRNVMLENYRNLVFLGIAVSKPDLITCLEQEKEPWNMKRHEMVAKSSGEAFSRS

SEQ ID NO: 6709 - protein, 81 aa, Aotus trivirgatus
MDVAIEFCLEEWQCLDTAQQNLYRNVMLENYRNLVFLGIAVSKPDLITCLEQEKEPWNMKRHEMVAKSSGEAFSRSSNLTK

SEQ ID NO: 6710 - protein, 81 aa, Aotus trivirgatus
MGPLTFMDVAIEFCLEEWQCLDTAQQNLYRNVMLENYRNLVFLGIAVSKPDLITCLEQEKEPWNMKRHEMVAKSSECGEAF

SEQ ID NO: 6711 - protein, 81 aa, Aotus trivirgatus
MGPLTFRDVTVEFSLEEWQFLDAAQQNLYKDVMLENYRNLVFLNIVVSKPDMICLEQGIEPWNIKRHEMVAKAPGSHSVNQ

SEQ ID NO: 6712 - protein, 81 aa, Aotus trivirgatus
ALFPEATAFEDITKDWNYLEASQKDYYRDTMLDSYENMVPQGSFLQFSMMPQRAGNDPPGASNASEMEMEISNMREKFLLS

SEQ ID NO: 6713 - protein, 81 aa, Aotus trivirgatus
LQGKYGNVTKEVIALYLTLCKQCHQKNPVPKKGPAPKPMTFKDIDSTCQVEILDMQSSADGEFKFILYYQDHLTKFIILRP

SEQ ID NO: 6714 - protein, 81 aa, Aotus trivirgatus
VLLKLLLSPGLQQPALFPEATAFEDITKDWNYLEASQKDYYRDTMLDSYENMVPQGSFLQFSMMPQRAGNDPPGASNASEM

SEQ ID NO: 6715 - protein, 81 aa, Aotus trivirgatus
QGKYGNVTKEVIALYLTLCKQCHQKNPVPKKGPAPKPMTFKDIDSTCQVEILDMQSSADGEFKFILYYQDHLTKFIILRPL

SEQ ID NO: 6716 - protein, 81 aa, Aotus trivirgatus
KGHTEGGGLVNELLTSWLQGLVTFEDVAVEFTQEEWALLDPAQRTLYRNVMLENFWNLSSSLDVETPLKASGLASKLHVFR

SEQ ID NO: 6717 - protein, 81 aa, Aotus trivirgatus
MTFDDVAVEFTQWEWGQLNPAQKDLYREVMLENFRNLTLLGLLVSKPYMICQLEEGGEPFMVNTEISVGAHSDWERRSKSK

SEQ ID NO: 6718 - protein, 81 aa, Aotus trivirgatus
MLENYKSVVSLGLPVPQPDMIFQLKRGDEPWMVDLHGSEEREWPESGSLDWETKPEIYDASEEKAERSLRESLGRQSPLCP

SEQ ID NO: 6719 - protein, 81 aa, Aotus trivirgatus
MAAVSPTTRCQESVTFEDVAVVFTDEEWSHLIPIQRDLYKEVMLENYKSVVSLDWETKPEIYDASEEKAERSLRESLGRQS

SEQ ID NO: 6720 - protein, 81 aa, Aotus trivirgatus
MAAVSPTTRCQESVTFEDVAVVFTDEEWSHLIPIQRDLYKEVMLENYKSVVSLGLPVPQPDMIFQLKRGDEPWMVDLHGSE

SEQ ID NO: 6721 - protein, 81 aa, Aotus trivirgatus
MEPRESGKAPVTFDDITVYLLQEEWVLLSKQQKELCGSDKLVPPLGPTVANPELFCKFGRGPEPWLGSMQGQRSLLEHQPG

SEQ ID NO: 6722 - protein, 81 aa, Aotus trivirgatus
QDPSAEQLSEEVPVVFEELPVVFEDVAVYFTREEWGMLDKRQKELYRDVMRMNYELLASLGPAAAKPDLISKLERRAAPWI

SEQ ID NO: 6723 - protein, 81 aa, Aotus trivirgatus
MARKVSITFKDLAVRFSEEEWRLLEEGQREFYRDVMRENYETLVSVGTAELLPLSAFLSPSEPGGAAGGGSRADEGQEPAG

SEQ ID NO: 6724 - protein, 81 aa, Aotus trivirgatus
MRENYETLVSVGTAELLPLSAFLSPSEPGGAAGGGSRADEGQEPAGCGGPQGGQPRHSLHLTALVQLVKEIPEFLFGEVKG

SEQ ID NO: 6725 - protein, 81 aa, Aotus trivirgatus
KKLANCEKTAVEFGNQLEGKWAVLGTLLQEYGLLRRRLENVENLLRNRNFWILRLPPGSKGEAPKVPVTFDDVAVYFSELE

SEQ ID NO: 6726 - protein, 81 aa, Aotus trivirgatus
KKLADYEKMAVEFGNQLEGKWAVLGTLLQEYGLLQRRLENVENLLRNRNFWILRLPPGSKGEAPKVSRSLENDGVCFTEQE

SEQ ID NO: 6727 - protein, 81 aa, Aotus trivirgatus
RNFWILRLPPGSKGEAPKVSRSLENDGVCFTEQEWENLEDWQKELYRNVMESNYETLVSLKVLGQPEGEAELGTEMLGDLE

SEQ ID NO: 6728 - protein, 81 aa, Aotus trivirgatus
PGGAHPAGGVMIKQELQYTQEGSADLPGEFSCIAEEQAFLSPEQTELWGGQGGSVLLETSPGASTLEEPVGSRDPSSGRTV

SEQ ID NO: 6729 - protein, 81 aa, Aotus trivirgatus
NFWILRLPPGSKGEAPKVSRSLENDGVCFTEQEWENLEDWQKELYRNVMESNYETLVSLSSSDSPGSASIVGVTEVLGQPE

SEQ ID NO: 6730 - protein, 81 aa, Aotus trivirgatus
LEEEGPGGAHPAGGVMIKQELQYTQEGSADLPGEFSCIAEEQAFLSPEQTELWGGQGGSVLLETSPGASTLEEPVGSRDPS

SEQ ID NO: 6731 - protein, 81 aa, Aotus trivirgatus
ALCVRGQRSLEERAIPTESITDSPISAQDLLSRIKQEEHQCVWDQQDLADRDIPTDPNSESLISAHDILSWIKQEEQPYPW

SEQ ID NO: 6732 - protein, 81 aa, Aotus trivirgatus
MAEPASVTVTFDDVALYFSEQEWEILEKWQKQMYKQEMKTNYETLDSLGYAFSKPDLITWMEQGRMLLISDQGCLHKTKRT

SEQ ID NO: 6733 - protein, 81 aa, Aotus trivirgatus
QGCLHKTKRTTGPPTDEQLDMKNTEKLPCFDDRGTLGTKEEDCHLNGPQKQDLCAALPGRERKILSAQRASFQSPSLQETE

SEQ ID NO: 6734 - protein, 81 aa, Aotus trivirgatus
GRGCRLCRNSGPCRGWSGVTVTFDDVALYFSEQEWEILEKWQKQMYKQEMKTNYETLDSLGYAFSKPDLITWMEQGRMLLI

SEQ ID NO: 6735 - protein, 81 aa, Aotus trivirgatus
SLGYAFSKPDLITWMEQGRMLLISDQGCLHKTKRTTGPPTDEQLDMKNTEKLPCFDDRGTLGTKEEDCHLNGPQKQDLCAA

SEQ ID NO: 6736 - protein, 81 aa, Aotus trivirgatus
MTEPPRLPLTFEDVAIYFSEQEWQDLQAWQKELYKRVMRSNYETLISLDDGLPKPELISWIEQGEEPFRNWRESQKSGNII

SEQ ID NO: 6737 - protein, 81 aa, Aotus trivirgatus
MAPRAQIQELLTFGDVAVAFTRIEWRHLDAAQRALYRDVMLENYGNLVSVGLLSSKPKLITQLEQGAEPWMEVREVPSGTC

SEQ ID NO: 6738 - protein, 81 aa, Aotus trivirgatus
RDVMLENYGNLVSVGLLSSKPKLITQLEQGAEPWMEVREVPSGTCAVPDYWFETKMSALKQSTSEGSVLGERMKSVMMEKG

SEQ ID NO: 6739 - protein, 81 aa, Aotus trivirgatus
LKTKTQAMAALFLSAPPQAEVTFEDVAVLLSREEWGRLGPAQRGLYRDVMLETYGNLVSLGVGPAGPKPGVISQLERGDEP

SEQ ID NO: 6740 - protein, 81 aa, Aotus trivirgatus
MAALFLSAPPQAEVTFEDVAVLLSREEWGRLGPAQRGLYRDVMLETYGNLVSLGVGPAGPKPGVISQLERGDEPWVLDVQG

SEQ ID NO: 6741 - protein, 81 aa, Aotus trivirgatus
MAALFLSAPPQAEVTFEDVAVLLSREEWGRLGPAQRGLYRDVMLETYGNLVSLALGTSTEYKELTSRETFDEEELGRLRGI

SEQ ID NO: 6742 - protein, 81 aa, Aotus trivirgatus
ALKTKTQAMAALFLSAPPQAEVTFEDVAVLLSREEWGRLGPAQRGLYRDVMLETYGNLVSLALGTSTEYKELTSRETFDEE

SEQ ID NO: 6743 - protein, 81 aa, Aotus trivirgatus
IVMALPMPGPQEAVVFEDVAVYFTRIEWSCLAPEQQVLYRDVMLENYRNLASLGFLVAKPALISLLEQGEEPGALILQVAE

SEQ ID NO: 6744 - protein, 81 aa, Aotus trivirgatus
IVMALPMPGPQEAVVFEDVAVYFTRIEWSCLAPEQQVLYRDVMLENYRNLASLALISLLEQGEEPGALILQVAEQRGAKTS

SEQ ID NO: 6745 - protein, 81 aa, Aotus trivirgatus
ENYRNLASLALISLLEQGEEPGALILQVAEQRGAKTSLCRDSRMEAGIMESPLQRKLSRQAGPSGTVWGCLPEEDPAPSHP

SEQ ID NO: 6746 - protein, 81 aa, Aotus trivirgatus
PALISLLEQGEEPGALILQVAEQRGAKTSLCRENHATLPCRGQEESPASSECGPREKGVARGRAGGAAFSWPHWEHLVTPN

SEQ ID NO: 6747 - protein, 81 aa, Aotus trivirgatus
MEVVTFGDVAVHFSREEWQCLDPGQRALYREVMLENHSSVAGLAGFLVFKPELISRLEQGQEPWVLDLQGAEGTEAPKTSK

SEQ ID NO: 6748 - protein, 81 aa, Aotus trivirgatus
MGFLGCWCVSFQEVVTFGDVAVHFSREEWQCLDPGQRALYREVMLENHSSVAGLAGFLVFKPELISRLEQGQEPWVLDLQG

SEQ ID NO: 6749 - protein, 81 aa, Aotus trivirgatus
MEVVTFGDVAVHFSREEWQCLDPGQRALYREVMLENHSSVAGLGFLVFKPELISRLEQGQEPWVLDLQGAEGTEAPKTSKT

SEQ ID NO: 6750 - protein, 81 aa, Aotus trivirgatus
MEVVTFGDVAVHFSREEWQCLDPGQRALYREVMLENHSSVAGLAFSRTLRFGYLCPCFPRDGSLWAWPSRGAAASGFLVFK

SEQ ID NO: 6751 - protein, 81 aa, Aotus trivirgatus
MYSVSFEDVAVTFTQEEWALLDLSQKSLYRDVMQEIFRNLAFVEKPYECKECGKAFSRSTYLGIHERTHTGEKPYECIKCG

SEQ ID NO: 6752 - protein, 81 aa, Aotus trivirgatus
QEENVRDTQQVVTTLQLPPNRVSPFKDMILCFSEEDWSLLDPAQTGFYGEFIIGEDCGVSMPPNDLAAQPDLSQGEENEPH

SEQ ID NO: 6753 - protein, 81 aa, Aotus trivirgatus
LGSGGKKAQVISVLSQIDGNRVSPFKDMILCFSEEDWSLLDPAQTGFYGEFIIGEDCGVSMPPNDLAAQPDLSQGEENEPH

SEQ ID NO: 6754 - protein, 81 aa, Aotus trivirgatus
MPSQDSMTLEDIVVDFTREEWALLDTSQRKLFRDVMLENISHLVSIGNQFCKSVVFSHLEQVEKVSTQGISLLQGKEGDIK

SEQ ID NO: 6755 - protein, 81 aa, Aotus trivirgatus
TQGISLLQGKEGDIKHQEMPFIQHIYQKDISTISTMRSHTQDDPFLCNDLGEDFTQHIPLTQNMITYMSKKHFVGKMFGKT

SEQ ID NO: 6756 - protein, 81 aa, Aotus trivirgatus
SVVFSHLEQVEKVSTQGISLLQGKEGDIKHQEMPFIQHIYQKDISTISTMRSHTQDDPFLCNDLGEDFTQHIPLTQNMITY

SEQ ID NO: 6757 - protein, 81 aa, Aotus trivirgatus
GSQGNLPQADITLMNQAQESVTFEDVAVNFTDREWQCLTYAQRHLYKDVMLENYGNMVSLGFPVPKPPLISHLERGVEPCV

SEQ ID NO: 6758 - protein, 81 aa, Aotus trivirgatus
GGYCRGDAVVASRVTPESQGLLKVEDVALTLPPEWTQQDSSQVNLCRDEKQENHGSLVFLGGEIQTKSRDLLPAKELPEKE

SEQ ID NO: 6759 - protein, 81 aa, Aotus trivirgatus
HGDKAAMPVFNPVRSQTLVKTEEETAQALATEKWPHLSLAQRNLCGNSAQETVRSLSLMTEEIVTKDRLFNAKQETSEEIE

SEQ ID NO: 6760 - protein, 81 aa, Aotus trivirgatus
GGHCREDAMVASRLTPGSQELLKMEDVALTLSPGWTQLDSSQVNLYRDEKQENHSSLVSLGGEIQTKSSDLPPAEELPEKK

SEQ ID NO: 6761 - protein, 81 aa, Aotus trivirgatus
GNSGNQEMTATLLTAGFQTLEKIEDMAVSLIREEWLLDPSQKNLSRDNRPENFRNMFSLGGETRSENRELASKQVIPTGIQ

SEQ ID NO: 6762 - protein, 81 aa, Aotus trivirgatus
MAQGLVTFADVAIDFSQEEWACLNSAQRDLYWDVMLENYSNVVSLDLESAYETKNLPTEKSLHEICVSRRNSDRRSKSLGH

SEQ ID NO: 6763 - protein, 81 aa, Aotus trivirgatus
SSPWSLALATEGRGSSCEISVSFEDVTVDFSKEEWQHLDPAQRRLYWDVTLENYSHLLSVGYQVPKSEATFKLEQGEGPWT

SEQ ID NO: 6764 - protein, 81 aa, Aotus trivirgatus
AAHVSADHAALNRIVSLQISVSFEDVTVDFSKEEWQHLDPAQRRLYWDVTLENYSHLLSVGYQVPKSEATFKLEQGEGPWT

SEQ ID NO: 6765 - protein, 81 aa, Aotus trivirgatus
QSYSGESIGKIQQQGIPGEIFFHCERFGLLERFDQPIGEASLCSILEELWQDNDQLEQCQENQNNLLSHVKVLIKERGYER

SEQ ID NO: 6766 - protein, 81 aa, Aotus trivirgatus
SPQGFPALIPGEPGRSFEGSVSFEDVAVDFTRQEWHRLDPAQRTMHKDVMLETYSNLASVGLCVAKPDMIFKLERGEELWI

SEQ ID NO: 6767 - protein, 81 aa, Aotus trivirgatus
MAAGERRSLLFFQKPVTFEDVAVNFTQEEWDCLDASQRVLYQDVMSETFKNLASVARMFVHKPELITKLEQQEKQWRMFLH

SEQ ID NO: 6768 - protein, 81 aa, Aotus trivirgatus
EQLKPIKPRDCWGKAWVKKKPVTFEDVAVNFTQEEWDCLDASQRVLYQDVMSETFKNLASVARMFVHKPELITKLEQQEKQ

SEQ ID NO: 6769 - protein, 81 aa, Aotus trivirgatus
MKRDCWGKAWVKKKPVTFEDVAVNFTQEEWDCLDASQRVLYQDVMSETFKNLASVARMFVHKPELITKLEQQEKQWRMFLH

SEQ ID NO: 6770 - protein, 81 aa, Aotus trivirgatus
MLVAAAAERNKEPILHVLRQYLDPAQRGVRVLEVASGSGQHAAHFARAFPLAEWQPSDVDQRCLDRNPEWGLRDTALLEDL

SEQ ID NO: 6771 - protein, 81 aa, Aotus trivirgatus
VLRQYLDPAQRGVRVLEVASGSGQHAAHFARAFPLAEWQPSDVDQRCLDRNPEWGLRDTALLEDLGQASGLFLERMVDMPA

SEQ ID NO: 6772 - protein, 81 aa, Aotus trivirgatus
GVRVLEVASGSGQHAAHFARAFPLAEWQPSDVDQRCLDRNPEWGLRDTALLEDLGQASGLFLERMVDMPANNKCLIFRKNE

SEQ ID NO: 6773 - protein, 81 aa, Aotus trivirgatus
MLVAAAAERNKEPILHVLRQYLDPAQRGVRVLEVASGSGQHAAHFARAFPLAEWQPSDVDQRCLDRGSSEQQDTCSNPRAC

SEQ ID NO: 6774 - protein, 81 aa, Aotus trivirgatus
LRQYLDPAQRGVRVLEVASGSGQHAAHFARAFPLAEWQPSDVDQRCLDRGSSEQQDTCSNPRACSSPMGEGVPISFSRPQP

SEQ ID NO: 6775 - protein, 81 aa, Aotus trivirgatus
SDVDQRCLDRGSSEQQDTCSNPRACSSPMGEGVPISFSRPQPLSVSRAHWEMAHLGPVGCVPIPTALCRQWEDLSPEQRGL

SEQ ID NO: 6776 - protein, 81 aa, Aotus trivirgatus
SQEESPEGDTGRTEQKPMVKDAFKDISIYFSKEEWAEMGDWEKTRYRNVKRNYNALITIGLRATRPAFMCHRRQTIKLQVD

SEQ ID NO: 6777 - protein, 81 aa, Aotus trivirgatus
MIQSQISFEDVAVDFTLEEWQLLSPTQKSLYRDVMLENYSNLVFLGYQIIKPDAISKWEQQDPWILDQEILSQNFSEVWLD

SEQ ID NO: 6778 - protein, 81 aa, Aotus trivirgatus
MIQSQISFEDVAVDFTLEEWQLLSPTQKSLYRDVMLENYSNLVFLEVWLDNPKMWLQDNQDNLKSMERGHKYGVFGKIFKS

SEQ ID NO: 6779 - protein, 81 aa, Aotus trivirgatus
MATSFRIASWWGLLSFKDISMEFTWDEWQLLDSTQKYLYREVTLENYHNLISVGYHGAKPDLIFKLEQGEDPWIINAKISR

SEQ ID NO: 6780 - protein, 80 aa, Aotus trivirgatus
MATSFRIASWWGLLSFKDISMEFTWDEWQLLDSTQKYLYREVTLENYHNLISVDGWEEWYQKNQDELESLERSYSCSVLG

SEQ ID NO: 6781 - protein, 81 aa, Aotus trivirgatus
KFRNLAGVPWPQGNSALPGLLSFKDISMEFTWDEWQLLDSTQKYLYREVTLENYHNLISVGYHGAKPDLIFKLEQGEDPWI

SEQ ID NO: 6782 - protein, 81 aa, Aotus trivirgatus
REVTLENYHNLISVGYHGAKPDLIFKLEQGEDPWIINAKISRESCPDGWEEWYQKNQDELESLERSYSCSVLGRLNLSKTH

SEQ ID NO: 6783 - protein, 81 aa, Aotus trivirgatus
MTMLQESFSFDDLSVDFTQKEWQLLDPSQKNLYKDVMLENYSSLVSLGYEAMKPDVIFKLEQGEEPWIGDEEIPSSYSPEV

SEQ ID NO: 6784 - protein, 81 aa, Aotus trivirgatus
MTMLQESFSFDDLSVDFTQKEWQLLDPSQKNLYKDVMLENYSSLVSLGYEAMKPDVIFKLEQGEEPWIGDEEIPSSYSPVW

SEQ ID NO: 6785 - protein, 81 aa, Aotus trivirgatus
MTMLQESFSFDDLSVDFTQKEWQLLDPSQKNLYKDVMLENYSSLVSLGYEAMKPDVIFKLEQGEEPWIGDEEIPSSYSPGT

SEQ ID NO: 6786 - protein, 81 aa, Aotus trivirgatus
MTMLQESFSFDDLSVDFTQKEWQLLDPSQKNLYKDVMLENYSSLVSLGYEAMKPDVIFKLEQGEEPWIGDEEIPSSYSPVS

SEQ ID NO: 6787 - protein, 81 aa, Aotus trivirgatus
MSQGSVTFRDVAIDFSQEEWKWLQPAQRDLYRCVMLENYGHLVSLGLSISKPDVVSLLEQGKEPWLGKRDVKTDLFSVSES

SEQ ID NO: 6788 - protein, 81 aa, Aotus trivirgatus
MLENYGHLVSLGLSISKPDVVSLLEQGKEPWLGKRDVKTDLFSVSESTGEIKDFSSKNVIYDDSSQYLIMERILSQGPIYS

SEQ ID NO: 6789 - protein, 81 aa, Aotus trivirgatus
MSQGSVTFRDVAIDFSQEEWKWLQPAQRDLYRCVMLENYGHLVSLAGLSISKPDVVSLLEQGKEPWLGKRDVKTDLFSVRV

SEQ ID NO: 6790 - protein, 81 aa, Aotus trivirgatus
MSQGSVTFRDVAIDFSQEEWKWLQPAQRDLYRCVMLENYGHLVSLGLSISKPDVVSLLEQGKEPWLGKRDVKTDLFSVLKE

SEQ ID NO: 6791 - protein, 81 aa, Aotus trivirgatus
IREFGGMGAGIANISFQGSVTFRDVAIDFSQEEWKWLQPAQRDLYRCVMLENYGHLVSLGLSISKPDVVSLLEQGKEPWLG

SEQ ID NO: 6792 - protein, 81 aa, Aotus trivirgatus
RNAEEERMIAVFLTTWLQEPMTFKDVAVEFTQEEWIMLDSAQRSLYKDVMLENYRNLTSVEYQLCRHTVISPLHQEEIRNM

SEQ ID NO: 6793 - protein, 81 aa, Aotus trivirgatus
NMKKRNPQGICPDQKIQPKTKESTMQNILGEEPFNAVKIKFTMDNWSSTLREDWESSHKIRKQYKIRKQHKIPGGHWRQVT

SEQ ID NO: 6794 - protein, 81 aa, Aotus trivirgatus
MDAESLTAWSQTLVTFKDIFVDFTREEWKLLDTAQQIVYRNVMLENYKNLVSLGYQLTKPDVILRLEKGEEPWVVERGIHQ

SEQ ID NO: 6795 - protein, 81 aa, Aotus trivirgatus
ILECLFISQEQPQITKSWGPLSFMDVFVDFTWEEWQLLDPAQKCLYRSVMLENYSNLVSLGYQHTKPDIIFKLEQGEELCM

SEQ ID NO: 6796 - protein, 81 aa, Aotus trivirgatus
KQKSHRTEKILECLFISQEQPQITKSWEWQLLDPAQKCLYRSVMLENYSNLVSLGYQHTKPDIIFKLEQGEELCMVQAPIP

SEQ ID NO: 6797 - protein, 81 aa, Aotus trivirgatus
MAARVRTASVWGPLSFMDVFVDFTWEEWQLLDPAQKCLYRSVMLENYSNLVSLGYQHTKPDIIFKLEQGEELCMVQAPIPN

SEQ ID NO: 6798 - protein, 81 aa, Aotus trivirgatus
SFMDVFVDFTWEEWQLLDPAQKCLYRSVMLENYSNLVSLGYQHTKPDIIFKLEQGEELCMVQAPIPNQCCPILEAGKSKAK

SEQ ID NO: 6799 - protein, 81 aa, Aotus trivirgatus
MAMSQESLTFKDVFVDFTLEEWQQLDSAQKNLYRDVMLENYSHLVSVGYLLAKPDMIFRLGPGDESWRADGGTPVRTCAGK

SEQ ID NO: 6800 - protein, 81 aa, Aotus trivirgatus
MAMSQESLTFKDVFVDFTLEEWQQLDSAQKNLYRDVMLENYSHLVSVGYLLAKPDMIFRLGPGDESWRADGGTPVRTCAGE

SEQ ID NO: 6801 - protein, 81 aa, Aotus trivirgatus
MAMSQESLTFKDVFVDFTLEEWQQLDSAQKNLYRDVMLENYSHLVSVGYLLAKPDMIFRLGPGDESWRADGGTPVRTCAEV

SEQ ID NO: 6802 - protein, 81 aa, Aotus trivirgatus
LAKPDMIFRLGPGDESWRADGGTPVRTCAGEDRPGESGRGKGTRLVGESLASGMRSGALLRARDLWTCLGSDERSCCHVHL

SEQ ID NO: 6803 - protein, 81 aa, Aotus trivirgatus
QKALYREVMRMNYETVLSLEFPFPKPDMITRLEGEEESQNSDEWQLQGGTSAENEESDVKPPDWPSPMNATSHFPQPQHFD

SEQ ID NO: 6804 - protein, 81 aa, Aotus trivirgatus
GHTEGGGLVNELLTSWLQGLVTFEDVAVEFTQEEWALLDPAQRTLYKDVMLENCRNLASLGCHVNKPRLISQLEQDKKVMT

SEQ ID NO: 6805 - protein, 81 aa, Aotus trivirgatus
DLFACSGLEPHTPSVGSQESVTFQDVAVDFTEKEWPLLDSSQRKLYKDVMLENYSNLTSLEMLASGWCHCTPAWVTRAKLH

SEQ ID NO: 6806 - protein, 81 aa, Aotus trivirgatus
KSTKDWKMASELILPASQSLLTFEDVAVYFSEEEWQLLDPPEKTLYNDVMQDIYETVISLGLKLKSDTGNDHPVSVSASEM

SEQ ID NO: 6807 - protein, 81 aa, Aotus trivirgatus
ALVLVEFLHREPDGTKNESLLTFEDVAVYFSEEEWQLLDPPEKTLYNDVMQDIYETVISLGLKLKSDTGNDHPVSVSASEM

SEQ ID NO: 6808 - protein, 81 aa, Aotus trivirgatus
MALTQVRLTFRDVAVEFSQEEWKCLEPTQRALYRDVMLENYWSLVSLGLCHFDMNIISMLEEGKEPWTVKSCMKIARKPRM

SEQ ID NO: 6809 - protein, 81 aa, Aotus trivirgatus
MLENYWSLVSLGLCHFDMNIISMLEEGKEPWTVKSCMKIARKPRMRQCVKDVVTDIPPKCTIKDLLPKEQSSTEAAFHTVM

SEQ ID NO: 6810 - protein, 81 aa, Aotus trivirgatus
KIARKPRMRQCVKDVVTDIPPKCTIKDLLPKEQSSTEAAFHTVMLERRGSPDIEDFSFKELQKNIHDFECQWGDDTENHKG

SEQ ID NO: 6811 - protein, 81 aa, Aotus trivirgatus
MALTQVRLTFRDVAVEFSQEEWKCLEPTQRALYRDVMLENYWSLVSLDIPPKCTIKDLLPKEQSSTEAAFHTVMLERRGSP

SEQ ID NO: 6812 - protein, 81 aa, Aotus trivirgatus
GHLTFRDVVIEFSLAEWKCLTPAQRALYREVMLENYRNLESVDSFLKSMLKFSAAGQGSTREGFHTGTLEKYTSHHIGDSC

SEQ ID NO: 6813 - protein, 81 aa, Aotus trivirgatus
MEEERTTAELQKNRIQDSVVFEDVAVDFTQEEWALLDLAQRNLYRDVMLENFQNLASLGYLLHTPHLISQWEQEEDLQTVK

SEQ ID NO: 6814 - protein, 81 aa, Aotus trivirgatus
MESQGAKTESFMAFGDVTVDFTPKEWRLLSPAQRALYREVTLENYSHLISLGILHSKPELIRRLEQGDAPWGEERRRQPGP

SEQ ID NO: 6815 - protein, 81 aa, Aotus trivirgatus
NAMIVMSVRREQDSSSGEGLLSFEDVAVDFTQEEWQFLDPSQKVLYKEVMSENYRNLVSVGYQGTKPDVLFKLERGESPWI

SEQ ID NO: 6816 - protein, 81 aa, Aotus trivirgatus
MALSQRLFTFKDVTIEFSQEEWECLDPAQRALYRDVMLENYRNLLLLDEDNIPPENNISAGFASKGLSPKENNKEEFYYLV

SEQ ID NO: 6817 - protein, 81 aa, Aotus trivirgatus
MIESQEPVTFEDVAVDFTREERQQLNPAQKTLHRDVMLETYSHLVSVGCSGIKPEVIFKVEHGKDPWIKDSELSRWIYPER

SEQ ID NO: 6818 - protein, 81 aa, Aotus trivirgatus
MIESQEPVTFEDVAVDFTREERQQLNPAQKTLHRDVMLETYSHLVSVGCSGIKPEVIFKVEHGKDPWIKDSELSRWIYPDR

SEQ ID NO: 6819 - protein, 81 aa, Aotus trivirgatus
MIESQEERQQLNPAQKTLHRDVMLETYSHLVSVGCSGIKPEVIFKVEHGKDPWIKDSELSRWIYPDREKGLKSSQRIISGE

SEQ ID NO: 6820 - protein, 81 aa, Aotus trivirgatus
MIESQEPVTFEDVAVDFTREERQQLNPAQKTLHRDVMLETYSHLVSVGCSGIKPEVIFKVEHGKDPWIKDSELSRWIYPGI

SEQ ID NO: 6821 - protein, 81 aa, Aotus trivirgatus
MAKGEEERQQLNPAQKTLHRDVMLETYSHLVSVGCSGIKPEVIFKVEHGKDPWIKDSELSRWIYPDREKGLKSSQRIISGE

SEQ ID NO: 6822 - protein, 81 aa, Aotus trivirgatus
MAKPQGLVTFEDVAVAFTQEEWQYLNPLQRTLYRDVMLETYSNLVFVGQQVTKPDLILKLEVEECPVEGKLPFWSFPEVCQ

SEQ ID NO: 6823 - protein, 81 aa, Aotus trivirgatus
SGEASGSFSSWKAKREQGLVTFEDVAVAFTQEEWQYLNPLQRTLYRDVMLETYSNLVFVGQQVTKPDLILKLEVEECPVEG

SEQ ID NO: 6824 - protein, 81 aa, Aotus trivirgatus
MLQTAWRQERVTFEDVAVYFTQNEWTSLDPVQRALYREVMLENYANVASLAFPFTTPVLVSQLEQGERPWGLDPWEPVGRE

SEQ ID NO: 6825 - protein, 81 aa, Aotus trivirgatus
VLQTLWFRGFSSNLFQEPVTFEDVAVYFTQIEWTSLHPTQRALYREVMLENYANVTSLSAFPFPKPDLIFQLEQGEAAWGP

SEQ ID NO: 6826 - protein, 81 aa, Aotus trivirgatus
VLQTLWFRGFSSNLFQEPVTFEDVAVYFTQIEWTSLHPTQRALYREVMLENYANVTSLYLIAGFPLGTERTEKVPGALPSF

SEQ ID NO: 6827 - protein, 81 aa, Aotus trivirgatus
KENPEDISGWGLPEARSKESVSFKDVAVDFTQEEWGQLDSPQRALYWDVMLENYQNLLALGPPLHKPDVISHLERGEEPWC

SEQ ID NO: 6828 - protein, 81 aa, Aotus trivirgatus
KENPEDISGWGLPEARSKESVSFKDVAVDFTQEEWGQLDSPQRALYWDVMLENYQNLLALEWEMKEVPSQQQGMCKEEPAQ

SEQ ID NO: 6829 - protein, 81 aa, Aotus trivirgatus
VSVSFEDVTVDFSREEWQQLDSTQRRLYQDVMLENYSHLLSVGFEIPKPEVIFKLEQGEGPWTLEGETPHHSCSDGKFGIK

SEQ ID NO: 6830 - protein, 81 aa, Aotus trivirgatus
DDNSSAKKPGDDEQILEDKCEDFDDIAQYFSKNEWEKLKYSEKSTYAYIKENYESLRRLGFHIPLPFFMHSKWTENFWEDD

SEQ ID NO: 6831 - protein, 81 aa, Aotus trivirgatus
EQTQAAGMLAGWLIDSYQDSVTFDDVAVDFTQEEWTLLDPSQRDLYRDVMLENYENLASVEWRLKSKGSALQQDRAWFRAS

SEQ ID NO: 6832 - protein, 81 aa, Aotus trivirgatus
EQTQAAGMLAGWLIDSYQDSVTFDDVAVDFTQEEWTLLDPSQRDLYRDVMLENYENLASVGHHLFKPRVICWLEEEGQLRA

SEQ ID NO: 6833 - protein, 81 aa, Aotus trivirgatus
MLENYENLASVGHHLFKPRVICWLEEEGQLRAGQRGVLQEWRLKSKGSALQQDRAWFRASDETQMARSHNGGQLCDRMQCG

SEQ ID NO: 6834 - protein, 81 aa, Aotus trivirgatus
MAAPDLAHRGHVSKDLICLREEQTQAAGMLAGWLIDSYQDSVTFDDVAVDFTQEEWTLLDPSQRDLYRDVMLENYENLASV

SEQ ID NO: 6835 - protein, 81 aa, Aotus trivirgatus
MDVAQEQVTFQDVAIYFSWEEWECLEPSQRALYRDVMLDNFSNVAALGFCSPRPDLVSRLEQWEEPWVEDRDRPELQAVQR

SEQ ID NO: 6836 - protein, 81 aa, Aotus trivirgatus
MDVAQEQVTFQDVAIYFSWEEWECLEPSQRALYRDVMLDNFSNVAALAPDQTSSPAWNSGRSHGLKTGTDLSCRQCRGAPA

SEQ ID NO: 6837 - protein, 81 aa, Aotus trivirgatus
GESLESRVTLGSPTAESQELLTFKDVSVDFTQEEWGQLAPAHRNLYREVMLENYGNLVSVGYQLSKPGVISQLEKGEEPWL

SEQ ID NO: 6838 - protein, 81 aa, Homo sapiens; identical to SEQ ID NO: 402

SEQ ID NO: 6839 - protein, 81 aa, Homo sapiens; identical to SEQ ID NO: 403

SEQ ID NO: 6840 - protein, 81 aa, Homo sapiens; identical to SEQ ID NO: 404

SEQ ID NO: 6841 - protein, 81 aa, Homo sapiens; identical to SEQ ID NO: 405

SEQ ID NO: 6842 - protein, 81 aa, Homo sapiens; identical to SEQ ID NO: 406

SEQ ID NO: 6843 - protein, 81 aa, Mus musculus
PSKTVTFKDVAVDLTQEEWQQMKPAQRALYRDVMLETYSNLVTVGCQVTKPDVIFKLEQAEEPWVLEEEMFWRRSPEAARG

SEQ ID NO: 6844 - protein, 81 aa, Homo sapiens; identical to SEQ ID NO: 407

SEQ ID NO: 6845 - protein, 81 aa, Homo sapiens; identical to SEQ ID NO: 408

SEQ ID NO: 6846 - protein, 81 aa, Homo sapiens; identical to SEQ ID NO: 409

SEQ ID NO: 6847 - protein, 81 aa, Homo sapiens; identical to SEQ ID NO: 410

SEQ ID NO: 6848 - protein, 81 aa, Homo sapiens; identical to SEQ ID NO: 411

SEQ ID NO: 6849 - protein, 81 aa, Mus musculus
VCGSVTFRDVAVDFSQEEWACLDATQKVLYRNIMLETYSNLVAVVGRCIPKPDLIVLLEPEKEPWMAVKKETGRPSQGLET

SEQ ID NO: 6850 - protein, 81 aa, Homo sapiens; identical to SEQ ID NO: 412

SEQ ID NO: 6851 - protein, 81 aa, Pongo abelii
CQESVTFEDVAVVFTDEEWSHLVPTQRDLYKEVMLENYNSIVSLGLPVPQPDVIFQLKRGDKPWMVDLHGSEEREWPESVS

SEQ ID NO: 6852 - protein, 81 aa, Homo sapiens; identical to SEQ ID NO: 413

SEQ ID NO: 6853 - protein, 81 aa, Homo sapiens; identical to SEQ ID NO: 414

SEQ ID NO: 6854 - protein, 81 aa, Homo sapiens; identical to SEQ ID NO: 415

SEQ ID NO: 6855 - protein, 81 aa, Bos taurus
QAQETLTFDDVAVDFTWEEWQLLAPAQKALYRDVMLENYSNLVSAGFQASTPEVLSKLDQGEPWMMDDEIHCRTHSEVWKV

SEQ ID NO: 6856 - protein, 81 aa, Homo sapiens; identical to SEQ ID NO: 416

SEQ ID NO: 6857 - protein, 81 aa, Homo sapiens; identical to SEQ ID NO: 417

SEQ ID NO: 6858 - protein, 81 aa, Homo sapiens; identical to SEQ ID NO: 418

SEQ ID NO: 6859 - protein, 81 aa, Homo sapiens; identical to SEQ ID NO: 419

SEQ ID NO: 6860 - protein, 81 aa, Pongo abelii
QGLLTFRDVAIEFSQEEWKCLDPAQRTLYRDVMLENYRNLVSLDISSKCMMKEFLSTAQGNREVFHTGTLERHESHHIGDF

SEQ ID NO: 6861 - protein, 81 aa, Homo sapiens; identical to SEQ ID NO: 420

SEQ ID NO: 6862 - protein, 81 aa, Canis lupus
AHGLVTFSDVAIDFSQEEWACLDSRQRDLYWDVMLENYSNLVSLDLESPYGTKSLPTEKGIYEINLSKWNSNGKSKSLGLD

SEQ ID NO: 6863 - protein, 81 aa, Homo sapiens; identical to SEQ ID NO: 421

SEQ ID NO: 6864 - protein, 81 aa, Homo sapiens; identical to SEQ ID NO: 422

SEQ ID NO: 6865 - protein, 81 aa, Homo sapiens; identical to SEQ ID NO: 423

SEQ ID NO: 6866 - protein, 81 aa, Homo sapiens; identical to SEQ ID NO: 424

SEQ ID NO: 6867 - protein, 81 aa, Mus musculus
MLETYSNLVAVVGSCISKPNLIVLLEQEKEPWMAVNEETGRPSPDLEADYDAENISPQNRIYNRKFSKQSIKQLSRTFDPK

SEQ ID NO: 6868 - protein, 81 aa, Homo sapiens; identical to SEQ ID NO: 425

SEQ ID NO: 6869 - protein, 81 aa, Mus musculus
VKGLVSFEDVSVDFTWDEWQDLDDSQRKLYRDVMLETYSSLESLGHCITKPEVIFKLEQGAEPWRAEDVPKQSRADVQKIT

SEQ ID NO: 6870 - protein, 81 aa, Mus musculus
RTPVSYEDVAVSFTQEEWEYLTSTQKTLYQKVMSETFKNLTFVGSKKKPQEPSSDLQDKNEEQEKSSSCTGVFKGGPFFFC

SEQ ID NO: 6871 - protein, 81 aa, Rattus norvegicus
PQESVTFKDVAVNFTQEEWRHVGPAQRSLYRDVMLENYSHLVSLGYQVSKPEVIFKLEQGEEPWISERELQRPFCPDWKTR

SEQ ID NO: 6872 - protein, 81 aa, Homo sapiens; identical to SEQ ID NO: 426

SEQ ID NO: 6873 - protein, 81 aa, Homo sapiens; identical to SEQ ID NO: 427

SEQ ID NO: 6874 - protein, 81 aa, Homo sapiens; identical to SEQ ID NO: 428

SEQ ID NO: 6875 - protein, 81 aa, Homo sapiens; identical to SEQ ID NO: 429

SEQ ID NO: 6876 - protein, 81 aa, Homo sapiens; identical to SEQ ID NO: 430

SEQ ID NO: 6877 - protein, 81 aa, Bos taurus
FREPVTFEDVALGFTPDEWGKLDLEQKSLYREVMLENYRNLVSVEHQLSKPDVVSQLEEEEELWSVERGIPQDTFSECPEA

SEQ ID NO: 6878 - protein, 81 aa, Homo sapiens; identical to SEQ ID NO: 431

SEQ ID NO: 6879 - protein, 81 aa, Mus musculus
MVDALTYDDVYVNFTQEEWALLNPSQKSLYKDVMLETYRNLNAVGYNWEDSNIEEHCESSRRHGRHERNHTGEKPYEGIQY

SEQ ID NO: 6880 - protein, 81 aa, Homo sapiens; identical to SEQ ID NO: 432

SEQ ID NO: 6881 - protein, 81 aa, Mus musculus
RPRALKFVDVAVYFSSEEWGCLQPAQRTLYRDVMRETYGLLGALGCAGPKPALISWLERNTDDWEPAALDPQEYRRWVTFQ

SEQ ID NO: 6882 - protein, 81 aa, Mus musculus
SQVSLTFEDVAVLFTRDEWKKLVPSQRSLYREVMLENYSNLASLGFPFTKPKVISLLQQGEDPWKVEEEGPGGFSLGLKCS

SEQ ID NO: 6883 - protein, 81 aa, Mus musculus
RGTEPVTFRDVAVSFSQDEWLHLDPAQRSLYREVMLENYSNLASLGFQASIPPVIGKLQKGQDPCMEREAPEDTCLDFEIW

SEQ ID NO: 6884 - protein, 81 aa, Rattus norvegicus
SKAPVTFGDLAIYFSQEEWEWLSPNQKDLYEDVMLENYHNLVSVGLACRRPNIIALLEKGKAPWMVEPSRKRRGPELGSKD

SEQ ID NO: 6885 - protein, 81 aa, Homo sapiens; identical to SEQ ID NO: 433

SEQ ID NO: 6886 - protein, 81 aa, Mus musculus
GSVSFTDVTVDFTQEEWEQLDPSQRILYMDVMLENYSNLLSVEVWKADGQVERDPRDLQRQVGSLTTIKNQPPTEERGSRF

SEQ ID NO: 6887 - protein, 81 aa, Bos taurus
FQESVTFKDVIVDFTQEEWKQLDPVQRGLFRDVTLENYTHLVSIGLQVSKPDVISQLEQGTEPWIVEPSIPVGTPGDWVTR

SEQ ID NO: 6888 - protein, 81 aa, Homo sapiens; identical to SEQ ID NO: 434

SEQ ID NO: 6889 - protein, 81 aa, Mus musculus
MVTFRDVAVVFSEEELGLLDAAQRKLYHDVMLENFRNLLAVGCQSPNKMAPLDTTGIRCLPLGQLPCWQMTSHDVNKLARA

SEQ ID NO: 6890 - protein, 81 aa, Homo sapiens; identical to SEQ ID NO: 435

SEQ ID NO: 6891 - protein, 81 aa, Pongo abelii
TQESLTLEDVAVEFSWEEWQLLDTAQKNLYRDVMVENYNHLVSLGYQTSKPDVLSKLAHGQEPWITDAKIQNKNCPGIRKV

SEQ ID NO: 6892 - protein, 81 aa, Homo sapiens; identical to SEQ ID NO: 436

SEQ ID NO: 6893 - protein, 81 aa, Homo sapiens; identical to SEQ ID NO: 437

SEQ ID NO: 6894 - protein, 81 aa, Homo sapiens; identical to SEQ ID NO: 438

SEQ ID NO: 6895 - protein, 81 aa, Homo sapiens; identical to SEQ ID NO: 439

SEQ ID NO: 6896 - protein, 81 aa, Homo sapiens; identical to SEQ ID NO: 440

SEQ ID NO: 6897 - protein, 81 aa, Homo sapiens; identical to SEQ ID NO: 441

SEQ ID NO: 6898 - protein, 81 aa, Homo sapiens; identical to SEQ ID NO: 442

SEQ ID NO: 6899 - protein, 81 aa, Mus musculus
SQGLVTIKDVSLCFSQEEWRSLDPSQTDFYGEYVMQENCGIVVSLRFPIPKLDMLSQQEGGEDQWAPDPQDVEGRDILKVT

SEQ ID NO: 6900 - protein, 81 aa, Homo sapiens; identical to SEQ ID NO: 443

SEQ ID NO: 6901 - protein, 81 aa, Homo sapiens; identical to SEQ ID NO: 444

SEQ ID NO: 6902 - protein, 81 aa, Pongo abelii
SYEGSVSFRDVVINFSREEWQHLDLSQRNLYRDVMLETYSHLLSVGYQVPKPEVVMLEQGKEPWALQGERPRHSCPGEKLW

SEQ ID NO: 6903 - protein, 81 aa, Homo sapiens; identical to SEQ ID NO: 445

SEQ ID NO: 6904 - protein, 81 aa, Rattus norvegicus
LQGPVSFKDVTVDFTQEEWQRLDPAQKALYRDVMLENYCHFISVGFHITKPDMIRKLEQGEELWTERMFPSQSYLEDEEVL

SEQ ID NO: 6905 - protein, 81 aa, Homo sapiens; identical to SEQ ID NO: 446

SEQ ID NO: 6906 - protein, 81 aa, Rattus norvegicus
SQVSVTFEDVAVLFTRDEWKKLDLSQRSLYREVMLENYSNLASMAGFLFTKPKVISLLQQGEDPWQVEKEGPRYFSLGLKC

SEQ ID NO: 6907 - protein, 81 aa, Homo sapiens; identical to SEQ ID NO: 447

SEQ ID NO: 6908 - protein, 81 aa, Homo sapiens; identical to SEQ ID NO: 448

SEQ ID NO: 6909 - protein, 81 aa, Homo sapiens; identical to SEQ ID NO: 449

SEQ ID NO: 6910 - protein, 81 aa, Homo sapiens; identical to SEQ ID NO: 450

SEQ ID NO: 6911 - protein, 81 aa, Homo sapiens; identical to SEQ ID NO: 451

SEQ ID NO: 6912 - protein, 81 aa, Mus musculus
FRESVTFKDVVVNFTQEEWKHLDPIQRDLFRDVTLENYTHLVSIGLQVSKPDMISQLEQGTEPWTEDSCIPVGPLEDWKKR

SEQ ID NO: 6913 - protein, 81 aa, Homo sapiens; identical to SEQ ID NO: 452

SEQ ID NO: 6914 - protein, 81 aa, Homo sapiens; identical to SEQ ID NO: 453

SEQ ID NO: 6915 - protein, 81 aa, Mus musculus
AQGLVTFGDVAVDFSQEEWEFLDPAQKNLYRDVMWETYSNFISLDLESRFKTDTSSSDKGICEVYSLQWELIEKIKNLSPQ

SEQ ID NO: 6916 - protein, 81 aa, Homo sapiens; identical to SEQ ID NO: 454

SEQ ID NO: 6917 - protein, 81 aa, Homo sapiens; identical to SEQ ID NO: 455

SEQ ID NO: 6918 - protein, 81 aa, Homo sapiens; identical to SEQ ID NO: 456

SEQ ID NO: 6919 - protein, 81 aa, Homo sapiens; identical to SEQ ID NO: 457

SEQ ID NO: 6920 - protein, 81 aa, Homo sapiens; identical to SEQ ID NO: 458

SEQ ID NO: 6921 - protein, 81 aa, Homo sapiens; identical to SEQ ID NO: 459

SEQ ID NO: 6922 - protein, 81 aa, Homo sapiens; identical to SEQ ID NO: 460

SEQ ID NO: 6923 - protein, 81 aa, Homo sapiens; identical to SEQ ID NO: 461

SEQ ID NO: 6924 - protein, 81 aa, Homo sapiens; identical to SEQ ID NO: 462

SEQ ID NO: 6925 - protein, 81 aa, Homo sapiens; identical to SEQ ID NO: 463

SEQ ID NO: 6926 - protein, 81 aa, Homo sapiens; identical to SEQ ID NO: 464

SEQ ID NO: 6927 - protein, 81 aa, Bos taurus
WSQMPVTFEDMALYLSREEWGRLDHTQQSFYREVLQKRSGLSLGFPFSRPFWASQVQGKGEAPGSSRQLGHEEEEKRGVVE

SEQ ID NO: 6928 - protein, 81 aa, Pongo abelii
LVTFRDVAIDFTQEEWECLDPAQRDLYRDVMLENYSNLISLDLESSCATKKLSPEKEIYEMESLQWENIGNLINHHLQYGL

SEQ ID NO: 6929 - protein, 81 aa, Homo sapiens; identical to SEQ ID NO: 465

SEQ ID NO: 6930 - protein, 81 aa, Homo sapiens; identical to SEQ ID NO: 466

SEQ ID NO: 6931 - protein, 81 aa, Homo sapiens; identical to SEQ ID NO: 467

SEQ ID NO: 6932 - protein, 81 aa, Mus musculus
TQGLVTFEDVAVYFSLEEWERLGVDQRDLYREVMQENYGILVSLGYPIPKPDLIFHLEQGEEPWVEDGPHPEEGDVVTGVY

SEQ ID NO: 6933 - protein, 81 aa, Pongo abelii
GSVSFTDVTVDFTQEEWEQLDPSQRILYMDVMLENYSNLLSVEVWKADDQMERDHRNPDEQARQFLILKNQTPIEERGDLF

SEQ ID NO: 6934 - protein, 81 aa, Homo sapiens; identical to SEQ ID NO: 468

SEQ ID NO: 6935 - protein, 81 aa, Homo sapiens; identical to SEQ ID NO: 469

SEQ ID NO: 6936 - protein, 81 aa, Homo sapiens; identical to SEQ ID NO: 470

SEQ ID NO: 6937 - protein, 81 aa, Mus musculus
FETLKDLAMDFTVEDWKDLESEWDQRDLFWDVTLNHYQDMFSFTDTSQPSLTSQPDVREELEATSTEVPETKSSPLQSGFV

SEQ ID NO: 6938 - protein, 81 aa, Homo sapiens; identical to SEQ ID NO: 471

SEQ ID NO: 6939 - protein, 81 aa, Homo sapiens; identical to SEQ ID NO: 472

SEQ ID NO: 6940 - protein, 81 aa, Homo sapiens; identical to SEQ ID NO: 473

SEQ ID NO: 6941 - protein, 81 aa, Homo sapiens; identical to SEQ ID NO: 474

SEQ ID NO: 6942 - protein, 81 aa, Mus musculus
SKNLLTFEDVSVNFTQEEWQWLSDTQRDLYRKVTLENYKSLVSLGIPVYKPAVISLLEQGKDPWMVQKKGARDTCPDWQYV

SEQ ID NO: 6943 - protein, 81 aa, Homo sapiens; identical to SEQ ID NO: 475

SEQ ID NO: 6944 - protein, 81 aa, Homo sapiens; identical to SEQ ID NO: 476

SEQ ID NO: 6945 - protein, 81 aa, Homo sapiens; identical to SEQ ID NO: 477

SEQ ID NO: 6946 - protein, 81 aa, Homo sapiens; identical to SEQ ID NO: 478

SEQ ID NO: 6947 - protein, 81 aa, Homo sapiens; identical to SEQ ID NO: 479

SEQ ID NO: 6948 - protein, 81 aa, Homo sapiens; identical to SEQ ID NO: 480

SEQ ID NO: 6949 - protein, 81 aa, Rattus norvegicus
RGTEPVTFRDVAVSFSQDEWLHLDPAQRTLYREVMLENYSNLASLGFQASIPPVIGKLQKGQDPCMEREAPEDTCLDFQIQ

SEQ ID NO: 6950 - protein, 81 aa, Pongo abelii
MAAPTREEWRHLDPSQRNLYRDVMLETYSHLLSVGYQVPEAEVVMLEQGKEPWALQGERPRQSCPGKKLWDHNQCRKILSY

SEQ ID NO: 6951 - protein, 81 aa, Homo sapiens; identical to SEQ ID NO: 481

SEQ ID NO: 6952 - protein, 81 aa, Mus musculus
ATGSHDEATPGTPAAGSHDGETPGIPAAGSHDGETPGTPTAGSHDGVTPGTTAAGSQESLTFKDIAVDLSQEEWGQLAPAY

SEQ ID NO: 6953 - protein, 81 aa, Mus musculus
MATSEPAESDAVRAKEWEQLEPVQRDVYKDTKLENCSNPASMGNQDPKQDIVSVLEEEEPSSGKGKKASPSSLKKIARPKT

SEQ ID NO: 6954 - protein, 81 aa, Homo sapiens; identical to SEQ ID NO: 482

SEQ ID NO: 6955 - protein, 81 aa, Homo sapiens; identical to SEQ ID NO: 483

SEQ ID NO: 6956 - protein, 81 aa, Homo sapiens; identical to SEQ ID NO: 484

SEQ ID NO: 6957 - protein, 81 aa, Homo sapiens; identical to SEQ ID NO: 485

SEQ ID NO: 6958 - protein, 81 aa, Mus musculus
GCVTFQDVAICFSHEEWRLLDETQRLLYLSVMLQNFALINSQGCGHKTEDEERRVSTRASKGLRSETTPKTNLCEKCVPIL

SEQ ID NO: 6959 - protein, 81 aa, Homo sapiens; identical to SEQ ID NO: 486

SEQ ID NO: 6960 - protein, 81 aa, Bos taurus
FSQEEWQHLDPAQKTLYMDVMLENYCHLISVGCHMTKPDVILKLERGEEPWTSFKGHTCLEENWKAEDFLLKFKEQQDKYS

SEQ ID NO: 6961 - protein, 81 aa, Homo sapiens; identical to SEQ ID NO: 487

SEQ ID NO: 6962 - protein, 81 aa, Homo sapiens; identical to SEQ ID NO: 488

SEQ ID NO: 6963 - protein, 81 aa, Homo sapiens; identical to SEQ ID NO: 489

SEQ ID NO: 6964 - protein, 81 aa, Homo sapiens; identical to SEQ ID NO: 490

SEQ ID NO: 6965 - protein, 81 aa, Homo sapiens; identical to SEQ ID NO: 491

SEQ ID NO: 6966 - protein, 81 aa, Homo sapiens; identical to SEQ ID NO: 492

SEQ ID NO: 6967 - protein, 81 aa, Homo sapiens; identical to SEQ ID NO: 493

SEQ ID NO: 6968 - protein, 81 aa, Homo sapiens; identical to SEQ ID NO: 494

SEQ ID NO: 6969 - protein, 81 aa, Homo sapiens; identical to SEQ ID NO: 495

SEQ ID NO: 6970 - protein, 81 aa, Homo sapiens; identical to SEQ ID NO: 496

SEQ ID NO: 6971 - protein, 81 aa, Homo sapiens; identical to SEQ ID NO: 497

SEQ ID NO: 6972 - protein, 81 aa, Homo sapiens; identical to SEQ ID NO: 498

SEQ ID NO: 6973 - protein, 81 aa, Homo sapiens; identical to SEQ ID NO: 499

SEQ ID NO: 6974 - protein, 81 aa, Homo sapiens; identical to SEQ ID NO: 500

SEQ ID NO: 6975 - protein, 81 aa, Homo sapiens; identical to SEQ ID NO: 501

SEQ ID NO: 6976 - protein, 81 aa, Homo sapiens; identical to SEQ ID NO: 502

SEQ ID NO: 6977 - protein, 81 aa, Mus musculus
SEGLVTFKDVAIDFTQEEWKQLDPTQRNLYRNVMLENYNNLITVGPPLTKPEVIFKLEQEEEPCVVEREVLWRPCPGEILG

SEQ ID NO: 6978 - protein, 81 aa, Homo sapiens; identical to SEQ ID NO: 503

SEQ ID NO: 6979 - protein, 81 aa, Homo sapiens; identical to SEQ ID NO: 504

SEQ ID NO: 6980 - protein, 81 aa, Homo sapiens; identical to SEQ ID NO: 505

SEQ ID NO: 6981 - protein, 81 aa, Homo sapiens; identical to SEQ ID NO: 506

SEQ ID NO: 6982 - protein, 81 aa, Mus musculus
SQMPVTFEDVALYLSQEEWGRLDHTQQNFYRDVLQGKNGLALGAVEMGKVVPALAVATLEDTKSIRTRARWAPGEDPKCGQ

SEQ ID NO: 6983 - protein, 81 aa, Homo sapiens; identical to SEQ ID NO: 507

SEQ ID NO: 6984 - protein, 81 aa, Bos taurus
MFQVTFSDVAIDFSHEEWRWLNSTQRNLYKDVMVQNYENLVSLGLSIPKPYVIALLEDGKEPCMVEEKLSKDTFPDCKTRW

SEQ ID NO: 6985 - protein, 81 aa, Homo sapiens; identical to SEQ ID NO: 508

SEQ ID NO: 6986 - protein, 81 aa, Bos taurus
FQEAVTFKDVAVVFTEEELGLLDSAQRKLYQDVMVENFRNLVSVGHVPFKADMVSQLETEEKLWTMERETQRNGHSSEIHS

SEQ ID NO: 6987 - protein, 81 aa, Homo sapiens; identical to SEQ ID NO: 509

SEQ ID NO: 6988 - protein, 81 aa, Homo sapiens; identical to SEQ ID NO: 510

SEQ ID NO: 6989 - protein, 81 aa, Homo sapiens; identical to SEQ ID NO: 511

SEQ ID NO: 6990 - protein, 81 aa, Homo sapiens; identical to SEQ ID NO: 512

SEQ ID NO: 6991 - protein, 81 aa, Homo sapiens; identical to SEQ ID NO: 513

SEQ ID NO: 6992 - protein, 81 aa, Homo sapiens; identical to SEQ ID NO: 514

SEQ ID NO: 6993 - protein, 81 aa, Homo sapiens; identical to SEQ ID NO: 515

SEQ ID NO: 6994 - protein, 81 aa, Homo sapiens; identical to SEQ ID NO: 516

SEQ ID NO: 6995 - protein, 81 aa, Homo sapiens; identical to SEQ ID NO: 517

SEQ ID NO: 6996 - protein, 81 aa, Homo sapiens; identical to SEQ ID NO: 518

SEQ ID NO: 6997 - protein, 81 aa, Rattus norvegicus
PHESVKFEDVSLTFTKEEWAQLDLQQKCLYREIMMENYNNMISVEHHFSKPNVISQLEEAEDCWPMEREIRQDILPECSGP

SEQ ID NO: 6998 - protein, 81 aa, Mus musculus
PHESVKFEDVSLRFTEEEWALLDRQQKCLYREIMMENLNNMISVEHHFSKANVMPQLEEVEDCWPMQREIPQDTLPECSGH

SEQ ID NO: 6999 - protein, 81 aa, Mus musculus
AWVPALFDEVAIYFSDEEWEVLTEQQKALYREVMRMNYETVLSLEFPFPKPDMINRLERDEECPNSDEWRLQGVTFAENEE

SEQ ID NO: 7000 - protein, 81 aa, Homo sapiens; identical to SEQ ID NO: 519

SEQ ID NO: 7001 - protein, 81 aa, Rattus norvegicus
RPRALKFADVAVYFSSEEWGRLRPAQRTLYRDVMRETYGLLGALGCAGPKPALITWLERNTDDWEPAALDPQEYRRWVTFQ

SEQ ID NO: 7002 - protein, 81 aa, Homo sapiens; identical to SEQ ID NO: 520

SEQ ID NO: 7003 - protein, 81 aa, Homo sapiens; identical to SEQ ID NO: 521

SEQ ID NO: 7004 - protein, 81 aa, Mus musculus
MGLVSFEDVAVDFTLEEWQDLDAAQRTLYRDVMLETYSSLVFLDPCIAKPKLIFNLERGFGPWSLAEASSRSLPGVHNVST

SEQ ID NO: 7005 - protein, 81 aa, Homo sapiens; identical to SEQ ID NO: 522

SEQ ID NO: 7006 - protein, 81 aa, Homo sapiens; identical to SEQ ID NO: 523

SEQ ID NO: 7007 - protein, 81 aa, Homo sapiens; identical to SEQ ID NO: 524

SEQ ID NO: 7008 - protein, 81 aa, Homo sapiens; identical to SEQ ID NO: 525

SEQ ID NO: 7009 - protein, 81 aa, Homo sapiens; identical to SEQ ID NO: 526

SEQ ID NO: 7010 - protein, 81 aa, Pan troglodytes
AQESVMFSDVSVDFSQEEWECLNDDQRDLYRDVMLENYSNLVSMGHSISKPNVISYLEQGKEPWLVDRELTRGQWPVLESR

SEQ ID NO: 7011 - protein, 81 aa, Mus musculus
LGLDVSFEDVAIHFSQEEWVLLDKAQRLLYCSVMLENLALVASLGSCTGMGDEDVTCEPAEEVVCNTSPSPQETHLLEIPV

SEQ ID NO: 7012 - protein, 81 aa, Homo sapiens; identical to SEQ ID NO: 527

SEQ ID NO: 7013 - protein, 81 aa, Homo sapiens; identical to SEQ ID NO: 528

SEQ ID NO: 7014 - protein, 81 aa, Homo sapiens; identical to SEQ ID NO: 529

SEQ ID NO: 7015 - protein, 81 aa, Bos taurus
HQEVVTFEDVAVYFTRTEWAGLSPAQRALYRSVMLEIYRSLTSLGYPVPKPALISLLERGDLPVGLETQDNPPAQGTRDIY

SEQ ID NO: 7016 - protein, 81 aa, Mus musculus
AHSTVMFRDVAVGFSQEEWECLSAYERDLYRDVMLENYSHLVSLAGCSISKPDVITLLEQGKEPWMIVRAEKRRWSRDLES

SEQ ID NO: 7017 - protein, 81 aa, Homo sapiens; identical to SEQ ID NO: 530

SEQ ID NO: 7018 - protein, 81 aa, Homo sapiens; identical to SEQ ID NO: 531

SEQ ID NO: 7019 - protein, 81 aa, Homo sapiens; identical to SEQ ID NO: 532

SEQ ID NO: 7020 - protein, 81 aa, Homo sapiens; identical to SEQ ID NO: 533

SEQ ID NO: 7021 - protein, 81 aa, Homo sapiens; identical to SEQ ID NO: 534

SEQ ID NO: 7022 - protein, 81 aa, Homo sapiens; identical to SEQ ID NO: 535

SEQ ID NO: 7023 - protein, 81 aa, Macaca fascicularis
ARDLVMFRDVAIDFSQEEWECLNSYQRNLYRDVILENYSNLVSLAGCSISKPDVITLLEQGKEPWMVMRDEKRRWTLDLES

SEQ ID NO: 7024 - protein, 81 aa, Homo sapiens; identical to SEQ ID NO: 536

SEQ ID NO: 7025 - protein, 81 aa, Homo sapiens; identical to SEQ ID NO: 537

SEQ ID NO: 7026 - protein, 81 aa, Homo sapiens; identical to SEQ ID NO: 538

SEQ ID NO: 7027 - protein, 81 aa, Homo sapiens; identical to SEQ ID NO: 539

SEQ ID NO: 7028 - protein, 81 aa, Homo sapiens; identical to SEQ ID NO: 540

SEQ ID NO: 7029 - protein, 81 aa, Pongo abelii
FQRPVSFQDLTVNFTQEEWQQLDPTQRLLYRDVMLENYSNLVSVGYHVSKPDVIFKLEQGEAPWIVEEFSNQNYPEVDDAL

SEQ ID NO: 7030 - protein, 81 aa, Homo sapiens; identical to SEQ ID NO: 541

SEQ ID NO: 7031 - protein, 81 aa, Homo sapiens; identical to SEQ ID NO: 542

SEQ ID NO: 7032 - protein, 81 aa, Homo sapiens; identical to SEQ ID NO: 543

SEQ ID NO: 7033 - protein, 81 aa, Homo sapiens; identical to SEQ ID NO: 544

SEQ ID NO: 7034 - protein, 81 aa, Homo sapiens; identical to SEQ ID NO: 545

SEQ ID NO: 7035 - protein, 81 aa, Homo sapiens; identical to SEQ ID NO: 546

SEQ ID NO: 7036 - protein, 81 aa, Homo sapiens; identical to SEQ ID NO: 547

SEQ ID NO: 7037 - protein, 81 aa, Mus musculus
VQEPVTFRDVAVSFSQDEWLHLDPAQRTLYREVMLENYSNLVSLGILFSKPKVIAQLEQAEDFPMVESGMFQGVYLGWKSL

SEQ ID NO: 7038 - protein, 81 aa, Homo sapiens; identical to SEQ ID NO: 548

SEQ ID NO: 7039 - protein, 81 aa, Homo sapiens; identical to SEQ ID NO: 549

SEQ ID NO: 7040 - protein, 81 aa, Homo sapiens; identical to SEQ ID NO: 550

SEQ ID NO: 7041 - protein, 81 aa, Pongo abelii
AQGLVTFADVAIDFSQEEWACLNSAQRDLYWDVMLENYSNLVSLDLESAYENKSLPTEKNIHEIRASKRNSDRRSKSLGRN

SEQ ID NO: 7042 - protein, 81 aa, Homo sapiens; identical to SEQ ID NO: 551

SEQ ID NO: 7043 - protein, 81 aa, Bos taurus
DPDQVTFEDVVVDFTQEEWGHLEPAQRTLYRDVMLETFGLLVSVGHWLPKPDVISLLEQEAELWAADKGGPRGVCPDLETR

SEQ ID NO: 7044 - protein, 81 aa, Mus musculus
ARVSVVFSDVSIAFSQEEWESLDLEQRNLYKDVMMENYHNVASLGCFISKPDVISLLEQGKEPWKVVRQRKPCPDSETKDE

SEQ ID NO: 7045 - protein, 81 aa, Bos taurus
QDPVTFEDVAVVFTDEEWRRLVPTQRDLYKEVMLENYKSIVSLGLPVPGPDVIFQLKRGDEPWLVEFHGFEGKEGAENVSL

SEQ ID NO: 7046 - protein, 81 aa, Mus musculus
NFWILRLPPGSKGEVPKEWGKLEDWQKELYKHVMRGNYETLVSLDYAISKPEVLSQIEQGKEPCTWRRTGPKVPEVPVDPS

SEQ ID NO: 7047 - protein, 81 aa, Homo sapiens; identical to SEQ ID NO: 552

SEQ ID NO: 7048 - protein, 81 aa, Homo sapiens; identical to SEQ ID NO: 553

SEQ ID NO: 7049 - protein, 81 aa, Xenopus laevis
MEEPKCLQREMYKSVMTENYQCVLSLGYPIRKPEIVSMMEVGEELWSKNDSARPGQKEVEGETPKESDWAAENCKRAQMHK

SEQ ID NO: 7050 - protein, 81 aa, Homo sapiens; identical to SEQ ID NO: 554

SEQ ID NO: 7051 - protein, 81 aa, Homo sapiens; identical to SEQ ID NO: 555

SEQ ID NO: 7052 - protein, 81 aa, Homo sapiens; identical to SEQ ID NO: 556

SEQ ID NO: 7053 - protein, 81 aa, Homo sapiens; identical to SEQ ID NO: 557

SEQ ID NO: 7054 - protein, 81 aa, Homo sapiens; identical to SEQ ID NO: 558

SEQ ID NO: 7055 - protein, 81 aa, Homo sapiens; identical to SEQ ID NO: 559

SEQ ID NO: 7056 - protein, 81 aa, Homo sapiens; identical to SEQ ID NO: 560

SEQ ID NO: 7057 - protein, 81 aa, Homo sapiens; identical to SEQ ID NO: 561

SEQ ID NO: 7058 - protein, 81 aa, Homo sapiens; identical to SEQ ID NO: 562

SEQ ID NO: 7059 - protein, 81 aa, Homo sapiens; identical to SEQ ID NO: 563

SEQ ID NO: 7060 - protein, 81 aa, Mus musculus
MLSFWDVAIDFSPEERECLEPDQWDLYRDVMLENYSHLDFLGLALSKPFLVTFLEQRQGPWDVKRQAAAAVHPGKTVNKCK

SEQ ID NO: 7061 - protein, 81 aa, Mus musculus
QVDAVTFEDVAVDFTQEEWTSLDPVQRNLYRDVMLENYQNLATVGGQMFKPSLISWLEKKVELTVIEQGILQEWEMHLKTK

SEQ ID NO: 7062 - protein, 81 aa, Mus musculus
SLGPLSFKDVAVAFSQEEWQQLDPEERTTYRDVMLETYSNLVSVGYDIIKPDVIIKLEQGEEPWIVEGAFSPQSYPDEIRH

SEQ ID NO: 7063 - protein, 81 aa, Homo sapiens; identical to SEQ ID NO: 564

SEQ ID NO: 7064 - protein, 81 aa, Homo sapiens; identical to SEQ ID NO: 565

SEQ ID NO: 7065 - protein, 81 aa, Homo sapiens; identical to SEQ ID NO: 566

SEQ ID NO: 7066 - protein, 81 aa, Homo sapiens; identical to SEQ ID NO: 567

SEQ ID NO: 7067 - protein, 81 aa, Macaca fascicularis
FQESVTFQDVAVDFTAEEWQLLDCTERTLYWDVMLENYRNLISVGCPINKTKVILKVEQGQEPWMVEGVNLHQSSPESDCP

SEQ ID NO: 7068 - protein, 81 aa, Homo sapiens; identical to SEQ ID NO: 568

SEQ ID NO: 7069 - protein, 81 aa, Homo sapiens; identical to SEQ ID NO: 569

SEQ ID NO: 7070 - protein, 81 aa, Homo sapiens; identical to SEQ ID NO: 570

SEQ ID NO: 7071 - protein, 81 aa, Homo sapiens; identical to SEQ ID NO: 571

SEQ ID NO: 7072 - protein, 81 aa, Homo sapiens; identical to SEQ ID NO: 572

SEQ ID NO: 7073 - protein, 81 aa, Homo sapiens; identical to SEQ ID NO: 573

SEQ ID NO: 7074 - protein, 81 aa, Homo sapiens; identical to SEQ ID NO: 574

SEQ ID NO: 7075 - protein, 81 aa, Homo sapiens; identical to SEQ ID NO: 575

SEQ ID NO: 7076 - protein, 81 aa, Homo sapiens; identical to SEQ ID NO: 576

SEQ ID NO: 7077 - protein, 81 aa, Homo sapiens; identical to SEQ ID NO: 577

SEQ ID NO: 7078 - protein, 81 aa, Homo sapiens; identical to SEQ ID NO: 578

SEQ ID NO: 7079 - protein, 81 aa, Homo sapiens; identical to SEQ ID NO: 579

SEQ ID NO: 7080 - protein, 81 aa, Chlorocebus aethiops
TFKEAMTFKDVAVVFTEEELGLLDLAQRKLYRDVMLENFRNLLSVGHQAFHRDTFHFLREEKIWMMKTAIQREGNSGDKIQ

SEQ ID NO: 7081 - protein, 81 aa, Homo sapiens; identical to SEQ ID NO: 580

SEQ ID NO: 7082 - protein, 81 aa, Homo sapiens; identical to SEQ ID NO: 581

SEQ ID NO: 7083 - protein, 81 aa, Homo sapiens; identical to SEQ ID NO: 582

SEQ ID NO: 7084 - protein, 81 aa, Homo sapiens; identical to SEQ ID NO: 583

SEQ ID NO: 7085 - protein, 81 aa, Bos taurus
NFWILRLPPGSKGEAPKEWGKLDEWQKELYKHVMRGNYETLVSLDYAISKPEVLSQIEQGKEPCSWRRAGPKVPDVPVDPS

SEQ ID NO: 7086 - protein, 81 aa, Homo sapiens; identical to SEQ ID NO: 584

SEQ ID NO: 7087 - protein, 81 aa, Bos taurus
QAEVTFEDVAVFLSQEEWGLLGPAQKGLYREVMLETYRNLVSLGAGLAGPKPEVIAQLEQGDELWVLDMHGAEQPSVDGSA

SEQ ID NO: 7088 - protein, 81 aa, Homo sapiens; identical to SEQ ID NO: 585

SEQ ID NO: 7089 - protein, 81 aa, Pongo abelii
TGEDVTFSDVAIDFSHEEWGWLNSAQRDLYKDVMVQNYENLVSVAGLSVTKPHVITLLEDGKEPWMMEKKLSKGLIPDWES

SEQ ID NO: 7090 - protein, 81 aa, Homo sapiens; identical to SEQ ID NO: 586

SEQ ID NO: 7091 - protein, 81 aa, Homo sapiens; identical to SEQ ID NO: 587

SEQ ID NO: 7092 - protein, 81 aa, Homo sapiens; identical to SEQ ID NO: 588

SEQ ID NO: 7093 - protein, 81 aa, Pongo abelii
AHALVTFRDVTIDFSQKEWECLDTTQRKLYRDVMLENYNNLVSLGYSGSKPDVITLLEQGKEPCVAARDVTGRQYPGLLSR

SEQ ID NO: 7094 - protein, 81 aa, Mus musculus
DQELVSFEDVIVDFTQEEWSSLNPDQRNLYRDVMLENYQNLATVGYQLIKPSLISWLEQEEFSKGQKIVFPEWKLQLETKC

SEQ ID NO: 7095 - protein, 81 aa, Homo sapiens; identical to SEQ ID NO: 589

SEQ ID NO: 7096 - protein, 81 aa, Mus musculus
SQGLVTFGDVAVVFSQEEWEWLNSEQRSLYWKVMLDNYRNLASLGLCASQPDMITSLEQGRDPWMMKRKMRKGQHLDLKAM

SEQ ID NO: 7097 - protein, 81 aa, Homo sapiens; identical to SEQ ID NO: 590

SEQ ID NO: 7098 - protein, 81 aa, Homo sapiens; identical to SEQ ID NO: 591

SEQ ID NO: 7099 - protein, 81 aa, Homo sapiens; identical to SEQ ID NO: 592

SEQ ID NO: 7100 - protein, 81 aa, Mus musculus
LQEPVTFRDVAVDFTQEEWGQLDPTQRTLYRDVMLETFGHLLSVGPDLPKPAVISQLEQGAELWVADRGGTGACHPGWILE

SEQ ID NO: 7101 - protein, 81 aa, Homo sapiens; identical to SEQ ID NO: 593

SEQ ID NO: 7102 - protein, 81 aa, Homo sapiens; identical to SEQ ID NO: 594

SEQ ID NO: 7103 - protein, 81 aa, Homo sapiens; identical to SEQ ID NO: 595

SEQ ID NO: 7104 - protein, 81 aa, Mus musculus
PQAKVTFEDVAVLLSQEEWARLGPAQRGLYRHVMMETYGNVVSLGLPGSKPVVISQLERGEDPWVLDGQGTELSQSLGSDH

SEQ ID NO: 7105 - protein, 81 aa, Pongo abelii
KSQEQVSFKDVCVDFTQEEWYLLDPAQKILYRDVILENYSNLVSVGYCITKPEVIFKIEQGEEPWILEKGFPSQDPERKWK

SEQ ID NO: 7106 - protein, 81 aa, Homo sapiens; identical to SEQ ID NO: 596

SEQ ID NO: 7107 - protein, 81 aa, Homo sapiens; identical to SEQ ID NO: 597

SEQ ID NO: 7108 - protein, 81 aa, Mus musculus
SKAPVTFGDLAIYFSQEEWEWLSPMQKDLYEDVMLENYHNLVSVGLACRRPNIIALLEKGKAPWVIEPSRRRWGPESGSKY

SEQ ID NO: 7109 - protein, 81 aa, Homo sapiens; identical to SEQ ID NO: 598

SEQ ID NO: 7110 - protein, 81 aa, Homo sapiens; identical to SEQ ID NO: 599

SEQ ID NO: 7111 - protein, 81 aa, Homo sapiens; identical to SEQ ID NO: 600

SEQ ID NO: 7112 - protein, 81 aa, Homo sapiens; identical to SEQ ID NO: 601

SEQ ID NO: 7113 - protein, 81 aa, Pongo abelii
RQEPVTFEDVAVYFTQNEWASLDSVQRALYREVMLENYANVASLAFPFTTPVLVSQLEQGELPWGLDPWEPMGREALRGIC

SEQ ID NO: 7114 - protein, 81 aa, Mus musculus
SKGPLSFKDVAVAFSQEEWQQLDPEERTTYRDVMLETYSNLVSVGYDVTKPNMIIKLEQGEEPWTVEGDRHAQRHLEISKV

SEQ ID NO: 7115 - protein, 81 aa, Homo sapiens; identical to SEQ ID NO: 602

SEQ ID NO: 7116 - protein, 81 aa, Homo sapiens; identical to SEQ ID NO: 603

SEQ ID NO: 7117 - protein, 81 aa, Homo sapiens; identical to SEQ ID NO: 604

SEQ ID NO: 7118 - protein, 81 aa, Mus musculus
LQEMVTFRDVAVVFSEEELGLLDAAQWKLYREVMLENFRMLLSVAHQPFKPGLIAQLENGEQLWMVEAEAHAGGLSGRRNG

SEQ ID NO: 7119 - protein, 81 aa, Homo sapiens; identical to SEQ ID NO: 605

SEQ ID NO: 7120 - protein, 81 aa, Homo sapiens; identical to SEQ ID NO: 606

SEQ ID NO: 7121 - protein, 81 aa, Homo sapiens; identical to SEQ ID NO: 607

SEQ ID NO: 7122 - protein, 81 aa, Homo sapiens; identical to SEQ ID NO: 608

SEQ ID NO: 7123 - protein, 81 aa, Homo sapiens; identical to SEQ ID NO: 609

SEQ ID NO: 7124 - protein, 81 aa, Homo sapiens; identical to SEQ ID NO: 610

SEQ ID NO: 7125 - protein, 81 aa, Homo sapiens; identical to SEQ ID NO: 611

SEQ ID NO: 7126 - protein, 81 aa, Homo sapiens; identical to SEQ ID NO: 612

SEQ ID NO: 7127 - protein, 81 aa, Homo sapiens; identical to SEQ ID NO: 613

SEQ ID NO: 7128 - protein, 81 aa, Homo sapiens; identical to SEQ ID NO: 614

SEQ ID NO: 7129 - protein, 81 aa, Homo sapiens; identical to SEQ ID NO: 615

SEQ ID NO: 7130 - protein, 81 aa, Homo sapiens; identical to SEQ ID NO: 616

SEQ ID NO: 7131 - protein, 81 aa, Homo sapiens; identical to SEQ ID NO: 617

SEQ ID NO: 7132 - protein, 81 aa, Mus musculus
CQALVTFEDVAVTFTDDEWKRLVPVQRALYKAVMLENYESIISLGLPVPRPDVILQFKRRGEPWIRGFHGSEEKTWPESVS

SEQ ID NO: 7133 - protein, 81 aa, Homo sapiens; identical to SEQ ID NO: 618

SEQ ID NO: 7134 - protein, 81 aa, Homo sapiens; identical to SEQ ID NO: 619

SEQ ID NO: 7135 - protein, 81 aa, Homo sapiens; identical to SEQ ID NO: 620

SEQ ID NO: 7136 - protein, 81 aa, Canis lupus
SQVLVSFEDVAVLLSREEWGRLGPAQRGLYSDVMLETYRNLISLGLQGSKPDVISRLEKGEEPWAPYSAKIEESWIRSHES

SEQ ID NO: 7137 - protein, 81 aa, Homo sapiens; identical to SEQ ID NO: 621

SEQ ID NO: 7138 - protein, 81 aa, Homo sapiens; identical to SEQ ID NO: 622

SEQ ID NO: 7139 - protein, 81 aa, Homo sapiens; identical to SEQ ID NO: 623

SEQ ID NO: 7140 - protein, 81 aa, Homo sapiens; identical to SEQ ID NO: 624

SEQ ID NO: 7141 - protein, 81 aa, Homo sapiens; identical to SEQ ID NO: 625

SEQ ID NO: 7142 - protein, 81 aa, Homo sapiens; identical to SEQ ID NO: 626

SEQ ID NO: 7143 - protein, 81 aa, Macaca fascicularis
DDVALYFSGQEWEILEKWQKQMYKQEMKTNYQTLDSLGYAFSKPDLITWMEQGRMLFISEQGCLDKTRRTTSPPTDEQLDM

SEQ ID NO: 7144 - protein, 81 aa, Homo sapiens; identical to SEQ ID NO: 627

SEQ ID NO: 7145 - protein, 81 aa, Homo sapiens; identical to SEQ ID NO: 628

SEQ ID NO: 7146 - protein, 81 aa, Mus musculus
MEDMLSFWDVAIYFSAEEWECLGPAQWKLYRDVMLENYSNLVFLGLASSKPYLVTFLEQIQEPSDVKRQAAITVHPGGKCY

SEQ ID NO: 7147 - protein, 81 aa, Homo sapiens; identical to SEQ ID NO: 629

SEQ ID NO: 7148 - protein, 81 aa, Homo sapiens; identical to SEQ ID NO: 630

SEQ ID NO: 7149 - protein, 81 aa, Mus musculus
ARFPLTFEDVAIYFSEQEWQHLEAWQKELYKQVMRTNYETLISLDNGLPKPELISWIELGRELFGSWGEKKKPDKETHCSI

SEQ ID NO: 7150 - protein, 81 aa, Macaca fascicularis
SCEPVNFEDVTLGFTPEEWGLLDLKQKSLYREVMLENYRNLVSVEHQLSKPDVVSQLEEAEDFWPVERGIPQDTIPEYSEL

SEQ ID NO: 7151 - protein, 81 aa, Homo sapiens; identical to SEQ ID NO: 631

SEQ ID NO: 7152 - protein, 81 aa, Homo sapiens; identical to SEQ ID NO: 632

SEQ ID NO: 7153 - protein, 81 aa, Rattus norvegicus
MATPEPAESDAEWEQLEPGQRNLYKDTKLETCSNPASMGNQDPKQGLVSKLDGEEERWSSVRANKNSSSSLHRLKKTGTSA

SEQ ID NO: 7154 - protein, 81 aa, Mus musculus
PKVTVSFEDVSVYFTKTEWRLLDLKQRTLYKQVMLENYSHLVSVGFAFSKPNLVSQLERGEKPWIRDDGMESAARSCAGNR

SEQ ID NO: 7155 - protein, 81 aa, Homo sapiens; identical to SEQ ID NO: 633

SEQ ID NO: 7156 - protein, 81 aa, Homo sapiens; identical to SEQ ID NO: 634

SEQ ID NO: 7157 - protein, 81 aa, Homo sapiens; identical to SEQ ID NO: 635

SEQ ID NO: 7158 - protein, 81 aa, Homo sapiens; identical to SEQ ID NO: 636

SEQ ID NO: 7159 - protein, 81 aa, Homo sapiens; identical to SEQ ID NO: 637

SEQ ID NO: 7160 - protein, 81 aa, Homo sapiens; identical to SEQ ID NO: 638

SEQ ID NO: 7161 - protein, 81 aa, Homo sapiens; identical to SEQ ID NO: 639

SEQ ID NO: 7162 - protein, 81 aa, Homo sapiens; identical to SEQ ID NO: 640

SEQ ID NO: 7163 - protein, 81 aa, Homo sapiens; identical to SEQ ID NO: 641

SEQ ID NO: 7164 - protein, 81 aa, Homo sapiens; identical to SEQ ID NO: 642

SEQ ID NO: 7165 - protein, 81 aa, Homo sapiens; identical to SEQ ID NO: 643

SEQ ID NO: 7166 - protein, 81 aa, Homo sapiens; identical to SEQ ID NO: 644

SEQ ID NO: 7167 - protein, 81 aa, Homo sapiens; identical to SEQ ID NO: 645

SEQ ID NO: 7168 - protein, 81 aa, Macaca fascicularis
AEGSVMFSDVSIDFSQEEWDCLDPVQRDLYRDVMLENYSNLVSMGLYTPKPQVISLLEQGKEPWMVGRELTRGLCSDLESM

SEQ ID NO: 7169 - protein, 81 aa, Mus musculus
SQVSVTFEDVAVLFTRDEWKKLVPSQRSLYREVMLENYSNLASLGFPFTKPKMISVLQQGEEPWKSEKESHGCSPLGCHGS

SEQ ID NO: 7170 - protein, 81 aa, Homo sapiens; identical to SEQ ID NO: 646

SEQ ID NO: 7171 - protein, 81 aa, Homo sapiens; identical to SEQ ID NO: 647

SEQ ID NO: 7172 - protein, 81 aa, Pongo abelii
MVTFEDVAVHFTKTEWTGLSPAQRALYRSVMLENFGNLTALGYPVPKPALISLLEGGDMAWGLEAQDDPPAETTKNVRKDV

SEQ ID NO: 7173 - protein, 81 aa, Mus musculus
SKGPVSFKDVTVDFTQEEWQRLDPAQKALYRDVMLENYCHFISVGFHITKPDMIRKLEQGEELWTERIFPSQSYLEEEEVL

SEQ ID NO: 7174 - protein, 81 aa, Homo sapiens; identical to SEQ ID NO: 648

SEQ ID NO: 7175 - protein, 81 aa, Homo sapiens; identical to SEQ ID NO: 649

SEQ ID NO: 7176 - protein, 81 aa, Homo sapiens; identical to SEQ ID NO: 650

SEQ ID NO: 7177 - protein, 81 aa, Homo sapiens; identical to SEQ ID NO: 651

SEQ ID NO: 7178 - protein, 81 aa, Macaca fascicularis
TQESLTLEDVAVEFSWEEWQLLDTAQKNLYRDVMVENYNHLVSLGYQTSKPDVLSKLAHGQEPWITVAKIQNKNCPGIGKA

SEQ ID NO: 7179 - protein, 81 aa, Homo sapiens; identical to SEQ ID NO: 652

SEQ ID NO: 7180 - protein, 81 aa, Homo sapiens; identical to SEQ ID NO: 653

SEQ ID NO: 7181 - protein, 81 aa, Homo sapiens; identical to SEQ ID NO: 654

SEQ ID NO: 7182 - protein, 81 aa, Homo sapiens; identical to SEQ ID NO: 655

SEQ ID NO: 7183 - protein, 81 aa, Homo sapiens; identical to SEQ ID NO: 656

SEQ ID NO: 7184 - protein, 81 aa, Homo sapiens; identical to SEQ ID NO: 657

SEQ ID NO: 7185 - protein, 81 aa, Rattus norvegicus
LRTTVRYEDVAVSFTQEEWEYLTSTQKTLYQKVMSETFKNLTFVESKKKPQEPNPNLKDKDDDKSSTCTGVFKGGPFFFCL

SEQ ID NO: 7186 - protein, 81 aa, Homo sapiens; identical to SEQ ID NO: 658

SEQ ID NO: 7187 - protein, 81 aa, Homo sapiens; identical to SEQ ID NO: 659

SEQ ID NO: 7188 - protein, 81 aa, Pongo abelii
AQESLTLEDVAVDFTWEEWQFLSPAQKDLYRDVMLENYSNLVAVGFQASKQDALSKLERGEETCTTEDEIYSRICFEIRKI

SEQ ID NO: 7189 - protein, 81 aa, Rattus norvegicus
YQELVSFDDVIVDFTQEEWTSLNPDQRTLYREVMLENYKNLATVGYQLIKPSVISWLEQEEFSTGQKIVFPEWKIQLETQC

SEQ ID NO: 7190 - protein, 81 aa, Homo sapiens; identical to SEQ ID NO: 660

SEQ ID NO: 7191 - protein, 81 aa, Homo sapiens; identical to SEQ ID NO: 661

SEQ ID NO: 7192 - protein, 81 aa, Homo sapiens; identical to SEQ ID NO: 662

SEQ ID NO: 7193 - protein, 81 aa, Homo sapiens; identical to SEQ ID NO: 663

SEQ ID NO: 7194 - protein, 81 aa, Mus musculus
MDVTIDFSREEWQHLDPAQRSLYRDVVQETYSHLRSVEELQQIGDQKKTYQQIGHKSASDMVFITKTLGAESCHDYSGVRK

SEQ ID NO: 7195 - protein, 81 aa, Homo sapiens; identical to SEQ ID NO: 664

SEQ ID NO: 7196 - protein, 81 aa, Mus musculus
PQESVTFKDVAVNFTQEEWHHVGPAQRSLYRDVMLENYNHLVSLGYQVSKPEVIFKLEQGEEPWISEKEIQRPFCPDWKTR

SEQ ID NO: 7197 - protein, 81 aa, Homo sapiens; identical to SEQ ID NO: 665

SEQ ID NO: 7198 - protein, 81 aa, Homo sapiens; identical to SEQ ID NO: 666

SEQ ID NO: 7199 - protein, 81 aa, Homo sapiens; identical to SEQ ID NO: 667

SEQ ID NO: 7200 - protein, 81 aa, Homo sapiens; identical to SEQ ID NO: 668

SEQ ID NO: 7201 - protein, 81 aa, Homo sapiens; identical to SEQ ID NO: 669

SEQ ID NO: 7202 - protein, 81 aa, Homo sapiens; identical to SEQ ID NO: 670

SEQ ID NO: 7203 - protein, 81 aa, Homo sapiens; identical to SEQ ID NO: 671

SEQ ID NO: 7204 - protein, 81 aa, Macaca fascicularis
DGLVTFRDVAIDFSQEEWECLDPAQRDLYVDVMLENYSNLVSLDLESTTYETKKIFSEKDIFEINFSQWEMKEKSKTLGLE

SEQ ID NO: 7205 - protein, 81 aa, Homo sapiens; identical to SEQ ID NO: 672

SEQ ID NO: 7206 - protein, 81 aa, Homo sapiens; identical to SEQ ID NO: 673

SEQ ID NO: 7207 - protein, 81 aa, Homo sapiens; identical to SEQ ID NO: 674

SEQ ID NO: 7208 - protein, 81 aa, Homo sapiens; identical to SEQ ID NO: 675

SEQ ID NO: 7209 - protein, 81 aa, Homo sapiens; identical to SEQ ID NO: 676

SEQ ID NO: 7210 - protein, 81 aa, Gallus gallus
MEPYVLLDPRQKALYRDVMQESYETLMSIAQGLVNHKAAEEDAVGLKEDAVGSEEPQTHPPHNPAQNRTAGSHRRKAKRPD

SEQ ID NO: 7211 - protein, 81 aa, Mus musculus
PHESVKFEDVSLTFTEEEWAQLDFQQKCLYREIMMENYSNMISVEHHFSKPNVISQLEKAEDCWPMQREIPQDTLPECSWP

SEQ ID NO: 7212 - protein, 81 aa, Homo sapiens; identical to SEQ ID NO: 677

SEQ ID NO: 7213 - protein, 81 aa, Homo sapiens; identical to SEQ ID NO: 678

SEQ ID NO: 7214 - protein, 81 aa, Homo sapiens; identical to SEQ ID NO: 679

SEQ ID NO: 7215 - protein, 81 aa, Homo sapiens; identical to SEQ ID NO: 680

SEQ ID NO: 7216 - protein, 81 aa, Homo sapiens; identical to SEQ ID NO: 681

SEQ ID NO: 7217 - protein, 81 aa, Homo sapiens; identical to SEQ ID NO: 682

SEQ ID NO: 7218 - protein, 81 aa, Homo sapiens; identical to SEQ ID NO: 683

SEQ ID NO: 7219 - protein, 81 aa, Homo sapiens; identical to SEQ ID NO: 684

SEQ ID NO: 7220 - protein, 81 aa, Homo sapiens; identical to SEQ ID NO: 685

SEQ ID NO: 7221 - protein, 81 aa, Homo sapiens; identical to SEQ ID NO: 686

SEQ ID NO: 7222 - protein, 81 aa, Homo sapiens; identical to SEQ ID NO: 687

SEQ ID NO: 7223 - protein, 81 aa, Homo sapiens; identical to SEQ ID NO: 688

SEQ ID NO: 7224 - protein, 81 aa, Homo sapiens; identical to SEQ ID NO: 689

SEQ ID NO: 7225 - protein, 81 aa, Homo sapiens; identical to SEQ ID NO: 690

SEQ ID NO: 7226 - protein, 81 aa, Homo sapiens; identical to SEQ ID NO: 691

SEQ ID NO: 7227 - protein, 81 aa, Homo sapiens; identical to SEQ ID NO: 692

SEQ ID NO: 7228 - protein, 81 aa, Homo sapiens; identical to SEQ ID NO: 693

SEQ ID NO: 7229 - protein, 81 aa, Homo sapiens; identical to SEQ ID NO: 694

SEQ ID NO: 7230 - protein, 81 aa, Homo sapiens; identical to SEQ ID NO: 695

SEQ ID NO: 7231 - protein, 81 aa, Homo sapiens; identical to SEQ ID NO: 696

SEQ ID NO: 7232 - protein, 81 aa, Homo sapiens; identical to SEQ ID NO: 697

SEQ ID NO: 7233 - protein, 81 aa, Homo sapiens; identical to SEQ ID NO: 698

SEQ ID NO: 7234 - protein, 81 aa, Homo sapiens; identical to SEQ ID NO: 699

SEQ ID NO: 7235 - protein, 81 aa, Homo sapiens; identical to SEQ ID NO: 700

SEQ ID NO: 7236 - protein, 81 aa, Homo sapiens; identical to SEQ ID NO: 701

SEQ ID NO: 7237 - protein, 81 aa, Homo sapiens; identical to SEQ ID NO: 702

SEQ ID NO: 7238 - protein, 81 aa, Homo sapiens; identical to SEQ ID NO: 703

SEQ ID NO: 7239 - protein, 81 aa, Homo sapiens; identical to SEQ ID NO: 704

SEQ ID NO: 7240 - protein, 81 aa, Homo sapiens; identical to SEQ ID NO: 705

SEQ ID NO: 7241 - protein, 81 aa, Homo sapiens; identical to SEQ ID NO: 706

SEQ ID NO: 7242 - protein, 81 aa, Homo sapiens; identical to SEQ ID NO: 707

SEQ ID NO: 7243 - protein, 81 aa, Homo sapiens; identical to SEQ ID NO: 708

SEQ ID NO: 7244 - protein, 81 aa, Homo sapiens; identical to SEQ ID NO: 709

SEQ ID NO: 7245 - protein, 81 aa, Homo sapiens; identical to SEQ ID NO: 710

SEQ ID NO: 7246 - protein, 81 aa, Homo sapiens
ASFMDVFVDFTWEEWQLLDPAQKCLYRSVMLENYSNLVSLGYQHTKPDIIFKLEQGEELCMVQAQVPNQTCPILKAGKSKA

SEQ ID NO: 7247 - protein, 81 aa, Homo sapiens; identical to SEQ ID NO: 711

SEQ ID NO: 7248 - protein, 81 aa, Homo sapiens; identical to SEQ ID NO: 712

SEQ ID NO: 7249 - protein, 81 aa, Homo sapiens; identical to SEQ ID NO: 713

SEQ ID NO: 7250 - protein, 81 aa, Homo sapiens; identical to SEQ ID NO: 714

SEQ ID NO: 7251 - protein, 81 aa, Homo sapiens; identical to SEQ ID NO: 715

SEQ ID NO: 7252 - protein, 81 aa, Homo sapiens; identical to SEQ ID NO: 716

SEQ ID NO: 7253 - protein, 81 aa, Homo sapiens; identical to SEQ ID NO: 717

SEQ ID NO: 7254 - protein, 81 aa, Homo sapiens; identical to SEQ ID NO: 718

SEQ ID NO: 7255 - protein, 81 aa, Homo sapiens; identical to SEQ ID NO: 719

SEQ ID NO: 7256 - protein, 81 aa, Homo sapiens; identical to SEQ ID NO: 720

SEQ ID NO: 7257 - protein, 81 aa, Homo sapiens; identical to SEQ ID NO: 721

SEQ ID NO: 7258 - protein, 80 aa, Homo sapiens; identical to SEQ ID NO: 722

SEQ ID NO: 7259 - protein, 81 aa, Homo sapiens; identical to SEQ ID NO: 723

SEQ ID NO: 7260 - protein, 81 aa, Homo sapiens; identical to SEQ ID NO: 724

SEQ ID NO: 7261 - protein, 81 aa, Homo sapiens; identical to SEQ ID NO: 725

SEQ ID NO: 7262 - protein, 81 aa, Homo sapiens; identical to SEQ ID NO: 726

SEQ ID NO: 7263 - protein, 81 aa, Homo sapiens; identical to SEQ ID NO: 727

SEQ ID NO: 7264 - protein, 81 aa, Homo sapiens; identical to SEQ ID NO: 728

SEQ ID NO: 7265 - protein, 81 aa, Homo sapiens; identical to SEQ ID NO: 729

SEQ ID NO: 7266 - protein, 81 aa, Homo sapiens; identical to SEQ ID NO: 730

SEQ ID NO: 7267 - protein, 81 aa, Homo sapiens; identical to SEQ ID NO: 731

SEQ ID NO: 7268 - protein, 81 aa, Homo sapiens; identical to SEQ ID NO: 732

SEQ ID NO: 7269 - protein, 81 aa, Homo sapiens; identical to SEQ ID NO: 733

SEQ ID NO: 7270 - protein, 81 aa, Homo sapiens; identical to SEQ ID NO: 734

SEQ ID NO: 7271 - protein, 81 aa, Homo sapiens; identical to SEQ ID NO: 735

SEQ ID NO: 7272 - protein, 81 aa, Homo sapiens; identical to SEQ ID NO: 736

SEQ ID NO: 7273 - protein, 81 aa, Homo sapiens; identical to SEQ ID NO: 737

SEQ ID NO: 7274 - protein, 81 aa, Homo sapiens; identical to SEQ ID NO: 738

SEQ ID NO: 7275 - protein, 81 aa, Homo sapiens; identical to SEQ ID NO: 739

SEQ ID NO: 7276 - protein, 81 aa, Homo sapiens; identical to SEQ ID NO: 740

SEQ ID NO: 7277 - protein, 81 aa, Homo sapiens; identical to SEQ ID NO: 741

SEQ ID NO: 7278 - protein, 81 aa, Homo sapiens; identical to SEQ ID NO: 742

SEQ ID NO: 7279 - protein, 81 aa, Homo sapiens; identical to SEQ ID NO: 743

SEQ ID NO: 7280 - protein, 81 aa, Homo sapiens; identical to SEQ ID NO: 744

SEQ ID NO: 7281 - protein, 81 aa, Homo sapiens; identical to SEQ ID NO: 745

SEQ ID NO: 7282 - protein, 81 aa, Homo sapiens; identical to SEQ ID NO: 746

SEQ ID NO: 7283 - protein, 81 aa, Schistosoma margrebowiei
VDSSIIPILTYGLESIVLRKQDWTRLETVLNTIWRMILGTNDRKQLDVQQLKLKVNLPNLANKIMQTDQAYHIRRIKDQIT

SEQ ID NO: 7284 - protein, 81 aa, Homo sapiens; identical to SEQ ID NO: 747

SEQ ID NO: 7285 - protein, 81 aa, Homo sapiens; identical to SEQ ID NO: 748

SEQ ID NO: 7286 - protein, 81 aa, Homo sapiens; identical to SEQ ID NO: 749

SEQ ID NO: 7287 - protein, 81 aa, Homo sapiens; identical to SEQ ID NO: 750

SEQ ID NO: 7288 - protein, 81 aa, Homo sapiens; identical to SEQ ID NO: 751

SEQ ID NO: 7289 - protein, 81 aa, Homo sapiens; identical to SEQ ID NO: 752

SEQ ID NO: 7290 - protein, 81 aa, Homo sapiens; identical to SEQ ID NO: 753

SEQ ID NO: 7291 - protein, 81 aa, Homo sapiens; identical to SEQ ID NO: 754

SEQ ID NO: 7292 - protein, 81 aa, Homo sapiens; identical to SEQ ID NO: 755

SEQ ID NO: 7293 - protein, 81 aa, Homo sapiens; identical to SEQ ID NO: 756

SEQ ID NO: 7294 - protein, 81 aa, Homo sapiens; identical to SEQ ID NO: 757

SEQ ID NO: 7295 - protein, 81 aa, Homo sapiens; identical to SEQ ID NO: 758

SEQ ID NO: 7296 - protein, 81 aa, Homo sapiens; identical to SEQ ID NO: 759

SEQ ID NO: 7297 - protein, 81 aa, Homo sapiens; identical to SEQ ID NO: 760

SEQ ID NO: 7298 - protein, 81 aa, Homo sapiens; identical to SEQ ID NO: 761

SEQ ID NO: 7299 - protein, 81 aa, Homo sapiens; identical to SEQ ID NO: 762

SEQ ID NO: 7300 - protein, 81 aa, Homo sapiens; identical to SEQ ID NO: 763

SEQ ID NO: 7301 - protein, 81 aa, Homo sapiens; identical to SEQ ID NO: 764

SEQ ID NO: 7302 - protein, 81 aa, Homo sapiens; identical to SEQ ID NO: 765

SEQ ID NO: 7303 - protein, 81 aa, Homo sapiens; identical to SEQ ID NO: 766

SEQ ID NO: 7304 - protein, 81 aa, Homo sapiens; identical to SEQ ID NO: 767

SEQ ID NO: 7305 - protein, 81 aa, Homo sapiens; identical to SEQ ID NO: 768

SEQ ID NO: 7306 - protein, 81 aa, Homo sapiens; identical to SEQ ID NO: 769

SEQ ID NO: 7307 - protein, 81 aa, Homo sapiens; identical to SEQ ID NO: 770

SEQ ID NO: 7308 - protein, 81 aa, Homo sapiens; identical to SEQ ID NO: 771

SEQ ID NO: 7309 - protein, 81 aa, Homo sapiens; identical to SEQ ID NO: 772

SEQ ID NO: 7310 - protein, 81 aa, Homo sapiens; identical to SEQ ID NO: 773

SEQ ID NO: 7311 - protein, 81 aa, Homo sapiens; identical to SEQ ID NO: 774

SEQ ID NO: 7312 - protein, 81 aa, Homo sapiens; identical to SEQ ID NO: 775

SEQ ID NO: 7313 - protein, 81 aa, Homo sapiens; identical to SEQ ID NO: 776

SEQ ID NO: 7314 - protein, 81 aa, Homo sapiens; identical to SEQ ID NO: 777

SEQ ID NO: 7315 - protein, 81 aa, Homo sapiens; identical to SEQ ID NO: 778

SEQ ID NO: 7316 - protein, 80 aa, Homo sapiens; identical to SEQ ID NO: 779

SEQ ID NO: 7317 - protein, 81 aa, Homo sapiens; identical to SEQ ID NO: 780

SEQ ID NO: 7318 - protein, 81 aa, Homo sapiens; identical to SEQ ID NO: 781

SEQ ID NO: 7319 - protein, 81 aa, Homo sapiens; identical to SEQ ID NO: 782

SEQ ID NO: 7320 - protein, 81 aa, Homo sapiens; identical to SEQ ID NO: 783

SEQ ID NO: 7321 - protein, 81 aa, Homo sapiens; identical to SEQ ID NO: 784

SEQ ID NO: 7322 - protein, 81 aa, Homo sapiens; identical to SEQ ID NO: 785

SEQ ID NO: 7323 - protein, 81 aa, Homo sapiens; identical to SEQ ID NO: 786

SEQ ID NO: 7324 - protein, 81 aa, Homo sapiens; identical to SEQ ID NO: 787

SEQ ID NO: 7325 - protein, 81 aa, Homo sapiens; identical to SEQ ID NO: 788

SEQ ID NO: 7326 - protein, 81 aa, Homo sapiens; identical to SEQ ID NO: 789

SEQ ID NO: 7327 - protein, 81 aa, Homo sapiens; identical to SEQ ID NO: 790

SEQ ID NO: 7328 - protein, 81 aa, Homo sapiens; identical to SEQ ID NO: 791

SEQ ID NO: 7329 - protein, 81 aa, Homo sapiens; identical to SEQ ID NO: 792

SEQ ID NO: 7330 - protein, 81 aa, Homo sapiens; identical to SEQ ID NO: 793

SEQ ID NO: 7331 - protein, 81 aa, Homo sapiens; identical to SEQ ID NO: 794

SEQ ID NO: 7332 - protein, 81 aa, Homo sapiens
ALYRDVMLENYRNLVSLGICLPDLSVTSMLEQKRDPWTLQSEEKIANDPDGRECIKGVNTDSPLLQCITSVPCVFCTASMI

SEQ ID NO: 7333 - protein, 81 aa, Homo sapiens; identical to SEQ ID NO: 795

SEQ ID NO: 7334 - protein, 81 aa, Homo sapiens; identical to SEQ ID NO: 796

SEQ ID NO: 7335 - protein, 81 aa, Homo sapiens; identical to SEQ ID NO: 797

SEQ ID NO: 7336 - protein, 81 aa, Homo sapiens; identical to SEQ ID NO: 798

SEQ ID NO: 7337 - protein, 81 aa, Homo sapiens; identical to SEQ ID NO: 799

SEQ ID NO: 7338 - protein, 81 aa, Homo sapiens; identical to SEQ ID NO: 800

SEQ ID NO: 7339 - protein, 81 aa, Homo sapiens; identical to SEQ ID NO: 801

SEQ ID NO: 7340 - protein, 81 aa, Homo sapiens; identical to SEQ ID NO: 802

SEQ ID NO: 7341 - protein, 81 aa, Homo sapiens; identical to SEQ ID NO: 803

SEQ ID NO: 7342 - protein, 81 aa, Homo sapiens; identical to SEQ ID NO: 804

SEQ ID NO: 7343 - protein, 81 aa, Homo sapiens; identical to SEQ ID NO: 805

SEQ ID NO: 7344 - protein, 81 aa, Homo sapiens; identical to SEQ ID NO: 806

SEQ ID NO: 7345 - protein, 81 aa, Homo sapiens; identical to SEQ ID NO: 807

SEQ ID NO: 7346 - protein, 81 aa, Homo sapiens; identical to SEQ ID NO: 808

SEQ ID NO: 7347 - protein, 81 aa, Homo sapiens; identical to SEQ ID NO: 809

SEQ ID NO: 7348 - protein, 81 aa, Homo sapiens; identical to SEQ ID NO: 810

SEQ ID NO: 7349 - protein, 81 aa, Myotis brandtii
KPRAVKFADVAVYFSPEEWGCLRPAQRALYRDVMRENYGHLGALETRTRKKNGEEEVFPPKEAPRKGKRGRKPSKPRLIPR

SEQ ID NO: 7350 - protein, 81 aa, Myotis brandtii
SQGILSFSDVAVYFTWEEWRLLDTAQKNLYRDVMLENHSNLMSLGYQATKPEAMIYLEKGEERGIVERKFPNHFNPEIMWQ

SEQ ID NO: 7351 - protein, 81 aa, Propithecus coquereli
VSFEDVAVDFTWEEWQLLNPTQKNLYRDVMLENYSHLVFLEVWLDNKSKMLHQDNQDKLKSMESSHEYDVFGRIFNSSMNF

SEQ ID NO: 7352 - protein, 81 aa, Vombatus ursinus
MLENYKNFVSLGFPVFKPDVISQLERGEGPWTSETEISQVVCPDPIIQKTRCENLDWIQKQDISLGESSKEIIRKNYPWSC

SEQ ID NO: 7353 - protein, 81 aa, Propithecus coquereli
IQGQVNFEDVFVYFSQDEWQLLDEAQRLLYRDVMLENFVLMASLGQASSMSHVIASLEQGSEPWVPDWVDVTPAIARGTLG

SEQ ID NO: 7354 - protein, 81 aa, Propithecus coquereli
MLENYKNLATVGCQLFKPSLISWLEQAESRTGQRGVLHASEWKVQLKTKESALQQDFLWEPTSSGIHMTGSHNGAELNESK

SEQ ID NO: 7355 - protein, 81 aa, Saimiri boliviensis
VLGPLTFKDVAIEFSQEEWRCLDPAQRTLYRDVMLENYRNLVSLGVGLPDLSVVSMLEQKREPWTLQSEEKIAWNPDGREC

SEQ ID NO: 7356 - protein, 81 aa, Propithecus coquereli
MLTFRDVTIEFSLEEWECLNPAQQNLYRDVMLEYYGNLISLCLAVSKQDLITCLEKRKEPWNVKKPETVVEHPAISSDSTQ

SEQ ID NO: 7357 - protein, 81 aa, Propithecus coquereli
PVPPQASVCLEDVAVTFTQEEWRQLDLAQRMLYCDVTLETCGHLVSLGLLLSKPEVISQLERDDLCRVGQPPPRGCRGYRA

SEQ ID NO: 7358 - protein, 81 aa, Vombatus ursinus
MLENYWHLVFLGLPVSKPELISQLECGGGPWMPLEEEPRNPHADQNSSPKTKKTVLKQGILVGKSSQERLSRDHRKDFKFG

SEQ ID NO: 7359 - protein, 81 aa, Lynx pardinus
LPEVLLTFRDVTIDFSQEEWECLDPAQRALYREVMLENYRNLVSLGVDKVRPDVGICPRTEPRGLEGKMKIVRKPNISVRS

SEQ ID NO: 7360 - protein, 81 aa, Balaenoptera acutorostrata
CWGLSSFKDISMEFTWEEWQLLDSAQKHLYRDVTLENYSNLVSLGYHGTKPDLIFKLEQGEEPWIINAEVSRQSGPGGLSC

SEQ ID NO: 7361 - protein, 81 aa, Balaenoptera acutorostrata
QGHVIFEDVAVSFSQEEWGLLNDAQRLLYCDVMLENLSLIASLGCWHGVEVEEAVSEQCVSVEHVTEDRNPKLEPSILKPL

SEQ ID NO: 7362 - protein, 81 aa, Vombatus ursinus
GARGSVRFADVAVYFSPEEWGRLRPAQRALYRDVVQVTYRCLGDFQSPKPVLISWMQQETEMWGLEAQDSEEKRNCSRTCR

SEQ ID NO: 7363 - protein, 81 aa, Balaenoptera acutorostrata
GLLTFKDVAITFSQEEWECLDPAQRALYRDVMLETYRNLLSLGSLSAGFAIKELSPREDINKGELYHLVILDRNENHGIKD

SEQ ID NO: 7364 - protein, 81 aa, Saimiri boliviensis
YQTPVSFQDVVVGFTQEEWHWLNPTQRALYRDVMLETYSNLVSVGYEGTKPDVILRLEQEEAPWIGEAACLGCHCWGISKL

SEQ ID NO: 7365 - protein, 81 aa, Balaenoptera acutorostrata
AQGKVNFEDVFVYFSQEEWGLLDEAQRLLYREVMLENFALMASLGCSHGMEEEEIHFEQSVSVKGVSQVTIPKTILSSQKA

SEQ ID NO: 7366 - protein, 81 aa, Vombatus ursinus
MLENYRDVVSLGFPFSKPTGISRREEEPWGLNHQGPLDLEGGKSTCTEGDNVTENEESTLKQEIFVESEAHSSSSEGLQKD

SEQ ID NO: 7367 - protein, 81 aa, Saimiri boliviensis
SVTFEDVAVNFSLEEWNLLNEAQRCLYRDVMLETLTLISSLGAPPHTLFPARACGPEAPPSRHCPRPSLCLSLSPLHPTGV

SEQ ID NO: 7368 - protein, 81 aa, Saimiri boliviensis
VQEPVTFKDVAVDFTQEEWGQLDLVQRTLYRDVMLETYGHLLSVGNQIAKPEVISLLEQGEEPWSLEQTCPQRACPEWMRN

SEQ ID NO: 7369 - protein, 81 aa, Saimiri boliviensis
FQGSISFKDVTVGFTQEEWQRLDRGQRALYRDVMLENYSNLVSVGYCVHKPEVIFRLEQGEEPWRLEEEFPSQSFPEVWTA

SEQ ID NO: 7370 - protein, 81 aa, Vombatus ursinus
SQKLLTFQDVAVDFTREEWGLLEPAQKDLFRDVMLESYENFVSLGLPDSKEDVISQLEKTEEPGPPEGEVVPGNTYTDFLH

SEQ ID NO: 7371 - protein, 81 aa, Vombatus ursinus
DHESLTFRDVAVDFTHEEWRQLDPGQRYLYKDVMLENYRNLVSVGKCVCKPDLISQLEQGKEPWIVEREIPRGTFPGEDCK

SEQ ID NO: 7372 - protein, 81 aa, Saimiri boliviensis
NDVAIEFSLEEWQCLDKTQQNLYRDVMLENYRNLIFLGIAVSKPDLVTCLKQGKEPWNMRRHEMVTKPPAMCSHFTQDVRP

SEQ ID NO: 7373 - protein, 81 aa, Vombatus ursinus
PGELVMTAELLPSRPQADMIFEDVAVYLSQEEWSCLGPAQRGLYRDVMLENYGNIVSLGKTLLSVPISELFGFVNSHGGLK

SEQ ID NO: 7374 - protein, 81 aa, Balaenoptera acutorostrata
SLDSVSFTDIAIDFSQDEWEWLNLAQRTLYKKVMLENYRNLASLGLCISKPDVISFLEQDKEPWMMKGEITRGLHPDLEFV

SEQ ID NO: 7375 - protein, 81 aa, Balaenoptera acutorostrata
GQLTLNDVVITFSQEEWKCLDPAQRALYRDVMLETYRNLIFVAISHIHVIKKLQLKSNTDRGGVFQTLMLGRHENQGIKHF

SEQ ID NO: 7376 - protein, 81 aa, Saimiri boliviensis
EQVTFEDVVVDFTKEEWGQLAPAQKTLYCDVMLDTFRLLVAVGHWLPKPNIISLLEQEAELAVDPGVPQGVYQDLESRPKV

SEQ ID NO: 7377 - protein, 81 aa, Cervus elaphus
DPEQVTFEDVVVDFTQEEWGHLEPAQRTLYRDVMLETFGLLVSVGHWLPKPDVISLLEQEAELWAADEGGPQGVCPDLETR

SEQ ID NO: 7378 - protein, 81 aa, Colobus angolensis
HQEVVTFEDVAVHFTKTEWTGLSPAQRALYRSVMLENFGNLTALGYPVPKPALISLLEGGDMAWGLEAQDDPPAERTKNIC

SEQ ID NO: 7379 - protein, 81 aa, Colobus angolensis
DSLVFEEVAVNFTPEEWALLDHAQRSLYRDVMLETCRNLASLDCCIYVRTSGSSSQRDVLGNGISNDEEIVKFTSDYWSIF

SEQ ID NO: 7380 - protein, 81 aa, Colobus angolensis
RRGHLTFRDVAIEFSQEEWKCLNLAQRTLYREVMLENYRNLVFLGICLPDLSIISMLEQRRDPRNLQSEVKIANNPDGREC

SEQ ID NO: 7381 - protein, 81 aa, Colobus angolensis
QEMPLTFQDVAVYFSQAEGQQLGPQQRALYRDVMLENYGNVASLGFPVPKPELISQLEQGKELWVLNLLGAEEPEILKSCQ

SEQ ID NO: 7382 - protein, 81 aa, Colobus angolensis
GTVAFEDVAVNFSQEEWSLLSEVQRCLYHDVMLENWVLISSLGYWCGSEDEEAPSKRNISIQRVWSLHLSVQAGVSRSQLT

SEQ ID NO: 7383 - protein, 81 aa, Tupaia chinensis
LQTLVTFQDVLVDFSREEWKLLDTAQQLMYRDVMLENYRNLLSLGHRLPKPDMILQLEKADLETASEFEPSVSSKHITKDQ

SEQ ID NO: 7384 - protein, 81 aa, Odobenus rosmarus
SQHLVTFEDVAVNFTQEEWTLLDQTQRDLYRDVMLENYQNLIILGYESCKPDLTSSMGGAEELRTGGRGILQELDLQLKTK

SEQ ID NO: 7385 - protein, 81 aa, Odobenus rosmarus
TARSQASVTFKDVAMDFTPEEWGKLDPAQREVMLENYRNLVSLWLPVSKPENYSLENGKEPLMLERKAPKSSYSDLETKPE

SEQ ID NO: 7386 - protein, 81 aa, Cucumis melo var. makuwa
ETTNLPVGGSFIDLPRELFQMLATAGPYLYRDTILLQKVCRVLRGYYTSAIEFVNSVESGQNPELVMPAGNRVPHLHLKEA

SEQ ID NO: 7387 - protein, 81 aa, Firmicutes bacterium
AKVSLLTHKKTISRKVKEWLYAINLERNLSKNEILERYLNYIFFGHGVYGVEAAAQLYFGKHIWELELHQFALLAGLIRSP

SEQ ID NO: 7388 - protein, 81 aa, Homo sapiens; identical to SEQ ID NO: 811

SEQ ID NO: 7389 - protein, 81 aa, Homo sapiens; identical to SEQ ID NO: 812

SEQ ID NO: 7390 - protein, 81 aa, Homo sapiens; identical to SEQ ID NO: 813

SEQ ID NO: 7391 - protein, 81 aa, Homo sapiens; identical to SEQ ID NO: 814

SEQ ID NO: 7392 - protein, 81 aa, Homo sapiens; identical to SEQ ID NO: 815

SEQ ID NO: 7393 - protein, 81 aa, Homo sapiens; identical to SEQ ID NO: 816

SEQ ID NO: 7394 - protein, 81 aa, Homo sapiens; identical to SEQ ID NO: 817

SEQ ID NO: 7395 - protein, 81 aa, Homo sapiens; identical to SEQ ID NO: 818

SEQ ID NO: 7396 - protein, 81 aa, Homo sapiens; identical to SEQ ID NO: 819

SEQ ID NO: 7397 - protein, 81 aa, Homo sapiens; identical to SEQ ID NO: 820

SEQ ID NO: 7398 - protein, 81 aa, Arthrobotrys oligospora
NMKLLRFLYDANIFLLQSWQSIDEAPLQIYSSALIFSPKASVIRKIFQNCIPKWISRWPEPPEPWKATLKLELNTLDPSAL

SEQ ID NO: 7399 - protein, 81 aa, Nitrospiraceae bacterium
QCVLVVDEAFIDFRPEESVIDHVQDNPYLIVLRSMTKFYALTGLRIGYGVFHPDLISRIIYFKEPWTVNNLAQKAAITALE

SEQ ID NO: 7400 - protein, 81 aa, Nodularia spumigena UHCC 0039
YAYGMEEADVALQLLDAGWKILDVPSLAVYHDTQLEHHNTVAINSSHISNTALLAYLRYPISAWPLGMMQVLNRVRYAASV

SEQ ID NO: 7401 - protein, 81 aa, Gordonia sp.
VDEAFADITIDPATGRPEPESVAHRSHPDLIVIRSVTKTFGLAGLRAGYLLAAPEVIARLTVGRRPWPLGTLALTALTACV

SEQ ID NO: 7402 - protein, 81 aa, Alteromonadaceae bacterium
QLQTYTFKKLALEYVEKRSKEFKTEQQVRKLTKMLENYAYPVIGGMRVGDIDLNAVKSMLDEIWLTKNETANRLRIYVGHI

SEQ ID NO: 7403 - protein, 81 aa, Magnetospirillum moscoviense
RLPTGTLDRLVAFTAEELAALESATRLFERDNREDEAAELATLGAKLRALLKPDVARRVEPDLEALLEAEGLAMRPGPRPR

SEQ ID NO: 7404 - protein, 81 aa, Arthroderma gypseum
SSEISEFIQDAKQFTLKNRQMVDTAPLQLYNSGLVFAPRTAVTRKFFEMDFPKWLSRLPNVEETWSAHIQALEGHGHWVTS

SEQ ID NO: 7405 - protein, 81 aa, Chloroflexi bacterium
GGVLVLDEAFVDFVEDGWDSVELARSGRVLALRSLTKAFALAGLRLGYALGRPELLERLRAHQPPWSVNAFAVAAGVACAV

SEQ ID NO: 7406 - protein, 81 aa, Rattus norvegicus
SKGPLSFKDVAVAFSQEEWQQLDSEERTTYRDVMLETYSNLVSVGYDVTKPNVIIKLEQGEEPWTVEGDRHAKRHLEIKKV

SEQ ID NO: 7407 - protein, 81 aa, Rattus norvegicus
PKVTVSFEDVSVYFTKTEWKLLDLKQRNLYKQVMLENYSHLVSVGFAFSKPNLVSQLEKGEKPWIRDGGMESAAGSCTGNR

SEQ ID NO: 7408 - protein, 81 aa, Rattus norvegicus
MEDMLSFWDVAIYFSGEEWEYLGPAQWNLYRDVTLENYNNLVFLGLASSKPYLVTFLEQIEEPLVVKKGEVTTMYSGKSEG

SEQ ID NO: 7409 - protein, 81 aa, Mus musculus
AQCLLTFKDVFLDFSSEEWECLNFAQRTLYMDVMLENYNNLLFVENHCICGNYEKEKVLEQETQHIVNEHGHNRKKSSKCN

SEQ ID NO: 7410 - protein, 81 aa, Mus musculus
MDLVTYDDVHVNFTQEEWALLHPSQKSLYKGVMLETYRNLTAIGYIWEEHTIEDHFQTSRSHGRHERSCSAEQPPEFIQCG

SEQ ID NO: 7411 - protein, 81 aa, Rattus norvegicus
GSVSFEDVAVDFSWDEWQHLDVAQRRLYRDVMLENYSSLLFLGRCMTKPEVIFKLEHGFGPRPVVDSSVRSLPGQKKVTAP

SEQ ID NO: 7412 - protein, 81 aa, Rattus norvegicus
KPELVSFADVAVYFSPQEWGCLRPAQRALYREVMRETYGLLGALGFPGPKPALISWMEQESEAWSPAAQDPEEGESLGGAP

SEQ ID NO: 7413 - protein, 81 aa, Rattus norvegicus
MLENYSHLVSLGYPITKPEVISSLEQGILGIIKKEIPSSNCTEDGQAEYNLAWNQKKQNMPLEQTISVIEKNVTEERSYEC

SEQ ID NO: 7414 - protein, 81 aa, Rattus norvegicus
LQGFLTFKDVAPEFTLEEWESLNYAQRALYMDVILETYNNLLSVENHLIRGKHGKVLEQYTECIVHEHVNIQKKFCKWDEI

SEQ ID NO: 7415 - protein, 81 aa, Rattus norvegicus
MLSFWDVAIYFSGEEWEYLGPAQWNLYRDVTLENYNNLVFLGLASSKPYLVTLLEQRQELSDVKRQVANSKYSGAKGYMCK

SEQ ID NO: 7416 - protein, 81 aa, Mus musculus
LQEAVTFNDVAIDFSPEEWDWLNPAQRSLYRTVVLENYRNLVSVGACISKPSLISLLEHGKEPWEVKGQVTGSRVQGGKSV

SEQ ID NO: 7417 - protein, 81 aa, Mus musculus
PQGLLTFKDVALVFSLEEWECLSFAQRTLYMEVMLENYNNLLFVENHCIHGKNGKVLDQDSQYIVHEHMNIQEKSSKWDKL

SEQ ID NO: 7418 - protein, 81 aa, Rattus norvegicus
GKDLLTFEDVSVDFTQEEWQQLSDTQRDLYRKVTLENYRSLVSLGIPIYKPVVISLLEQGKDPWMVQKKGARDTCPDWEYV

SEQ ID NO: 7419 - protein, 81 aa, Dipodomys ordii
SLKLMSFDDVAVYFTWKEWQDLDTSQRTLHRDVMLETYRNLRSLGHCVPKPELIVKLEQGAEPWIRETSDKNFTDVPVMED

SEQ ID NO: 7420 - protein, 81 aa, Dipodomys ordii
SLRLVSFEDVAVDFSWEEWQDLDNAQRTLYRDVMLETYSSLVSLGHCVPKPEAIIKLEQGAEPWVGEPSGQSFADVQQVDD

SEQ ID NO: 7421 - protein, 81 aa, Dipodomys ordii
LEGLVSFEDVAVDFSLEEWQDLDSAQRTLYKDVMMETYSNLVFLGHCVPKPEVIVKLEQGTEPWMGGASDKNFSDVPQVDH

SEQ ID NO: 7422 - protein, 81 aa, Dipodomys ordii
EAPEPPTLEDVAVVFSWEEWRLLRPAQKDLYRDVMLENYRSLLAVGGGAGRPGALSTLLRGGPWTAGGDPHRGSRADAGAA

SEQ ID NO: 7423 - protein, 81 aa, Dipodomys ordii
APLPLTFEDVAIYFSEQEWQHLQTWQKMLYKHVMKTNYETLVSLDGDLSKPELILWIEHGREPFKSWEETQKLDSIMHSSA

SEQ ID NO: 7424 - protein, 81 aa, Rattus norvegicus
MLENYSHFVSLGLAISKPSVISLLEQGKEPWRVEQAGWYPDLLSVNEAKNLSLKHGIFGKESLKWKVTERVGSSCLEESRF

SEQ ID NO: 7425 - protein, 81 aa, Rattus norvegicus
GCVTIEDVTVYFSQEEWKLLDEAQRLLYLDVMLENFTLISSLVYRYEAEAEEKTCAQSLSQTEAPQVRTPKQGQLRQKPHP

SEQ ID NO: 7426 - protein, 81 aa, Rattus norvegicus
AMESVSFEDIAVYFTWEEWQVLDVAQKLLYRDVMLENYSSLVSLGCCVIKPELILMLEREFGPWRVADTSIWNLPGYCITR

SEQ ID NO: 7427 - protein, 81 aa, Rattus norvegicus
TWVPALFDEVAIYFSDEEWEVLTEQQKALYREVMRMNYETVLSLEFPFPKPDMINRLEREEECPESDEWRLQGVTFAENEE

SEQ ID NO: 7428 - protein, 81 aa, Mus musculus
MLENYSNLVFLGLAFSKPYLVTFLEQSSDPWSMKRKESAAIHLGSKPHKCKECGKAFDRNSVLIQHQRIHTGERPYKCEEC

SEQ ID NO: 7429 - protein, 81 aa, Rattus norvegicus
YQDSVTFDDVAVEFTPDEWTLLDLTQKNLYREVMLENYENLTSVGCQFFIPSLTPWLKQEELGVAESALPQQLELQPTIDD

SEQ ID NO: 7430 - protein, 81 aa, Mus musculus
LSFADSASLHEGRPLLLPSSFRESVTFKDVVVNFTQEEWKHLDPIQRDLFRDVTLENYTHLVSIDRFLFFLPLSRAPGFQT

SEQ ID NO: 7431 - protein, 81 aa, Mus musculus
VCGSVTFRDVAVDFSQEEWACLDATQKVLYRNIMLETYSNLVAVVGRCISKPDLIVLLEQEKEPWMAVKEETDRPSPDVET

SEQ ID NO: 7432 - protein, 81 aa, Mus musculus
YREVMFENYHNVVSLAGCFISKPDVISLLEQGKEPWKVVRQRKPCPDSETKDETNQVFSENGIYEMNLSQWKIMERVGNSG

SEQ ID NO: 7433 - protein, 81 aa, Mus musculus
MLSFRDVAIDFSAEEWECLEPAQWHLYRDVMLENYSHLVFLELADSKPQLVTFLEQRQQSTGVKRQEVIQTPAGKCGEGIR

SEQ ID NO: 7434 - protein, 81 aa, Octodon degus
VQGCVTFEDVTIYFSQEEWGLLDEAQRLLYYTVMLENFALIASLGLTSFRCHDIGECEMRREPNRVDMTSAMARGAFGKAD

SEQ ID NO: 7435 - protein, 81 aa, Octodon degus
QVPISFKDLAVRFSEEEWRLLEEGQREFYRDVMRENYETLVSVGTAELLPLSAFLLPTEPGGTAGAGSRTEDGQELPVGGG

SEQ ID NO: 7436 - protein, 81 aa, Octodon degus
SPVLVSFEDVVVDFTCEEWQDLDDAQRTLYKDVMLETYRSLVLLGHCITKPAVIFKLEQGAEPWMREESPHLSSPDVQKVD

SEQ ID NO: 7437 - protein, 81 aa, Octodon degus
VDSVDFEDVAVQFTFEEWALLDPSQKRLYRDVMRETIRNLAAVGRNWKDWNIEDDDQNVRRNLRSYVVKRPRESKASLQCR

SEQ ID NO: 7438 - protein, 81 aa, Octodon degus
QQGCVTLEDVTIYFSQEEWGLLNEAQRLLYCNVMLENFALIASLGLTSFKCHISAQLEMRRELWGPGRVNMTSAVARRAFG

SEQ ID NO: 7439 - protein, 81 aa, Octodon degus
MDLVTFKDVAVHFTQEDWALLDPFQKNLYRDVMEETVSNLASVGIKLEDLNIEEVYQSPDENLRSHMVVILWARVEDGQCA

SEQ ID NO: 7440 - protein, 81 aa, Octodon degus
AHGAVTFADVAVEFSQEEWACLDTAQRDLYWDVMLDNYSNLVSLDLESAHTDRNSAVEKSFDKMNLQRRNALGRSKSCPAD

SEQ ID NO: 7441 - protein, 81 aa, Octodon degus
MALLTFRDVVIDFCLEEWKCLDLAQRTLYRDVTLENYRNIFSLGLAVSKPHLVTCLEQNRDPWNVQPRNRAAAPPAFVKSH

SEQ ID NO: 7442 - protein, 81 aa, Octodon degus
RRGLVTIKDVSLCFSQEEWRSLDPSQTDFYGEYVMQENCGIVVSLRFPIPKLDMLSQVGGGEEQWVPDSQDFEERDILRVT

SEQ ID NO: 7443 - protein, 81 aa, Octodon degus
PQEPILFEDLAVYFSQEECVSLHAAERSLSREFTQECFKDVALMGGETNTDVNEQLSLEPMEIEKVSLENHSTATPLVSYP

SEQ ID NO: 7444 - protein, 81 aa, Octodon degus
HAQGSVTFGDVAVDFSWEEWKLLDETQRLLYLDVMLENIALVASLGLISSRIHVVQLEVGEQTQVPDTADFTPVVSKDTGS

SEQ ID NO: 7445 - protein, 81 aa, Octodon degus
EAVTLEDVLVNFTLEEWAVLNPSQKKLYQDVMWETFMNVTAIGGTWDNQQTEDGCISSPRNLRNDEVFKFCQYKAWNQHEK

SEQ ID NO: 7446 - protein, 81 aa, Fukomys damarensis
VFDISVTLREKWLWVFAEETPAAQTRRPRGLARRSNSLDLSLSGHSIAKPDIITLLEQGREPWMVLREETRRECTDLESSY

SEQ ID NO: 7447 - protein, 81 aa, Fukomys damarensis
QGSVSFEDVAVDFTQEEWNRLDPTQRILYRDVMLENYSHLVSLGYPITKPDVIASLEKGVLGIIKREIPSSSCSEDGQAED

SEQ ID NO: 7448 - protein, 81 aa, Fukomys damarensis
MQEWALLDPSQKKLYRDVMWENFKNVAAIGRNWDDQQIEDEYRNYRKNRRSEEVDECCQFKLWYERGEKVFMTPNTNVHMK

SEQ ID NO: 7449 - protein, 81 aa, unidentified marine metagenome
LERNLIEKDIVLEKEQKKWETRAEERQSKYRQQVREMESKLVELGDAIKEKDKISMTEQEKRDNVLEKKQEQYFSRERQLQ

SEQ ID NO: 7450 - protein, 81 aa, Terrapene carolina
FQMPVTFEEVAVYFTQGQGALLDPAQRALYRDVMQENYETVTSLGKGFLSPQILEAVGSACLNLVMFFPCQLDQRGMGSIM

SEQ ID NO: 7451 - protein, 80 aa, Terrapene carolina
MTMTFEEVAVYFTQGQGALLDPAQRALYRDVMRENYETVTSLGFPLPKPDLITRLERGEEPWVPNLQACEERENPRGTHT

SEQ ID NO: 7452 - protein, 81 aa, Terrapene carolina
VTFEEVAVYFTERQGALLDPAQRALYRDVMQENYETVTSLGFPLPKPDLISRLERGEEPWVPDLQACISKCPQFLPYLTQG

SEQ ID NO: 7453 - protein, 81 aa, Aptenodytes forsteri
PKAPAAFESNAAYFSAQEWENLEEWQRELYKNVLRGNNESLISLDDAISKPDLLSRLQRGEAPCNGDGAASREIPAEPNYG

SEQ ID NO: 7454 - protein, 81 aa, Paroedura picta
TPGQVTFEDVAVYFTESEWALLDPGQRALYYEVMRENHANMASLGTGFVKDEDNLRPEDATQAESNEMFIGPHGIFQHPKM

SEQ ID NO: 7455 - protein, 81 aa, Latimeria chalumnae
MEKTFADIEIFFTEDIWDELQDWEKEVYRDIKEHYDTLVSFGYNVPKPDFMCKVEETCRVPAYKPSAREKEFSLPALAESN

SEQ ID NO: 7456 - protein, 81 aa, Terrapene carolina
FQGLVTFEEVAVYFTREEGALLDPTQRALYRDVMQENYETVVLLGKEVCGKSAPDRFDLSHTYFGLFIAFSIPLAEISFLS

SEQ ID NO: 7457 - protein, 81 aa, Terrapene carolina
GPVSFEEVAVYFTAGQGALLDPAQRALYRDIMQENYENVTSLGKVSFKGYSIPTIFTCTSLHITVTSLPSCSQSSTADTHA

SEQ ID NO: 7458 - protein, 81 aa, Terrapene carolina
INGPVTFEEVAVYFTREEWALLDLTQRALYRDVMQENYETVVFLVGFPISKPDVISQLERGEEPWLHSQLKPCLTSENPHG

SEQ ID NO: 7459 - protein, 81 aa, Terrapene carolina
GDPQGSAVCFTEGQGALLDPAQRALYRDVMQENYEMVTSLDKGFPKQSGEGAVRVGKVKAQSGWAEGPWIGIRCRGWARVP

SEQ ID NO: 7460 - protein, 81 aa, Terrapene carolina
TKGPVTFEEVAVYFTREEGALLDPTQRALYRDVMQENYETVVFLVGFPISKPDVISQLERGEKPWVLDLQVTYVWILSVSH

SEQ ID NO: 7461 - protein, 81 aa, Terrapene carolina
AGELVTLEEVAVYFTEEEWALLDPGQRALYTAVMRENFETVTSLGFLISKPEVISWLERGEEPWVPDLQGYEEREIPRDAH

SEQ ID NO: 7462 - protein, 81 aa, Terrapene carolina
MPFMTDALNPPCTLIWSDFIPCAGFPIPKPELIAQLERGEEPWVPDLQACKEREILRGTRTGAERGSENEEGNHHEEVEPQ

SEQ ID NO: 7463 - protein, 81 aa, Terrapene carolina
MFPFSWVPHSPAEHRDRFHSQNVLYDRCSLNPPCTLICLISPPPPGFPIPKPELISHLERGEEPWMPDFRACEERESLRCA

SEQ ID NO: 7464 - protein, 81 aa, Terrapene carolina
LVTDALSYPSCTLISSDFPPCAGFPIPKPELISHLERGEELWVPDLQACKEREIPRGARTGAERGSENVEGNHHQEVPGEV

SEQ ID NO: 7465 - protein, 81 aa, Terrapene carolina
ELPFYWPCSPINSVIITGAAGTDWEITLFQGPVTFEEVAVHFTKEVWALLDPAQRALYRDVMQENYENMAWLGKNSCPISY

SEQ ID NO: 7466 - protein, 81 aa, Terrapene carolina
AGFPVSRPDVSSQLERGEEPLVPDLQSSEDREGICTAGDGTVSETREQNSKEEDTEQVELYRASSQRAKGNVPGNCEQGEG

SEQ ID NO: 7467 - protein, 81 aa, Terrapene carolina
MPVTFEEVAVYFTQGQGALLDPAQRALYRDVMQDNYETVTSLGKGFLSPRLLEAEGQCVGLWLSSSLVRSEGNVLCNAQLP

SEQ ID NO: 7468 - protein, 81 aa, Terrapene carolina
LQVPVTFEDVAIYFSREEWEMLAEWQKELYRDVMKEHYDNLISLGHAGTKPDVLSWIEQGGEPWVVDQKEERERLECSSLE

SEQ ID NO: 7469 - protein, 81 aa, Terrapene carolina
VGLLLFQRPVTFEEVALYFTKEEWALLDPTQRALYGDVMQENYENLTQGTLLECLRRNAGVQSEEHKTHSGMFLVLPSGDQ

SEQ ID NO: 7470 - protein, 81 aa, Lithobates catesbeianus
PITVPPTHCLITKRTVEKILEVTKKIIELLTGEVPIRCQDVTVYFSMEEWEYLEGHKDHYKDVMMEDQQMSTLLGKRRLGF

SEQ ID NO: 7471 - protein, 81 aa, Terrapene carolina
SSPVNGRVVTGQQVLSVGLLLFQRPVTFEEVALYFTKEEWALLDPAQRALYGDVMQENYENVTSLGKDSCPLIWEQSKTWG

SEQ ID NO: 7472 - protein, 81 aa, Lithobates catesbeianus
VPIRCQDVSAHFSMEEWEYLEGHKDLYKNVMIDNKPPLTSPDGSSNGNPPERCPRLLYSQDSTQEGHTIPHHHQSGNLRDS

SEQ ID NO: 7473 - protein, 81 aa, Terrapene carolina
PSGLVTFEEVAVYFTREEGALLDPTQRALYRDVMQENYETVVLLGFPVSKPDVISQLERGEEPWVPDLQGSEKEVLPRAAC

SEQ ID NO: 7474 - protein, 81 aa, Terrapene carolina
SGGPVTFEEVAVYFTREEGALLDPTQRALYRDVMQENYETVVFLVGFPISKPDVISQLERGEKPWVLDLQGSEKEVTTWNV

SEQ ID NO: 7475 - protein, 81 aa, Terrapene carolina
MSVTFEDVAMYFSPAEWVLLGEEQKQLYRHVMWENYQTLVSLGIQISKPVVISSIERGEELWAQSPTEDEDEDILSGTSPG

SEQ ID NO: 7476 - protein, 81 aa, Terrapene carolina
FQMPVTFEEVAVYFSEDEWALLDEKQKELYRDVMQENYETLLSLGFPIAKPDVLSQIERGEEPWFPDLQDLGEFTSYLSGS

SEQ ID NO: 7477 - protein, 81 aa, Lithobates catesbeianus
PIRCQDVTVYFSMEEWEYLEGHKDLYKDIMMENQQLLNYVNMKKNLHKRILLLTLEIVCLLTGEDCTVVMKSSIENIIRSR

SEQ ID NO: 7478 - protein, 81 aa, Terrapene carolina
AGFPVYKPYVISQLEGGEEPWVPDLQGSEESEILRSPCTSEETLNQPRNCDGVVRENKEQNPHQEDAQLAEAHGALLRRSK

SEQ ID NO: 7479 - protein, 81 aa, Lithobates catesbeianus
GQISSHSPISVPSLSFLTPERNTDKKILEVTQNIIEVLTGEVPIRHQDVTVYFSMEEWEYIEGHQYLYKDVMMENRPPLTS

SEQ ID NO: 7480 - protein, 81 aa, Terrapene carolina
MRRSGVGAVTHAQRQRSPAAELQPPGFPVSKPDVISQLERGEEPWVTDLHDSEKKVLPRAACAGVGMVSENEENPQQEDAE

SEQ ID NO: 7481 - protein, 81 aa, Podarcis muralis
MLENERNMASRALPLPKTSLIPSAEQAEEPRTPQYQISDGTGAAILDTSSAGNSRRKHFCPECGQCFAFGLALARHQRIHT

SEQ ID NO: 7482 - protein, 81 aa, Podarcis muralis
LTLVTFEDVAIYFCREEWAELIPWQKELYRGVMVENYEAVLSVGKYTAVLWNSVRWWGGRGHGGWSSGPTLVSFAEPISYS

SEQ ID NO: 7483 - protein, 81 aa, Podarcis muralis
WLVCFEDVAVRFTDEEWALLDPDQRALHKDVMEENRGIVASLGKAPCGIVISAWKYKKYLYVTNLIYFHRAQQRPLQHLGT

SEQ ID NO: 7484 - protein, 81 aa, Paroedura picta
VQEVLSSFKVCLGKSFFCSRFFCCCRKYGREAAVLETDQEPVTFEEVAVRFTEGEWALLDPHQKALYRDVMQENYENITSV

SEQ ID NO: 7485 - protein, 81 aa, Paroedura picta
VSFQEVAVFFTWEEWTLLDPAQKALYWEVMRENYEAVASLGDAQDPEKWGQPGEVSSEGDEDLQEEPWDQDGPLRKPKRKR

SEQ ID NO: 7486 - protein, 81 aa, Terrapene carolina
GQAVPVTFEEVAVYFTQGQGALLDPAQRALYRDVMQENYETVTSLGTPSEGITIPLTSPEVCFPQAVSVTMFPSSWIPHSP

SEQ ID NO: 7487 - protein, 81 aa, Terrapene carolina
PLPAPRPRAPWGTPGWGLERMLQVAFEDVALYFTREEWELLSQPEKQVYRDQMLRNYRVLVSLGKYKISHPLLTPTGRNLL

SEQ ID NO: 7488 - protein, 81 aa, Lithobates catesbeianus
VPIRCQDVTVSFSMEEWEYLEGHKDLYKDVMIENRPPLTSPDGSSNRNTPESSPSPLHSWDSTQEQLKVPYENQAEHQNNV

SEQ ID NO: 7489 - protein, 81 aa, Terrapene carolina
ACMPVTFEEVAVYFTQGQGALLDPAQRALYRDVMQENYKIVTSLGFPIPKPELISRLERGEEPWVPDLHEKEEGNHNEEVP

SEQ ID NO: 7490 - protein, 81 aa, Gopherus agassizii
GQGPVSFEDVAVYFTQGQGALLDPTQRALYRDIMQENYETVTSLGKRFPSPRLLEAVGSVMFPFLVFLNQLDFRAMSPMVT

SEQ ID NO: 7491 - protein, 81 aa, Gopherus agassizii
GPVTFEEVAVYFTREEWALLDPAQRALYRHVMQENYKNVTSLGKDSHPLTVGPRFPGLRGKRDPERQLHDKDLVRSLGSGW

SEQ ID NO: 7492 - protein, 81 aa, Gopherus agassizii
LTFEEVAVYFTQEQGALLDPAQKDLYRDVMRENYEAVTSLGKRFPSPQLVEAVQRFNGTVWSRASTGTELVNHLREQVSVQ

SEQ ID NO: 7493 - protein, 81 aa, Podarcis muralis
VCFEDVAVHFTDEEWALLDLDQRALHKEVMEENCGIVASLSKAPLWIITSLWKFHTYLSVISLPDFEGALQGHLHLTSQEI

SEQ ID NO: 7494 - protein, 81 aa, Podarcis muralis
SSVYFEDVSVCFTAEEWALLDPAQRALHKEVMEETWRTMISLEFIRERSPITAWSVERASVSAPVSLLIEEFIQGRNHISA

SEQ ID NO: 7495 - protein, 81 aa, Podarcis muralis
QDMVTFEDVAVSFSPEEWEMMEDWQRELHWEVMMENYRMLISLGNDLYLLSSSGMFWNTSDEENVPAEPQRGPAMGSPETS

SEQ ID NO: 7496 - protein, 81 aa, Podarcis muralis
SGETLGGGEREGMVSQGCSLSFEDVAVPFPGEEWVLLDPDQRALHQGELWDHESLDCCIGLDGESHLLQVSAMQDIQQKNS

SEQ ID NO: 7497 - protein, 81 aa, Alligator sinensis
RKLEEAFEDVAVYFTRKEWELLGDEDKVLYQDQMLRNYHTLVSLGYRGPTPELICRIQQKEVEIWVWNDEDPGESSWSEDL

SEQ ID NO: 7498 - protein, 81 aa, Alligator sinensis
TQLREAFEDVALYFTRKEWELLGDGDKALYRDQMLRNYQALVSLGYEGPIPDLICRIQRGEVELWVCDDYDPGESVQSEGV

SEQ ID NO: 7499 - protein, 81 aa, Alligator sinensis
AGSAQGPVTFREVALYFTDPSQRALYREAMQENHESGSLPGTGSPVPQPEAVSQLKLEENPWVQDLQGCEVREIPSSACTD

SEQ ID NO: 7500 - protein, 81 aa, Alligator sinensis
MRENYDVLMALGSPITKPELVPQIEHAEEPCVQAQGQAEEQEAPGCVNPGSIVPKPEVFPLGEQEQQQQRGGQQRGPEEGN

SEQ ID NO: 7501 - protein, 81 aa, Gopherus agassizii
LVPVTFEDVAVYFSREEWGLLDDMQRTFYRDVMKENYQTVVSLPGSSIPKPDVISQMERGEEPWVPDLQKLGPHQTPENPL

SEQ ID NO: 7502 - protein, 81 aa, Gopherus agassizii
FQGPVTFKEVAMYFTREEGALLDPTQRALYRDVMHENYETVTSLGFPISKPDVILQLERGEEPWIRDLQSSEKEVLLRAAF

SEQ ID NO: 7503 - protein, 81 aa, Gopherus agassizii
TTRPVTFEEVAVYFTRDEWALLDSTQRVLCWDVMQENYENVTSLGKESCPPRFLEGEMQGEGSHHPTMPPLLCPVSASPRR

SEQ ID NO: 7504 - protein, 81 aa, Gopherus agassizii
FQMLVTFEEVAVYFTQGQGALLDPAQRTLYRNVMQENYETVTSLGFAVPKPDLIAQLERGEEPWVPDLQAAEERESQRGTH

SEQ ID NO: 7505 - protein, 81 aa, Gopherus agassizii
PVIFEEVAVKLTRKEWTLLDPTQRALYWDVMQENYKDVTSLGKGSCPSVLGRGNEELRLTPAPRCPLCSVLFQHHPNMPVT

SEQ ID NO: 7506 - protein, 81 aa, Gopherus agassizii
HRPVTFEEVAVYFTREEWALLDPTERALYRDVMQENYENVTSLGKDSHACSGNFQGPYECRECGKTFSQISTLSVHQRIHT

SEQ ID NO: 7507 - protein, 81 aa, Gopherus agassizii
GPVTLEEVAVYFTREEWALLDPTQRALYRDVMQENYENVTSLGKGSCPLCSWKGKRREMEGGLPGEVEKRANCQRLEGRRH

SEQ ID NO: 7508 - protein, 81 aa, Gopherus agassizii
FQGLVTFEEVAVYFTREEWALLDPAQRALYRDVMQENYENVTSLGFPVSKPDVISQLEQKDEPWVSNLHASEEREIPKGAC

SEQ ID NO: 7509 - protein, 81 aa, Gopherus agassizii
LQVAFEDVALYFTREEWELLSQREKHLYRDQMLRNYWALVSLGKDQLRFFLTAVKCLGSLHTSASVIIIKSLLIYTPASEG

SEQ ID NO: 7510 - protein, 81 aa, Gallirallus okinawae
RWQKDLYRAVMRGNYEMLISLGCAVPKPDTLSQLQRGEDEELCVKPSQEPLQMGVREGLESPLTQREAGLESLQPPKETDS

SEQ ID NO: 7511 - protein, 81 aa, Taeniopygia guttata
NFWILRLPPGAKGEVPKEWKSLNEWQKELYRHIMKGNYEAVISMDAAISKPDLLTRIEQGEDPNCFGKCPLPRCFFWMILF

SEQ ID NO: 7512 - protein, 81 aa, Podarcis muralis
ECSGEDVAVCFTDKGWTLLDPDQRAQHKEVKEETRGIVDSLGKAPCWIITWKNKGEHNRIHIAEKSYKYSERGENIRQSSH

SEQ ID NO: 7513 - protein, 81 aa, Podarcis muralis
RLVSFEEVAVYFSKGEWDLLGPCQRALYKEVMLENYANVMFLANQRDKSSSEPLETGQHKAEEEMFGHQRRGNRLEGYRLK

SEQ ID NO: 7514 - protein, 81 aa, Podarcis muralis
TARSQGPVCFEDVAVCFTDEEWALLDPDQRALHKDVMKENCGILASLGKAPCGIVISAWKFKKYLYGTNLIYFHRVQQHPP

SEQ ID NO: 7515 - protein, 81 aa, Alligator sinensis
MEPVTFEMLAVYFTKEQWALLDPAQTALYKEVMLENYATVASLGFLISKPSLISRLEQGEELWVQAWQNYKEREIPGDSSP

SEQ ID NO: 7516 - protein, 81 aa, Alligator sinensis
MLRNYQALVSLAGYRGPAPDLICRIQRGQVELWVRDDEDRGEMRKSEDVLPGHAWLLSRPEEQAPEEGPGKLKPPWASLRS

SEQ ID NO: 7517 - protein, 81 aa, Gopherus agassizii
MPVTFEEVAVYFTEGQGALLDPAQRALYRDVMQEIYEMVISLGFLLPKPDVIIQLERGEEPWVPDLQGSAEREMSRGTCAG

SEQ ID NO: 7518 - protein, 81 aa, Gopherus agassizii
WSRPVTFEEVAVYFTQGQGALLDPGQRTLYRDVMWENYETVTSLGKGTPVPSVITKFWDYKSPGRETLSLPPGWGTIHSEI

SEQ ID NO: 7519 - protein, 81 aa, Gopherus agassizii
FQGPVTFEEVAVYFTREEWALLDPVQRALYRDVMQENYEMVVLLGFPISKPDVISQLERGEEPWVADLQDLKVSCPLIGPL

SEQ ID NO: 7520 - protein, 81 aa, Gopherus agassizii
AGPEVWTLVAVYFTREEWALLDPVQRALYRDVMQENYETVTSLGKEQENDCHPGEAHGMLSGRSKENKPYTCTECGKSFNW

SEQ ID NO: 7521 - protein, 81 aa, Gopherus agassizii
KLGPVTFEEVAVYFTKEEWALLDPSQRALYRDIMQENYEMVTSLGFPIPKPDVISQLERGEEPWVLEEGTFRACFFQSSQK

SEQ ID NO: 7522 - protein, 81 aa, Gopherus agassizii
FQGLVTFEEVAVYFTREEWALLDPAQRALYRDVMQENYENVTSLAGFPVSKPDVISQLEQKDEPWVSNLHASEEREIPKGA

SEQ ID NO: 7523 - protein, 81 aa, Gopherus agassizii
MSVMFEDVAMYFSPAEWALLGEEQRQLYRHVMWENYQTLVSLGEDASQRHRLSPNIHSTILQSHSPSLKPKSSDPGQLQLF

SEQ ID NO: 7524 - protein, 81 aa, Taeniopygia guttata
KAPAVALENDATGFSTQEWENLEEWQKELYGKVLTGKREALVQLDDVISEPALLSRLQGGEAPCSEAEAAPGEIPAEPESL

SEQ ID NO: 7525 - protein, 81 aa, Podarcis muralis
PPLVPNPQSAIPAGTKWYSLVDLCSAKEEWALLDPDQRALHKEVMEENRGIMASLGKAPSWMIISALKFQREREREREIAN

SEQ ID NO: 7526 - protein, 81 aa, Podarcis muralis
PASPQCNFSFQDLVTFEEVAVHFTQEEWALLDPGQRALHREVMEENYEIVTSLGKDAPTPPPPPDTPTVWISLFSPLYIHI

SEQ ID NO: 7527 - protein, 81 aa, Podarcis muralis
MEPWVYLDPRQRALYRDVMQESYETLMSLAADKLLNSNNNEEEEEEEDDEEEEDEGPEELRPGTSQSTPRRVKPVVRRAPP

SEQ ID NO: 7528 - protein, 81 aa, Podarcis muralis
GRKQPGNQEGKTAQSRRSGRGGRMSVCFEDVAVRFTDEEWELLDPDQRALHKDVMEENWGIVASLGKAPLNQVFSSAAVIM

SEQ ID NO: 7529 - protein, 81 aa, Podarcis muralis
GLVSFDEVSVHFTNEEWALLDPGQRALYEEVMEEIREMMTSVGDVSEFLTEGEQSEPSREGAEEQKEQRKQRVQVGTYRKE

SEQ ID NO: 7530 - protein, 81 aa, Podarcis muralis
YSVSFEDVAVCFTAEEWALLDPAQRALHKEVMEETWRTMISLGKVPCWVIISVLEFSRYFSGTNLPYLDGSQRCHLECQGF

SEQ ID NO: 7531 - protein, 81 aa, Podarcis muralis
LTTDGVCFEDVAFHFTHKDWALLDPDQRALQEEVKGVKCGILDSLVRLPAGSSDQFLNSIQISAGQTSAILREPNSASYSV

SEQ ID NO: 7532 - protein, 81 aa, Podarcis muralis
FQSSVSFEDVTVCFTAEEWALLDPAQRALHKEVTEENRGILASLSFILIKGKGSLFYLPISFCWYCFFFPSLGVYHSGSCG

SEQ ID NO: 7533 - protein, 81 aa, Taeniopygia guttata
MRGNYETLVSLDYAVSKPDILSQMERDEELSDKEGQEPPWTQTGDGQEPLRAAEERDKADEAPGDETPMEAAPDGAESTPN

SEQ ID NO: 7534 - protein, 81 aa, Phasianus colchicus
SQEPVSFAEVAVYFSREEWALLDPAQRALYRDVMLETYQCVASLAPLPVPKPAVITLLEGGADPWIPDVCSPEEMAGELSP

SEQ ID NO: 7535 - protein, 81 aa, Podarcis muralis
AQVPVAFEDVVVYFSREEWAQLAEWQKELYQDVMAENYELVSSLECLLSIPELLSRLARGEAPHPAADPPPSAGNADSPAD

SEQ ID NO: 7536 - protein, 81 aa, Podarcis muralis
SSRGCDLSELRLLVAMEQYVLLDPRQKALYHDVMQESYETLMALEFPLSKPDLLSRLEQGDEATTFDLQDPSVILPAISGN

SEQ ID NO: 7537 - protein, 81 aa, Podarcis muralis
GPVCFEDVAVCFTDEEWAFLDPDQRALHKDVMEENCGIVASLDKAPCGIIISAWKFTELNSAPYNPWEPNTPTINSKLQFF

SEQ ID NO: 7538 - protein, 81 aa, Podarcis muralis
LCFEDVAVHFTDEEWVLLDPDQRALHKEVMEENREVMDSLSKTPSCFIISVLILKNQAEGLLGSGTCPVERPPTSCQREKQ

SEQ ID NO: 7539 - protein, 81 aa, Podarcis muralis
LGPVTFEDVTVHFTEEEWALLDPGQRALHREVMEENYRNLASLGDQKESSQENEPQRIKTEAEENVRKDAVVPDGASFNEI

SEQ ID NO: 7540 - protein, 81 aa, Alligator sinensis
AELQKAFEDVAVYFTRKEWALLEDEDKLLYRDQMLRNYQALVFMGHRGPTPDLISRIQQGDAELWVSDGEDSGESSWSEGP

SEQ ID NO: 7541 - protein, 81 aa, Alligator sinensis
LQLREVFEDVAVYFTREEWELLDDDDKVLYQEQMVKNYQALVSLGYRGPTPDLICSIQQGRVDLWTCADEDCGEMSRWEDL

SEQ ID NO: 7542 - protein, 81 aa, Alligator sinensis
AQFQEAFEDLALFFTRKEWELLGDGDKVLYRDQMLRNYQALVSLGYQGPTPDLICRIQRGEVELWVCDDEDSGESASSEGL

SEQ ID NO: 7543 - protein, 81 aa, Alligator sinensis
SKLLEAFEEVAGYFTQEEWELLETGDKGLYQDQMLRNYRALVSLGYQGPTPDLICRIQQGEMELWICDEEAGENLFSEDLT

SEQ ID NO: 7544 - protein, 81 aa, Paroedura picta
VTLEEVSVHFTEEEWALLNPDQRMLYQEVMEDNRQNVAFLGKAASPLSCDSQVLKGEMAPSKKDIVGEWSGSGSHADKRDV

SEQ ID NO: 7545 - protein, 81 aa, Paroedura picta
TQSWVSFEEVAVYFTPGEWALLRPAQRALYKRVMLENFGHLASLGPVTGKPDLISWLEEEEEEEPLLQGCDQVGRSAGSCP

SEQ ID NO: 7546 - protein, 81 aa, Paroedura picta
PVSFEEVVVSFNAEEWALLDPGQRALHREVMVENYGIVASLGDGWNKEAKDDRPGMPRGRGRLQPSGTQRQKTEINALPEP

SEQ ID NO: 7547 - protein, 81 aa, Gopherus agassizii
MPYAGFLVSKPDVISQLEQGEEPWVSDLQGNQPGEKLGKRISSQGTQKDLKETTTRQEIITGKRKNTCIECGKNVCDYSAL

SEQ ID NO: 7548 - protein, 81 aa, Gopherus agassizii
MSVTFEDVAMYFSPAEWALLGEEQRQLYRHVMWENYQTLVSSGEELLMISSIERGEDLCVAYRTLTFSTSPALGPLGVWPL

SEQ ID NO: 7549 - protein, 81 aa, Taeniopygia guttata
HGVPVLFEDVAVRFSRQEWANLSEGQKEMYRSVMEDCALSKPELLLQLEREELSTPPESEAEAAEVSPELAVEPARQNCTS

SEQ ID NO: 7550 - protein, 81 aa, Phasianus colchicus
GRKPLGLEFLSSEPVSFADVATYFSREEWALLDPVQRVLYQDVMLETYECVGFAAFPSLWIETKQPNVNVEEIIPVQFLKV

SEQ ID NO: 7551 - protein, 81 aa, Podarcis muralis
RLGRDRACACFSEQEWRSLDEGQKDLYRHIMKCNYKAVVSMGKEGSTWRGQAELSVMGDLEESEIPGDPAMSKLERPKWGV

SEQ ID NO: 7552 - protein, 81 aa, Podarcis muralis
GSVSFDEVSVRFSNEEWALLDPGQRALYEEVMEEIREMMTSVGDVSEFLTEGEQSELSREGAEEQKEQRKQRVQVGTYRNE

SEQ ID NO: 7553 - protein, 81 aa, Podarcis muralis
RSGVCFEDVAVRFTDEEWALLDPDQRALHKDVMEENRGIVASLGKAPCGIVISAWKYKKYLYGPTSYIFTELNSAPATPGT

SEQ ID NO: 7554 - protein, 81 aa, Gopherus agassizii
WNGPVTFEEVAVYFTREEGALLDPAQRALYRDVMQENYENVTSLAGFPVSKPDVISQLERGEEPWVPDLQELIPSSLLFWG

SEQ ID NO: 7555 - protein, 81 aa, Gopherus agassizii
PVTFEEVAVYFTQGQGALLNPAQRALYRDVMWENYETVTSLGKGFPSPRLLESEKLLGNHPRNKLDESIKCGVGYKDPTTQ

SEQ ID NO: 7556 - protein, 81 aa, Gopherus agassizii
VTFEEVALYFTEGQGALLDPGQRALYGDIMQENYETVTSLAYALFSLSAISLSVFSTREGKPQQECPEQVELQGSILRRAD

SEQ ID NO: 7557 - protein, 81 aa, Gopherus agassizii
LEGPVTFEDVAVYFTREEWALLDPTQRALYRAIMQENYENVTSLGFPVSKPDVISQLEQGEEPWVPDLQGSEEREILRVPL

SEQ ID NO: 7558 - protein, 81 aa, Gopherus agassizii
IPEDMSFEEVAVYFTQAQGALLDPTQRALYKDVMVENYETVTSLGKGFLSPQILEAVGEVKPCSASGITHRRKTAQVLGLW

SEQ ID NO: 7559 - protein, 81 aa, Gopherus agassizii
CGWGMTFEEVAVHFTREEGVLLDPTPRARYRDTMQENNETVTLLGFPIPKPDLIAWLEGWEEPCVPDLQWGRIAQWFEHWP

SEQ ID NO: 7560 - protein, 81 aa, Gopherus agassizii
FQGPVTFEEVAVYFTKDEWALLDSVQRTLHRDVMQENCETVTLLGFPISKPDVISQLERGEEPWVPELQGSEKEVLPRAAF

SEQ ID NO: 7561 - protein, 81 aa, Gopherus agassizii
SEGLEQMRLYLRVPVTFDDVSVYFNEQEWENLDEWQKELYKNVMKGNYETLISLGKDRLGHLGIWGKNQYLVLLVKAGDRI

SEQ ID NO: 7562 - protein, 81 aa, Alligator sinensis
LELQEVFEDVAVCFTRKEWELLEDDDKVLYRDQMLKNYQALASLGYRGPTPDLICRIQQGEVELWVCEDEDGGEIPRSEDL

SEQ ID NO: 7563 - protein, 81 aa, Alligator sinensis
MLRGWRLPWRWPNLAMEPYVLLDPRQRALYRDVMQESYETLMALEFPISKPDLLSRLDHGDEPTALDLHVPKGARAAEGAT

SEQ ID NO: 7564 - protein, 81 aa, Alligator sinensis
MELREAFEDVAVYFTRKEWELLEDEDKELYRDLMLRNYQALVSLGYQGPTPGLICRIKQREVELWVCDDEHHGESSVSENL

SEQ ID NO: 7565 - protein, 81 aa, Alligator sinensis
QSLVPVTLEDVALDFSLEWVELAAWQQDLYWDVMRENHTLVASLGYPALEPALFSHAERGEEPGAGEQLDPAGADIPWDPC

SEQ ID NO: 7566 - protein, 81 aa, Alligator sinensis
LQVCVSFEEVAVYFTKEQWALLDPSQRALYRGVMLENYEAVTSLGFPVPNTSLISWLEQGEELWVTDLQDSKEWEIPRNTC

SEQ ID NO: 7567 - protein, 81 aa, Alligator sinensis
LELREVFQDVAVYFTRKEWELLEDEDKGIYQDQMLRNFQALVSLGHRGPTPDLICRIQRGLVELWVCDDEDGGEISRSEEL

SEQ ID NO: 7568 - protein, 81 aa, Alligator sinensis
MELREAFEDVAVYFTREEWELLEDAQKGLYRDQMLTNCRALVSLGYRGPMPDLILCMQRGQEELWVSDEKDHGDISRLEDL

SEQ ID NO: 7569 - protein, 81 aa, Alligator sinensis
LQLREVFEDVAVYFTREEWELLDDEDKVLYRDQMLKNHQALVSVGYRGPTPDLICSIQQEQVELWVCDDEDRGEISRWEDL

SEQ ID NO: 7570 - protein, 81 aa, Alligator sinensis
MQENYETLISLAEEMAISLPRITALAESHRRGLVSAGFPISKPDLLSWMDRGDEPWVPDLQASEGTEIPRDASPAGDGSAS

SEQ ID NO: 7571 - protein, 81 aa, Alligator sinensis
PQVPVTFDDVSVYFSEEEWESLAGWQKELYKNVMKGNYETLVSLDYAISKPDLLSRIERGETPCIGEQVDGEVPVEPSTVV

SEQ ID NO: 7572 - protein, 81 aa, Gopherus agassizii
GGPVTFEEVAVYFTREEGALLDPTQRALYKDVMQENYETVTSLGKGSCPLGAPSLPTEGLDGMRTGPALGKWHLGRTCILV

SEQ ID NO: 7573 - protein, 81 aa, Gopherus agassizii
SLFVPTPWCFQDALSSWGWDSVDCSPPTVLSVGCLLFQGPEEWALLDPAQRALYRAIMQENYENVTSLGKDSCPLCSWKGK

SEQ ID NO: 7574 - protein, 81 aa, Gopherus agassizii
MAGPVTFEEVAVYFTREEGALLDPAQRALYRDVMQENYENVASLGKDSRPLEDAMVSEDEEQNPQQEDGEHMEAHGGLSQG

SEQ ID NO: 7575 - protein, 81 aa, Gopherus agassizii
FQGPVTFEEVAVYFTREEWALLDPAQRALYRDVMQENYENMTLLGLPISKSDVISQLEKGEEPWVPDLQESEEQEILRGAC

SEQ ID NO: 7576 - protein, 81 aa, Gopherus agassizii
VYFTQGQGALLDPAQRALYRDVMQENYEMVTSLGKRFPSPWLLEVLPKSLRLRPHSIWEVGFPAQGDLHALDREKPYKCLV

SEQ ID NO: 7577 - protein, 81 aa, Gopherus agassizii
FQIPVTFEEVAVYFTQGQGALLDPAQRALYRDVMQENYETVTSLGFPIPKPDLIARLERGEEPWVLDLQASDESVSLRGTC

SEQ ID NO: 7578 - protein, 81 aa, Gopherus agassizii
FQMPVTFEEVAVYFTQGQGALLDPAQRALYRDVMQENYETRLLRNYSREQMDEFIICGEGYRDPTAQQTTPKEDKHHEWFG

SEQ ID NO: 7579 - protein, 81 aa, Gopherus agassizii
MSGLVSFEEVAVYFTAGQGALLDPAQRALYRDVMQENYENVSSLGCPASKPDVISQLERGEEPWIPDLQGCEEGEIPRGAC

SEQ ID NO: 7580 - protein, 81 aa, Gallirallus okinawae
MQEPVTFEDVAVYLSRAEWDAMAEGQRELYRSVMLDNYNLLTSLGYSGPKPDLLHRLERGEEPWVCTPQSPGRWDGPDSPS

SEQ ID NO: 7581 - protein, 81 aa, Phasianus colchicus
FPCFVLGTHFAQVAVYFSREEWALLDPAQRALYRDVMLETYQCVASLGEAPELVLASRHQPWRAEPSPCKQPLCSCITRCH

SEQ ID NO: 7582 - protein, 81 aa, Phasianus colchicus
GWGFAQVAVYFSREEWALLDPAQRALYRDVMLETYQFLISPVSLIEAPLPAPKPMVISLLEGGEDPWIPDARSSGALLGDL

SEQ ID NO: 7583 - protein, 81 aa, Phasianus colchicus
GRKGEVPKVPVTFDDVSVYFNDKEWEKLEEWQKELYKNVMKGNYESLISLGAHQEPEWAQQRGQHCGKQPGAAGTPGGDCW

SEQ ID NO: 7584 - protein, 81 aa, Gopherus agassizii
FQGRVTFEEVAVYFTREEWALLDPAQRALYWDVMQENYETVVLLGFPISKPDVISQLERGEEPWCPSIKREIKTTQETTDQ

SEQ ID NO: 7585 - protein, 81 aa, Podarcis muralis
EVTFEDVTVSFSREEWSMLDGWQKDLHQEVMLENFTLLLSVGKAWCATVALVERATLPPYFGVAPVSRRIQRKAEHPHHYI

SEQ ID NO: 7586 - protein, 81 aa, Podarcis muralis
SVSFKEVTVNFTDEEWALLDPGQRALYGEVMLEILPPETAEEQRKLGVQDGTSTQEGRQMQKAGSESAASQVYGNQITREE

SEQ ID NO: 7587 - protein, 81 aa, Alligator sinensis
PKVPVTFDDVSVYFNEKEWEKLEEWQKELYRNVMRSNYESLISLDYAISKPGALSQVEQGRESSIGDQQDLEEREIITDPS

SEQ ID NO: 7588 - protein, 81 aa, Alligator sinensis
AAGSAQGPVTFREVALYFTDPSQRALYREAMQENHESGSLPGSPVPQPEAVSQLKLEENPWVQDLQGCEVREIPSSACTDE

SEQ ID NO: 7589 - protein, 81 aa, Alligator sinensis
TELREAFEDVAVYFTREEWGLLEDAQKGLYRDQMLRNCRALIFLGYRGPAPDLIHRMQRGQEELWVSDDEDCGDISRSEGL

SEQ ID NO: 7590 - protein, 81 aa, Alligator sinensis
LELWEVFEDVAVYFTLKEWELLDDDNKALYQDQMLKNYQALVSLGYQGPTPDLICSIQEGQVELWVCDGEDHGEISRSEDL

SEQ ID NO: 7591 - protein, 81 aa, Alligator sinensis
VVLLEAFEDVAVYFTQKEWALLDDGDKALYRDQMLRNYQALISLGYRGPTPALINRIQRGEMELWVCDKDYGEKSSLEGLF

SEQ ID NO: 7592 - protein, 81 aa, Alligator sinensis
GGGPGRFEEVALRFTRAEWRLLGDGDKALYRDQMLRIYEALVCLGYQGPTPDLIGRIQRGEMELWVCDESPGENSWSEGHL

SEQ ID NO: 7593 - protein, 81 aa, Alligator sinensis
PKVPVMFNDASFNFSEQEWKNLNEWQKELYRHIMKGNYEAVISLDAAISKPDLLSRIEQGDDPSDGDQGDFEGRETPRDPN

SEQ ID NO: 7594 - protein, 81 aa, Alligator sinensis
SKLLEAFEDVAVYFTREEWELLEASDKGLYQDQMLRNYQALVSLGYRGPTPDLICRIQQGEMELWIRDDEEARESSLSEDL

SEQ ID NO: 7595 - protein, 81 aa, Paroedura picta
RLQPRAKRDAEAAAAAAMPRRPAPVTFEDVAVYFTEGQWALLDPEQRALYKEVMQENYSSLASLGKGPSQCTSWIYGFLQV

SEQ ID NO: 7596 - protein, 81 aa, Paroedura picta
TLLNRRPGRDVGRAVVLPVQSPVSFEEVAVDFTEAEWALLDLGQRALYREVMLENYRSVAFLRDHQGDEEEEELHHLSPGE

SEQ ID NO: 7597 - protein, 81 aa, Paroedura picta
CPFSFEEVAVRFTEAEWALLDPGQRALCEEVMLENHENLAFLARSMRETVAETDNGLASEERLESFSRGSQEHISFPDVLA

SEQ ID NO: 7598 - protein, 81 aa, Paroedura picta
VQGPVFFEEVAVHFSPGEWSLLHPAQRALYKEVMLENFGNMASLGPGMAKPDLISWLEGEEELFSPFSGEEEGLAAKRMRR

SEQ ID NO: 7599 - protein, 81 aa, Paroedura picta
GPFSFGEVAVSFTEAEWALLDPGQRALYKEVMLENYGDLAFLAEDDQGNEESAKFGQQFPDGVKTKDFKDKVVNQGASKGS

SEQ ID NO: 7600 - protein, 81 aa, Paroedura picta
GPFYFEEVAVSFTEAEWALLDPGQRALCEEVMLENYGDFSFLEARSIRETLVETDNGLASEEKLEKYSRASQEHISFPSEL

SEQ ID NO: 7601 - protein, 81 aa, Paroedura picta
FSLEDVSVSFSPAEWALLDPAQRALWREVMRENAENVAFLARSIGETLVEANNDPVSEGRLERSSGGAEEQISFPNGLAKR

SEQ ID NO: 7602 - protein, 81 aa, Paroedura picta
SGPPVSFEEVAVFFTREEWALLDPAQRALYWEVMQENYETAASLGLCVPGPFLDSGQHARDTPFRQSSEKSGRCAVNSFSG

SEQ ID NO: 7603 - protein, 81 aa, Paroedura picta
MENYELVTSLGYPVLKPDLLSRIERAGEPCLGDQLDSARGIPQDPCPGYRFFKPEGLSWIERWEELGIADRQKVEEGKLCT

SEQ ID NO: 7604 - protein, 81 aa, Paroedura picta
PVSFEEVAVFFTEEEWILLDPSQRALYWDVMQENYETAAYLAGWLEEDEEGEPTLGSLSHLQLNRIVWGSDEVSFPRGEGQ

SEQ ID NO: 7605 - protein, 81 aa, Paroedura picta
MQGPVSFKDVAVYFTKKEWALLDPHQRGLYREVMRENYRMAMSVGCRDSTPTLISWLKEKALFLPSATEVTQSEDDVWGSQ

SEQ ID NO: 7606 - protein, 81 aa, Paroedura picta
FPLSKPDLLSWMDRGEDLWAPDLQASEGSEILKEASPGDDLRRKNEGGLPHPEAPGKTEQRAKSSLEGNPVEGESQPADRL

SEQ ID NO: 7607 - protein, 81 aa, Podarcis muralis
PLLCFEDVAVRFTDEEWAYLDSDQRALHKDVMEENCGIVASLDKAPCGIIISAWKFTELNSAPYNPWEPNTPTINSKLQFF

SEQ ID NO: 7608 - protein, 81 aa, Podarcis muralis
GSMSFAGVSLHFTDEEWSLLDPGQRALYNEVMMEIYEMVASVGDVWRILVEGDPSEGPPERAEEQQKLRIQDGTNRQEGRR

SEQ ID NO: 7609 - protein, 81 aa, Podarcis muralis
SGDLHRGRVSVCFSEEEWGNLDEDQRELYKNVMKGNYESLVSLGKENPKATKPEGLACVDGQTSGGSLEEPAACGSDFADF

SEQ ID NO: 7610 - protein, 81 aa, Alligator sinensis
SEPVQVKTGQSRPPKQEESWELREVFEDVAVYFTRKEWKLLEDEDKVLYQDQMLRNYEALVSLGKALVLASPWSYGSSGVL

SEQ ID NO: 7611 - protein, 81 aa, Alligator sinensis
LELWEVFEDVAVYFTRKEWELLEDENKVLYQAQVLKNYQALVSLGYRGPTPALICSIQQGQVELWVCDDEDHGEISRSEDP

SEQ ID NO: 7612 - protein, 81 aa, Alligator sinensis
AQELVTFEDVAVYFTKEQWALLDPSQKALYRDVMLEHYETVASLAGFPIPKPEVISQLEQGKDPWIPGLQGSEGRKIPGML

SEQ ID NO: 7613 - protein, 81 aa, Paroedura picta
GWVTLEEVSIHFTEEEWALLDLDQRRLHQKVMEENRQTVASLEVDGPQNKSVEEPKHHVLEKIQQKRISREKMLSRCRPST

SEQ ID NO: 7614 - protein, 81 aa, Paroedura picta
KETLQRSEFESRRQSSRARVWTSSSLGGRAETPKMRPAQGPVSFEEVAVRFTKAEWGLLNPDQRALYREVMVENYGNVAWL

SEQ ID NO: 7615 - protein, 81 aa, Paroedura picta
GVVTFEDVAVYFSEEEWALLDVGQKNLHREVTVENCGILASLERESQQGGKPPHQHKSSQENFTSRQLDSKHLLGGKGMFL

SEQ ID NO: 7616 - protein, 81 aa, Podarcis muralis
RGQVTLDDVTVSFSPEEWAGLQEWQRRLHRDVMRENYELLASLGCDLRVKDEEGESGEEDGRGLFSEMVLRRWKPEGKTSR

SEQ ID NO: 7617 - protein, 81 aa, Alligator sinensis
LELREVFEDVAVYFTRKEWELLKDEDKVLYQDQMLRNFQALVSLGYQGPTPDLICCVQQGQVELWVCDEDDGEISRSEDLL

SEQ ID NO: 7618 - protein, 81 aa, Alligator sinensis
SKLPEAFEDVAVYFTRKEWELLEAEDKGLYRDQMLRNYQALVSLGYRGPTPDLICRIQRGEMELWVSDDEEAGESSLSEDL

SEQ ID NO: 7619 - protein, 81 aa, Paroedura picta
GVSFEEVVVSFTEEEWTLLDPGQRKLYWEVMQENYETVVSLGNYNSQKGLGAPQWSTLSFLGDDREKEISGEGEGNIRNSK

SEQ ID NO: 7620 - protein, 81 aa, Paroedura picta
AQVAFEDVAVYFTEEQWALLDHSQRALYRDVMQENYETVASLGLPIPGPDSISRLQQREESRIEAQPVLEGNDVSSDDDLG

SEQ ID NO: 7621 - protein, 81 aa, Paroedura picta
GVERALEPSPLQAEGRRAAMPSAQGGVSFEEVAVYFSPGEWSLLRPAQRALYKEVMMENFGIVASLGEDLSLRLAQRNDAS

SEQ ID NO: 7622 - protein, 81 aa, Paroedura picta
GAPVSFEEVAVFFTEEEWALLDPDQRALYQEVMEENYEMVTSLAAGMRETKSEGETGGGSSGRDKSPEFEEETGSRERATK

SEQ ID NO: 7623 - protein, 81 aa, Paroedura picta
MRGLVTFEDVAVYFTKEQWALLDPDQRTLYREVMLENYENVAMLGVQAVKPDLVSRLEQGQEPWVSDSPAKNGRKISDATS

SEQ ID NO: 7624 - protein, 81 aa, Podarcis muralis
ECSSDDVAVCFTDKAWMLLDPDQTAQHKEVKEENCGIVESLGKAPCWIIISVLIGDGVDSRTQSEKYPSQIKFFLYHKHSL

SEQ ID NO: 7625 - protein, 81 aa, Podarcis muralis
FPPPSPPCFEDIAVHFTDEEWALLDPDQRALHKEVMEENGGIMNSLSKAPCWIISLSEFKIPWEESGRVSCSHTYSANLAS

SEQ ID NO: 7626 - protein, 81 aa, Alligator sinensis
LELREVFEDVAVYFTQMEWELLEDEDKVLYQDQMLRNFQALVSLGHQGPTPDLIHRIQRGQVELWVCDDEDSGEISRSEDL

SEQ ID NO: 7627 - protein, 81 aa, Alligator sinensis
ALLREAFEDVALYFTQKEWELLEDRDKMLYQDQMLRNYQALVSLGYQGPAPDLICRIQRGEVELWVYEDEGHGERTWSEGL

SEQ ID NO: 7628 - protein, 81 aa, Alligator sinensis
QELREVFEDVAVYFTRKEWELLEDEDKVLYRDEMLKYYEALISLGYQGPTPDLICRIQQGQVELWVCEDEDGGEISRSEEL

SEQ ID NO: 7629 - protein, 81 aa, Alligator sinensis
QQLQEVFEDVAVYFTRREWELLDDDDKVLYRDQMLKNFQALVSLGYQGPTPDLICSIQQGQAELWISDDEGGGEISRSEDL

SEQ ID NO: 7630 - protein, 81 aa, Alligator sinensis
GQVPVAFEDVAVYFSAEEWAELAGWQRELYREVMKENYELISFLGCPSTKPELICQLEKGEELYVWDPQGWRAGCRPPDTW

SEQ ID NO: 7631 - protein, 81 aa, Alligator sinensis
LELLDAFEDVVLHFTRKEWELLEDEDKVLYRDQMLRNYQALISLGYRGPTPDLIRRIQRGEVALWVCEDEDRGEISRSEDL

SEQ ID NO: 7632 - protein, 81 aa, Alligator sinensis
GALLLFQGPVTFEEVPTYFTEGQWDLLDPHHRILYRDVIGFPVPKPSVISKLERGEELWVLDLQGFGKREIPRGACTGEGT

SEQ ID NO: 7633 - protein, 81 aa, Alligator sinensis
MQENYETLISLAEEMAISLPRITALAESHRRGLVSGFPISKPDLLSWMDRGDEPWVPDLQASEGTEIPRDASPAGDGSASE

SEQ ID NO: 7634 - protein, 81 aa, Alligator sinensis
VQMLVTFEEVAVYFSEVEWTLLDPSQKALYRNVMQENYETVTSLGLLISKPDVVSQLEQGEDPWVLDLQGSEEKKPLSWTH

SEQ ID NO: 7635 - protein, 81 aa, Alligator sinensis
MAQDLDSDHREEMAISLPRITALAESHRRGLVSGFPISKPDLLSWMDRGDEPWVPDLQASEGTEIPRDASPAGDGSASENE

SEQ ID NO: 7636 - protein, 81 aa, Alligator sinensis
AKGEIPKVPVMFNDASFNFSEQEWKNLNEWQKELYRHIMKDAAISKPDLLSRIEQGDDPSDGDQGDFEGRETPRDPNMGFP

SEQ ID NO: 7637 - protein, 81 aa, Paroedura picta
QCPLSSFEDVAVYFSEAEWALLDPGQRALYREVMLENYGSVASLEGNQGTEEDNEMHRLLPEEVKAADLGGNFSHRVEKRD

SEQ ID NO: 7638 - protein, 81 aa, Paroedura picta
QVAFEDVAVYFTEEQWALLDQSQRALYRDVMQENYETVASLVITVVKEEDFWVPVNPYSKESKASPGPVKEEEEQTLLSED

SEQ ID NO: 7639 - protein, 81 aa, Paroedura picta
VQGPFSLEEVSVSFTEAEWALLDPGQRALHGEVMREISQDLAFLEEARSKRETLVETDGGLVAQERLPGSSRGLRGQVSFR

SEQ ID NO: 7640 - protein, 81 aa, Podarcis muralis
MRPETQPVCFEDVTIRFTDEEWAFLDPVQRALHKDVMEDTRGVVASLGKAPSGIIISAWKFKTYLYGTNLIYFHRAQQRPL

SEQ ID NO: 7641 - protein, 81 aa, Podarcis muralis
PKVPVTFGDISVHFDAQEWANLDEGQKELYKGVMRSNYEMLVSLDYAVAKPEILTRIEQGEELCEKGLGDSEGSGVPEQLD

SEQ ID NO: 7642 - protein, 81 aa, Podarcis muralis
GSVSFDEVSVRFTNEEWALLDPGQRALYEEVMEEIREMMTSVGDVSEFLTEGEQSELSREGAEEQKEQRKQRVQVGTYRNE

SEQ ID NO: 7643 - protein, 81 aa, Alligator sinensis
PKVPVAFDEASVQFPREKWENLEDWQKELYKNALKGSYEPSISVDHTISKPDILSRVEPGEEPHIREQQDLEVREVPTGPS

SEQ ID NO: 7644 - protein, 81 aa, Alligator sinensis
AQDPVSFEDVAVYFTEGEWVLLGASQRALYWEVMRDNYEAVALLGFPIFKPVMIAQLEQGEEPWVPSPPGADHQVEMVPRD

SEQ ID NO: 7645 - protein, 81 aa, Paroedura picta
VQGPFSLEEVSVSFTEAEWALLDPGQRALHREVMREISQDVAFLAKEARSPRETLVETDKGLAGQEFLANSSRGSRGQVSF

SEQ ID NO: 7646 - protein, 81 aa, Paroedura picta
AQGLVTFEDVAVYFTARQGALLDPEQIALYKEVMMENFGNVASLGFPIAKPDLISHLEEGEVPWVPDGKESDSNSGDLTEE

SEQ ID NO: 7647 - protein, 81 aa, Phasianus colchicus
SSEPVSFAQVAVYFSREEWALLDPAQRALYRDVMLETYQFSWGLIVFSTLIKAPELVLASRHQPWRAEPSPCKQPLCSCIT

SEQ ID NO: 7648 - protein, 81 aa, Phasianus colchicus
TEPVSFAQVAVYFSREEWALLDPAQRALYRDVMLETYQCVASLGEGFAAFPPFERKQTNCFKGNQGERFKKSLGNYPGKRA

SEQ ID NO: 7649 - protein, 81 aa, Phasianus colchicus
MPGEREVAVYFSREEWALLDPAQRALYRDVMLETYQCVASLGEGFAFHGAGISHGGQNHLPANSPCVLALHGATRKRARNP

SEQ ID NO: 7650 - protein, 81 aa, Podarcis muralis
LETAQCSVCFEDVAVRFTDKEWALLDPDQRALHKDVMEENCGILASLGKAPCGIIISAWKFKKYLYGTNLIYSQRAQQRPL

SEQ ID NO: 7651 - protein, 81 aa, Paroedura picta
VQFSLEEVSVSFSAAEWALLDPGQRALCKEVMLENCENVAFLAGNYRRNEEGEELHQQLLDRFKNEVTKENARNRGRPNEK

SEQ ID NO: 7652 - protein, 81 aa, Paroedura picta
AQGRLSFEEVAVYFTEEQWTLLSPPQRAVYKEVMLENFGNVASLGLAIAKPDLILWLEGGRGGGGGELFGNGFDVVGGWAD

SEQ ID NO: 7653 - protein, 81 aa, Paroedura picta
SRVFLQKWLMYFAEIQWALLDPCQRPVYRDIVQDNYGTLLSLDTGTMNPNPHPAGAENTQAPKELPGRSEGSLYLSPPGHQ

SEQ ID NO: 7654 - protein, 81 aa, Paroedura picta
RQSRTSFEEVAVCFTEAEWALLDPGQRALYEEVMLENDEALASLGELEVSKPDLIAWLEESRRAEAGGEGEDTAGSLWECD

SEQ ID NO: 7655 - protein, 81 aa, Paroedura picta
PQVQVRFEDVMVRFSEEELGLLEKWQQDLYVEVLTDIYESLIIIGNPVTYSDFIAWWKQGEQQNCPGSQESRAVDSSANEG

SEQ ID NO: 7656 - protein, 81 aa, Paroedura picta
TQGLVPFEEVAVYFTPGEWALLHPAQRALYKRVMLENFGNVASLGLLIAKPALIAWLEEEEEEEPFLLASAEEERWAVGQT

SEQ ID NO: 7657 - protein, 81 aa, Paroedura picta
LRKELVTFKEVYVYFTEEEWALLDREQRALFIEVMLENYGIVASLGLVPNPDLVFRLKEEEELVGARWGRRGHSAADGERS

SEQ ID NO: 7658 - protein, 81 aa, Paroedura picta
AQRPVTFEDVAVYFSEAQGTLLDPDQKALYREVMMENYENVASLGSLTPKPELIIRLERGEEPWVSDPGDAPVSGDFRKSH

SEQ ID NO: 7659 - protein, 81 aa, Paroedura picta
APVTFEDVAVYFTEGEWALLDPEQRALYKEVMQENYNIVVSLDTNAGNPVPKPDLICRLEGGEMLWLPDPPKITERQVASH

SEQ ID NO: 7660 - protein, 81 aa, Paroedura picta
PAVQCPVSFEEVAVHFTKAEWALLDPGQRALYVEVMLDNAGSVASLEGRDVRVITVETEEGKESFSRGSQQNVSFPRDPAA

SEQ ID NO: 7661 - protein, 81 aa, Paroedura picta
VWDPVTFEEVAIYFSPEEWEELAGWQKQLYKDVMRDNYETFVSLGLAAPKPDIILQIEQGEELCTGGLREPKANIVPSQDF

SEQ ID NO: 7662 - protein, 81 aa, Paroedura picta
EEPASGQPAQRLVSFEEVAVYFTEEEWALLEPCQRVLYREVMLENYGMVFSVEGLCSSMPHLLAQRRVPLSPELCRRPLEE

SEQ ID NO: 7663 - protein, 81 aa, Gopherus agassizii
LNMPVTFEEVAVYFTQGQGALLGPTQRALYRDVMQENYETVTSLGFPLPKPDLITRLERGEEPWIPELQACEERESLRCTC

SEQ ID NO: 7664 - protein, 81 aa, Gopherus agassizii
MELLFEVAVYFTREEWALLDPTQRALYRDVMQQNYENVTSLAGFLVFQHDVISQLEQGGEPWVPDLQGSEEREILRSPCTG

SEQ ID NO: 7665 - protein, 81 aa, Gopherus agassizii
GSARSPVTQLVGLWLEQEALNGRFLLFQEPVTFEEVAVYFTKEQWALLVPGQRALYRDVMQENYEAVASLGKDSCPLGYSL

SEQ ID NO: 7666 - protein, 81 aa, Podarcis muralis
MENYELVTSLGYPVLKPDLLSRIERAGEQCVGDQLDSSRGIPTDPCPGYRFFKPESLSWIERWEELGVTDRQKLEEGKLCT

SEQ ID NO: 7667 - protein, 81 aa, Podarcis muralis
NFWILRLPPGVNGEAPKEREKMEDWQKELYKKVLKGNCEYLISLDYAISKPDILSRIERGEDLGPGEQQDADSRENLGDAS

SEQ ID NO: 7668 - protein, 81 aa, Alligator sinensis
VQLRAVFEAVAVYFTRKEWELLEDEDKVLYRDQMLKIYQTLVSLGYRGPTPDLICSIQLGQVTLWHYDDEDSGENSRSEEL

SEQ ID NO: 7669 - protein, 81 aa, Alligator sinensis
MTFEEVAIYFNKGEWALLDATQRSIYKDVMQENYETVVSLTPEVAVPKPVVITQLEQGEEPWVEDLQKSTERENLQDICPG

SEQ ID NO: 7670 - protein, 81 aa, Alligator sinensis
MLRNYRALVSLGYQGPTPDLICRIQRGEVELWAHDDEDPGESAFFEGLSPGLWQCHSFQQCLLSPSSENLSLTHLGEGEDS

SEQ ID NO: 7671 - protein, 81 aa, Alligator sinensis
MQENYETLISLEEMAISLPRITALAESHRRGLVSGFPISKPDLLSWMDRGDEPWVPDLQASEGTEIPRDASPAGDGSASEN

SEQ ID NO: 7672 - protein, 81 aa, Alligator sinensis
SPFLTLLLPLPFVSTPRPDAPGMATATLDQLPEAVEDVSVYFTREEWELLEDEDKELYRDQMLRNYQVLVSLGNMVLVFLI

SEQ ID NO: 7673 - protein, 81 aa, Paroedura picta
GKGLVLFEDVAVCFSPEEWALLTAWQRDLHQEVMEANFELVASLGSQMHPKPALLCKTKQGEELYAMDLPGQGGEVARGPP

SEQ ID NO: 7674 - protein, 81 aa, Paroedura picta
AQAGVSFEEVAVHFSPGEWSLLQPAQRALYKEVMLENFGHVASLGPPGATPDLIAWLQEGLFLLGGDEEAGSAGDAWRSAT

SEQ ID NO: 7675 - protein, 81 aa, Paroedura picta
CPGLVTLEEVSVHFTVEEWSLLDPDQRRLHQEVMEENRQNVASLGGLLGPSPDSISPEGETVEPSVQEADEAERFTGADGP

SEQ ID NO: 7676 - protein, 81 aa, Paroedura picta
SGVSFEEIVVSFTEEEWTLLDPDQRKLYWEVMQENYETVVSLGNYSSQKNLGAPKSFTLSFLGDDRVLFTLEGEGNFRNSE

SEQ ID NO: 7677 - protein, 81 aa, Paroedura picta
MPQVPEAFVEVTVRSSEGQCSLMGRRQRVLYKNIMQANSVASLGGFPVSTAELLTRLERGEEAWVPDLHSSDESADEGPVK

SEQ ID NO: 7678 - protein, 81 aa, Podarcis muralis
SQATVRFEDVILYFSRSEWKSLAKWQKELYWEVLTDNYEALLVAGQPVTKAEVVAWLEQCERLDIERTQESRVRDPAANVS

SEQ ID NO: 7679 - protein, 81 aa, Podarcis muralis
MEVSAASGDGSAPFSREKWERLEDWQRELYKNVAKGNGESLISLGKEQGRLSVGSLSRWQQEPPEGPRRWISVSGQNDGGG

SEQ ID NO: 7680 - protein, 81 aa, Alligator sinensis
LQLREVFEDVAVYFTREEWELLDDEDKVLYRDQMLKNYQALVSLGYRGHTPDLISSIQRGQMELWACDDEDRGEISRWEDL

SEQ ID NO: 7681 - protein, 81 aa, Alligator sinensis
LEGLVTFEEVAVYFTKDQWALLDPDQRALYRDVMLENYETVASLGFLTSKPDVVSQLEEGDAPWVPDCQECEERRSLRHTS

SEQ ID NO: 7682 - protein, 81 aa, Alligator sinensis
SKLPEAFEDVAMYFTRKEWELLEAGDKGLYRDQMLRNYQALVSLGLQGPAPDLICRMQLGEMELWVCDDEEAGESSLSEDF

SEQ ID NO: 7683 - protein, 81 aa, Alligator sinensis
PVTFEDVAVYFSPEEWKELVEWQKELYWDVMKENYELVTSLVDDGLTNESLEEKSREEEVESLPIQPFLAKLKEKVPQSPA

SEQ ID NO: 7684 - protein, 81 aa, Alligator sinensis
MELREAFEDVAVYFTREEWELLEDAQKGLYRDQMLRNWRALVSLGYRGLTPDLICCIVRGQEELWVCDDEDRGDISKLEDL

SEQ ID NO: 7685 - protein, 81 aa, Alligator sinensis
PKVPVTFDDVSVYFNEQEWERLDEWQKELYKNVMKGNFETLISLDYSVSKPDILSWTERGEEPCIKDQQDLKEREIPSFPD

SEQ ID NO: 7686 - protein, 81 aa, Paroedura picta
MQAQEGAQDALSCEWALLDPGQRALYREVMLENYESVKSLGAQSIRWTLDNRLASEEGLESFSGGSQEQISFPNEPAETET

SEQ ID NO: 7687 - protein, 81 aa, Paroedura picta
TQDEAAHRHAVSPQKAETLLPEQRSSYTAMETTGRRPAQGPVSFEEVAVFFTGEEWALLDPCQRALYRQVMLENYGMVVSV

SEQ ID NO: 7688 - protein, 81 aa, Paroedura picta
PKVPVTFDDVSVYFNEKEWEKLEEWQKELYKNLMKGNHESLISLDYAISKPGVLSQSEPRADSCLGDEQDSEEPGSLPNPT

SEQ ID NO: 7689 - protein, 81 aa, Paroedura picta
QDALSSVTGGGEGLLSCHLFRHVETAAARPVLGLPSFSLEDVSVSFSPAEWALLDPGQRALWREVTRENAENVAFVGEDLS

SEQ ID NO: 7690 - protein, 81 aa, Paroedura picta
KMPVTFVDIAVYFSAEEWKNLAEWQKDLYSNLVKENYESLLSQGVDINISKPEAQQRIQRSTEPCVPEQPNSKDREVAADP

SEQ ID NO: 7691 - protein, 81 aa, Paroedura picta
PSGPAVSFEEVAVFFTREEWALLVPAQRALYWEVMRENYETAASLGLWVPGPFPNLQDHAREMWFLQSSEKSGRRAGTPWP

SEQ ID NO: 7692 - protein, 81 aa, Terrapene carolina
MPVTFEEVAVYFTQAQGALLDPGQRALYRDVMQENYETVTSLGFPIPKPDLIARLERGEELWVPDLQATEERENPRGTRTG

SEQ ID NO: 7693 - protein, 81 aa, Terrapene carolina
DGGPVSFEEVAVYFTAGQGALLDPSQRALYRDVMQENYENVTLLGCPVSKPDVISQLERGEEPWVPDLQVRRRSRILSRKI

SEQ ID NO: 7694 - protein, 81 aa, Terrapene carolina
FEPGTFCEVAVYFTREEGALLDPTQRALYRDVMQENYETVVLLGFPVSKPDVISQLERGEEPWVPDLQGSEKEVLPRAACT

SEQ ID NO: 7695 - protein, 81 aa, Terrapene carolina
VSACMPVTFEEVAVYFTQGQGALLDPAQRALYRDVMQENYKIVTSLGFPIPKPELISRLERGEEPWVPDLQSYKDPTTQQT

SEQ ID NO: 7696 - protein, 81 aa, Terrapene carolina
FQGLVTFEEVAVYFTREEGALLDPTQRALYRDVMQENYETVVLLGKESFSKPDVISQLERGEEPWVPDLQGSEKERPEENF

SEQ ID NO: 7697 - protein, 81 aa, Microcaecilia unicolor
AQVRVTFEDITVSFSQEEWEYLDEGQKELYREVMKENYQTLISLGYEKINPEILSNIKQEEESYVQDPQESGEREVTHLYP

SEQ ID NO: 7698 - protein, 81 aa, Microcaecilia unicolor
QVPLTFDDVAVYFTLDEWRKLEDWQKELYKTTMQENYDSLESMVLAILERLEKRIARMEHHQIFFLTHLFKHLKPATLEKD

SEQ ID NO: 7699 - protein, 81 aa, Terrapene carolina
QAEESRPRFVAVYFTQGQGALLDPAQRALYRDVMQENYETVTSLGKGFLSPQILEAVGSARQKPGEVGTGQRGFWETTQGR

SEQ ID NO: 7700 - protein, 81 aa, Terrapene carolina
IPKPDMISQMEQGEEPWTPDHKGSEERQILRNIRAGEELVKRTQKPSVLDINRKRQVISTLRGGGFKNHNETVIQLTLCTK

SEQ ID NO: 7701 - protein, 81 aa, Terrapene carolina
FQGPVTFEEVAVYFTREEGALLDPTQRALYRDVMQENYETVVFLGFPISKPDVISQLERGEKPWVLDLQGSEKECGKSFSR

SEQ ID NO: 7702 - protein, 81 aa, Lithobates catesbeianus
GEVPIRCQDVTVYFSMEEWEYIEGHKDLYKDVMMENWPPLTSPDGSSNRNPPERCPRPLYSRDPTLEDQEIPQEDQNDDLI

SEQ ID NO: 7703 - protein, 81 aa, Terrapene carolina
INLLIFCMPVTFEEVAVYFTQGQGALLDPAQRALYRDVMQENYETVTSLGKGFPVIVSPSSWIPHSSTRAQGLVPLTECPF

SEQ ID NO: 7704 - protein, 81 aa, Terrapene carolina
MPRAGFPIPKPELIARLQRGEEPWVPDLQASEKKEVMRVTHTGDETLSENKEVNWQVEPERAFLRGAEGNFSQCLEQGEAW

SEQ ID NO: 7705 - protein, 81 aa, Terrapene carolina
MSRPDLICQLEQGEETWVPDLQGSEERGIRRGACTGDKILCKNEGENPQQEGPAQVEPHGMVLGGSRGNVPAQGEAGGSQN

SEQ ID NO: 7706 - protein, 81 aa, Terrapene carolina
SLMPVTFEEVAVYFTQGQGALLDPAQRALYRDVMQENYETVTSLGKGFLVPWLLEAGVGGRSLRVLSCLCCFSVPHRIPLL

SEQ ID NO: 7707 - protein, 81 aa, Terrapene carolina
AGLPIPKPDLVARLEAGEEPWVPDLQASEEKKVPRDTHTGDKTKSENEEETPQQEGPEQVEIQGTILRSDSNFSQCLEQRT

SEQ ID NO: 7708 - protein, 81 aa, Terrapene carolina
ERMVAFEDVALYFSQEEWELLSPPEKQLYRDQMLRNYWALISLGKDLFIFTHSFMDKWGNRSIPGLGILGGTRTQSECGES

SEQ ID NO: 7709 - protein, 81 aa, Lithobates catesbeianus
VPIRCQDVTVYFSTEEWEYLEGHKDLYKDVMIENQPPFTSPGHIIEEPSNDRITLSLSCEMEDEDITRDCAGEKTTSSAMD

SEQ ID NO: 7710 - protein, 81 aa, Lithobates catesbeianus
IDLLTGEVPIRCQDVTVYFSMEEWEYLEGHKDLYKDVMIENQQTLNYGKLGKNKLSLNEMILNLAMEIIHMLTAEVRRILI

SEQ ID NO: 7711 - protein, 81 aa, Lithobates catesbeianus
IELLTGEVPIRCQDVTIYFSMEEWEYLEGHKDLYMDVMMENQQTLNYGKLGKNKLSLNEMLLNLAMEIIHMLTAEVRRILI

SEQ ID NO: 7712 - protein, 81 aa, Terrapene carolina
FQMPVTFEEVAVFFTQGQGALLDPAQRALYRDVMQENYKTVTSLGKGFLGPLWEELKGIFPSAWSRQKPGEVGKGQRGFWE

SEQ ID NO: 7713 - protein, 81 aa, Terrapene carolina
FQMPVTFEDVAVYFTQGQGALLDPAQRAIYRDVMWENYETVTSLGFPLPKPDLITRLEQGEEPWEVPGHGELKGTSVGRPH

SEQ ID NO: 7714 - protein, 81 aa, Terrapene carolina
AQGPVTFEEVAVYFTREEGALLDPTQRALYRDVMQENYETVVLLGFPVSKPDVISQLEQGEEPWIPDLQGSEKEVLPRAAC

SEQ ID NO: 7715 - protein, 81 aa, Terrapene carolina
PVTFEEVAVYFTQGQGALLDPAQRALYRDVMQENYETVTSLGKGFLSPQILEAVGSASGAERGSENEEGNHHEEVPGEVEP

SEQ ID NO: 7716 - protein, 81 aa, Terrapene carolina
GKEMAAAEPVTFEEVAVYFSEKEWALLDPGQRALYRHVMQENYETVISLGKDSCPLSYQSSWMLSPELPQISPPVTFPFIR

SEQ ID NO: 7717 - protein, 81 aa, Terrapene carolina
MFPFSWVPRSPAEHRDRFHSQNVLYDRCSLNPPCTLICLIPPPPGFPIPKPELISHLERGEEPWMPDFQACEERESLRCAH

SEQ ID NO: 7718 - protein, 81 aa, Terrapene carolina
FQMPVTFEEVAVYFTQGQGALLDPAQRALYRDVMQDNYEMVTSLGFPIPKPELIARLERGEEPWVPDLQACEERRLPRCTR

SEQ ID NO: 7719 - protein, 81 aa, Lithobates catesbeianus
KPERNNMQKILEVTKKMMELLTGEVPIRCQDVTVYFSMEEWEYLEGHKDLYEDIMMEKQPPLTPLGKRRLYCKGEQYGGST

SEQ ID NO: 7720 - protein, 81 aa, Lithobates catesbeianus
IRCQDVTVYFSMEEWEYLEGHKDLYKDVMMENQPPLTSPERCPRPLYSWDSTQEDHTIPHHHQHEEQMYVKVEVKEEEEEV

SEQ ID NO: 7721 - protein, 81 aa, Lithobates catesbeianus
VPIRCQDVTVYFSMEEWEYLEGHKDLYKDVMMENQPPLTSPDGSSNGNPPERCPLPLYSRDSTQEDHTIPHHHQVGGNQHV

SEQ ID NO: 7722 - protein, 81 aa, Terrapene carolina
STCRVPVTFKEVAVYFTQGQGALLDPAQGTLYRDIMQENYEMVTSLGKGFLSPRLLELLPWSVRLEENGLRNAHLPCERDL

SEQ ID NO: 7723 - protein, 81 aa, Lithobates catesbeianus
VPIRCQDVTIHFSVEEWEYLEGHKDLFEDIMEDDWQTLTPLGELISCGTPERSPSPVYAQNRLENIVDVSRQPEEENNSIT

SEQ ID NO: 7724 - protein, 81 aa, Terrapene carolina
FQMPVTFEEVAVYFTQGQGALLDPAQRALYRDVMQENYETVTSLGKGFPSPQLLEAVGSACLNVFRFFPGQLDQRQMGSIM

SEQ ID NO: 7725 - protein, 81 aa, Lithobates catesbeianus
VPIRCQDVTVYFSMEEWEYIEGHKDLYKDVMMENQPPLTSTDLSEGVEKLKSHRAIYEELDSLEDWSVNTKEEGDLPGGHC

SEQ ID NO: 7726 - protein, 81 aa, Terrapene carolina
MSQVSLGKNLGDCDPACPTHPLFTGFPVSKPDVISQLERGEEPWVRDLYDSEKKVLLKAACTGEELVKPTQKQSEHIGNIW

SEQ ID NO: 7727 - protein, 81 aa, Lithobates catesbeianus
GEVPIRCQDVTVYFSMEEWEYLEGHKDLYKDVMMENQPPLISPDGSSNGNPPERCSCHLYSRDSTQQEQNISCKVKEEIKK

SEQ ID NO: 7728 - protein, 81 aa, Lithobates catesbeianus
TGEVPIRCQDVTVYFSMEEWEYLEGHKDLYKEVMMENQPPLTSPDGSSNGNPPERCPRPLYSWDSTQEGHTIPHPHQGEER

SEQ ID NO: 7729 - protein, 81 aa, Terrapene carolina
MLVTFEEVAVYFTQGQGALLDPGQRALYRDVMQENYKMVTSMGKGFLSPRLLEAMGSACLTLVRRRAVGARSPGLQGKRDP

SEQ ID NO: 7730 - protein, 81 aa, Terrapene carolina
AGLGVAFEDVALYFSQEEWELLSPPEKQLYRDQMLRNYWALISLGYSGSTPDLIHRIEPPLQGEAPVQKTVMDKWGNRSIR

SEQ ID NO: 7731 - protein, 81 aa, Lithobates catesbeianus
GEVSIRCQDVTVYFSMEEWEYIEGHKDLYKDVMMENRPPLTSPDGSSNRNPPERCPCPLYSQDSTQEDQEILQDYQDEDLI

SEQ ID NO: 7732 - protein, 81 aa, Terrapene carolina
MPVTFEEVAVYFTQAQGALLDPGQRALYRDVMQENYETVTSLGKRYLSPRLLEAAGSAFLNLFFPWSRSPQLQCGRETFIC

SEQ ID NO: 7733 - protein, 81 aa, Terrapene carolina
AGFPIPKPDLVARLEAGEEPWVPDFQASEERKLPRGTRTGDKTKSENKEGNPQQKCPEQVELQRTFLRRAEENFSQCFEQR

SEQ ID NO: 7734 - protein, 81 aa, Terrapene carolina
FQMPVTYEEVAVYFTQGQGALLDPAQRALYRDDMQENYETVTSLGLPIPKPDLISQLEQGEKPWVPDLQACEEREISRGAH

SEQ ID NO: 7735 - protein, 81 aa, Lithobates catesbeianus
LLSLLTKHRPDRRVPPCCSLKPERHNMEKILEVTKKMMELLTGEVPIRCQDVTVYFSMEEWEYLEGHKDLYKDVMMDNQQN

SEQ ID NO: 7736 - protein, 81 aa, Terrapene carolina
LERMLQVAFEDVALYFTREEWELLSQPEKQVYRDQMLRNYRVLVSLGKYKISHPLLTPVKCVWSLDASSSPTDRVDSPSLG

SEQ ID NO: 7737 - protein, 81 aa, Lithobates catesbeianus
PIRCQDVTVYFSMEEWEYLERHKDLYKDVMMDNQQILSCVKKKIHLNKKIHKLSLEIIYLLIGENFPPVKSGDQVTITVPP

SEQ ID NO: 7738 - protein, 81 aa, Lithobates catesbeianus
VPIRCQDVTVYFSMEEWEYIEGHKDLYKDVMMENQPPLTSPDGSSNRNTLERCPRPLCLQDSLEEDFNMDLQDSVDVCHSI

SEQ ID NO: 7739 - protein, 81 aa, Terrapene carolina
SFYPLMPPGCSRQASIYLVLLFRVGLLLFQGPVTFEEVAVYFTREEWALLHPTQRALYRDVMQENYENVTSLGKDSRPLSF

SEQ ID NO: 7740 - protein, 81 aa, Lithobates catesbeianus
GEVPIRCQDVTVYFSMEEWEYLEGHKDLYKDIMMENQPPLTSPDGSSNGNPPERCPRPLYSRDSTQEHHKDPQDFEADHLI

SEQ ID NO: 7741 - protein, 81 aa, Terrapene carolina
FLVDMGTVKSLMRRGSFSKPDVISQLERGEEPWAPDLQGSEEREILRGSCTGEGSLNQLRICHCLKETAGITNKDLVSSLS

SEQ ID NO: 7742 - protein, 81 aa, Terrapene carolina
MSNEFTCPPLFSFPLAGFPISKPDVISQLELGEEPWVPDLQGSEEKELLRCAYTAGDEMVRENEEQVELSGALLQRSKGTV

SEQ ID NO: 7743 - protein, 81 aa, Lithobates catesbeianus
GEVPIRCQDVTVYFSMEEWEYLEGHKDLYKDVMMGDHKNPNDSQSRSLTDFNVIVKEEVNDEIDEDDVTKEWKNLEGHKDL

SEQ ID NO: 7744 - protein, 81 aa, Microcaecilia unicolor
AEMLVTFEDVAVYFSEEEWKVLEDGQKELYKDVMKENYESLTLLGYPLVKPDVLLRLERGEDPWEKNWGHLRNTVISKTSC

SEQ ID NO: 7745 - protein, 81 aa, Microcaecilia unicolor
DQALVTFKDIAAYFLEAEWDVLGELQKELYKKVIKEIHSFLISQGYSIANPDVIFKIKEEDEKYVTQKCEWEGKENMNDPT

SEQ ID NO: 7746 - protein, 81 aa, Microcaecilia unicolor
RKMRVTFEEIAIYFSQEEWEYLDEGQKELYREVMKENHETLMFLENEVTEEEVKETNREGRPLKWKLRPRHVSVYEGIERG

SEQ ID NO: 7747 - protein, 81 aa, Microcaecilia unicolor
FQASVVFNDVAIYFSEEEWNILKQRQRDLYKNVVKEIHQAVISLGYSIINPDVLVRISKEEEPCLWKDHDSERRRNNSPFN

SEQ ID NO: 7748 - protein, 81 aa, Terrapene carolina
IPHSPAQHRDRFRSRNVLSDRRSLSPPHTLIWSDFTPCTGFPIPKPDLITRLERGEEPWVPDLQVCEEREIPRGAHTAGDE

SEQ ID NO: 7749 - protein, 81 aa, Terrapene carolina
MEPVTFEEVAVYFTREEWALLDLTQRALYRDVIQENYETVVFLGFPVSKPEVISQLERGEEPSVPDLQGSEKEVFNLSRTY

SEQ ID NO: 7750 - protein, 81 aa, Terrapene carolina
QVPVTFEDVAVYFTLEEWEKLTEWQKALYREVMRENYDHLISLGKDRFSLFDCVLEDRALGKSPNLCLSHGNPAGSSLGQP

SEQ ID NO: 7751 - protein, 81 aa, Terrapene carolina
FQMPVTFEEVAVYFSEDEWALLDEKQKELYRDVMQENYETLLSLAGFPIAKPDVLSQMKQGEEMWLPDLQGSAEREIPRGT

SEQ ID NO: 7752 - protein, 81 aa, Terrapene carolina
RVTFEEVAVYFTREEGALLDPAQRALCRDVMQEKYENVTSLGKDSLKVHVTPTMQPLLCLVSASPEHATFHAQRRVPTPGI

SEQ ID NO: 7753 - protein, 81 aa, Terrapene carolina
VTFDDVSVYFNEQEWANLDEWQKELYKNVMKENYETLISLGRARVLLVYFRLGDGQLMTKETRFDGDCEPENLEAEGELPG

SEQ ID NO: 7754 - protein, 81 aa, Lithobates catesbeianus
PIRCQDVTVYFSMEEWEYLEGHKDLYMDVMMENKQLLNYVNMKNNNLHNWILLTLEIVCLLTGEDCTVVMKSSIENNIKGI

SEQ ID NO: 7755 - protein, 81 aa, Lithobates catesbeianus
REVPIRCEDSTVPFSMEEWEYIEGHKDLYKDVMMENRPPLTSLDGSSDRNPPERCPRLLYSKDSTQEHQEIPQEDQDENPI

SEQ ID NO: 7756 - protein, 81 aa, Lithobates catesbeianus
PIRCQDVTVYFSMEEWEYIEGHKDLYKDVMMENRPPLTSPAESSNRNPPERCPRPLYSQYTKQEHQEIPQKDQEENLCESR

SEQ ID NO: 7757 - protein, 81 aa, Lithobates catesbeianus
KKILEVTNKIIDLLTGEVPIRCQDVTVYFSMEEWEYLEGHKDLYKDIMMENQPPLTSPGKRRLYCKGESSTEGPPRSPIIL

SEQ ID NO: 7758 - protein, 81 aa, Microcaecilia unicolor
QIPVTFEDIAIYFFQEEWKDLDAWQKELYKDVMKENYQTLMSLGTGSQNVTPDIISHIERGEEPYIRDEPRSEERETGENS

SEQ ID NO: 7759 - protein, 81 aa, Microcaecilia unicolor
KEALVTFKDVAAYFLEVDWDLLGEWQKELYKKVIEEFHAILISRGYSIVNPDVIFKIKKEDEKYFTQQFEWEGKENPNDFN

SEQ ID NO: 7760 - protein, 81 aa, Microcaecilia unicolor
QVPVTFEDITVYFSKEQWGYLDEGQKELYREVMKENYETLISLGTDHESINPEVLMWIKQEEEPHGWDPKESGGKEVSHSC

SEQ ID NO: 7761 - protein, 81 aa, Microcaecilia unicolor
KVPVKFEDVAVSFSQDEWGYLDEGQKELYREVMKENFQTLISLESGLQRIEEPYVQDPQEADGREFVQSYSADHEIMQKEE

SEQ ID NO: 7762 - protein, 81 aa, Microcaecilia unicolor
RQMSVTFEDIAVYFSQEEWEDLEERQKDFYKEVMKENYEILSSLGYSTLRPEILCRMERGEEPWVNDPQKGEHSIYLYAGN

SEQ ID NO: 7763 - protein, 81 aa, Microcaecilia unicolor
PEPVSFEDITVYFSQEQWEYLDEGQKELYREVMKENFETLISLGTNHESINSEVLLRINQEEEPRVWDPKESGQREVTHSY

SEQ ID NO: 7764 - protein, 81 aa, Microcaecilia unicolor
DQALVTFKDVSAYFLEVDWEILGEWQKELYKKVVREVHAFLISRGYSIINPDVIFKIKKEDEKYFTQHFEWEGKENPDDPM

SEQ ID NO: 7765 - protein, 81 aa, Microcaecilia unicolor
KEALVTFQDVAAYFLEVDWDILGEWQKELFKKVIKEIHDVLISRGYSIVNPDIIFRIEKEDEKYFTQHFEWEGEKTPNDST

SEQ ID NO: 7766 - protein, 80 aa, Paroedura picta
APVTFEDVAVYFTEGEWALLDPEQRALYKEVMQENYFSLASLGYPVAKPDFICRLEGGEVLWLPDPPGTAMRDMPPDYSS

SEQ ID NO: 7767 - protein, 81 aa, Paroedura picta
PVTFDDNTVRFSAQEWARLEEWQKELCKNITKGHHEPLVSLDSALCKAGSLPPAERVGALHVADQEVLEDRAFLPEVRTGP

SEQ ID NO: 7768 - protein, 81 aa, Paroedura picta
APVSFEEVAVFFTEEEWALLDPAQRALYWEVMQENYEAVASLGKEFGPFILNREGESRPAGDAPDSEKRGQPGEVSSEGGE

SEQ ID NO: 7769 - protein, 81 aa, Paroedura picta
ELVSFEEVAVRFTVEEWALLDPDQRSLYKEVMLENYDNVTFLGVLKPDYLSYLEEGEDPFALDSEEEEEEEEAERPARTFP

SEQ ID NO: 7770 - protein, 81 aa, Paroedura picta
DVLEETSSHFSHEEWENLQGWQKELYRNVVKGNCESLISLEGEPPCGLAQAASRAPQEPPARNPAEPSAPKMEGSSWVQPQ

SEQ ID NO: 7771 - protein, 81 aa, Paroedura picta
FQEPVTFEDVAMYFTKEQWAMLDPTQRALYTDVMRENYGNVLAAGFSVSKPALIYFLERGEVLWEPDQQRIRAREILSGIS

SEQ ID NO: 7772 - protein, 81 aa, Paroedura picta
SPLCSDGQRADMKPFQGPVSFEEVAVYFTQGEWVLLRPAQRALYKKVMLETFGNVASLGPVTVKPDLILWLEGKDQIDGEK

SEQ ID NO: 7773 - protein, 81 aa, Alligator sinensis
AKLADVFEDVAVYFTQEEWELLEAGDKVLYQDQMLRNYQALVSLGYQGPTPDLICHIQQGEMELWVWNDEKAEENAFSEDL

SEQ ID NO: 7774 - protein, 81 aa, Alligator sinensis
LQEAFEDVALYFNQKEWELLGDGDKVLYQDQMLSNYQALVSLGYQGPTPDLINCIQGGEVELWVCDVEDPGESTLSEGLFP

SEQ ID NO: 7775 - protein, 81 aa, Alligator sinensis
WQLPEAFEDVAVYFTPEEWQLLEAGDKGLYRDQMLRNYQALVSLGYRGPTPALICRIQRREMELWACDDEEGGESSLSEDM

SEQ ID NO: 7776 - protein, 81 aa, Alligator sinensis
PKVPTGFENGAAYFSEQEWKNLDECQKELYKNVMKGNFDSLVSLDYAISKPDLLSRIERGEAPCPRDAGDSEEREIPAEPS

SEQ ID NO: 7777 - protein, 81 aa, Alligator sinensis
SELREVFEDVAVYFTRKEWELLDDEDKVLYQDQMVKNYQALVSLGYRGPTPDLICSIQQGRVDLWTCADEDCGEMSRWEDL

SEQ ID NO: 7778 - protein, 81 aa, Paroedura picta
LQGGVSFEEVAVYFTWGEWALLHPAQRALYKEVMRENFGIVASLGPLTVKPDLISWLEEEKELFFCGCEELEEMPAGNVQE

SEQ ID NO: 7779 - protein, 81 aa, Alligator sinensis
VQVPVTFDDVAVYFSKEEWEELVEWQKELYKDVMRDNYEVLFSLGCSAVKPDIISQIEQGEDPCVSGHQEGCTSYSAPAAV

SEQ ID NO: 7780 - protein, 81 aa, Alligator sinensis
MDLREAFEDVAVYFTREEGELLEDAQKGLYRDQMLRNCRALVSLGYRGPTPDLICCIKQGQEELWVSDNGDRGDTSRLKEL

SEQ ID NO: 7781 - protein, 81 aa, Alligator sinensis
MVPVNSEASGCFSEQEWGNVEQWPADLHRDAVRSNYEALMSLGQGTDSVLSSAEIPCEVTLGDEPSVPDQADSQGAESPTD

SEQ ID NO: 7782 - protein, 81 aa, Alligator sinensis
PVQLREAFEDVAVYAKEWELLEDGDKVLYRDQMLRNYQTLDSLGYQGPTPDLIYHIQRGEVELWVCDEEPGESVLSQGLSP

SEQ ID NO: 7783 - protein, 81 aa, Alligator sinensis
TELPEAFEDVAVYFTREEWELLEDAQKGLYRDQMLRNWRALVSLGYRGSTPDLIHRIARGQEELWVCDDEDRGDISKSEDL

SEQ ID NO: 7784 - protein, 81 aa, Alligator sinensis
MELREAFEDVAVYFTREEWELLEDVQKGLYRYQMLRNCRALISLGYQGPTPNLICRIQQGQEELWVGDSEERGDISGLEVL

SEQ ID NO: 7785 - protein, 81 aa, Alligator sinensis
VQLREAFEDVALYFTREEWELLGDRDKVLYQDQMLRNYQALISLGYQGPTPDLICRIQQGEVELWVCDDENRGETAWSEGL

SEQ ID NO: 7786 - protein, 81 aa, Alligator sinensis
LGPQEMFEDVAVYFTRKEWELLEDEDKVLYQDQMLRNFQALISLGYRGPTPDLICSIQQGQVELWVCDDEDCGELSKLEDL

SEQ ID NO: 7787 - protein, 81 aa, Alligator sinensis
LELWDVFEDVALHFTWKEWKLLEDEDKVLYRDQMLRNYQALVSLGYRGSTSDLICCIQRGEVELWVRDDEDCGEISGSEDL

SEQ ID NO: 7788 - protein, 81 aa, Alligator sinensis
AQELVTFEDVAVYFTKEQWALLDPSQKALYRDVMLEHYETVASLGFPIPKPEVISQLEQGKDPWIPGLQGSEGRKIPGMLN

SEQ ID NO: 7789 - protein, 81 aa, Alligator sinensis
LPEAFEDVAVYFTREEWELLEDAQKGLYRDQMLRNWRALVSLGGTWLLCRAEKHSLEEGPANLEPPWTSPRDLAEMESLRP

SEQ ID NO: 7790 - protein, 81 aa, Alligator sinensis
AQLWEAFEDVALYFTRKEWEQLQDGDKMLYREQMLRNYQALVSLGYQGPTPDLIGRIQQGEVELWVYDDEEPGECICSEGL

SEQ ID NO: 7791 - protein, 81 aa, Podarcis muralis
SQGLVSFEEVSVSFAAEEWVLLDPDQRALYKEVMLENYRNVASLEGPLMPKSDLVSWLEGKEELLSWEEPAKKDEGFFQEK

SEQ ID NO: 7792 - protein, 81 aa, Podarcis muralis
PPFNGPVCFEDVAVHFTDEEWALLDLDQRALHKEVMEENLASFGSFSNTADVGISRDVFDPWVLTFSSPVPKAPLPLLFLN

SEQ ID NO: 7793 - protein, 81 aa, Podarcis muralis
GLCALKMSAVRFTDEEWALLDPDQRALHKDVMEENWGIVASLGKAPCGIVLSRRLTLEMEGNAMTGPNKIHPREEELDLLN

SEQ ID NO: 7794 - protein, 81 aa, Podarcis muralis
MGPVCFEDVAVPFTDENLALLDPDQRALQKEVKEDNPGIVASLVRLPISVGETREPVWCSGSEQWIRNLGNRVRVSAPPPP

SEQ ID NO: 7795 - protein, 81 aa, Paroedura picta
PVSFEEVDVDFTREEWELLDPGQRALAMEVTLENLGNVASLEADAPQNKFKEEPKQHPLEEKPKRRNAGTKQGRDNECPAS

SEQ ID NO: 7796 - protein, 81 aa, Paroedura picta
WELLDPGQRALAMEVTLENLGNVASLGELLTPRPEEETTSAWSCKEREAAGGSGRQGGEGEREPCGALAGRAWWPEVGKSR

SEQ ID NO: 7797 - protein, 81 aa, Podarcis muralis
RIPTLKMQNKRIQLKLCFEDVAVRFTDEEWELLDPDQRAMHKDVMEGNRGIVASLGKPPCGIVLSQEQRRTQHNLQSGEGT

SEQ ID NO: 7798 - protein, 81 aa, Latimeria chalumnae
QLEMENTFADIEIYFSEDEWQELQDWEKEVYRNLKEHYDIIISFGYKFPKPDFMCKKEDTYQPTMFKSIRGKEEEFLVVSR

SEQ ID NO: 7799 - protein, 81 aa, Alligator sinensis
LREVFEDVAVYFTQMEWELLEDEDKVLYQDQMLRNFQALVSLGGTWLLNGAEEETPVEGPANLGPPWTSPRSLGEMDSLRH

SEQ ID NO: 7800 - protein, 81 aa, Alligator sinensis
MREEWELLDDADKELYQDQMLKNYQALVSLGYRGLTPDLICRIQGGQVELWVCADEDHKRISRSECLLPGELLWQAPVPDS

SEQ ID NO: 7801 - protein, 81 aa, Alligator sinensis
MEHWVFLDPRQRALYRDVMQESYETLMSLKYPISKPDVISRLEQGEGMCVPDLQDSGEKENPGGTSAGTASEDEVEDLGQG

SEQ ID NO: 7802 - protein, 81 aa, Alligator sinensis
AQLQEAFEDVALYFTQKEWELLEDRDKVLYQDQMLRNYQALVSLGYEGPIPDLICRIQRGEVELWVCDDYDPGESVQSEGV

SEQ ID NO: 7803 - protein, 81 aa, Alligator sinensis
AAEEPAQGPVTFEEMPAYFSEGQWDLLNPSQRAFCRDVIGFPVPKPSVVSWMEKQKEPWAPDLLGSEQKELLGEVCTDDRT

SEQ ID NO: 7804 - protein, 81 aa, Alligator sinensis
GEAPVTFEDVAVYLTTEEWKELVDWQRELYQDVMKENYELATSMEAVLEKPEIVARLERGEEPYVADPLDSRKGCWAGSPS

SEQ ID NO: 7805 - protein, 81 aa, Paroedura picta
LLGRGPEGGYFTEEEWALLDPGQRALYREVMMENFGSVAFLGSRKRSLMGFLSPPVGRRVESNVLHEPPTRVEGPVSFEEV

SEQ ID NO: 7806 - protein, 81 aa, Paroedura picta
TQSLVSFKEVAVYFSTEEWALLDPCQRALYREVMLENYGMVVSMGRQDSTPALIAWLREEGDLLQSSTEEVQSADDILGNE

SEQ ID NO: 7807 - protein, 81 aa, Paroedura picta
GLQTAFLHTNQAMERSKEWIRPSFLSEGGLSDSTRCQIEGPVSFEEVAVYFPEEEWALLDPGQRALYREVMLENYRSLVSL

SEQ ID NO: 7808 - protein, 81 aa, Paroedura picta
AQGGVSFEEVAVDFSPGEWALLHPAQRALYKEVMRENFGIVASLGSLIATPDLISWLEEEEDPFLLIAEEEEGLAGGCLGG

SEQ ID NO: 7809 - protein, 81 aa, Paroedura picta
PKVPVTFQDNSAYFSEQEWGDLEGWQKELYKNVMKSNYESLVSLDYAIAKPDLLSRIEQGEAPCEEEEEASKEREIPAEPS

SEQ ID NO: 7810 - protein, 81 aa, Paroedura picta
GPFSFEEVAISFSEAEWALLDPGQISLYREVMLENYGSVAFLVRNTGETTVETDEILTSEESSESFSRASPESISFPDELE

SEQ ID NO: 7811 - protein, 81 aa, Paroedura picta
SPPAYAAMDPVAGWPAQRPVSFEEVAVYFTVEEWALLDVCQRALYREVMLENYRMVVSVGKNPLNACSGDRFLLIFFLQKK

SEQ ID NO: 7812 - protein, 81 aa, Paroedura picta
ETAAALAVQSPISFEEVVVDFSDVEWALLDPGQRALYREVMLENWGSVVFLEEARKFCHSQRTYTGEKPFQCSDCGNKFSG

SEQ ID NO: 7813 - protein, 81 aa, Podarcis muralis
PVCFEDVAVRFTDEEWELLDPDQRAMHKDVMEGNRGIVASLDCDELESKNKEEHNTICRVEKARKKLECGKSCSQSSHSTS

SEQ ID NO: 7814 - protein, 81 aa, Podarcis muralis
ICFEDVTIRFTDEEWAFLDPDQRALHKDVMEETRGIVASLGKAPCGIIISNEGDHDRIPREEKPRENLECGESCSQRSHST

SEQ ID NO: 7815 - protein, 81 aa, Podarcis muralis
PKVPVTFDDVSVYFNEKEWEKLEEWQKELYKNLMKGNHESLISLDYAISKPGVLAQAEPGTDSCLGDEQDSEEQGSLPDPT

SEQ ID NO: 7816 - protein, 81 aa, Podarcis muralis
GSVSFDEVSVRFSNEEWALLDPGQRALYEEVMEEIREMMTSVGDVSEFLTEGEQSEPSREGAEEQKEQRKQRVQVGTYRKE

SEQ ID NO: 7817 - protein, 81 aa, Alligator sinensis
WKVPVTFEDVAVYFSPEEWAELAGWQQELYRDVMMENYELVASLGWPSVKPEIICKIEQEEEPCVRDPADPSVPGKPRHSW

SEQ ID NO: 7818 - protein, 81 aa, Alligator sinensis
LDGLVTFEEVAIYFTQEEWDLLDPAQRAFYWDVMQENYDMVNSLWNLIYIPSMTSQPEYSQDPWVPALQCSEGMEFSNDIT

SEQ ID NO: 7819 - protein, 81 aa, Alligator sinensis
LQVCVSFEEVAVYFTKEQWALLDPSQRALYRGVMLENYEAVTSLAGFPVPNTSLISWLEQGEELWVTDLQDSKEWEIPRNT

SEQ ID NO: 7820 - protein, 81 aa, Alligator sinensis
MDLREAFEDVAVYFTREEGELLEDAQKGLYRDQMLRNCRALVSLGYRGPTPDIIHCIQQGQEQLWVSNDEDCGDISRSEDL

SEQ ID NO: 7821 - protein, 81 aa, Alligator sinensis
MQENYETLISLEEMAISLPRITALAESHRRGLVSAGFPISKPDLLSWMDRGDEPWVPDLQASEGTEIPRDASPAGDGSASE

SEQ ID NO: 7822 - protein, 81 aa, Alligator sinensis
TELWEAFEDVAVYFTQKEWELLGDEDKELYQDQMLRNYQALLSLGYQGPTPGLICRIERGEVELWVCDDEDHGDSSRAEDL

SEQ ID NO: 7823 - protein, 81 aa, Alligator sinensis
LQLQEVFEDVAVYFTREEWELLDDEDKVLYQEQMLKNYQALVSLGYRGPTPDLISSIQRGQVELWVCDDEDCGEISRWEDL

SEQ ID NO: 7824 - protein, 81 aa, Alligator sinensis
AQLREAFEDVALYFTRKEWELLGDGDKVLYQEQMLRNYQALVSLGYQGFAPDLICCIQRGEMELWVCDDEDPGERSWSETS

SEQ ID NO: 7825 - protein, 81 aa, Paroedura picta
GSMSFEEVAVFFSDEEWALLDPGQRALYREVMLENYGNIASLEILPRWQEESKGGTIRIEMSGKSFPQEGPAPGDVLDCFD

SEQ ID NO: 7826 - protein, 81 aa, Paroedura picta
VQCPFSFEEVSVSFSEAEWALLDPGQRALHREVMLENWGNVAFLAQCLTLLPKEDRRETMMETDYDLATEGNLESSSARAL

SEQ ID NO: 7827 - protein, 81 aa, Paroedura picta
PKVPVVFDEASCSFSEQEWQSLDAEQKDLCKHLMKCNYKAVVSMDAAISKPDLLSQMEEDDAADQGGSEDREPLRESSLGC

SEQ ID NO: 7828 - protein, 81 aa, Paroedura picta
VQGPFSLEEVSVSFTEAEWALLDPGQRALHWEVMLEISRDLAFLAKEARSMWETVRETEEGPAPQGRLQNSSNGSQDQTGS

SEQ ID NO: 7829 - protein, 81 aa, Alligator sinensis
SQGLVTFEEVAMYFTKGQWALLDPNQRALYKEVMLENYETVSTLGFPVPKPDMITQLEQGGEPWVPDLQGSEGREMSRGAH

SEQ ID NO: 7830 - protein, 81 aa, Alligator sinensis
PARQGESMELWEAFDDVAVYFTREEWELLEDAQKGLYRDQMLSNCRALVFLGYRGPTPDLISRIQQGQEELWIFDLEPRKC

SEQ ID NO: 7831 - protein, 81 aa, Alligator sinensis
PQVPVTFDDVSVYFSEQEWESLAAWQKELYKHVMRGNYETLVSLDYAISKPDILSRLERGEEPCIRDQLAAWDGPEKGSQE

SEQ ID NO: 7832 - protein, 81 aa, Alligator sinensis
MLRNYHTLVSLGYQGPTPDLICRIQRGEVELWVCDDKDPGESAWSKNLSPDFSDSWDSLAEDSSVGSFPGPGSSVQAALSG

SEQ ID NO: 7833 - protein, 81 aa, Alligator sinensis
MSMRMSTCTRTVLSQWNQVTHYQAYPKEIYLRFLSRAKLMVLIAGFPITKPDMISRMEQKEEPWVLRVQGYEEKEILNGMR

SEQ ID NO: 7834 - protein, 81 aa, Alligator sinensis
PAKQGQSMELREVFEDVAVYFTREEWELLEEEDKGLYRDQMLRNYQALVSLGKALVLASPWSHVSSEVVLSSPWFSSISSS

SEQ ID NO: 7835 - protein, 81 aa, Microcaecilia unicolor
QQMRVAFEDIAVSFSQEEWEYLDEGQKELYREVMKENYETLISLGYESVNPDILSRIKQEEGPSEEKQDCHSYTGQPITQE

SEQ ID NO: 7836 - protein, 81 aa, Microcaecilia unicolor
MRVTFEDIAVSFSQEEWEYLDDGQKELYREVMKENYEILISLGYERISPDTLSRIKQEEEPYVWDPHESREREVTHADTVD

SEQ ID NO: 7837 - protein, 81 aa, Microcaecilia unicolor
HQTLVTFKDVAAYFMEVEWNILGEWQKELYKKVIKDVHEILMAQGYSIVNPDVIFKIKKEDEKYFVQHCELEGKENLNDPT

SEQ ID NO: 7838 - protein, 81 aa, Microcaecilia unicolor
LKTSVTFKDVAAYFSEEEWAALEEWQKELYRSVMKEIHAALLSLGYRIVNPDAVFWVKNKLEPNAKWSQDLGEIQSINVSY

SEQ ID NO: 7839 - protein, 81 aa, Microcaecilia unicolor
QVPVTFEDITVYFSQEQWEYLDESQKELYREVMKENYKTLITLGTDHESINPEVLARIKQEKEPHVWDPKESEDRGVPHSC

SEQ ID NO: 7840 - protein, 81 aa, Microcaecilia unicolor
IPVTFEDIAVYFSQEEWKDLEDWQKKLYKDVMKENYEILLSLGTGSITVTPDIISYVEREIRDEPGSEERETGKSSCSEAV

SEQ ID NO: 7841 - protein, 81 aa, Microcaecilia unicolor
DEALVTFKDVAAYFSEVDWNILGEWHKKLYKKVIKEIHDILMSRGYSIVSPDVVFKIEKEDEKYFSQPFEWEGKENPYDST

SEQ ID NO: 7842 - protein, 81 aa, Bambusicola thoracicus
VVVAFEDVAVYFSAEEWVLLARWQRELYQEVMMDNYDLVACLVPWDEDTAGDSIQGHRVPPEPESPPLRPAWGGWDPAGAA

SEQ ID NO: 7843 - protein, 81 aa, Micrurus paraensis
LVSFEEVAVYFSEEEWSRLDPDQKALHSEVMLENHRNLVSLGKNGQGNQDSCELSQVINTKDGMEKFGIRTEFEKHERNQS

SEQ ID NO: 7844 - protein, 81 aa, Micrurus paraensis
PKVPLNFSDTSVHFNEQEWRNLEEWQRELYRTVMRSNYDMLVSLDHAISKPDILSQMDQGEEVRMEESEVLENREIPKDPS

SEQ ID NO: 7845 - protein, 81 aa, Micrurus paraensis
QDLVPFEDVAVFFSMEERALLDSEQKALYQKDMLESKRNVASLDPLMAVSSSPGTSVLCSGRSTAAELPTQIFNIMSKKRR

SEQ ID NO: 7846 - protein, 81 aa, Micrurus paraensis
WSDPFEEVTVDFTEEEWALLDSDQRALCAEVTLEAFRNIIALGDGMENANEKQERLMLLQTTNYEGEVTSDHQENPKRERN

SEQ ID NO: 7847 - protein, 81 aa, Xenopus tropicalis
QQMHLTYSDLAVYFSEEEWKDLEGWQKEMYKEVMKDNYENLRSLGIQVPKPDVFLKFRRGKKEVGEAIPCNTGSTKEKQIE

SEQ ID NO: 7848 - protein, 81 aa, Micrurus paraensis
LPQEESSQNTSEGKHRMKFSELYDGAETVVEHPNQVQEGLVSFGEVAVHFSEEEWSQLDPDQKELHWEVMMENYRNVASLG

SEQ ID NO: 7849 - protein, 81 aa, Microcaecilia unicolor
DQTSVTFSDVAAYFLEAEWDILGEWQKELYKKVIKEIHSFLMSQGYSILNPDVIFKIKKEDEKYFIQHCEWEGKENMNDPS

SEQ ID NO: 7850 - protein, 81 aa, Microcaecilia unicolor
EPAPVTFSNVAAYFWEAEWDVLGEWQKELYRQVIKGIHSVLISWGYSIINPDVIFRIKQPEEKYFSQYHDWEEAEPPLGHP

SEQ ID NO: 7851 - protein, 81 aa, Microcaecilia unicolor
MKENYQTLISLGTGSTTVIPDIISHIEQGEEPYIRDEPGPEERETGKSNCSDPRITQGGKRQKKPEEPLVEIEEIQRKTEN

SEQ ID NO: 7852 - protein, 81 aa, Microcaecilia unicolor
QKRVTFEDIAVSFSQEEWGYLDEEQKELYREVMKENYQTLISLGTGSPTVIPDIISHIERGEEPYVREEPGSEEREAGTSR

SEQ ID NO: 7853 - protein, 81 aa, Microcaecilia unicolor
QQPVTFEDITVHFSQEQWEYLDEGQKELYREVMKENYETLISLGTDLKSINSEVLSKIKKEEKPHVWDAKNSREREVTHSY

SEQ ID NO: 7854 - protein, 81 aa, Microcaecilia unicolor
EPMFITFSDVAAYFWEAEWDVLGEKQKEIYRNVIKGIHSVLKSWGYSIVNPDVIFKIKKEDEKYFTQHCERGQKEDSSSLN

SEQ ID NO: 7855 - protein, 81 aa, Microcaecilia unicolor
AQASVIFRDVAVCFSEEEWETLEEWQKELYRNAMKEIHGALISLGYVISNPGVLFKIRKEDETRCGGEHASKDRENNDIAG

SEQ ID NO: 7856 - protein, 81 aa, Microcaecilia unicolor
QMLVTFEDIAVSFSKEEWEYLDEGQKELYREVMKENYQTLISLGTGFPTVIPEIISHIEQGDEPGSEERENGKSSCSGESG

SEQ ID NO: 7857 - protein, 81 aa, Microcaecilia unicolor
FQTLLAFEDVAVFFSEEEWELLDELQKEVYKNTMRENYETLLSLGLTNMKPEIIAKIDAGEAPSVQNASYLEKRGKKSAAG

SEQ ID NO: 7858 - protein, 81 aa, Microcaecilia unicolor
DQASVAFSDVAAYFLEMEWNILGEWQKELYKNVIKEIHSFLILQGYSIVNPDVIFKIKKEDEKYFTQHCEWEGKENMSDPS

SEQ ID NO: 7859 - protein, 81 aa, Microcaecilia unicolor
MEWDILGEWQKELYRKIIKEIHDILTSRGYSIVNPDVIFKIKKEDEKYFTQHFEQDGKENLNDPPKSLPIVTSVFSLSVKQ

SEQ ID NO: 7860 - protein, 81 aa, Microcaecilia unicolor
QVPVTFEDITIYFSQEEWEGLQEWQKELYKDVMKENYEILISLGASSPILTPDVISHIERGEEPYIRDEPRSEERESGKSS

SEQ ID NO: 7861 - protein, 81 aa, Microcaecilia unicolor
QQMRVTFEDIAVSFSQEEWEYLDEEQKELYREVMKENYQTLISLDHQITQERKIKKNPGDHHRNDELFTSTECNQSFTLLS

SEQ ID NO: 7862 - protein, 81 aa, Microcaecilia unicolor
DLTPVTFTDVAAYFCEAEWDILEEWQRELYKKVIEEIHEILMSRGYSIVNPDVIFRIKRQDEKYFSQHHDWKKNENINGPA

SEQ ID NO: 7863 - protein, 81 aa, Microcaecilia unicolor
DQVSVIFKDVAAYFLEVEWNILGEWQKELYKMVIKEIHGILISRGYSIVSPDVIFKIKKEDEKYFTQQIEWEGKEYPNDPN

SEQ ID NO: 7864 - protein, 81 aa, Microcaecilia unicolor
NPASVTFNDVAAYFWEVEWDVLGEWQKELYKKVIKEIHGLLMSRGYSIVNPDVIFKIKKEDEKYFTQHCEWEGRGYTNDPT

SEQ ID NO: 7865 - protein, 81 aa, Xenopus tropicalis
HQMPVTFFDVAASFTEQQWSRLETWKKELYQNVMKELHGALTTLGYKIENPEILFKIKNADDTCVRIDVNSKEKENIDSKD

SEQ ID NO: 7866 - protein, 81 aa, Terrapene carolina
MPVTFEEVAVYFTQGQGALLDPAQRTLYRDVMRENYETVTSLGFPIPKPDLITRLERGQEPWISDLQACEEREIPRGTRTG

SEQ ID NO: 7867 - protein, 81 aa, Terrapene carolina
ERGPVTFEEVAVYFTREEWALLDLTQRALYRDVMQENYETVVFLVGFPISKPDVISQLERGEEPWVLDLQGYEKEVLPRAA

SEQ ID NO: 7868 - protein, 81 aa, Pantherophis guttatus
PKVPVTFDDLSVHFNEQEWGNLDELQKDLYKTVMKSNYEMLVSMDYAIAKPDILTRIEQGDSLCDTNVETMPENNTLAHPG

SEQ ID NO: 7869 - protein, 81 aa, Pantherophis guttatus
IKNSVTFEDVAVYFTEDQGALLDRKQRTLYEDVMVENYGIVASLGFLTLKPALISQIECGEEPWLPETPKLDDTKISNADA

SEQ ID NO: 7870 - protein, 81 aa, Pantherophis guttatus
RVTFEDVVVGFSLEEWSLLEGSQKELHQEVMLETCSLLLSLGHSVPTLDFSSLTCQPDGTAETPQPSWRRRLPLVAGGDKT

SEQ ID NO: 7871 - protein, 81 aa, Xenopus laevis
MEESAKPNDVTVCFSVEELDSLEDGQRDHNKNLKTKVHHSPNLVGYLYVKPEIVPRIRRGEGLCVSSDLYTEKRRNRAYLT

SEQ ID NO: 7872 - protein, 81 aa, Notechis scutatus
MEPWVYLDQRQKALYRDVMQESYETLMSLANQLLNNSNHDNEDEEDVEELRPGTSQSVPRKVKPLTRRETPKQPKIIPVVK

SEQ ID NO: 7873 - protein, 81 aa, Pipra filicauda
DVSFEEVAIYFSPEEWAELLPWQRALYREVMADNYDLVASLGSVSKFTDMKEESPGEVPCAGGDSRTSDASSTVAQDGSAS

SEQ ID NO: 7874 - protein, 81 aa, Pantherophis guttatus
SQDISDGKNKTNLTPFYGGAEILVEAPKEGLVSFKEVAVYFSEEEWSQLDADQKALHREVMLENHRNVASLGENIQEFLSE

SEQ ID NO: 7875 - protein, 81 aa, Pantherophis guttatus
MEPWVYLDQRQKALYRDVMQESYETLMSLANQLLNNSNHDDEDEDEDDEEEHEGMEELRPGTSQSAPRRVKPLTRRETPKQ

SEQ ID NO: 7876 - protein, 81 aa, Pipra filicauda
KAPTLVLENDATGFSAQEWENLEEWQRELCRKVLAGKSQALVLPDAAMSEPALLSRLQGGEVPCNEDEVASREIPEDPDTG

SEQ ID NO: 7877 - protein, 81 aa, Pantherophis guttatus
KVPVTFDEEQAVHFSTPEWAKLEDWQKELYRNITRGSYEPLVSLDSAIAKADVLPPQAGLGAAPHIADQPSAGEKEFPPAP

SEQ ID NO: 7878 - protein, 81 aa, Pantherophis guttatus
TEESRKLSLEFLESPLSDEVEGLAEPLLQDVVSFEEVAVYFSKEEWSQLDADQKALHGEVMLENSRNLFSLGKNPFLCSGM

SEQ ID NO: 7879 - protein, 81 aa, Pantherophis guttatus
LVSFKEVAVSFSEEEWSQLDPDQKALHSEVMLQNHRNVVSLGNNGQENQNSCELLQVINAKDGREKFGIRMEFESHERNQS

SEQ ID NO: 7880 - protein, 81 aa, Pantherophis guttatus
MAQAHSAQIQQDLLGSDQERLYREVMQESYNTIFRASPLQLQKSELLAHLKRGQEGLQSSSNGADQKLVKEALKKWPESGN

SEQ ID NO: 7881 - protein, 81 aa, Xenopus laevis
QQMHLTYSDLAVYFSEEEWKDLEGWQKEMYKEVMRDNYENLRSLGIQVPKPDAFFKFQSGKKDVREAIPPDTGSTNEKQVG

SEQ ID NO: 7882 - protein, 81 aa, Xenopus laevis
ATTSIGFNEVAVYFSEEEWRNLELWQKELYSNVMREIHTTLISLGYTIDHPDVLCRIRKDQDPYISSLEEERKTSCFPSTS

SEQ ID NO: 7883 - protein, 81 aa, Alligator mississippiensis
LLREAFEDVAMYFTREEWELLEDAQKGLYRDQMLRNCRALVSLGSWKLLPTFLPDVIISTGRRLWLGCLYLETFSQARSVV

SEQ ID NO: 7884 - protein, 81 aa, Alligator mississippiensis
LQMCVSFEEVAVYFTKEQWALLDPSQRALYRDVMLENYEAVTSLAGFPVPNTNLISWLEQGEELWVTDLQDSKEWEIPRNT

SEQ ID NO: 7885 - protein, 81 aa, Alligator mississippiensis
REMPVIFEEVAVYFTKEQWALLDPSQRVLYRDVMLENYETVTSFVGFPVPKPNLISQLEQGEEPWVPDLQDSKEWEIPKNI

SEQ ID NO: 7886 - protein, 81 aa, Alligator mississippiensis
ELWRTCAGSLEERSSLTPEPGQVQKGQGRPPKQEESLELWEVFEDVAVYFTRKEWELLDDEDKVLYQEQMLKNYQALVSLD

SEQ ID NO: 7887 - protein, 81 aa, Alligator mississippiensis
MVPVNSEASGCFSEQEWGNVEQWPADLHRDAVRSNYEALMSLGQGTDSVLSSAEIPCEVTLGDEPSVQDQADSQGAESPTD

SEQ ID NO: 7888 - protein, 81 aa, Pantherophis guttatus
LVSFEEVAVSFSEEEWSQLDPDQKALHSEVMLENHRNVASLGNNGQENQDSCELFQVINAKDGTEKFGIRMELGSHERNQS

SEQ ID NO: 7889 - protein, 81 aa, Xenopus laevis
GAGQVTFDDAAIYFSEEQWSNLEEVQKKVYKELIKEIYEIMLSLGYLIPKPEIVSRIERGEEPYGVVGKKQKLQEPQPEGQ

SEQ ID NO: 7890 - protein, 81 aa, Pipra filicauda
PKVPLTFDDISVYFNELEWERLERWQKDLYRAVMRGNYETLVSLDYAMSKPDILSWIERDEELGDKEDQEPPWTRAGDRQE

SEQ ID NO: 7891 - protein, 81 aa, Pantherophis guttatus
NSVSFEDVAVFFSVEEWTLLDCEQKTLYQEVMLENAKNVASLTGDGWEVESSGQEAAAPLPKDKKEVAEKFSGKPSPVEKE

SEQ ID NO: 7892 - protein, 81 aa, Pantherophis guttatus
VVSFEEVAVYFSKEEWSQLDADQRELYREVMLENSRNLAYLGFNGQENINCKEECQAIHLKGGERKFVAQMKLKSDDTKKS

SEQ ID NO: 7893 - protein, 81 aa, Pantherophis guttatus
STPVTFEDVVVYFTAAEWARLTDWQRDLYQAVMVETYELVASLAGDVILMAEDEEGGVERPIRQCVPQGKRRQKTPQLRAE

SEQ ID NO: 7894 - protein, 81 aa, Pipra filicauda
PKVPVTFDDVSVYFNDKEWEKLEEWQKELYKNVMKGNYESLISLDYAISKPGVLSQIEQGEESRGRNEQDLEESEIITDAT

SEQ ID NO: 7895 - protein, 81 aa, Pantherophis guttatus
QAPPFSFEEVAVYFTEVEWPLLDAEQRDLYWDVMQENYETVASLAVAIPKPELICRLERGEEPWIPAQAASEEKKIPLNLY

SEQ ID NO: 7896 - protein, 81 aa, Pantherophis guttatus
LVSFEEVAVYFSEEEWSQLDPDQKALHSEVMLENHRNVVSLGNNGQENQDFCELFQVINAKDGTEKFGIRMQLETHDRKES

SEQ ID NO: 7897 - protein, 81 aa, Pantherophis guttatus
MENYELVTSLGYPVLKPDLLSRIERVGEPCVGDQLDSTRGIPTDPCPGYRFFKPESLSWIERWEELGVTDRQKLEEGKLCA

SEQ ID NO: 7898 - protein, 81 aa, Pantherophis guttatus
AQVLAAFGDVAICFSAEEWAELDGWQKDLYREVMAENFQLVSSLECLLAIPELLSQLARGEVSQIGARPPPGQDGECQVVR

SEQ ID NO: 7899 - protein, 81 aa, Pantherophis guttatus
MQESRKLSLDFLESPLCAGAEGLAEPSLQDVVSFEEVAMYFSEEEWSQLDADQKELYREVMLENSRNLFFLGKKHCLCSGT

SEQ ID NO: 7900 - protein, 81 aa, Xenopus laevis
VQMHLTYSDLAVYFSEEEWNDLEGWQKEMYKEVMRDNYENLHSLGIQVPKPDVFLKFHKGKKDVREAILPDAGSTNEKQVG

SEQ ID NO: 7901 - protein, 81 aa, Pantherophis guttatus
NSVSFEDVAVFFSVEEWTLLDCEQKTLYQEVMLENAKNVASLSDGWEVESSGQEAAAPLPKDKKEVAEKFSGKPSPVEKEL

SEQ ID NO: 7902 - protein, 81 aa, Alligator mississippiensis
ADSAQGPVTFREVALYFTDPSQRALYREAMQENYESGSLPGTGSPVPQPEAVSQLKSEENPWVQDLQGCEVREIPSSACTD

SEQ ID NO: 7903 - protein, 81 aa, Alligator mississippiensis
LREVFEEVAVYFTRKEWLLLEDEDKVLYRDQMLRNFQALVSLGGAWLLRGPKEEAHVEGPANAESPWTSLGSLGEMDSPRP

SEQ ID NO: 7904 - protein, 81 aa, Alligator mississippiensis
RRPLRPGPDQMCEKLGSGPPQREDMAVSKLREVFEDVAVYFTRKEWELLENDNKVLYRDQMLKNYQALVFLEDFSIYFHTS

SEQ ID NO: 7905 - protein, 81 aa, Alligator mississippiensis
LLVPVTFEDVAVYFSREEWDVFAGWQKALYRAVMTETYNMLLSLGYPGPKPDILYRMERGEEPWIYTPRGPVVWERPDSPI

SEQ ID NO: 7906 - protein, 81 aa, Alligator mississippiensis
QQPSEDGPGNLELQRTSPGRPEERSSLTPEPGQVQRGQGRPPKQEESWELPEVFEDVAVYFTRREWELLDDDDKSVLSKHI

SEQ ID NO: 7907 - protein, 81 aa, Alligator mississippiensis
MVPVTFEDVAVYFSPEEWAELAGWQRELYRDVMMENYELVASLGWPSVKPEIICKIEQEEEPCVEDPADPSVPGKPRHSWS

SEQ ID NO: 7908 - protein, 81 aa, Alligator mississippiensis
PARQGESTELREAFEDVAVYFTREEWELLEDAQKGLYRDQMLRNCQALVSLGRRLWLGCVYLEICSEAHFTVLRSFAEGLP

SEQ ID NO: 7909 - protein, 81 aa, Alligator mississippiensis
MGPVRFEDVAIHFSREQWEMLAPWQQELYRAVMMENYELLVQLGQEAAKPELVSRLERGAEPYGPEQQDLERGAVPASTST

SEQ ID NO: 7910 - protein, 81 aa, Pantherophis guttatus
LETRQLLATKCFLLKYIFPTWKKNKNSISFEDVAVFFSMEEWGLLDLKQRTLYREVMLENARNVASLSKGFCFFWTEIMVE

SEQ ID NO: 7911 - protein, 81 aa, Pantherophis guttatus
GSITFEEVAVYFTEDEWELLDPSQKVLYGEVMLENSRNVADLAYGQENENYEHPALLQMIKFEEGMLRHQDALQKGMKSCI

SEQ ID NO: 7912 - protein, 81 aa, Pantherophis guttatus
KQRMKLSGFSDGDQTAVEPPNQESLVSFEEVAVYFSEEEWSLLDPDQKVLHSEVMLETHRNMASLGKSSLVPNQRVQEDRL

SEQ ID NO: 7913 - protein, 81 aa, Xenopus laevis
YQMPVTFFDVAASFSEEQWSRLEAWQKELYRNVMKELHGALTTLGYKIENPEILFKIKIADKTCVRIDINSQERENIKSKD

SEQ ID NO: 7914 - protein, 81 aa, Pantherophis guttatus
ELSQVAFEEVAVYFTEQEWALLNVGEKVLYRDVMKENFEHVMSLGILLALKESKIAPCLLLVTPYSSSVAFRQVSFEEVAM

SEQ ID NO: 7915 - protein, 81 aa, Xenopus laevis
HRDSVFFTDVAATFSECEWNMLAQWQREVYGTVMREIHTVLMDLGYHIHNSEILFRITKNEEPGRSHRYVAARSKEGHAPD

SEQ ID NO: 7916 - protein, 81 aa, Xenopus laevis
RKVSIKFEDVAVYFSEDEWNYLEDGQKNLYKNVMMENYYAVSSVGCANKKPNIIVNIEQGEKTYLGYTPPDRTKYVSMLRN

SEQ ID NO: 7917 - protein, 81 aa, Xenopus laevis
EVHIKSGDAAVYFSTEEWEYIESHKESYKDVMMETIGSSGIPNNKTFGKIVTKVAFEKEQKEESYAIRRLDTKVQKISGYA

SEQ ID NO: 7918 - protein, 81 aa, Xenopus laevis
VSPQVIFRDVAVYFSEKEWDLLEGWQRDLYTGVIKEIHGILISLGFIILNPNNFLRIQPEDEPCRKSRNVLERHESINITE

SEQ ID NO: 7919 - protein, 81 aa, Pantherophis guttatus
PKVPMTFEDNAVYFSEQEWGNLEEWQKELYKNVMKSNYESLVSLDYAIAKPDLLSRIEQGERPCAEEEEAATMDRVIPSEP

SEQ ID NO: 7920 - protein, 81 aa, Pantherophis guttatus
FLESSLVAGAEGLAEPLLQDVVSFEEVAVYFSKEEWSQLDADQKVLHGEVMLENFRNLFSLGKNQCSRNFMVAFPRSVPSQ

SEQ ID NO: 7921 - protein, 81 aa, Pantherophis guttatus
QGSVSFEDVAVYFTEEEWALLDSSQRALHREVMLENSRNLAAVGYGQEHKNYQEPSLALFQSEERMLGIQRVLQKTRRSCL

SEQ ID NO: 7922 - protein, 81 aa, Xenopus laevis
GVGQVTFDDAAIYFSEEQWSNLEEVQKKVYKELIKEIYEIMLYLGYRIPKPEIVSRIERGEEPYGVVSKKQKLQEPQPEGP

SEQ ID NO: 7923 - protein, 81 aa, Xenopus laevis
SLTQVAFEDVAVYFSELEWALLKDCQKDLYKTVMRDNYEVVASLGFPVLSSKALGRMRHGVTVELEGTEEIDIGDSAQNMK

SEQ ID NO: 7924 - protein, 81 aa, Xenopus laevis
LVPVSFDEVAVYFSEVEWCFLSDQQQDLYKEVMLENLELVLSLGHQYRPAVPHHVLHDVPHHVPHHVPHHVPHHVLHDVPH

SEQ ID NO: 7925 - protein, 81 aa, Xenopus laevis
PKVSVTFRNLSVCFATEDWAILTESDRNMYKDAIQEIYRTLLSMGHRIMNPNILMYTEETENCGATKKRKSNADIPKLHNA

SEQ ID NO: 7926 - protein, 81 aa, Xenopus laevis
LVKFEEVAVVFSEDEWNLLSDQQRGLYMEVMKENYEHLIYLGYEVPVILSLLQDGGGISSDAGSQSKSQQVAVAEGSNVNS

SEQ ID NO: 7927 - protein, 81 aa, Xenopus laevis
MEEWQRELYRNAMKEIHGALLDLGYRILNPELLVKVEKSLDRGRGKVPSASAAVLVPDILLNIEKLHSPDTSCATDKGRVR

SEQ ID NO: 7928 - protein, 81 aa, Callipepla squamata
ALCLQEPVSFAEVAVYFSREEWALLDPAQRALYRDVMLEMYECVTSLGEGFAAFPPLLDTFGCAECASASRAQSNRHAVPS

SEQ ID NO: 7929 - protein, 81 aa, Alligator mississippiensis
SPGSLGRRGSPRLELGQLHKRQGRPPKRKENVVLLEAFEDVAVYFTQKEWALLDDGDKALYRDQMLRNYQALVSLGMQDLF

SEQ ID NO: 7930 - protein, 81 aa, Alligator mississippiensis
VTFEDVAVYFSPEEWKELVEWQKELYWDVMKENYELVTSLVDDGLTNESLEEKSREEEVESLPMQPFLAKLKEKVLQSPAK

SEQ ID NO: 7931 - protein, 81 aa, Lepidothrix coronata
PKVPVAFNDASFSFSEEEWKSLNEWQKELYRHIMKGNYEAVISMDAAISKPDMLSRIEQGEDPNAEEQEDSEAGETPTDPS

SEQ ID NO: 7932 - protein, 81 aa, Lepidothrix coronata
MQENYESLILLDFPIPKPTVVSRLELEEELGELGVPDPNDSKEWQILRVAPADDGTGSEEEEEEEESESPEPPELDAALPR

SEQ ID NO: 7933 - protein, 81 aa, Pantherophis guttatus
LVSFEEVAVYFTEEEWALLDPSQRALYEEVMLENSRNVAALASGLEHENCKEPSIIVFRMIKSEEDTLVDEEPSQGSKKSC

SEQ ID NO: 7934 - protein, 81 aa, Athene cunicularia
PLQPPLLPERAHVPVTFVDIAVYFSAEEWKNLEEWQKELYNNLVKENYESLLSLGKHPFSPLSVPASLWREGPRCGCPGSL

SEQ ID NO: 7935 - protein, 81 aa, Notechis scutatus
MEEWALLDSEQKALYREVMLENKRNKASLAGDGWEMEDSGQEAAASSLKDKKEVAEKMYGKQSSEENQLTGELENCCGLPC

SEQ ID NO: 7936 - protein, 81 aa, Pantherophis guttatus
LVSFEEVAVYFSEEEWSVLDPDQKALHWEVMLENYRNVASLGDNGQDHKESRESFQVFRYGNVTEKPKMQMKFQRQERNQS

SEQ ID NO: 7937 - protein, 81 aa, Pantherophis guttatus
MQESRKLSLYFLESPLVAGAEGLAEPLFQDVMSFEEVAVYFSKEEWSQLDADQRELYREVMLENSRNLLSLGKNHCLCSGT

SEQ ID NO: 7938 - protein, 81 aa, Alligator mississippiensis
AVELITFEEVAVYFTLEEWALLDSGQRALYWDVMQENYEAMVNLGFPIPKPSVISKLKGGEAQWVPDLKGCEAKRILRSPC

SEQ ID NO: 7939 - protein, 81 aa, Alligator mississippiensis
PKVPVIFNDASFNFSEQEWKNLNEWQKELYRHIMKGNYEAVISLDAAISKPDLLSRIEQGDDPSDGDQGDFEGRETPRDPN

SEQ ID NO: 7940 - protein, 81 aa, Alligator mississippiensis
SLTPEPGQVQRGQGRPPEQEESWEVREVFEDVAMYFSRKEWELLEDDDKVLYRDQMLKNYQALVSQDHKPITDKKRAMCRA

SEQ ID NO: 7941 - protein, 81 aa, Notechis scutatus
RKLFSIFLESSLCVGAERVAATLPQDVLSFEEVAVYFSEEEWSQLNADQKALYGEVMLEISRNLASLGKNPYHKEDMKKRA

SEQ ID NO: 7942 - protein, 81 aa, Alligator mississippiensis
GWAIGGRRMYFAEIQWALLDPGQRPVYRDVVPDGYGTLVSLADGGMTNANPQQGCLETAQPHGTLPGLRSELFVQQWFPKQ

SEQ ID NO: 7943 - protein, 81 aa, Alligator mississippiensis
PQLREVFEDVAVYFTRKEWELLEDEDKVLYWDQMLKNYQALISLGYRGPTPDLICSIQQGQVELWVCEDEDGGEMSKSKEL

SEQ ID NO: 7944 - protein, 81 aa, Alligator mississippiensis
AQLREAFEDVALYFTRKEWELLGDGDKVLYQDQMLRNYQALVSLGYQGFAPDLICCIQRGEMELWVCDDEDPGESSWSETS

SEQ ID NO: 7945 - protein, 81 aa, Alligator mississippiensis
ADVFEDVAVYFTQEEWELLEAGDKVLYQDQMLRNYQALVSLGLFRRCRAESGGRSVETCAGAATLPERFQLGQAEDEKLQV

SEQ ID NO: 7946 - protein, 81 aa, Alligator mississippiensis
PWLQEAFEDVALYFTQKEWELLEDRDKMLYQDQMLRNYQALVSLGSSNTEDTWYLLEEENSMDLFLRSGTSLHAAGARILN

SEQ ID NO: 7947 - protein, 81 aa, Alligator mississippiensis
SKLVEAFEDVAVYFTREEWELLETGDKGLYQDQMLRNYRALVSLGYQGPTPDLICRIQQGEMELWICDEEAGENLFSEDLT

SEQ ID NO: 7948 - protein, 81 aa, Alligator mississippiensis
GTLSRAEQQLPEEGPGNLELQRTSPGRPEERSSLTPEPGQVQRGQGKPPKQEESWELREVFEDVAVYFSRKEWELLEDDDK

SEQ ID NO: 7949 - protein, 81 aa, Alligator mississippiensis
GQRRQGPEHGGQGVQLPVVCEAVAVCFMLEEWELLDDEGKELYRDWMLRHSQALVSLEKGFIINHCPGSFSLPRVLVLNLQ

SEQ ID NO: 7950 - protein, 81 aa, Notechis scutatus
VQDRVTFEEVAIYFSAKEWETLTDWQKTLYLDVMKDNYKNLVSLGLAAQPPSVLLQIEGWEKPCVGRAQFPKSREDSEDNL

SEQ ID NO: 7951 - protein, 81 aa, Notechis scutatus
LVPVTFDEEQAVNFSTPEWAKLEDWQKELYRNITRGSYEPLVSLDSAIAKADVLAPQVGPGSVPHVVDQPSAGGKGLPPAP

SEQ ID NO: 7952 - protein, 81 aa, Notechis scutatus
DVVSFEEVSVYFSKEEWSQLDADQKALHREVMLENSRNLAFLGYNGQESKNCKEECQAIHSKGRKGKFSDQMQPKSDETKQ

SEQ ID NO: 7953 - protein, 81 aa, Notechis scutatus
GFPTQGPVSLGEVAIHFNSEEWLLLDPSQKALYQEVMLETSRMVASLAFDAQKNEIVQEPNLVPLQIIKTEIPGEISTNKW

SEQ ID NO: 7954 - protein, 81 aa, Notechis scutatus
AQDLVSFEEVAVYFTEEEWAMLDPNQRALHKDVMLENFRSVAALAYGQEHENYKEQVIKSEEDSLVDQDPSQGSKKSCEVS

SEQ ID NO: 7955 - protein, 81 aa, Alligator mississippiensis
LGERGSLTPDLGQVQKRQSRPPKQGESTELLEVFEAVAVYFTRKEWELLGDEDKELYRDQMLRNFHALVSLGRKDLFETTC

SEQ ID NO: 7956 - protein, 81 aa, Alligator mississippiensis
TPEPGQMQRQQSKPPKQGESLELREVFEDVAVYFTRKEWELLKDEDKVLYQDQMLRNFQALVSLGKALVLASTWTCVNCEI

SEQ ID NO: 7957 - protein, 81 aa, Alligator mississippiensis
AQDPVSFEDVAVYFTEGEWVLLGAAQRALYWEVMRENYEAVALLGFPIFKPVMIAQLEQGEEPWVLSPPGADHQVEMVPRD

SEQ ID NO: 7958 - protein, 81 aa, Alligator mississippiensis
DSRGWRLPWRWPNLAMEPYVLLDPRQRALYRDVMQESYETLMALEFPISKPDLLSRLDHGDEPTALDLHVSKGARAEGATS

SEQ ID NO: 7959 - protein, 81 aa, Alligator mississippiensis
MELQEVFEDVAVYFTREEWELLEEEDKGLYRDQMLRNYQALVSLGKALVLASPWSHIRHAEEKPHVRATCGKSFTCLSTLA

SEQ ID NO: 7960 - protein, 81 aa, Notechis scutatus
PKVPVTFDDLSIHFNEHEWGNLDELQKDLYKTVMKSNYEMLVSMDYAIAKPEILTRIEQGDSLCDTNVDAMPENNTPAHPG

SEQ ID NO: 7961 - protein, 81 aa, Notechis scutatus
RLFTLEDMAVHFTEEEWALLEPDQKALHREVMEEINGILATLGDEWRIMDKRKPSTNPRFHQEGKPYECSECGKAFRMKTN

SEQ ID NO: 7962 - protein, 81 aa, Athene cunicularia
LEITLLFPASPYVLLDPRQRALYRDVMQESYETLMALEFPVSKPDLLSRLDHRDEPTALDLHVPRDAPAAGESLITPRSQR

SEQ ID NO: 7963 - protein, 81 aa, Notechis scutatus
QAPPFSFEEVAVYFTEVEWTLLDAEQRDLYWDVMQENYETVASLAVAIPKPELICRLEQGEDPWIPSQAASEEKKIRLNLY

SEQ ID NO: 7964 - protein, 81 aa, Notechis scutatus
VVSFEEVAVYFSEDEWSQLDPDQKALHSEVMLENHRNVVSLGNNGQENQDSCELFQVINAKDGTEKFGIRMEFESHERNQS

SEQ ID NO: 7965 - protein, 81 aa, Limosa lapponica
PKVPLTFDDISVYFNEEEWERLERWQKDLYRAVMRGNYEMLVSLDYAVSKPDILSRMERDEELCVREGQELPMTGLGKDQE

SEQ ID NO: 7966 - protein, 81 aa, Alligator mississippiensis
PQVPVTFDDVSVYFNEQEWENLASWQKELYKHVMRGNYETLVSLDYAVSKPDILSQIERGEEPCVREQPGSPERSEEAEEK

SEQ ID NO: 7967 - protein, 81 aa, Alligator mississippiensis
SKLQLPEAAEDISVYFTREEWELLEDEDKELYQDQMLRNYQVLVSLGGIISRTTRVHAGEKPFSCPQCGKSFIKSSTLTQH

SEQ ID NO: 7968 - protein, 81 aa, Notechis scutatus
PKVPMTFEDNAVYFSEQEWGNLEEWQKELYKNVMKSNYESLVSLDYAIAKPDLLSRIEQGERPCAEEEEAATTDRVIPSEP

SEQ ID NO: 7969 - protein, 81 aa, Notechis scutatus
PKVPVTFDDMSVYFNEKEWEKLEEWQKELYKNLMKGNHQSLVSLDYAISKPGVLSQTERATDSCHEDNGDSEEQGRLPDAT

SEQ ID NO: 7970 - protein, 81 aa, Lepidothrix coronata
AQVPVTFEDVMVYLSRAEWDSLQAGQRELYRDVVLDTYELLTSLGHPGPKPDILYRLERGEEPWICPSSGHTGSWQEEPLS

SEQ ID NO: 7971 - protein, 81 aa, Notechis scutatus
QVTFEDVAVDFSLEEWSLLEGSQKDLHQEVMLELCSLLLSLGHSVPSLDFSSLTCQPARTAQRPPPSWRRWLPLAAGSDQI

SEQ ID NO: 7972 - protein, 81 aa, Limosa lapponica
LEVPVTFEDVAVCFSREEWEILDEEQKELYRTVMEDNYDTLVSLYAEVGIPTEVPQEEVAAEELAVPETPSKSLKEQDVKD

SEQ ID NO: 7973 - protein, 81 aa, Callipepla squamata
ARHGAGTRSVSPSLWGTMEPYVLLDPRQRALYRDVMHESYETLMSLGNADPKSSVPPPIPTLPTFGVPPSVGESHCAHLHL

SEQ ID NO: 7974 - protein, 81 aa, Alligator mississippiensis
QGLLTFEEVAIYFNKGEWALLDATQRSIYKDVMQENYETVVSLTPEVAVPKPVVITQLEQGEEPWVEDLQKSMERENLQDI

SEQ ID NO: 7975 - protein, 81 aa, Alligator mississippiensis
PQSQHGVHVQGTPPGRLGEGGSLTPDPGRLHMGPPKQELREAFEDVAVYFTRKEWELLGDEDKELYRNQMLKNYQALVSLV

SEQ ID NO: 7976 - protein, 81 aa, Callipepla squamata
SKEPLSFEEVALYFSREEWALLDHAQRALYRNVMLEKYECVASLAPIPAPKPMVISLLEEGEEPWIPDVGSPEAMAGDVSP

SEQ ID NO: 7977 - protein, 81 aa, Callipepla squamata
SLCLQEPVSFEEVAVYFSREEWALLDPAQRALYRDVMLETYECVASLGEGFAAFPSLLGTFGCAECASARGPQSKPHAVPS

SEQ ID NO: 7978 - protein, 81 aa, Alligator mississippiensis
VQMLVTFEEVAVYFSEVEWTLLDPSQKALYRDVMQENYETVTSLGLLISKPDVVSQLEQGEDPWVLDLQGSEEKEPLSWTH

SEQ ID NO: 7979 - protein, 81 aa, Alligator mississippiensis
GALSPEQGQLHKGQGRLARQGESMELWEAFEDVAVYFTREEWELLEDAQKGLYRDQMLSNCRALVFLGKAVSSFSLQPCEH

SEQ ID NO: 7980 - protein, 81 aa, Alligator mississippiensis
PKVPTGFENGAAYFSEQEWENLDECQKELYKNVMKGNFDSLVSLDYAISKPDLLSRIERGEAPCPRDAGDSEEREIPAEPS

SEQ ID NO: 7981 - protein, 81 aa, Alligator mississippiensis
VTFEDVAVYFSPEEWKELVEWQKELYWDVMKENYELVTSLDDGLTNESLEEKSREEEVESLPMQPFLAKLKEKVLQSPAKT

SEQ ID NO: 7982 - protein, 81 aa, Alligator mississippiensis
VTLEEVAVGFPGKQRSPLDSSQRALYWDVMLEKNETLVSLDFRGSGLIFPVSVAYSRAPACPSASKETFSQNKAENPQQPY

SEQ ID NO: 7983 - protein, 81 aa, Alligator mississippiensis
KLREAFDDVAVYFTLEEWELLEAGDKGLYRDQMLRTYQALVSLVHQVTHAGEQLYRCAECKKSFTKWDHLQSHVCVHAGEK

SEQ ID NO: 7984 - protein, 81 aa, Limosa lapponica
PKVPVTFVDIAVYFSAEEWKNLEEWQKELYNNLVKENYEALLSLDGAISRSEAQPRGERGEGPCVPEQRELEQRELPPDAC

SEQ ID NO: 7985 - protein, 81 aa, Alligator mississippiensis
AQGPVTFEDVAVYFSAEEWQELAGWQRELYRDVMMDTYELVASLGPAGLKPEVVSKLERGEEPHQPARSRESPRAPLPVLL

SEQ ID NO: 7986 - protein, 81 aa, Alligator mississippiensis
AQVPVAFEDVAVYFSAEEWAELAGWQRELYREVMKENYELISSLGCPSAKPELICQLEKGEEPYVWDPQGWRSGCRPPDTW

SEQ ID NO: 7987 - protein, 81 aa, Alligator mississippiensis
DKLPRVPEEEPLPHQESVQRGQGRPPKQEESLEVREVFEDVAMYFSRKEWELLDDDDKVLYRDQMLKNYQAPVSLGKALVF

SEQ ID NO: 7988 - protein, 81 aa, Alligator mississippiensis
AQAPVTFEDVAVYFSPEEWAELVDWQRDLYRDVMMENHELIASLGPRLKPSVKRAKREKAPRAWDHQYSRMTDLMPPGQGN

SEQ ID NO: 7989 - protein, 81 aa, Alligator mississippiensis
KLSEAFEDVAVYFTWKEWALLEAGDKMLYRDQMLKNYQALFSLADAETLGRAEQQLSEEGPATLELFPTQTRRLAQLGQRT

SEQ ID NO: 7990 - protein, 81 aa, Alligator mississippiensis
QEAFEDVAVYFTQKEWELLEAGDKELYRDQMLRNYQALVSLESLTHGKTPVATSNFITARNASSRIENRDKCISSWLNPAT

SEQ ID NO: 7991 - protein, 81 aa, Alligator mississippiensis
AGAPDETPAQEQRESLELREVFEDVAVYFIWKAWELLEDEVKVLFQDQMLRNYQASVSLEKKKFHCEPSVMDLFQHHESLL

SEQ ID NO: 7992 - protein, 81 aa, Notechis scutatus
DLVSFEDVAVFFSVEEWALLDSEQKALYQEVMLENKRNIASLGDRWEMEDSGQEAAAPLPKDKNEVAEKIYGKQSSEQNQL

SEQ ID NO: 7993 - protein, 81 aa, Notechis scutatus
LQVLVSLAEVAVCFSEEEWSQLDPVQKDLHREVMLENSRNVAFLGNNVQENKEIFQTFRDEERRKEFSYSMETTENERNLS

SEQ ID NO: 7994 - protein, 81 aa, Notechis scutatus
ELPQVAFEEVAVYFTDQEWALLNVGDKVLYKDVMQENFEHVMSLGILLALKESKIAPCLLLVTPYSSSLAFHQVSFEEVAM

SEQ ID NO: 7995 - protein, 81 aa, Athene cunicularia
PKVPVAFNDASFNFSEEEWKSLNEWQKELYRHIMKGNYEAVISMDAAISKPDLLSRIEQGEDPNAEDQEDSEGGETPTDPS

SEQ ID NO: 7996 - protein, 81 aa, Notechis scutatus
DIVTFEEVAVYFSKEEWSQLDADQQELYREVMLENSRNVLSLGFNGQENKKCKEERQAIHSKGAERKFVDQMQPKSDETKQ

SEQ ID NO: 7997 - protein, 81 aa, Alligator mississippiensis
LEGLVTFEEVAMYFTKDQWALLDPDQRALYRDVMLENYETVASLGFLTSKPDVVSQLEEGDAPWVPDCQECEERRSLRHTS

SEQ ID NO: 7998 - protein, 81 aa, Alligator mississippiensis
MQENDQTVLSVGFPIPSAAMISCLEQGEKPRVLDPLDSEMTEIPRVTDEGIPSNSKVDAPDSEKTELHEMLLRGSSQATSW

SEQ ID NO: 7999 - protein, 81 aa, Alligator mississippiensis
AQVPVTFEDVAVYFFREEWDVFADWQKALYREVMMENYGTLLSLGYAGPKPDILYRMERGEEPWVCTLQSPVVWESPGSPA

SEQ ID NO: 8000 - protein, 81 aa, Alligator mississippiensis
LDGLVTFEEVAIYFTQEEWDLLDPAQRAFYWDVMQENYDMVNSLWNLIYIPCMTSQPEYSQDPWVPALQCSEGMEFSNDIT

SEQ ID NO: 8001 - protein, 81 aa, Limosa lapponica
GQEPVTFEDVAIYLSRAEWEALEEEQRELYRSVMLDNYRLLSSLGYPGPKPDILHRLERGEEPWVCALPSPLRWDGHDSPS

SEQ ID NO: 8002 - protein, 81 aa, Alligator mississippiensis
PKMPVTFVDVAVYFSAEEWKNLEEWQKELYNNLVKENYESLISLGSSLSKADAQPRPERGVEPCIPQQPELEQRPIPVDHC

SEQ ID NO: 8003 - protein, 81 aa, Notechis scutatus
SGEKQRMKLPGFYDGDQTAVEPPNQEGLVSFEEVAVYFSEEEWSQLDPDQKALHSEVMLENHRNVVSLGKSFLVPNQEERF

SEQ ID NO: 8004 - protein, 81 aa, Callipepla squamata
LPPTIIPACRRVAMAPAHPSQEPVSFAEVAVYFSREEWALLDAAQQAPYRDMMLEMYKCVASLGEGFAAFPPHYGTFGCTE

SEQ ID NO: 8005 - protein, 81 aa, Alligator mississippiensis
MFEMVAVYFIKEQWALLDPAQTALYKEVMLENYATVASLAGFLISKPSLISRLEQGEELWVQAWQNYKEREIPGDSGSGDD

SEQ ID NO: 8006 - protein, 81 aa, Alligator mississippiensis
RTSPGRLEERGSLTPEPGQVQIPEVFEAVAVYFMRKEWELVEDEDKVLYRDQMLKNYQDLVSLGKALVVASPWRYANSEVL

SEQ ID NO: 8007 - protein, 81 aa, Athene cunicularia
FQEPVAFEDVAVYFSAEEWRGLAGWQKGLYKEVMMENYQLIASLGSAGPKPEVVLKLEQGEEPLLGDTPTAPIRGSPQAPS

SEQ ID NO: 8008 - protein, 81 aa, Callipepla squamata
LPPMILPACRRAAMAPAHPSQEPVSFVEVAVYFSREEWALLDAAQQAPYRDVMLETYKCVASLGESFAAFPPHYGTFGCAE

SEQ ID NO: 8009 - protein, 81 aa, Callipepla squamata
VAVTFEDVAVHFCPEEWALLSRWQRELYWEVMMDNYDLVNGLGSYGIPERTLQELLMDLKRCPKGLVLRHPKESHGIPQRT

SEQ ID NO: 8010 - protein, 81 aa, Alligator mississippiensis
LREVFEDVAVYFTQMEWELLEDDDKVLYQDQMLRNFQALVSLGGTWLLNGAEEETPVEGPANLGPPWTSPRSLGEMDSLRH

SEQ ID NO: 8011 - protein, 81 aa, Notechis scutatus
GSVTFEEVAVYFTEEEWALLDPSQRALHKEVMLENSRNVAALAYGQAHENNQEPSLVLFQGIQSEKGMVGNPGAAPKSRNI

SEQ ID NO: 8012 - protein, 81 aa, Notechis scutatus
QTQPVSFEEVAVCFSQGEWSLLGPSQRVLYKEVMQENYENVTSLVLSLTGLGPNSWMEEEDEAVLGLHSQLSEKGDNQDVR

SEQ ID NO: 8013 - protein, 81 aa, Lepidothrix coronata
KAPTLVLENDTTGFSAQEWENLEEWQRELCRKVLAGKSQTLVLPDDAMSEPALLSRLQGGEVPCSEDEVASREIPEDPDTG

SEQ ID NO: 8014 - protein, 81 aa, Notechis scutatus
FRRIPWEDPSQDTSGEKQGMNLSGFYDGDQTAAEPPNQEGLVSFQEVAVPFSEEEWSQLDPDQKALHSEVMLENHRNVVSL

SEQ ID NO: 8015 - protein, 81 aa, Alligator mississippiensis
RPSPGTRGQSGFLTPGPGQLQEGQGRPAKQGQSMELREVFEDVAVYFTREEWELLEEEDKGLYQDQMLRNHQALVSLVSSS

SEQ ID NO: 8016 - protein, 81 aa, Alligator mississippiensis
PQALVTFEEVAVYFSKGQWALLDPGQRALYRDVMQENYEMVASLAGFPVPQPDVISQLERGEEPWVMDLQEREILGYIHTD

SEQ ID NO: 8017 - protein, 81 aa, Alligator mississippiensis
LQEVFQDVAVYFTRKEWELLEDEDKVLYRDQMLRNFQALVSLGGAWLLGGAEEENHAERPANLEPPWASPGNFGDMDSLRP

SEQ ID NO: 8018 - protein, 81 aa, Alligator mississippiensis
PQVPVTFDDVSVYFSEEEWESLAGWQKELYKNVMKGNYETLVSLDYAISKPDLLSRIERGETPCIGEQAGSVDGEVPVDPN

SEQ ID NO: 8019 - protein, 81 aa, Athene cunicularia
SHEPVIFEDVAIYLSRAEWDAIEVEQKDLYCSVMLDNYELLTSLGYPGPKPDVLFRLERGEEPWVCTPQSPVRWDGSVRVP

SEQ ID NO: 8020 - protein, 81 aa, Alligator mississippiensis
LREVFEDVSVYFTRKEWELLEDEDKVLYRDQMLKNYQALISLGSLGEMDSLRPQKKQWHKSQARPKKQKENVAASQHRHVH

SEQ ID NO: 8021 - protein, 81 aa, Alligator mississippiensis
PGRLGERGSLIPELGQVQKGLVRPPKQEESLELQQVFEDVAMYFTQKEWELLEDDDKVLYRDQMLRNYQALVSLGYFVFLC

SEQ ID NO: 8022 - protein, 81 aa, Alligator mississippiensis
TLSRAEQQPPEEGPVILELQRTSPGRLEERSSLTSEPGQVQRGQGRPPEQGESLELQEVFEDVAVYFTQREWELLDDNDKD

SEQ ID NO: 8023 - protein, 81 aa, Alligator mississippiensis
AKLQVVFEDVALYFTRKEWALLEDGDKALYREQMLRNYQALVSLGAMSEPDPSIFATYSRAANWTHEEMKDLLTIWGREEN

SEQ ID NO: 8024 - protein, 81 aa, Alligator mississippiensis
MGGPVTLEEAAVYFAMDQWAAGDPRKALYKDDAQENYDTLVTLSDGTASENEEEAPEQEGPEIVEMDTALISRPEETVPQS

SEQ ID NO: 8025 - protein, 81 aa, Notechis scutatus
EGLVSFKEVAVYFSKEEWSQLDADQKALRIHTGEKPYKCMECRKCFSMKTNLKTHEMIHTGKKPYKCIECGKCFSTKTNLK

SEQ ID NO: 8026 - protein, 81 aa, Notechis scutatus
LVSFEEVAVYFSEEEWSQLDPDQKALNLEVMLENHRNVVSLGNNGQENQDSRELFQVINAKDGTEKFGIQMEFESHERNQS

SEQ ID NO: 8027 - protein, 81 aa, Lepidothrix coronata
DVSFEEVAIYFSPEEWAELLPWQRALYREVMADNYDLVASLGSVSKFTDMKEESPGDVPCAGGDSRTSDASSTVAQDGSAS

SEQ ID NO: 8028 - protein, 81 aa, Notechis scutatus
AQVLAAFGDVAVCFSAEEWAELAGWQKDLYRDVMAENFQLVSSLECLLAIPALLSQLAQREVPQIGAKRPPGQDEECQVAS

SEQ ID NO: 8029 - protein, 81 aa, Notechis scutatus
FRRIPWENPCQDTSGEKQRMKLSGFYDGDQTAVEAPNQEGLVSFEEVAVYFSKEEWSQLDPDQKALHSEVMLENYRNVVSL

SEQ ID NO: 8030 - protein, 81 aa, Callipepla squamata
NFCLPPVIIPACRRAAMASAHPSQEPVCFEEVAVYFSREEWALLDPAQRALYRDVMLETYQTVASLGEEFAAFPPLLGTFG

SEQ ID NO: 8031 - protein, 81 aa, Alligator mississippiensis
QMLVTFKEAAVHFTEEQWNLLDPDQRSLYTDVIQEIYEMVVSLGSLSPSTENDPPLDALSVPAGYWMARGTFSGGWNRPSR

SEQ ID NO: 8032 - protein, 81 aa, Alligator mississippiensis
EDISVSFEDISVSFARGEWEMLAEWQRELYWDVMVESYETLVSLGCDAPKPKILLLMEEKGKPYAEDAAERAGRDLDCASA

SEQ ID NO: 8033 - protein, 81 aa, Alligator mississippiensis
QSLVPVTLEDVALDFSPEWVELAAWQQDLYWDVMRENHTLVASLGYPALEPALFSHAERGEEPGAGEQLDPAGADIPWDPC

SEQ ID NO: 8034 - protein, 81 aa, Alligator mississippiensis
PQVPVTFDDVSVYFSEEEWESLAGWQKELYKHVMRGNYETLVSLDYAISKPDILSRLERGEEPCIRDQLAAWDGPEKGSQE

SEQ ID NO: 8035 - protein, 81 aa, Alligator mississippiensis
LREVFEAVAVYFTREEWELLDDEDKVLYRDQMLKTYQALVSLGGAWLLSKAEEQTPVEGPTDLEPPWTSPGHLGEMDSLRP

SEQ ID NO: 8036 - protein, 81 aa, Alligator mississippiensis
MTFEEVAVYFTTEEWALLDPSQRALYSAVMQENYETVASLGFPIPRLDVVSQMEEGEEPWVLDLQYSTESEMLRSILMVGE

SEQ ID NO: 8037 - protein, 81 aa, Alligator mississippiensis
AQGTVLFEEVAVYFSKGQWDMLDPGQKALYKDVMLENYKTLNSVGLHITKPQVISQLEQGEEPWIPDLQDLEERGILRNIN

SEQ ID NO: 8038 - protein, 81 aa, Callipepla squamata
CLPPVIIPACRRAAMASAHLSQEPVSFEEVAVYFSREEWALLDPAQRALYRDVMLETYECVASLVLKIKDRMWIEEWYEEV

SEQ ID NO: 8039 - protein, 81 aa, Callipepla squamata
PKVPVTFVDIAVYFSAEEWKNLEEWQKELYNNLVKENYESLISLDAALSRSDTQPRLERGDVPCVPEQQDLEQREMPPDAC

SEQ ID NO: 8040 - protein, 81 aa, Alligator mississippiensis
RMGERASLTPEPGQLEQREGMPPKQGGSLELLDAFEDVVLHFTRKEWELLEDEDKVLYRDQMLRNYQALVFLGKALVLAYP

SEQ ID NO: 8041 - protein, 81 aa, Alligator mississippiensis
GKLPEAFEDVAVYFTWKEWELLEAGDKGLYQDQMLRNYQVLVSLGYQGPTPDLICRIQQGEMELWVWEEEEDHCLRTCLQQ

SEQ ID NO: 8042 - protein, 81 aa, Notechis scutatus
MEPWVYLDQRQKALYRDVMQESYETLMSLAANQLLNNSNHDNEDEEDVEELRPGTSQSVPRKVKPLTRRETPKQPKIIPVV

SEQ ID NO: 8043 - protein, 81 aa, Notechis scutatus
DLVSFEDVAVFFSVEEWALLDSEQKALYQEVMLENKRNVASLGDRWEMEVSGQEAAAPLPKDKKEVAEKMYGKQSLKQNQL

SEQ ID NO: 8044 - protein, 81 aa, Callipepla squamata
GTLIQEYGQLQKSFSEDEWKNLNEWQKELYRHIMKGNYEAVISMDTAISKPDLLSRIEQGEDPNAEDPDDSEGGETPTDPS

SEQ ID NO: 8045 - protein, 81 aa, Alligator mississippiensis
PEPGQVQKGQGRPPKQAENLELHEVFEDVAVYFTQEEWELLDNEDKVLYQDQMLRDFKVLVSLGKALVLASSWSYMSCEIL

SEQ ID NO: 8046 - protein, 81 aa, Notechis scutatus
QCSVSFEDVAVYFTEEEWALLDSSQRALHREVMLENSRNLAAVGYGQEYENYQELNFTLFQSEERMLGIQRLLQKSTKSCL

SEQ ID NO: 8047 - protein, 81 aa, Alligator mississippiensis
MEEWGLLDARQRALCHHVIQENYGDAIALGFSVPKPAGISQLERGDAACGLDLPHGDRPPGPRAVPAVPRTSPRHFDCSDC

SEQ ID NO: 8048 - protein, 81 aa, Alligator mississippiensis
LREVFEDVAVYFTRKEWELLEGEDKVLYRDQMLRNFQALVSLGSLGEMDSLRPEKEQWPKCQGRPQKQMKNVAVNQHQYIH

SEQ ID NO: 8049 - protein, 81 aa, Alligator mississippiensis
AQTPVTFDDIAVYFSEEEWEELAQWQKELYQDVMRDNYEALVALGHVATRPDIVLLIEHGEKPCVKGPEDSGKRGIFNNDY

SEQ ID NO: 8050 - protein, 81 aa, Alligator mississippiensis
VPKVPATFEDNAVFSQEEWENLEDWQKELYKNVMKGNYEYLISLDYAISKPDILSRIERGEEPCPRDLPGSEGRETSADPN

SEQ ID NO: 8051 - protein, 81 aa, Alligator mississippiensis
AQLREAFEDVALYFTQKEWELLEDGDKVLYRDQMLRNYQALVSLGCRGPAPDLICRIQRGQGELWVGDDKEPGESAWFEGL

SEQ ID NO: 8052 - protein, 81 aa, Notechis scutatus
NFQEGQSQDATQESRKLSLEFLESPLSAGAEGLAELLVQDVVCFEEVAVYFSEEEWSQLDADQKELYTAVMLENSRNLLSL

SEQ ID NO: 8053 - protein, 81 aa, Notechis scutatus
PKVPLLFDDAACSFSEQEWRGLDESQKDLYRHIMMHNYQAVVSVDAAVSKPELLTRIEQRETLEQNDGRGDYPRDESSFGN

SEQ ID NO: 8054 - protein, 81 aa, Notechis scutatus
DLVSFEDVAVFFSMEEWALLDSEQKALYQEVMLENKRNVASLAGDGWEMEDSGQETAAPLPKDKKEVTEKLYVKQCLEQNQ

SEQ ID NO: 8055 - protein, 81 aa, Callipepla squamata
EPVSFEEVAVYFSREEWALLDPAQRALYWDVMLETYECVASLAPLPGPKPMVISLLEEGEEPWIPDVGSPEAVAGDVSPGE

SEQ ID NO: 8056 - protein, 81 aa, Alligator mississippiensis
TQLREAFEDVALYFTRKEWELLGDGDKALYRDQMLRNYQALVSLGCRGPAPDLIGRIQRGEVELWVCVDEHPRRHAWFEGL

SEQ ID NO: 8057 - protein, 81 aa, Alligator mississippiensis
SKLPEAFEDVAVYFTRKEWELLEAGDKGLYQDQMLRNYQALVSLGLQGPAPDLICRMQLGEMELWVCDDEEAGESSLSEDF

SEQ ID NO: 8058 - protein, 81 aa, Notechis scutatus
MEEWALLDYEQKAPHQEVMVEDTKNMASFGDGLKIVHAAQEMATPFLTAEKEVAERMSEKEKPEEKELKEELGKYSSSPYV

SEQ ID NO: 8059 - protein, 81 aa, Alligator mississippiensis
SQGLVTFEEVAMYFTKGQWALLDPNQRALYKEVMLENYETISTLAGFLVPKPDMITQLEQGGEPWVPDLQGSEGREMSRGA

SEQ ID NO: 8060 - protein, 81 aa, Notechis scutatus
LVSFEEVAVYFSEEEWSQLDPDQKALHSEVMLENHRNVVSLGNNGQENQDSCELFQVINAKGGTEKFGIRMEFESHERNQS

SEQ ID NO: 8061 - protein, 81 aa, Notechis scutatus
LVSFEEVAVYFSEEEWSQLDPDQKALHSEVMLENHRNVVSLGNDAQENQDSCELFQVISAKNGTEKFGIRMEFETHERNQS

SEQ ID NO: 8062 - protein, 81 aa, Athene cunicularia
PKVPVTFDDVSVYFNEQEWERLDRWQKDLYRAVMRGNYEMLISLDYAVSKPDILSRIERDEELHVQDGQEPPQTHIRDSQE

SEQ ID NO: 8063 - protein, 81 aa, Alligator mississippiensis
QVPVTFEDVAVYFSPEEWAELREWQKELYWDVMRENYELVASVGAGFADPKPEPALKPERERDSPILEPWDDSDGGVLDVP

SEQ ID NO: 8064 - protein, 81 aa, Alligator mississippiensis
EAFEDVALYFTQKEWELLEDRDKVLYRDQMLRNYQALVSLDSSDTKGTWDSSTEENSWHSFPRGETSLQAAGARMLSRAEQ

SEQ ID NO: 8065 - protein, 81 aa, Notechis scutatus
KMPVTFVDIAVYFSAEEWKNLADWQKDMYNNLMKENYESLLALGADVNVAKPEMHPRAERAAPESSVPEPPSTKERDVIPE

SEQ ID NO: 8066 - protein, 81 aa, Callipepla squamata
SQEPVSFEEVAVYFSREEWALLDPAQRALYRDVMLEMYEFVASLGEGFAAFPPLLGTFGSEECASARELQNKPHKVPSGQT

SEQ ID NO: 8067 - protein, 81 aa, Callipepla squamata
LQEPVSFEEVAVYFSREEWALLDPAQRALYWDVMLGTYECVASLAPHPGPKPMVISLLEEGEEPWVPDVGSPDAVAGDISP

SEQ ID NO: 8068 - protein, 81 aa, Alligator mississippiensis
MFEMVAVYFIKEQWALLDPAQTALYKEVMLENYATVASLGFLISKPSLISRLEQGEELWVQAWQNYKEREIPGDSGSGDDL

SEQ ID NO: 8069 - protein, 81 aa, Alligator mississippiensis
GQLQEGQGRPAKQGESMELQEVFEDVAVYFTREEWELMEEEDKGLYRDQMLRNYQALVSLGKALVALPSSHVSSAVLLSSS

SEQ ID NO: 8070 - protein, 81 aa, Alligator mississippiensis
LQEVFQDVAVYFTRKEWELLDDEDKVLYRDQMLRNFQALVSLGSAWLLREAKEETPVEGPADPESPWTFPESLGEMDSLRP

SEQ ID NO: 8071 - protein, 81 aa, Alligator mississippiensis
DQLQEAFEDVALYFTQNEWELLGDGDKVLYRDQMLRNYQALVSLGYQGPAPDLISRIQRQEVELWVCEEENPGESVWTEGL

SEQ ID NO: 8072 - protein, 81 aa, Alligator mississippiensis
VQLREAFEDVALYFTWKEWELLEDGDKVLYRDQMLRNYQTLDSLGYQGPTPDLIYRIQRGEVELWVCDEPGESVFSQGLSS

SEQ ID NO: 8073 - protein, 81 aa, Alligator mississippiensis
MLTPEPETPGFPITKPDMISRMEQKEEPWVLRVQGYEEKEILNGMRTAGGGILSENEENPHQDDPKSMEPYDTVSDASRGG

SEQ ID NO: 8074 - protein, 81 aa, Notechis scutatus
AQVPAAFRDVAVCFSAEEWAELTGWQKDLYRDVMAETFQLVSSLECLLAIPDLLSQLAQGEVPQIGARQPPGQDQECQVVS

SEQ ID NO: 8075 - protein, 81 aa, Callipepla squamata
SQEPLSFEEVAVYFSREEWALLDHAQRALYRNMMLETYECVASLAPLPAPKPMVISLLEEGEEPWIPDVGSLEAMAGDVSP

SEQ ID NO: 8076 - protein, 81 aa, Alligator mississippiensis
RGWAIGGRRMYFAEIQWALLDPGQRPVYRDVVPDGYGTLVSLDGGMTNANPQQGCLETAQPHGTLPGLRSELFVQQWFPKQ

SEQ ID NO: 8077 - protein, 81 aa, Notechis scutatus
QDRVTFEEVAIYFSAKEWETLTDWQKTLYLDVMKDNYKNLVSLGGRPTIKQEPPLDEDETGLPCCPLAWKGSQDPGSLSEQ

SEQ ID NO: 8078 - protein, 81 aa, Notechis scutatus
FPTQGPVSFEEVAIHFNSEEWLLLDPNQKTLHQEVMLETSRIVDSLVEDPDTENYQEPGVVPSQIIKIEIQGDTSSDKCGK

SEQ ID NO: 8079 - protein, 81 aa, Gopherus agassizii
SSMPMTFEDVAVYFTKEEWMLLDLGQRALYRDVMQENYENVTSLGFLMSRPDLIYQLEQGEETWVPDRQGSEQRGIQRGAC

SEQ ID NO: 8080 - protein, 81 aa, Gopherus agassizii
ALGLVTFEEVAVYFTESEWALLDPAQRALYRDVMEENYENVTSLAFPVSKPDVISWLEQGEEPWVPDLQNVENLQQDDAEQ

SEQ ID NO: 8081 - protein, 81 aa, Gopherus agassizii
TFTSSEVAVYFTKDEWALLDSVQRTLHRDVMQENCETVTLLVGFPISKPDVISQLERGEEPWVPELQGSEKEVLPRAAFPG

SEQ ID NO: 8082 - protein, 81 aa, Gopherus agassizii
VTFEEVAVYFTREEWALLDPTQRALHRNVMQENYENKALRETTTQQEILMGKRKNTCIECGKNLSDYSALIKHQRIHTGER

SEQ ID NO: 8083 - protein, 81 aa, Gopherus agassizii
LAQVRDSQGMAVYFTKEEWALLDPVQRALYRDIMQENYENVVLLGFPVSKPDVISQLEQEEEPWVPDLQGSEKEVFPRARP

SEQ ID NO: 8084 - protein, 81 aa, Gopherus agassizii
FQGPVTFEEVAVYFTKEEGALLDPTQRALYRDVMQENYETVTSLGKDSFSKPDVVSQLEQGEEPWVLDLQGSEERGILRGV

SEQ ID NO: 8085 - protein, 81 aa, Gopherus agassizii
FQGPVTFEEVAVYFTREEGALLDPAQRALYRDVMQENYENVASLGCPISKPDVITQLERGEEPWVPDLQGSEEGEVLRGAC

SEQ ID NO: 8086 - protein, 81 aa, Gopherus agassizii
FQGPVIFEEVAVYFTSEEWALLDPTQRALYWDVMQENYENVTSLGKGYFSKPHIISQLEQGEEPWVPDLQAGDAMLCEKEE

SEQ ID NO: 8087 - protein, 81 aa, Micrurus lemniscatus
QDLVSFEDVAVFFSMEEWALLDSEQKALYREIMLENKRNVASLDPLMAFSSSPGTSVLCNGGSTAAELPTQDLVSFEDVAV

SEQ ID NO: 8088 - protein, 81 aa, Gopherus agassizii
KVPVAFENDSVYFSEQEWQNLDEWQKELYKNVMKGNYESLISLGKYWFSLQEEELFVEEQGPLEEVEIFSEPSTGELSAVS

SEQ ID NO: 8089 - protein, 81 aa, Phasianus colchicus
CQEPVSFAQVAVYFSREEWALLDPAQRALYRDVMLETYQCVASLAPLPAHKPMVISLLEGGEDPWIPDVRSPEAVPGDLSP

SEQ ID NO: 8090 - protein, 81 aa, Podarcis muralis
LLFICGGPAERQKGYWEMIYNELKNCPVSFEDVAVFFAEEEWSLLDPDQRALHSEVMEDNCLVVTSLGKAPSFPSLQCVIL

SEQ ID NO: 8091 - protein, 81 aa, Gopherus agassizii
PVTFEEVAVYFTQGQGALLDPAQRALYRDVMQENYEMVTSLGKRFPSPWLLEGRIVLRWLIRATARAAMASHIAVVRHLCL

SEQ ID NO: 8092 - protein, 81 aa, Gopherus agassizii
FQRPMTFEEVAVYFTREGWALLDPTQRALYRDVMQENYETVTSLGFPVSRPHIISQLEQREEPWVPDLQGSEERQILRAPR

SEQ ID NO: 8093 - protein, 81 aa, Gopherus agassizii
ATKLLISSNKDVHGVVSGAADTECWTPSLSGAGDFEEVAVYFSREEWALLDPVQRALYRDVMQENYETVTSLGKEFCPLGY

SEQ ID NO: 8094 - protein, 81 aa, Gopherus agassizii
WSLLLQVPVTFDDVAIYFSREEWEMLADWQKELYQEVMRENYANLISLGKDQPSLFYWVQQDHCNPWTVFTPSQPPQRLSV

SEQ ID NO: 8095 - protein, 81 aa, Gopherus agassizii
QGLVTFEEVAVYFTREEGALLDPTQRALYRDVMQENYENVTSLDKVHATLTMPPLLCPVSSSFQHARDTHTSPLPSSVTEH

SEQ ID NO: 8096 - protein, 81 aa, Gopherus agassizii
EQGAVTFEEVAVYFTQGQGALLDPTQRALYRDVMQENYEMVTSLGFPITKPDLITQLERGEEPWVPDLQAWEERESPRGTH

SEQ ID NO: 8097 - protein, 81 aa, Gopherus agassizii
MLVTFEEVALYFTEGQGALLDPGQRALYGDIMQENYETVTSLGKDSCPLSYLKPWGLHFCTWSGSSLVSYIRGDWVSQSTP

SEQ ID NO: 8098 - protein, 81 aa, Gopherus agassizii
VSFEEVAVYFTQGQGALLDPAQRALYRDVMQENYEMVTSLGKGVPSPQILDAVGSPPQTTSSAQGGSVTILHSSWIPRSSS

SEQ ID NO: 8099 - protein, 81 aa, Gopherus agassizii
FQGPVSFEEVAVYFTREEWALLDPVQRALYWNVMQENYETVTSLGKESFSKPDVISQLERGEEPWVPDLQGSEKEVKIQRD

SEQ ID NO: 8100 - protein, 81 aa, Gopherus agassizii
PVTFEEVAVYFTSEEWSLLDPTQRALYWDVMQENYENVTSLGKVYRPLCSWKGKWRVKVYASPKMLLHKLSYHGIRGKIFS

SEQ ID NO: 8101 - protein, 81 aa, Gopherus agassizii
MDTPATDDLVAVYFTREEWALLDPTQRALYRDVMQEIYENVTSLGKEIERENTYSECGKNFRYRSSLIQHKIMHTKGRSYE

SEQ ID NO: 8102 - protein, 81 aa, Gopherus agassizii
HTGPVSFEEVAVYFTREEWALLDPAQRALYRAVMQENYENVTSLGKNSSGDSRIYLSTPDPSPSVQTEIPASLSNPGTPTR

SEQ ID NO: 8103 - protein, 81 aa, Gopherus agassizii
LVTFKEVAVYFSEEEWVMLYPGQRALYRDVMQENYETVTSLGKDSCPLRFFISPPYVRGISPNNLWLLGERLSPPHPLPCD

SEQ ID NO: 8104 - protein, 81 aa, Gopherus agassizii
GNTGKNQQGPTGRGLLLFQGPVTFEEVAVYFTREEWALLDPRQRALCRDVMQENYENVTLVKVHATPTMPPLLCPVSATAH

SEQ ID NO: 8105 - protein, 81 aa, Gopherus agassizii
FQGPVTFEEVAVYFTREEWALLDPTQRALHRNVMQENYENVTSLGKDSFSQPDVIFQLEQEEEPGVSLSITAGDVTVHEKE

SEQ ID NO: 8106 - protein, 81 aa, Gopherus agassizii
SRMPVTFEEVAVYFTQGQGALLDPTQRALYRDVMQENYETVTSLGFPLPKPDLISRLERGEEPWVPDLPACGEREIPRGAH

SEQ ID NO: 8107 - protein, 81 aa, Gopherus agassizii
CLGPVTFEEVAVYFTREEGALLDPTQRALYRDVMQENYENVTLLGKGSCPLGSWKGKCRVKVHATPTKHPPLFFSITPTSQ

SEQ ID NO: 8108 - protein, 81 aa, Phasianus colchicus
PKVPMAFNDTSFSFSEDEWKNLNEWQKELYRHIMKGNYEAVISMDTAISKPDLLSRIEQGEDPNAEDQDDSEGGETPTDPS

SEQ ID NO: 8109 - protein, 81 aa, Crotalus adamanteus
SLALAIFEEVAVHFTEDEWMLLNADQRVLHREVLEEIWKTLASLEILLALGSGQISRIDEDLPAEGFKEEEDNFRGNLSVG

SEQ ID NO: 8110 - protein, 81 aa, Podarcis muralis
MLVSFEDVAVYFTKGQWDLLDSHQKSLYSEVMGENYGHVAFLMGSPVLKPDLISRLEQEEEPWIPIPCEVDGGKTLDSGPG

SEQ ID NO: 8111 - protein, 81 aa, Podarcis muralis
HMWWTCRKDVAVFFAEEEWSLLDPDQRALHSEVMEDNSGGEWETQHNRDRLPKVSSERDRCKKSKTHTGQLPYKCLECGKS

SEQ ID NO: 8112 - protein, 81 aa, Podarcis muralis
MLLVRFTDEEWVLLDPDQRALHKDVMEENRGIVASLDCDELEIENKGDHEKIPREEKPQKNLECGESCSQSSNSTSHQQNL

SEQ ID NO: 8113 - protein, 81 aa, Podarcis muralis
QVTFEDVAVYFAEEEWRLLDPDQRVLHKEVMEENWGVVASLERQDSGDPQASGDLHATQAGSSEEFWERTVQKILGEKQDG

SEQ ID NO: 8114 - protein, 81 aa, Podarcis muralis
QGLVCFEDVAVHFTDKELALLDPDQRALHEEVMEENCGLLDSLGGDEMEINNKGDQERIHTVEEPYKYSDCEDNFIQSSQT

SEQ ID NO: 8115 - protein, 81 aa, Podarcis muralis
MPQTIEVAVYFTKEEWALLDPDQRDLHKEVMEENSENLQHYRHYRTATPIISVLVYNCLESLAIYQLLALYVFAHFLKWIN

SEQ ID NO: 8116 - protein, 81 aa, Podarcis muralis
SPLCFEDVAVCFTDKEWALLDPDQRALHKDVMEENWGIVASLGKPPCGIVLSARKFKTYLYWGKAALAPTASPTGSCDAFA

SEQ ID NO: 8117 - protein, 81 aa, Gopherus agassizii
VTFEEVAVYFTREEETLLDPAQRALYRDVMQENYEKATQSPDSPSQGPQTPPETQPGAHQIFPGTQSAESLARDPRCFSNP

SEQ ID NO: 8118 - protein, 81 aa, Phasianus colchicus
SQEPVSFAQVAVYFSREEWALLDPAQRALYRDVMLETYQCVASLAPLAAPKPMVISLLEGGEEPWIPDVHSPEAVPGDLSP

SEQ ID NO: 8119 - protein, 81 aa, Phasianus colchicus
CQEPVSFAQVAVYFSREEWALLDPAQRALYRDVMLETYQCVASLAPLPAPKPMLISLLEGGEDPWVPDVCSPEAVPGDLSP

SEQ ID NO: 8120 - protein, 81 aa, Podarcis muralis
VCFEDITVCFTAEEWALLDPAQRALHKEVTEENRGILASLSKAPSCIMRFVLQFHTYISIVRELNSAAFSSWASNTSTKTK

SEQ ID NO: 8121 - protein, 81 aa, Podarcis muralis
RMPVNFKEVAVHFPGDQGPLLDPDQRILHNSIMAENDENLAFLGDGQADVNEGDMQMQSSEQDKPTGSPPGLAGESVSQCL

SEQ ID NO: 8122 - protein, 81 aa, Podarcis muralis
PKVPVTFDDDAANFSTQEWAGLEDWQKELYRNITKGTYEPLVSLDSAISKADILPPMGQAEPPRAADHEFVGGKGFPAEPR

SEQ ID NO: 8123 - protein, 81 aa, Phasianus colchicus
LKAAEASESDTSCFAEQEWENLEEWQKELYKNVLRGNSESLNSLDYAISKPDLLSRLQRGEVPCSEVTSGQKEIPTEPSAD

SEQ ID NO: 8124 - protein, 81 aa, Podarcis muralis
MEDAWLVADPNQKPVYRETHQETCDSLVALRPASPKPNEIFLVEEDEETCVPASINRENARRATLVEGLGSEEEEESDEED

SEQ ID NO: 8125 - protein, 81 aa, Podarcis muralis
SQRDNLLPYFFYFQGLMTFRALLTFEEVAVFFTEEEWALLNPSQRALHREVMEDNYETVALLGKDTFLPYNNNNNLLAGFQ

SEQ ID NO: 8126 - protein, 81 aa, Podarcis muralis
GLVSFDEVSVRFTNEEWALLDPGQRALYEEVMEEIREMMTSVGDVSEFLTEGEQSEPSREGAEEQKEQRKQRVQVGTYRKE

SEQ ID NO: 8127 - protein, 81 aa, Podarcis muralis
QGPVCFEDVAVHFTDEEWVLLDPDQRALHKEVMEENREVMDSLSADELEIKNKRDHCKIHTVEKPYNYMVCGESFSQSFYS

SEQ ID NO: 8128 - protein, 81 aa, Gopherus agassizii
GPGPVTFEEVAVYFTREEGALLDPTRRALYRDVMRENYETVTSLGFPVSKPSVISQLEGGEEPWILDLQGSEESKILRSPW

SEQ ID NO: 8129 - protein, 81 aa, Gopherus agassizii
FQGPVTFEEVAVYFTKDEWALLDSVQRTLHRDVMQENCETVTLLGFPISKPDVISQLERGEEPWNEEEKPHQEDAEQGEPH

SEQ ID NO: 8130 - protein, 81 aa, Gopherus agassizii
FQGPVTFEEVAVYFTKDEWALLDSVQRTLHRDVMQENCETVTLLVGFPISKPDVISQLERGEEPWVPELQGSEKEVLPRAA

SEQ ID NO: 8131 - protein, 81 aa, Gopherus agassizii
FQMPVTFEEVAVYFTQGQGALLDPAQRALYRDVMQENYETVTSLGFPLPKPDLISRLERGEEPWVTLLFQMPVTFEEVAVY

SEQ ID NO: 8132 - protein, 81 aa, Gopherus agassizii
AVYFTREEGALLDPNQRALYRDVMQENYENVTSLGKSYSPFSSWNGKRRVMVHASHTMQPLLCPVSASPQYASDTHTTRDP

SEQ ID NO: 8133 - protein, 81 aa, Gopherus agassizii
MTQGREMEVAVYFTSEEWALLDPTQRALYWDVMQENYENVTSLAGFPVSKPHIISQLEQGEEPWVPDLQGSEEREILSFSC

SEQ ID NO: 8134 - protein, 81 aa, Gopherus agassizii
KGVPVTFEDVVVYFSPEEWAALAEWQRELYRDVIMENYELVASLGEDPFISRRSSQWGPFLWDVQTESGGVSLSPADSVPL

SEQ ID NO: 8135 - protein, 81 aa, Gopherus agassizii
FQMPVTFEEVAVYFTQGQGALLDPTQRTLYRDIMQENYETVTSLGKGFLSPRLLEAMGSACLNLVRLFPGQLDQRRMGSIM

SEQ ID NO: 8136 - protein, 81 aa, Micrurus lemniscatus
FEDVAVYFSEEEWSRLDPDQKALHSEVMLENHRNVVSLGNNGQENQDSYELFQVICAEDGTENFRIRMEFKSHERSQSKNW

SEQ ID NO: 8137 - protein, 81 aa, Gopherus agassizii
FLFQGPVTFEEVAVYFTREEWALLDPVQRALYRDVMQENYETVVLLVSKPDVISQLERGEEPWVPDLQGSEKEVLPRAAFP

SEQ ID NO: 8138 - protein, 81 aa, Gopherus agassizii
CTSASPATAIPLPVCKLCHAELGCLSFQMLVTFEEVAMYFSPAEWALLGEEQRQLYRHVMWENYQILVSLGNIFYWANFCC

SEQ ID NO: 8139 - protein, 81 aa, Podarcis muralis
MLLVRFTDEEWVLLDPDQRALHKDVMEENRGIVASLDCNESEIENKGDQDKIPREEKPRKNLECGESCSQSSHSTSHQQNL

SEQ ID NO: 8140 - protein, 81 aa, Podarcis muralis
NLTDKSPVAHFSTPYPGWTTNKGIAFLFQGSMSFEGVSLHFTDDECSLLDPGPRVLYKEVMMEIYEMVASVDKVLSPLINS

SEQ ID NO: 8141 - protein, 81 aa, Podarcis muralis
MQENYETLISLAEEMAISLPRITALADSHRRGLASAGFPLSKPDLLSWMDRGEDPWVPDFQEPEGREMPSESSPGDELRRK

SEQ ID NO: 8142 - protein, 81 aa, Podarcis muralis
NSLCFEDVAVHFTDDEWALLHPDQRALHEEVMGENREIMDSLGKTPCCITISVLKIIHTSIAPTASGTAHLECTVIYCLVC

SEQ ID NO: 8143 - protein, 81 aa, Xenopus tropicalis
GMVPVSFDEVAVYFSADEWHYLSERQRDLYKEVMLENLEVVLSLGYQYRRAAPQAVPAHGSAFILSTGKYFDECSPLFSEE

SEQ ID NO: 8144 - protein, 81 aa, Microcaecilia unicolor
DQVPVTFNDVAAYFWEVEWDVLGEWQKELYKNVIKEIHSLLMSRGYSIVNPDVIFKIKKEDEKYFTQHCEWERKEKTNDPS

SEQ ID NO: 8145 - protein, 81 aa, Microcaecilia unicolor
QQVQVTFEDIAISFSQEEWDYLDEGQKELYRQVMKENYETLISLGYERINPDILSRIKRKEEPYVQEVQESEEKEDCHSYT

SEQ ID NO: 8146 - protein, 81 aa, Microcaecilia unicolor
VPDKALFKDVSAYFLEVEWEILGEWQKELYKKVIKEIHDILISRGYSIVNPDVIFKIKKEDEKCLMHHFEWEGKENPDDPM

SEQ ID NO: 8147 - protein, 81 aa, Microcaecilia unicolor
DQASIIFRDVAAYFLDVEWNILGEWQKELYKKVIKEIHDILMSRGYSIVNPDVIFKVKKEDEKYFTQHFECEGNKNPNDPT

SEQ ID NO: 8148 - protein, 81 aa, Microcaecilia unicolor
VPDQDLFKGVSAYFLEADWDILEEWQKELYEKVIKEVHDILISRGYSIVNPDDMFKLLKEDEKYFTPHFEWEGKENPDDPT

SEQ ID NO: 8149 - protein, 81 aa, Microcaecilia unicolor
DQASVTFSDVAAYFLEVDWDSLGEWQKELYKKVVKEIHNFLFSRGYSILNPDVIFKIKKEEKHLTQHYELEGKENMNDPSM

SEQ ID NO: 8150 - protein, 81 aa, Microcaecilia unicolor
NEALVTFKDVAAYFLEVDWDLLGERQKELYKKVIKEIHDILTSRGYSIVNPDVIFKIKKEDEKYFIQQFEREGNENPNDST

SEQ ID NO: 8151 - protein, 81 aa, Microcaecilia unicolor
KVPVKFEDVAVSFSQDEWGYLDEGQKELYREVMKENFQTLISLESGLQRIEEPYVQDPQEADGREFVQSYSDHEIMQKEER

SEQ ID NO: 8152 - protein, 81 aa, Microcaecilia unicolor
QVPVTFEDITVYFSREQWEYLDEGQKELYREVMKENYETLISLGIDHQSINPEVLSRIKQEEESPVWDPKESGEREVTHSD

SEQ ID NO: 8153 - protein, 81 aa, Microcaecilia unicolor
LLFQALFKDVAAYFLEVDWDILGEWQKELYKKVIKEVHDILISRGYSIVNPDVIFKIKNEDEKYFTQHFEWEEKENPDHLI

SEQ ID NO: 8154 - protein, 81 aa, Xenopus tropicalis
SKVSVHFSEVAVYFSEEEWQCLSKSEKDLYQTVTMDSYYMLLSLDLLNVKPEIVQRIEQGRDPSVSCHQEMLWRKKCMGTQ

SEQ ID NO: 8155 - protein, 81 aa, Microcaecilia unicolor
RTMRVTFEDIAVSFSQEEWEYLDKGQKELYREVMKENYETLISLAHNEAVQELKQEQNREEPPVEMEQIPRQSGNVCENFS

SEQ ID NO: 8156 - protein, 81 aa, Microcaecilia unicolor
VDCVQMPVTFQDIAVSFSQEEWEYLDEGQKELYMEVMEENLELLTSVGSLVVQLEQNQEFYVMEQRGTPLIPYTGNGVGVG

SEQ ID NO: 8157 - protein, 81 aa, Microcaecilia unicolor
DQALVTFKDVSAYFLEAEWDILGGWERELYRKVVRDIHDILTSKGYSIVNPDVIVKIKKEDETYLTQHFEWEGKENPNKSF

SEQ ID NO: 8158 - protein, 81 aa, Microcaecilia unicolor
DQASITFKDVAAYFLEVEWDILGEWQKELYKRVIKEIHDILMSRGYSIVNPDVIFKIKKEDAKYFTQHFEWEGNENLNDPT

SEQ ID NO: 8159 - protein, 81 aa, Microcaecilia unicolor
NEVSITFNDVSVYFLEVEWDILGEWQKELYKTVIKEIHDNLMSRGYSIVNPDVIFKIKKEDEEKENPDDPTKSFPIVTSVF

SEQ ID NO: 8160 - protein, 81 aa, Micrurus paraensis
EEVAVYFSEDEWSQLDPDQKVLHLEVMLENHRNVVSLGNNGQDSCELFQVINAKDGTKMFGIQMEFESHERNQSKNWNQES

SEQ ID NO: 8161 - protein, 81 aa, Micrurus paraensis
QDTSGGNRVISFAFVRPSCSGGTEGVAEAPAQGLVSFEEVAVYFSEEEWSQMDAHQKALHKEVMLENSQNVASLGAREQEN

SEQ ID NO: 8162 - protein, 81 aa, Xenopus tropicalis
YQVSVTFHDVAACFSAEEWAGLQDWQKELYRNVMREIHTALQAMGFEIINPDVLFRIKKVKEVYSSLMERAEPSAAFPGAE

SEQ ID NO: 8163 - protein, 81 aa, Bambusicola thoracicus
PKVPVTFDDVSVCFNDKEWEKLEEWQKELYKNVMKGNYESLISLDYAISKPGVLSQIEQGEEPRVRNEQDLEESEMMSDAT

SEQ ID NO: 8164 - protein, 81 aa, Xenopus tropicalis
SFDQVTFEDVAVYFSEREWASLLDAQKDLYKSVMRDNYEAVTSLGFPVVRPKAWGRMCQGVTVKLEGTEQMDIGDSAQNMK

SEQ ID NO: 8165 - protein, 81 aa, Xenopus tropicalis
VTHTYQSTPVQFSEEEWGFLNERQKLLYKEVMTENYLIKYKRKIRRRKQNHRRKPARPVVPVNRKPLACSQCGKQYVKKLC

SEQ ID NO: 8166 - protein, 81 aa, Lithobates catesbeianus
EAEHPHFDDIAVYFTEEEWACLNDKERNLYKKVMMDNYWNLVAVGKVSVTPPLISKIERGEELCIRSLQQADHKQFPDLDS

SEQ ID NO: 8167 - protein, 81 aa, Microcaecilia unicolor
QMQVKFEDVAVSFSQEEWEYLDEEQKELYREVMKENYQILISLGIGSSTSTPKIISHIERGEEPYSRDEPGSEERETGKNS

SEQ ID NO: 8168 - protein, 81 aa, Microcaecilia unicolor
QVPPVTFSDVAAYFWEVEWDILGERQKELYKKVILEIHGILMSRGYSIFNPDAIFKIKKGDGKYFTQHCEWEGKENLNDPS

SEQ ID NO: 8169 - protein, 81 aa, Microcaecilia unicolor
MMVNYQTLISLETDSVTVTPDIISHIERGEAPYIRHELGSEERKTGKSSCSENDNLRNSSKETHHWKLGENPEENKMLSEA

SEQ ID NO: 8170 - protein, 81 aa, Microcaecilia unicolor
MKENYETLISLGYERIEPDILSKTEEKEEPNIQNLQESRERDATHSYTAEKIKQKQTKEKKLVLKMQQMIHRERPKKKPCM

SEQ ID NO: 8171 - protein, 81 aa, Microcaecilia unicolor
QQMRVTFEDIAVSFSQEEWEYLDEGQKELYREVMKENYETLISLDYERIDPDILSKIKQEEEPFVQELLESEKKEDYHSFT

SEQ ID NO: 8172 - protein, 81 aa, Microcaecilia unicolor
MRVTFEDIAVSFSQEEWEYLDEGQKELYREVMKENYEILISLGYEMISPDTLSRIKQEEEPYVWDPHESREREVTHADTAV

SEQ ID NO: 8173 - protein, 81 aa, Microcaecilia unicolor
AQVPVTFEDIAVYFCEGEWETLAEWQKELYKETMKENYETLTSLDSSSEKPSLISKIEREEDPCVRDQQDPRDRRRLRSCW

SEQ ID NO: 8174 - protein, 81 aa, Microcaecilia unicolor
QMRVTFEDIAVSFSQEEWRYLDEGQKELYREVMEENYETLLFLETNHQFIDPDVLSKIKQHSRKPGKREVGGSYSADNEAK

SEQ ID NO: 8175 - protein, 81 aa, Microcaecilia unicolor
VPVTFEDISVDFSQEQWEYLNEGQKELYREVMKENYETLISLEDDRRNSNTERHQWKLSVETEEEKMLSESDKEGTTSDLG

SEQ ID NO: 8176 - protein, 81 aa, Microcaecilia unicolor
QVPVTFEDIAIYFSQAEWEDLEEWQKELYMDVMKENYEILNSLGTGSPTVTPDIISHIEREEELYIRNELRSEERETGKSS

SEQ ID NO: 8177 - protein, 81 aa, Microcaecilia unicolor
QLPVMFEDVTVYFSQEQWNYLDESQKELYREVMKENYEILISLGVDHESINSEVLSRIKQEEEPRVWDPKEPGRKEVPQSC

SEQ ID NO: 8178 - protein, 81 aa, Xenopus tropicalis
TTTSIGFNEVAVYFSEEEWRNLELWQKELYSNVMREIHTTLISLGYTIAHPDVLCRIRKDQDPYISSLEEERKTSCFPSTS

SEQ ID NO: 8179 - protein, 81 aa, Xenopus tropicalis
EVHIKSGDAAVYFSTEEWEYIERHKESYKDVMMETLGTLGIPTSKTSGKIVTEVASDKEQKEESFAIRRLDTEVQEIKENS

SEQ ID NO: 8180 - protein, 81 aa, Xenopus tropicalis
VTFDDVAAYFSEDEWKDLEECQKELYKDMMKENYEALISLGNFTPYSNNTLLLDDGPISDKEKSKYNDKLESIEAPPLPML

SEQ ID NO: 8181 - protein, 81 aa, Bambusicola thoracicus
KVPITFDDIAVYFNEQEWERLDSWQKDLYKAVMRGNYETLISLGKAQALLLPPDILSRIERGEELCVKDCWEPPQTLNQDG

SEQ ID NO: 8182 - protein, 81 aa, Microcaecilia unicolor
QVPVTFEDITVYFSQEQWGYLDEGQKKLYREVLKDNYEILISLGTDHGSINPEVLSRIKQGDEPHVWDTKESGEREVTHSC

SEQ ID NO: 8183 - protein, 81 aa, Microcaecilia unicolor
AQVPVTFEDIAVYFSQEEWGYLEEEQKEVYREVMKDNYETLISLGCPILKPAVISSIERGEEPCIGKLQERAELSLTAGDE

SEQ ID NO: 8184 - protein, 81 aa, Microcaecilia unicolor
TQVPVTFEDIAIYFSQAEWEDLEEWQKELYMDVMKENYEILNSLGSPTVTPDIISHIEREEELYIRNELRSEERETGKSSC

SEQ ID NO: 8185 - protein, 81 aa, Microcaecilia unicolor
QIPVTFEDIAIHFSQEEWETLEEWQKELYKDVMKENYETLILLENDDPRNNNTKIPHWGLGENPAGKKILSERGKEGISSC

SEQ ID NO: 8186 - protein, 81 aa, Microcaecilia unicolor
QMQVKFEDIAVSFSQEEWEYLDEEQKELYREVMKENYQILISLGTGSSTFTPEIISHIERGEEPYSRDEPGSEEREPGKSS

SEQ ID NO: 8187 - protein, 81 aa, Microcaecilia unicolor
AQVPVTFEDVAVYFSEDEWEMLAEWQKELYKETMKENYETLLAMSSSSEKPSLLAKIEQEEDPCVSNQQDLRDRIRPKRSW

SEQ ID NO: 8188 - protein, 81 aa, Microcaecilia unicolor
AQASVTFHDVAVYFSEEDWQQLEERQKELYRSVMKEIHGALISLGYTILNSDVYFRIREENGRYFRADDLERSKGIKECTT

SEQ ID NO: 8189 - protein, 81 aa, Xenopus tropicalis
PKICVTFRNLAACIATEDLAALTERDINMYKDAMQEIHKTLLSMGHRILNPEILMFTEETENCQATKKQKLNACIHKLDST

SEQ ID NO: 8190 - protein, 81 aa, Lithobates catesbeianus
TGEVPIRCHDVTVYFSMEEWEYLEGHKDLYKDVMMENQPPLTSLDGSSNGNPPERCPHPLYSRDSTQEDHTISFIFMCILI

SEQ ID NO: 8191 - protein, 81 aa, Terrapene carolina
MWHLPQAQNNGVLLSSGDTPGWGLERKLQVAFEDVALYFTQEEWELLSQPEKQLYRDQMLRNYRALVSLGKDQFPFFYSQL

SEQ ID NO: 8192 - protein, 80 aa, Terrapene carolina
VSLSLGLRGLQRCDVAVYFSPEEWAALAEWQRELYRDVMRENYALVASLGEDPFRPSHGTNVRLRSLQIWPIYCPVIEHS

SEQ ID NO: 8193 - protein, 81 aa, Terrapene carolina
MRENYDAMIALGSPVAKPEIVPRVEQAEEPRAKAPGEAEQREAPGSASPGSVVPKPEIVPQGEREQQQQHGGGEQMGLEGQ

SEQ ID NO: 8194 - protein, 81 aa, Terrapene carolina
NFWILRLPSGTKGEVPKGWESAAKWQKELCENVMKGNFETLISLDSAISKPSILSRLERGEEPCVEDGPEETEIPMEPSMD

SEQ ID NO: 8195 - protein, 81 aa, Microcaecilia unicolor
DQASFTFKDVAAYFLEVEWDILGEWQKELYKKVIKEIHDILRSRGYSIVNPDVIFKIKKEDEKYFTRHVEQEGKENLNDPT

SEQ ID NO: 8196 - protein, 81 aa, Microcaecilia unicolor
MKENYQILISLGTPALTPEIISHIERGEEPYIRDEPGSEERETGKSSCSDKSIKKQGEYLVEMEQIQRQAENVSENISRGI

SEQ ID NO: 8197 - protein, 81 aa, Microcaecilia unicolor
KVPVTFEDIAVSFSQEEWGYLDETQKKLYREVMKESYDNLMSLAGKEIKLEKVKEEIKEEAEEEWTVELDLTQTPSGNACE

SEQ ID NO: 8198 - protein, 81 aa, Microcaecilia unicolor
QVSVTFEDIVIYFSQEEWEDLEEWQKELYKDVMKENYQTLLSLGTGCLTVTPDIISHIERGEEPYIRNDLGSEERETGKSR

SEQ ID NO: 8199 - protein, 81 aa, Microcaecilia unicolor
QVPVTFDDVAAYFSEEEWKDLEECQKELYKDMMKENYEPLISLDDGPMNEKEKHHLKYNEKIEPNEPLPVTVLEDTTQCSD

SEQ ID NO: 8200 - protein, 81 aa, Microcaecilia unicolor
QSLVTFKDVAAYFSEVEWNVLGEWKKELFKKVIKEIHDILVSRGSHTVKPDILIRFEQEGFKTEPLGFEERGNLTTTGTYI

SEQ ID NO: 8201 - protein, 81 aa, Microcaecilia unicolor
DQALVTFKDVSAYFLEADWDILGEWQKELYKKIIKEIHDILISRGYSIVNPDVIFKIKKEDEKYFTQYFEWEVKENPDDFM

SEQ ID NO: 8202 - protein, 81 aa, Microcaecilia unicolor
KMQVTFEDIAISFTQEEWEYLDEGQKELYREVMKENYETLMFLAENEMTVKEAKESNREEHSLKWTLHPRHVCVSQGTERG

SEQ ID NO: 8203 - protein, 81 aa, Microcaecilia unicolor
MSDQALFKDVAAYFLEVDWDILGEWQKELYKKVIKEVHDILISQGYSVVNPDVIFKIKNKDENYFPQHFEWEEKKTQMISL

SEQ ID NO: 8204 - protein, 81 aa, Microcaecilia unicolor
DQALVTFRDVAAYFWEEEWHVLGEWQKELYKEIIKEIHSFLMSRGYSIFNPDVIFKIKKDDGKYFPHHCKQEEKENLDDPS

SEQ ID NO: 8205 - protein, 81 aa, Microcaecilia unicolor
VTFEDITVCFSQEQWEYLDEGQKELYREVMKENYENLISLGKGDPRNSTTELHHWKLSEEIEEENTLFVRDKEDTSSCSDW

SEQ ID NO: 8206 - protein, 81 aa, Microcaecilia unicolor
DQASVMFSDVAAFFLEVEWDILGEWQKELYKKVIKEIHIFLISKGHSVLNPAVIFKIKNEDEKHFTQYCEWEGEKNVKNPT

SEQ ID NO: 8207 - protein, 81 aa, Microcaecilia unicolor
DEALFIFRDVAAYFLEVDWDILGEGQKELYKKVIKEIHDILMSRGYSIVSPDVVFKIKKEDEKYFTQPFEWEGKENPYDST

SEQ ID NO: 8208 - protein, 81 aa, Microcaecilia unicolor
FQVSVIFKDVAAYFLEVEWNILGESQKELYKMVIKEIHGILMSRGYSIVSPDVIFKIQKEDEKYFTHHFEWEGKENPNDPT

SEQ ID NO: 8209 - protein, 81 aa, Terrapene carolina
MPVTFEEVAVYFTEGQGPLLDPSQRALYRDVMQENYKMVTSLGFPIPKPDLIARLERGEEPWVPDIQTSEESEIPRGSHTG

SEQ ID NO: 8210 - protein, 81 aa, Lithobates catesbeianus
IRCQDVTVYFSMEEWEYLEGHKDLYKNVMMDHHRSLNSEKFEKNAFFLNEILFNLILEIIYLLTAEDFSVVMKKPLNITKR

SEQ ID NO: 8211 - protein, 81 aa, Lithobates catesbeianus
PIRCQDVTVYFSMEEWEYLEGHKELYKDVMMENHQKLKCGKSFTTKGGLLRHHRSHTGERPYSCSEVWEMFYYKRRASATP

SEQ ID NO: 8212 - protein, 81 aa, Microcaecilia unicolor
DQVPLTFDDVAVYFTLDEWRKLEDWQKELYKTTMQENYDSLESMGFPIKKPEVVSRIEQGEEPWVMENAGSSILGTNTILA

SEQ ID NO: 8213 - protein, 81 aa, Microcaecilia unicolor
NEALVTFKDVAASFLEADWDLLGEWQKELYKKVIKEIHDILMSRGYSILNPEVIFKIKNEDEKYIIQQSEWEWKNPSNDST

SEQ ID NO: 8214 - protein, 81 aa, Microcaecilia unicolor
EPASVTFSDVAAYFWEAEWDVLGEWQKDLYRKVIKEIHGILMSLGYSIVNPDVIFRIKQREEKYFSQHYDWKEKENNDNPS

SEQ ID NO: 8215 - protein, 81 aa, Microcaecilia unicolor
VPDQALFKDVAACFLEVDWDILGEWQKELYKKVIMEVHDILISLGYSIVNPDVIFKIKNEDEKYFTQHFEWEEKENPDHLI

SEQ ID NO: 8216 - protein, 81 aa, Microcaecilia unicolor
MLLTFHDVAVTFSEEEWQLLEDWQKDLYRNVMKETYDNLLSLMPVTFHDIAICFSEEEWQLLGEHQKALYRNVMKENYDIL

SEQ ID NO: 8217 - protein, 81 aa, Microcaecilia unicolor
QVPVIFEDVAVYFWEEEWEMLEEWQKELYKETMKENYKTLVSLGMELPTEKPDLIVRIEREENPCVKAQWDSRDKTRWRNS

SEQ ID NO: 8218 - protein, 81 aa, Microcaecilia unicolor
QKWVTFEDIAVSFSQEEWGYLDEEQKELYREVMKENYQTLISLGHQITQGRKREKKKGEHLVEIEQIQRKTENVCKNVSQA

SEQ ID NO: 8219 - protein, 81 aa, Microcaecilia unicolor
NVPVTFEDIAVYFSEEEWEDLKEWQKELYKDVMKENYQTLISLGAGSLTVTPDIISHIEEGEEPYIKDELESEERETGKSS

SEQ ID NO: 8220 - protein, 81 aa, Microcaecilia unicolor
VIFNKVAIYFSEEEWQLLEEWQKELYRNVMKEIHGTLISLGHKVLNRGVLFRIKNEDMLHHGREEKQLLGLARALVTFHDV

SEQ ID NO: 8221 - protein, 81 aa, Microcaecilia unicolor
MKENYETLISLGFERKGSDILSRIKQEEEPYALDPQETREREVTHPYTDNEAILELKREQNQEKTPVKMEQIPGQPKTFCE

SEQ ID NO: 8222 - protein, 81 aa, Microcaecilia unicolor
TLKKATFDDVAIYFSSEEWSQLDEDQKTIYRHVMEDNYQIMISLGYDIPKPEVLLLMEQGRDPCIQDHIDSARESIDGMVI

SEQ ID NO: 8223 - protein, 81 aa, Microcaecilia unicolor
QVPVTFEDITVYFSREQWEYLDEGQKELYREVMKENYETLISLGTGPEGFNPEVLSRIKLEEESRVWDPKEPGQKEVTRSY

SEQ ID NO: 8224 - protein, 81 aa, Microcaecilia unicolor
QVPVTFEDIVIYFSRGEWEELEDWQKELYKDVMKENYQTLISLGRGSRTETPDIISHIERGEEPYIRDELGSEERITGKGG

SEQ ID NO: 8225 - protein, 81 aa, Microcaecilia unicolor
VTFEDIAVSFSQEEWEYLDEGQKELYREVMKENYETLISLVNEAEQEELKREQNQEESVIQTEQNGDRNISQRMERRHPRN

SEQ ID NO: 8226 - protein, 81 aa, Microcaecilia unicolor
DQTLVTFRNVAAYFLEVEWNILGEWQKELYKKVIKEIHGILMSRGYSIVNPDVIFKIKKEDGKYFAQDCELKGKENLNDPT

SEQ ID NO: 8227 - protein, 81 aa, Microcaecilia unicolor
AAAQVLVTFDNAANYFSEDEWKGLDEGQKTTYREMKEDAPEAPVLLGVDSEVLSKIKEENEPLCNDYCAFDGKENNPSPST

SEQ ID NO: 8228 - protein, 81 aa, Microcaecilia unicolor
MRVTFEDIAVSFSQEEWEYLDEEQKELYREVMKENYQTLISLGAGSLTFTPEIISHIERGEEPYSRDEPGSGEREPGKSRC

SEQ ID NO: 8229 - protein, 81 aa, Microcaecilia unicolor
QEPVTFEDITVYFSQEQWEYLDEGQKELYREVMKENYETLISLGIDHESINPEVLSRIKQEEKLHNRDPKDSGEIEVKHSY

SEQ ID NO: 8230 - protein, 81 aa, Microcaecilia unicolor
QMWVTFEDIAVFFSQEEWEYLDEGQKELHREVMKENYEILMFLEKEEPENSNTEKVSEKPEGEKMLSERENEQTYSCSDWG

SEQ ID NO: 8231 - protein, 81 aa, Microcaecilia unicolor
DQASVVFKDVAAYFLDTEWNILGEWQKELYKKVIKEIHDILKSRGYSIANPDVIFKVIKEDEKYFTHHFEWEGNQNPNDPT

SEQ ID NO: 8232 - protein, 81 aa, Xenopus tropicalis
VSPKVIFRDVAVYFSEKEWDLLEGWQRDLYTGVIKEIHGILISLGFIILNPNNFLRIQPEDEPCLKSRNVLERNESINITE

SEQ ID NO: 8233 - protein, 81 aa, Xenopus tropicalis
QQVSVTFHDVAACFSAKEWARLEDWQKELYRNVIREIHATLEAMGCTIANSDVLLKIKEDDAGGSRKDSDKTDTGTAPSGT

SEQ ID NO: 8234 - protein, 81 aa, Terrapene carolina
MPVTFEEVAVYFTQGQGALLDPSQRALYRDVMQENYEMVTSLGKGFPSPQILEAVGSARRQGFKSRAVCESAMLPEITHPG

SEQ ID NO: 8235 - protein, 81 aa, Lithobates catesbeianus
GEVPIRCQDIAVHFSMKEWEYLEGHRDLYRDDDMEKSQPFISLDGGLPAYEPDGYPLPAHHLEDRNKDLFVMKFTQSRASS

SEQ ID NO: 8236 - protein, 81 aa, Lithobates catesbeianus
PIRCQDVTVYFSMEEWEYLEGHKDLYKDVMMDNRTYNVQHDQSGNLGDDNLVKEEHIEGGEKYGVMTEFLEGHMDVAFEPP

SEQ ID NO: 8237 - protein, 81 aa, Microcaecilia unicolor
TGNLTTTGRCEELPEACDEATIKASNEALVTFKDVAAYFLDVDWDLLGERQKELYKKVIKEIHDILISRGYSILNPDTFQL

SEQ ID NO: 8238 - protein, 81 aa, Microcaecilia unicolor
DQASVSFKDVAAYFLEAEWDILREWQKELYKKIIEEIHDILRSRGYSIVNPDVIFKIKKEDEKHFTQHVEQEGKENLNDPT

SEQ ID NO: 8239 - protein, 81 aa, Microcaecilia unicolor
DQALVTFKDVSAYFLEAEWDILGEWQKELYKKAVKEIHDILTSKGYSIVNPDVMFKIKKEDEKYFTQHFEWEGKENPNDPM

SEQ ID NO: 8240 - protein, 81 aa, Microcaecilia unicolor
DQSLVTFNDVAAYFSEVEWNVLGEWKKELYKKVIKEIHDILVSRGYSIVNPNTIFKIKKEDEKYFTQQFEWEGKENPNDST

SEQ ID NO: 8241 - protein, 81 aa, Microcaecilia unicolor
MSDQALFKDVAAYFLEVDWDILGEWQKELYKKVIKEVHDILISQGYSIDNPDVIFKIRNEDKKYFTPHFEWEEKENPDDLI

SEQ ID NO: 8242 - protein, 81 aa, Microcaecilia unicolor
DRVKFTFSDVAVYFSEEEWQLLEEQQKELYRNVMKENYTTLTSLGYTTVKPDVISKIEQGKQPSVSSPSGSKGRRAVGRPT

SEQ ID NO: 8243 - protein, 81 aa, Microcaecilia unicolor
MPVTFEDIAVSFSQEEWEYLDEGQKELYREVMKENYEILISLAGYERISPDTLSRIKQEEEPYVWDPHESREREVTHSDTV

SEQ ID NO: 8244 - protein, 81 aa, Microcaecilia unicolor
AKAAVTFDDVAVYFSEEEWEKLEEGQKELYKETMKDNYEALISLGVPVFKHEIISRIETGEEPCVQGSQNLEQREMPESDF

SEQ ID NO: 8245 - protein, 81 aa, Microcaecilia unicolor
NEALVTFKDVAAYFLEVDWDLLGERQKELYKKVIKEIHDILTSRGYSIVNPDVIFKIKKEDEKYFIQQFQREGNENPNDST

SEQ ID NO: 8246 - protein, 81 aa, Microcaecilia unicolor
DQASVTFNDVAAYFWEAEWDILGERQKELYKKVIKEIHNFLMSRGYSIVKPEVIFRIKKDEDKHFTQHGEWEEEENLKDST

SEQ ID NO: 8247 - protein, 81 aa, Microcaecilia unicolor
VSKTMRVTFEDIAVSFSQEEWEYLDEGQKELYREVMKENYETLISLVNEAEQELKREQNQEESVIQTEGNDDRNISQRMER

SEQ ID NO: 8248 - protein, 81 aa, Microcaecilia unicolor
QMQVTFEDIVISFSQEEWGYLDERQKVLYTEVMKENYQTLISLGTGSLTFTPKIISCIERGEEPYIRDEPRSEEKETGNSS

SEQ ID NO: 8249 - protein, 81 aa, Microcaecilia unicolor
QMRVTFEDIAVSFSQEEWEYLDEEQKELYREVMKENYQTLISLGTGSTTVIPDIISHIEQGEEPYIRDEPGPEERETGKSN

SEQ ID NO: 8250 - protein, 81 aa, Microcaecilia unicolor
DQALVSFIDVAAYFLEVEWDILGERQKELYEKVIKAIHNFLISQGYSILNPDVIFKIKYEDEKYFTQHCEWEAKENKNEPS

SEQ ID NO: 8251 - protein, 81 aa, Microcaecilia unicolor
QMQVKFEDIAVSFSQEEWEYLDEEQKELYREVMKENYQILISLGTGSSTFNPKIISLIERGEEPYIRDEPGSEEREPGKSS

SEQ ID NO: 8252 - protein, 81 aa, Microcaecilia unicolor
QKQVTFEDIAVSFSQDEWEYLDEEQKELYREVMKENHQTLMSLGTGSPTVIPDIISHIERGEELYVRDEPGSEERETGKSS

SEQ ID NO: 8253 - protein, 81 aa, Microcaecilia unicolor
QQVPVTFEDITVHFSREQWKYLNEGQKELYKEVMKENYETLISLEKVDPTNHNTEPHHWKPEGEETLSERDKEGTSSCCNW

SEQ ID NO: 8254 - protein, 81 aa, Microcaecilia unicolor
DQASVAFSDVAAFFLEAEWDILEEQQKELYKKVIKEIHIFLISRGHSILNPAVIFKIKNDNEKQFTQYCEWEGKENMKNPT

SEQ ID NO: 8255 - protein, 81 aa, Microcaecilia unicolor
DQASVTFKDVAAYFLEMEWDILGEWQKELYRKIIKEIHDILTSRGYSIVNPDVIFKIKKEDEKYFTQHFEQDGKENLNDPP

SEQ ID NO: 8256 - protein, 81 aa, Microcaecilia unicolor
QKWFTFEDIAVSFSQEEWEYLDEGQKELYREVMKENYQTLISLGTGSPTVIPDIISHIERGEEPYVREEPGSEEREAGTSR

SEQ ID NO: 8257 - protein, 81 aa, Microcaecilia unicolor
GRAKVVFSDVAIYFSEGEWQLLEDRQKELYTNVMKEIHGALVSLGYTIVNSDTVFKIKPEEEPSLRNHIDSKEGGGGGKAS

SEQ ID NO: 8258 - protein, 81 aa, Microcaecilia unicolor
MPADAADQVQMKLEEEWKGLEEGQRKLNIGTMRDNYENYDSLISLGCTAATPDVLSRIKEENKVQSCSDQFVSETRESTAS

SEQ ID NO: 8259 - protein, 81 aa, Microcaecilia unicolor
MKDNYEALISLGVPVFKHEIISRIETGEEPCVQGSQNLEQREMPESDFMDDGLIKEIKVEEERLDECASVPDVQITSSEKL

SEQ ID NO: 8260 - protein, 81 aa, Microcaecilia unicolor
FQTLVTFKDVAAYFLEVEWNILEEWQKELYKKVIKEIHGILISRGYSIVNPDVTLKIKKENEKYFAQHCELEGKEDLNDPT

SEQ ID NO: 8261 - protein, 81 aa, Microcaecilia unicolor
QRGSVMFSDVVACFTEEEWEVLKERQKKVYRAVMMEIHEALISLGYEITNRDVLFRVQEEKNACRRDGFERRDDICALTTG

SEQ ID NO: 8262 - protein, 81 aa, Microcaecilia unicolor
QKRFTFEDIAVSFSQEEWEYLDEEQKELYREVMKENYQTLISLGTGTPTVIPDIISHIEGGEEPYVRVEPGSEEREAGTSC

SEQ ID NO: 8263 - protein, 81 aa, Microcaecilia unicolor
QEPVTFEDITVYLSQEHWEYLNERQKELYREVMKENYKTLISLGADHKNINSEVLARIKQEEDPNVWDPKESEKRDVTHSY

SEQ ID NO: 8264 - protein, 81 aa, Microcaecilia unicolor
SEAPVSFEEVAVYFSQEEWQTLQGWQKELYRGVMRENYEIMLSLGYQFSKPEILLMMERGEEPFVEDSQRRVPEPFREKHL

SEQ ID NO: 8265 - protein, 81 aa, Microcaecilia unicolor
EQMWVSFEDITVSFSQEEWGYLDEGQKELYREVMKENYETLISLGYENINPDILSCTRQEEEANIQDPQESDKREVKNSHT

SEQ ID NO: 8266 - protein, 81 aa, Microcaecilia unicolor
LQMRVTFEDVAVSFSQEEWEYLDEGQKELYMEVMEENLELLTSVNSLVAQPEQMQELYVTDQHDMGLRGTLLSPYVEGGAG

SEQ ID NO: 8267 - protein, 81 aa, Microcaecilia unicolor
DQAPVTFSDVAAYFLEVEWDILGAWQKELYKKVIKEIQSFLIAQGYSILNPEVIFKIKKEDEKYFTQYSVLEGKENMDDPT

SEQ ID NO: 8268 - protein, 81 aa, Microcaecilia unicolor
GNLTTTGRCEELPEACDEATIKASNESLVTFKDVAASFLEADWDLLGEWQKELYKKVIKEIHDILISRGKYVFSVIYHTST

SEQ ID NO: 8269 - protein, 81 aa, Microcaecilia unicolor
MKENYETLISLGCDEESPDILSRMKQEEEPYVWDPHESREREVTHSDTAVNEAIQKLKQEQNHEETPVEMEQIPGQSKNVC

SEQ ID NO: 8270 - protein, 81 aa, Xenopus tropicalis
MQDNYQNLTALGLVITKPEIVLKIEKGEDPIIGVCLAPAHKRPTHMDGAPKAALGPKHSKYPLRSHRAPPGSAERVGSLGQ

SEQ ID NO: 8271 - protein, 81 aa, Xenopus tropicalis
VTFHDVAACFSAEEWAGLQDWQKELYRNVMREIHTALQAMGKGAVTGYGGDPHCPAGHGIRGRSTLPCWPWVRGQLRDTGE

SEQ ID NO: 8272 - protein, 81 aa, Microcaecilia unicolor
QIPVIFEDIAIYFSQKEWEDLEECQKKLYKDVMKENYQILTSLGADFLTVTPDIISYIERGEELYIRNESGSEERETGKSS

SEQ ID NO: 8273 - protein, 81 aa, Microcaecilia unicolor
MKENYEILISLGFEKVSRDALSRIKQEEEPYVWDPHESREREVTHSDTVDEALQKLKQEQNHEETPVETEQIPGQSKNVCE

SEQ ID NO: 8274 - protein, 81 aa, Microcaecilia unicolor
SRTMRVTFEDIAVSFSQEEWGYLDERQKALYREVMKDNYETLISLGYERINHDIFSRIKEEEPYIQDPHYSRERKVIHSDT

SEQ ID NO: 8275 - protein, 81 aa, Microcaecilia unicolor
QKWCTFEDIAVSFSQEEWEYLDEEQKELYREVMKENYQTLISLGTGSPTVLPDIISHIERGEEPYVREEPGSEEREAVTSR

SEQ ID NO: 8276 - protein, 81 aa, Microcaecilia unicolor
DQASVAFGDVAAYFWEVEWDILGEWQKELYKKIIKEIHSFLISQGYSILNPDVIFKIKKEDDKYFTQHCELEGEKTMNDPS

SEQ ID NO: 8277 - protein, 81 aa, Microcaecilia unicolor
QVPVTFEDITVYFSQEQWEYLNEGQKELYREVMKENYETLISLGTDNESINPEVLARIKQEEEPHVWDPKESGEKEVTHSC

SEQ ID NO: 8278 - protein, 81 aa, Microcaecilia unicolor
DQALVTFKDVAAYFLKADWDILEEWQKELYKKVIKKIHDILTLKGYSIVNPDVIFKIKKDDDKYFTQHFEWEGKENPNDPM

SEQ ID NO: 8279 - protein, 81 aa, Microcaecilia unicolor
KMRVTFEDIAISFTQEEWEYLNEGQKELYREVMKENYETLMFLAENEVTEEEVKETNREGRPLKWKLRPRRVSISQGTERG

SEQ ID NO: 8280 - protein, 81 aa, Microcaecilia unicolor
ISKTMWVTFEDITVSFSQEEWEYLDEGQKELYREVMKENYETLISLVNEAEQELKREQNQEESVIQTEGNDDRNISQRMER

SEQ ID NO: 8281 - protein, 81 aa, Microcaecilia unicolor
QGPVTFEDIAVYFTQEEWEDLEEWQKKLYKEVMKENYQMLRCLETGFQTVTPDIISHIERGEEPYIRVGLKSEERETGKSS

SEQ ID NO: 8282 - protein, 81 aa, Microcaecilia unicolor
AQVPVTFEDVAVYFSEDEWGMLAEWQKELYKETMKENYETLTALGSLSEKPLLLSKLEQEEDLFVREPQDPRDRIRLKSCW

SEQ ID NO: 8283 - protein, 81 aa, Terrapene carolina
EMDFAALPVTELVGLWLGQQVLRGGLWLFQGLVTFEEVAVYFTEEQWALLDPSQRALYRDIMQQNYENVTSLGKDSCPLGY

SEQ ID NO: 8284 - protein, 81 aa, Terrapene carolina
RRPVTFEEVAVYFTREEWALLDPTQRALYRDVMQENYETVVLLGKENFDKFPCPPFLLHLPPTSIIFGHPPPDITSPSLCT

SEQ ID NO: 8285 - protein, 81 aa, Microcaecilia unicolor
QVPVTFEDIAIYFCQEEWEVLEEWQKDLYKDVMKENYQALISLGTGSLIVSPDIISRIERGEDPYIRDERGSKKRETENSS

SEQ ID NO: 8286 - protein, 81 aa, Microcaecilia unicolor
QVPVTFEDVAIHFSQEEWECLEEWQKNLYKDVMKENYQTLISLEAGCPTFTPDIISHIERGEEPYIRDELGSEERETGKSS

SEQ ID NO: 8287 - protein, 81 aa, Microcaecilia unicolor
MFEDIAVSFSQEEWEYLDEGQRELYREVMKENYETLVSLGDEVTQEKERKEKSVLIKNQIVNYKEKPFPCTECKRSFTCRD

SEQ ID NO: 8288 - protein, 81 aa, Microcaecilia unicolor
QVSVTFEDITVYFSQEQWRYLDEGQKKLYREVMMENYETLISLGADCESIDSEVLSRIKQAEYLHVWDLKKSEEREVTHSY

SEQ ID NO: 8289 - protein, 81 aa, Microcaecilia unicolor
CRALVTFKDVSAYFLEVEWDVLGEWQKELYKKVVKEIHDILISRGYSIVNPDIIFKIKNEDEKNFTPHFEWDEKENPDDPT

SEQ ID NO: 8290 - protein, 81 aa, Microcaecilia unicolor
DQASIAFSDVAAYFLEVDWVSLGEWQKELYKKVIKEIHNFLISRGYSILNPDVIFKIKKEEKHLTQHYELEGRENMNDPSM

SEQ ID NO: 8291 - protein, 81 aa, Microcaecilia unicolor
QMQVTFEDIAVSFSQEEWEYLDEGQKELYKEVMTENYQTLISLGTGSTTVIPDIMSHIEQGEEPYIRDEPGPEERETGKSN

SEQ ID NO: 8292 - protein, 81 aa, Microcaecilia unicolor
QMQVKFEDIAVSFSQEEWEYLDEEQKELYREVMKENYQILISLGTGSSTSTPKIISQIERGEEPYSRDEPGSEEREPGKSS

SEQ ID NO: 8293 - protein, 81 aa, Microcaecilia unicolor
DQTLVTFKDVAAYFLEVEWNILEEWQKELYKKVIKEIHGILISRGYSIVNPDVMLKIKKENEKYFAQHCELEGKEDLNDPT

SEQ ID NO: 8294 - protein, 81 aa, Microcaecilia unicolor
QKPMITFNAVAAYFSEAVWEALEEWQKELYRSVVQEIHGALLSLGYSIIHPDVLLRIKGQEEPYKEESGKIYKHHMTSDSS

SEQ ID NO: 8295 - protein, 81 aa, Microcaecilia unicolor
VSDQVFFKHVAAYFLKVDWEILGEWQKELYKKVIKEVHGILISQSYSIVNSDVIFKIKNEDEKYFTQHFEWEEKENPYDLM

SEQ ID NO: 8296 - protein, 81 aa, Microcaecilia unicolor
DQVLVTFKDVAAYFLDVDWDILGEWQKELYKKVIKEIHDILISRGYSVVNPDVMFKIKKEDEKYFTQHFEWEGKENPDDPM

SEQ ID NO: 8297 - protein, 81 aa, Microcaecilia unicolor
DQASVTFSDVADYFLEVDWDSLGEWQKELYKKIVKEIHNFLISRGYSILNPDVIFKIKKEEKHLTQHYELEGKENMNDPSM

SEQ ID NO: 8298 - protein, 81 aa, Microcaecilia unicolor
DQGSVTFKDVAAYFLEVEWDILGEWQKELYKKVIKEIHDVLMSRGYSIVNPDVIFKIKKEDEKYFTRHLEQEGKENLNDPT

SEQ ID NO: 8299 - protein, 81 aa, Microcaecilia unicolor
AQVPVTFEDVAVYFCEDEWEMLAEWQKELYKETMKENYETLTSLDSSSEKPSLISKIEQDEDLCVWDQQDVRERLNSSRRA

SEQ ID NO: 8300 - protein, 81 aa, Microcaecilia unicolor
DRASVAFSDVAAFFLEADWDLLGERQKELYKKVIKEIHIFLISRGHSILNPAVIFKIKNEDEKHVTQYYEWEGKKSMKNPT

SEQ ID NO: 8301 - protein, 81 aa, Microcaecilia unicolor
DQASITFKDVAAYFLEVEWDILGEWQKELYKKVIKEIHDILTSRGYSIVNPDVIFKIKKEDKKYFTQHFEQAEKENLNEPT

SEQ ID NO: 8302 - protein, 81 aa, Microcaecilia unicolor
VQVPVTFEDVAVYFSEDEWGMLAGWQKELYKETMKENYETLTLLGCLSEKPSLISKIEREEDPCVRDQQDPRDRRKLRSSW

SEQ ID NO: 8303 - protein, 81 aa, Microcaecilia unicolor
TQMQVKFDDIAVSFSQEEWKYLDEEQKELYREVMKENYQILISLGTGSSTTPKIISHIERGEEPYIRDEPVLVERKTGKSS

SEQ ID NO: 8304 - protein, 81 aa, Microcaecilia unicolor
QEPVTFEDITVHFSQEQWEYLDEGQKELYREVMKENYETLISLGTDHESINPEALARIKQEEEPRVWDPKESGERGVTRTC

SEQ ID NO: 8305 - protein, 81 aa, Microcaecilia unicolor
DQALVTFKDVSAYFLEADWDILGEWQKELYKKVIKEIHDILTSQGYSIVNPDAIFKIKNEDEKYFTQHFEWEEKENPDDLM

SEQ ID NO: 8306 - protein, 81 aa, Microcaecilia unicolor
DQASIMFKDVAAYFLEVEWDILGEWQKELYKRIIKEIHDILMSRGYSIANPDVIFKIKKEDEKYFTQHFEWEGKENLNDPT

SEQ ID NO: 8307 - protein, 81 aa, Xenopus tropicalis
EVHIKSGDAAVYFSTEEWEYIERHKESYKDVMMETLGTLGIPTSKTSGKIVKEVASDKEQKEESYAIRRQDTEVQEVNGNA

SEQ ID NO: 8308 - protein, 81 aa, Microcaecilia unicolor
VQVPVTFDDIAVYFSQEEWEELDEEQKDLYQEVMRENLELLTSLGYPKAAPDITLKIKEWEESFVWEQQNTQGDQILLSFP

SEQ ID NO: 8309 - protein, 81 aa, Microcaecilia unicolor
QMQVTFEDIAVNFSQEEWEYLNEGQKELYREVMKENYQTLISLGTGSPTVTPEIISYIERGKEPYIRDEPGSEERETGKSI

SEQ ID NO: 8310 - protein, 81 aa, Microcaecilia unicolor
LLVTFEDIAVYFSQEQWEYLDEGQKELYREVMKENYETLISLEKDYSRNSDTEPHHKKLSEKPEGEKSLSERDKEETSSFS

SEQ ID NO: 8311 - protein, 81 aa, Microcaecilia unicolor
EIMRVTFEDIAVSFSQDEWEYLDEGQKALYREVMKENYQTLISLGYGRISPDTLSRIKQEEEPYVWDPHESREREVTHSDT

SEQ ID NO: 8312 - protein, 81 aa, Microcaecilia unicolor
QKRVTFEDIAVSFSQEEWEYLDEQQKELYREVMKENYQTLISLGTGSPTVIPDIISHIERGEEPYVREEPGSEEREAGTSR

SEQ ID NO: 8313 - protein, 81 aa, Microcaecilia unicolor
DQAAVTFNDVAMCFTEEEWNVLNDWQKELYRNVMREIHHALISLGHVIVNSEILFRFRRDKGPFFGGHCELEGKASIGATV

SEQ ID NO: 8314 - protein, 81 aa, Terrapene carolina
PLTSLCLGFPVQLTFEDVTISFSREEWEVLSVWQKELYREVMKENYASLISLGKDQCSVSGMELWDLWRGFLRAIDSGLIS

SEQ ID NO: 8315 - protein, 81 aa, Microcaecilia unicolor
MKENYEALISLGYESINPDIVSCTKQEEEANIQDPQESGERDVKNSYTDHQITQGKKREKKQGEHPVETEQIQRQSENICD

SEQ ID NO: 8316 - protein, 81 aa, Microcaecilia unicolor
DQAMVAFKDVAAYFLEVEWNILEEWQKELYKKAIKEIHGILMLRGYSIVNPDVIFKIKKEDKKYFTHHFECEGKENPNDPM

SEQ ID NO: 8317 - protein, 81 aa, Microcaecilia unicolor
EPVTFEDITVHFSQEQWEYLDEGQKELYRKVMKENYETLISLEKEDPSTSNTEIHHWKLCEKLEEEKLLSERDKEETSSCS

SEQ ID NO: 8318 - protein, 81 aa, Terrapene carolina
GPVTFEEVAVYFTREEWALLDLTQRALYRDVMQENYETVVFLGFPISKPDVISQLERGEEPWVLDLQGYEKEVLPRAKPEE

SEQ ID NO: 8319 - protein, 81 aa, Terrapene carolina
LQVPVSFEDVAVYFSPEEWAELAKWQRELYRDVMKENYALVASLGHPGVKPEIICQMERGEEPCVEDPWGWEERSTAQNPC

SEQ ID NO: 8320 - protein, 81 aa, Terrapene carolina
FQMPVTFEEVAVYFTQAQGALLDPSQRALYRDVMQENYETVTSLGFAVPKPDLISRLEQGEEPWVPDLQASEERESQRGTR

SEQ ID NO: 8321 - protein, 81 aa, Lithobates catesbeianus
EVTQKIIDLLTGEVPIRCQDITVYFSMEEWEYLEGHKDLYKDIVKENQQLLSCFNVGKNNFLSNEIILNCTLEIICLLIGE

SEQ ID NO: 8322 - protein, 81 aa, Lithobates catesbeianus
IRCQDVTVYFSMEEWEYLEGHKDTYKNVMTENQPSLTSPERCPRPLYSRDSTQEDHTIPHHHQHKEQMYVKNYVKAEEEET

SEQ ID NO: 8323 - protein, 81 aa, Terrapene carolina
QPFVCLQVPVTFEDVAVRFSAEEWEILEGWQKELHKEVMEENYQLLISLGKEQHVSCLHGGLWTIPWHCSYKCVSFQLCLH

SEQ ID NO: 8324 - protein, 81 aa, Microcaecilia unicolor
MRVTFEDIAVSFSQEELEYLDEGQKELHREVMKENYEILMSLEKDDPRRSNTKTHDWKLSEKPERENMLPEREKAETPSCS

SEQ ID NO: 8325 - protein, 81 aa, Microcaecilia unicolor
EQITVTFNDVAAYFSEQEWQALEEWQKELYRGVMKEIHRALFSLGYSIANPDVLFRIKQEEGPYFRDPFDSEGSNNIGGKD

SEQ ID NO: 8326 - protein, 81 aa, Terrapene carolina
PVTFEEVAVYFTAGQGALLDPAQRALYRDVMQENYENVTSLGKDSFQIHVIPTMPPLLCPVSALPNLVLLAGAPTWSHPLP

SEQ ID NO: 8327 - protein, 81 aa, Terrapene carolina
LGVGEPWTAGAVSGAAGTGIGHFLFQGPVTFEEVAVYFTRDEWALLDPRQRALCRDVIQENYENVTSLGKDSCPLGSWKGK

SEQ ID NO: 8328 - protein, 81 aa, Lithobates catesbeianus
EVPIRCQDVTVYFSMEEWEYLEGHKDLYKNVMTEDQPPLTLPEGPKIENILEGDLILSSDYYVENDDIALNAPEVNDMSHI

SEQ ID NO: 8329 - protein, 81 aa, Lithobates catesbeianus
VPIRCQDVTVYFSMEEWEYLEGHKDLYKDVMMDNQPPLTSPVKDKEEIIEDDEDGVMEGFPKGHKDLYQDTMSGNLRDPEV

SEQ ID NO: 8330 - protein, 81 aa, Terrapene carolina
GSCVAFEDVALYFSQEEWELLSPPEKQLYRDQMLRNYWPPLQGEAPVQKTLSPAGLGILGGTRTQSECGESTAGRQDSTSH

SEQ ID NO: 8331 - protein, 81 aa, Microcaecilia unicolor
VPDQDLFKDVSAYFLEADWDILEERQKELYEKVIKEVHDILISRGYSIVNPDVMFKIQKEDKKYFTPHFEWEGKENPNDPM

SEQ ID NO: 8332 - protein, 81 aa, Microcaecilia unicolor
FHVPVSFEDIAVYFSQEEWEALEEGQKELYKDVMKENYETLSSLGFLIVTPDIISLIEHGEEPYIKDEPGSEERCHGERNW

SEQ ID NO: 8333 - protein, 81 aa, Microcaecilia unicolor
PVTFEDITVHFSQEQWEYLDDGQKELYREVMKENYETLISLEDDRRNSDTEIPHWKQHQRVHTGMKPVMCTECGKSFSDKG

SEQ ID NO: 8334 - protein, 81 aa, Microcaecilia unicolor
DQASVMFSDVAAYFLEAEWNILGEWQKELYKKVIMEIHRFLISQGYSILNPDVIFKIKKEDEKYFTQHCEWERKENMNDLR

SEQ ID NO: 8335 - protein, 81 aa, Microcaecilia unicolor
LQVPVIFADMAICFTQEQPMDLEEQQKELYKDMMENYQTLISLGTGSVTVAPDIISHTEQREEQYIRDELGSEERDTEESG

SEQ ID NO: 8336 - protein, 81 aa, Microcaecilia unicolor
DQVLVAFKDVTAYFLKVDWDILGEWQKELYKKVVKEIHDILISRGYSIVNPDVIFKIKKEDEKYFSPHFEWEEKESPDDLM

SEQ ID NO: 8337 - protein, 81 aa, Microcaecilia unicolor
MKENYQTLISLGCERINPDILSRIKQEEEPSVQEMQEPEDCRSYTDQPITEEQNREKNQGNDHVKIGQMQRQSENVCENIS

SEQ ID NO: 8338 - protein, 81 aa, Microcaecilia unicolor
MAASIPEVEWNLLEDWQKQLYRDVMKESYKTILSLGYSVAKQNIMTEPAAEEKACNSAVRDPESGDIAGSSSAEPCGRKRK

SEQ ID NO: 8339 - protein, 81 aa, Terrapene carolina
DGLFQKPEPGFAELEKRLSDFSLKSAILQEVLLGFKETLRLELENNTGFPVSKPDGVSQLEQGEEPWVLGLQGSEEREIQG

SEQ ID NO: 8340 - protein, 81 aa, Terrapene carolina
VLSEELLLFQGSIAFGEVAVYFTEEEWALLDPAQRALYRDVMQENYENVTLLGKDSYSHAPLFFHSPSSVKLLQLFPPLFM

SEQ ID NO: 8341 - protein, 81 aa, Lithobates catesbeianus
PVRCQDVTVYFSMEEWEYLEGHKDLYKDVMMENQQLLNYVNMKKNHLLNGILILTLEIICLLTGEDCTVVMKSSIENIIKR

SEQ ID NO: 8342 - protein, 81 aa, Lithobates catesbeianus
WSVPITFDEVAVYFLEEEWRHLEAWQRELYQEVMRDNLEAVLSLGYEYRQPPPPPRVFTEDDKWIVRYSEDPLEADEEKGP

SEQ ID NO: 8343 - protein, 81 aa, Lithobates catesbeianus
VPIRCQDVTVYFSMEEWEYLEGHKDLYKDVMMDNQPPLTSLDGSSNGYPPERCPRPLYSWDSTQEGHTIPHHHQRGNLRDS

SEQ ID NO: 8344 - protein, 81 aa, Terrapene carolina
MPMTFEEVAIYFTKGQGALLDPAQRVLYRDVMQENYETVTLLGKGFPSPQLLEAVESACRSRMQLVCLCFGFFLGAIPLSP

SEQ ID NO: 8345 - protein, 81 aa, Microcaecilia unicolor
RTMPMTFEDIAVSFSQEEWEYLDEGQKELYRDVMKENYETLISLGYDRKSPDILTRIKQEEEPYVWDPHESREKEVTLSDT

SEQ ID NO: 8346 - protein, 81 aa, Microcaecilia unicolor
NEVLVSLKDVAAYFLEVEWNTLEEWQKQLFKKVIKEIHDILMSQGYPIVNRDVVFKIKKEDETYIIQPFEWEGKENPNDST

SEQ ID NO: 8347 - protein, 81 aa, Microcaecilia unicolor
NEALVTFKDVAAYFLDVDWDLLGERQKELYKKLIKEIHNILISRGYSILNLDVIIKIKNEDEKYLIQQSEWEWKKPQNDST

SEQ ID NO: 8348 - protein, 81 aa, Microcaecilia unicolor
CMLVTFEDITVSFSQEEWEYLDEAQKELYREVMKENYQTLISLDHHITREKKRVKKQGEHPVEMEQIQKQSENVCENISPR

SEQ ID NO: 8349 - protein, 81 aa, Microcaecilia unicolor
MRVTFEDVAVSFSQEEWEYLDEGQKELYREVMKENYETLISLEDACRNSSTEMHHWKLSEETGEEKISENDKKGTASFSDW

SEQ ID NO: 8350 - protein, 81 aa, Terrapene carolina
MLADWQKELYRAVMLENYENLFLLGHADAKPEIITKLERGEELCVGDQQAWEGREILPSASRGNWSRKKTKRESDLQECGG

SEQ ID NO: 8351 - protein, 81 aa, Terrapene carolina
LIFEEVAVYFTREEWALLDPTQRALYRDVMQENYENVTSLGDAMICEKEEQNSQPENVEQVDKHRELSQRLKRNMSSSHEQ

SEQ ID NO: 8352 - protein, 81 aa, Terrapene carolina
QGPVTFEEVAVYFTREEWALLDPRQRALCRDVIQENYENVTSLAGDAMVCDKEEQNSQKENVEQVDKHRALSQRSKRHVSR

SEQ ID NO: 8353 - protein, 81 aa, Lithobates catesbeianus
NMEKILELTTMMVHLLTGEVPIRCQDVTVYFSMEEWEYLEGHKDLYKDVMMDNQPPLTSPGKRRLYCKAESSTEGPPRSPI

SEQ ID NO: 8354 - protein, 81 aa, Terrapene carolina
FQVPVTFKEVAVYFTQGQGALLDPAQRALYRDVMQENYEMVTSLGKGFPSPRLLETMGDRFHPWNVLSDRHSLNPPHTLIW

SEQ ID NO: 8355 - protein, 81 aa, Microcaecilia unicolor
DQALVTFKDVSAYFLEADWDLLGERQKELYKKVIKEIHDILTSRGYSIVNPDVIVKIKKEDEKYFTQHFEWEGEENPDDLM

SEQ ID NO: 8356 - protein, 81 aa, Microcaecilia unicolor
QIPVTFEDIAIYFCQEEWEDLEECQKELYKDVMKENYDNLNSVGIASQTVAPDIISRIEQGEEPYIRDEPQSEKREIGNSS

SEQ ID NO: 8357 - protein, 81 aa, Microcaecilia unicolor
QMRVTFEDIAVSFSQEEWEYLDEEQKELYREVMKENYQILISLGTGSTTVIPDIISHIEQGEEPYIRDEPGPEERETGKSN

SEQ ID NO: 8358 - protein, 80 aa, Microcaecilia unicolor
MRVTFEDVAVSFSQEEWEYLDEGQKELYREVMKENYQTLISLGYERNDPDMLLRIEEEEEFYIKIQRRQMKEGYLLAPRY

SEQ ID NO: 8359 - protein, 81 aa, Terrapene carolina
LVFQMPVTFEEVAVYFTQGQGALLDPAQRALYRDVMQDNYEMVTSLGKGFPSPQILEAVGSVCLNLVRFFPCQLYQRRVVP

SEQ ID NO: 8360 - protein, 81 aa, Terrapene carolina
MSFPCAEFPVFTPDEISHLEQDKEPWVPDLHDSEEREILRGTCTREESFSQFKTCPCLKETAAVPDRDLVSSPSSGFSPAG

SEQ ID NO: 8361 - protein, 81 aa, Lithobates catesbeianus
IRCQDVTVYFSMEEWEYLEGHKDLYKDVMMENQPPLTSPGGQGVWNTLEADSEAEDHGITQCSPGENPDVRNMRCTLSCVD

SEQ ID NO: 8362 - protein, 81 aa, Terrapene carolina
MNKINACFLAPQTGFPISKPDVSSQLELGEEPWVPDLQIYEEREILKDVHRGSLSPGTGTDSCLDSLSVPAVEEMVNENKE

SEQ ID NO: 8363 - protein, 81 aa, Terrapene carolina
AGFPVSKPDVISQLERGEEPWVPDLQGSEKEVLPRVACTGSDLCLDPLSLPSGDGRVSENEEKPQQEDAEQIEAHGTLSGR

SEQ ID NO: 8364 - protein, 81 aa, Terrapene carolina
PVTFEDVAVYFTQGQGALLDPAQRAIYRDVMWENYETVTSLGKGFLAPWLLEAGGVSVAGLQSADITDIAFHVSCYLQEFP

SEQ ID NO: 8365 - protein, 81 aa, Microcaecilia unicolor
KLRVAFEDVAASFSQEKWEYLKGDPKELHREAVKDNYETPISPDTDQKKNNPDILLRIKEEEEPYVWVPQESGMKEMTHSD

SEQ ID NO: 8366 - protein, 81 aa, Microcaecilia unicolor
VPDQALFKDVAAYFLEVDWDLLGEWQKELYKKVIKEIHDILISQGYSIVNPDVLFKIKNEDEKYFTQHFEWEEKENPDGLM

SEQ ID NO: 8367 - protein, 81 aa, Microcaecilia unicolor
EVPISFEDIFIYFSQEEWENLQEEQRELYKDVMKENYEMLISLGAGFLTVTLDIISLIERGEEPYIRDEPGSEEGEIGKSS

SEQ ID NO: 8368 - protein, 81 aa, Microcaecilia unicolor
QQMRVAFEDIAVSFSQEEWEYLDEGQKELYREVMKENYETLISLGYESVNPDILSRIKQEEGPSEEKEDCHSYTANQLIPQ

SEQ ID NO: 8369 - protein, 81 aa, Microcaecilia unicolor
MKENYEILISLGYERISPDTLSRIKQEEEPYVWDPHESREREFTHSDTAVNEALQKLKQEQNCKETPVEMEQIPGQSKNVC

SEQ ID NO: 8370 - protein, 81 aa, Terrapene carolina
MTKTQRPKRAEFPIKKPDIISLIEREEEPWVPDLQGYEEKEMLSGTYAGDGIVSENGKENLHQDSHEPMEPHGTLSGASQR

SEQ ID NO: 8371 - protein, 81 aa, Terrapene carolina
MPVTFEEVAVYFTQAQGALLDPAQRALYRDVMQENYEAVTSLGKRFPSPQLVEAVQRFNRTVWSHANTGTELVNHLHEQVS

SEQ ID NO: 8372 - protein, 81 aa, Microcaecilia unicolor
GQVSVIFKDVAAYFLEVEWNILGEWQKELYKMVIKEIHGILMSRGYSIVSPDVIFKIKKEDEKYFTQQFEWEGKENPNDPN

SEQ ID NO: 8373 - protein, 81 aa, Microcaecilia unicolor
MRVTFEDITVFFSQEEWEYLDEGQKELYGEVVKENYEILMSLENDPKPSNTEKHNWKLLEKPEGEKMLPEREKEKTRSCSD

SEQ ID NO: 8374 - protein, 81 aa, Microcaecilia unicolor
TQVPVTFEDVAVYFCEGEWETLAEWQKELYRETMKENYETLTSLGFSSKKPSLISKIEREEDPCVRDKQDSRDRRRLRSCW

SEQ ID NO: 8375 - protein, 81 aa, Microcaecilia unicolor
MQENYDSLESMGFPIKKPEVVSRIEQGEEPWVMENAGSSILGTNTILAILERLEKRIARMEHHQIFFLTHLFKHLKPATLE

SEQ ID NO: 8376 - protein, 81 aa, Microcaecilia unicolor
AQFPVTFEDIAIYFSQEEWEELEESQKELYKDVMKENYEILRSLGCPAVTPEIISHIEQGEEPCIRNEPGSEERETGKSSC

SEQ ID NO: 8377 - protein, 81 aa, Terrapene carolina
MPVTFEEVAVYFTQGQGALLDPAQRALYRDVMQENYETVTSLGKGFLSPQILEAGMEEQVENPKIWYCTTSQDESINGGGR

SEQ ID NO: 8378 - protein, 81 aa, Terrapene carolina
FHSRNVLSDKYSTLIWSDFTLCAGFPIPKPELIARLERGEEPWVPDLQACKERRLPRCTRTGAERGSENEEGNHHKEVPGE

SEQ ID NO: 8379 - protein, 81 aa, Terrapene carolina
LRVRLNSGNALCDSRYSTNATCTLIWSDFTSCSGFPIPKPELIARLEGGKEPWVPDLQAAKERESPRGTRTAGDRTVSETK

SEQ ID NO: 8380 - protein, 81 aa, Terrapene carolina
PHNGPTFEEVAVYFTREEGALLDPAQRALYRDVMQENYENVTSLGFQVSQPQVISQLEQGEEPWVPDLQSSEKEVFLSLSQ

SEQ ID NO: 8381 - protein, 81 aa, Terrapene carolina
MELGKLTRLVAVYFTREEWALLDPAQRALYRDVMQENYENVTSLGKGYSPQCHLYSAQFQHHPNMPVTHITRDPPPLQNTW

SEQ ID NO: 8382 - protein, 81 aa, Terrapene carolina
VCGWKFPNWSSRKQPPRTGLGKRIKLQYWSLNLLGPVTFEEVAVYFTEEEWALLDPAQRALYRDVMQENYENVTSLLGYLV

SEQ ID NO: 8383 - protein, 81 aa, Terrapene carolina
MLRNYWALVSLGYSGSTPDLIQRIELGEAELWIRDAEDSRKNSGPDSPSSAGHEILGGTRTWSGCGRSFSQSSVLKIHPRT

SEQ ID NO: 8384 - protein, 81 aa, Lithobates catesbeianus
AGPAVLSCMRGCRGSAHISEHRRKEQATFDDIAVYFSKDEWDYLNDEEKDLYREVMIENYQTLQSLDWCRSLQTKFTHHIL

SEQ ID NO: 8385 - protein, 81 aa, Terrapene carolina
AGPPIPKPDLIARLEAGEEPWVPDLQVSEERKIPRGTCTADETKRENKEGNPQQEGPKEVELQGTFLRRAEGNFSKCLEQR

SEQ ID NO: 8386 - protein, 81 aa, Terrapene carolina
YVINGPVTFEEVAVYFTREEGALLDPTQRALYRDVMQENYETVVFLVGFPISKPDVISQLERGEKPNSSHLIRHKRIHTGE

SEQ ID NO: 8387 - protein, 81 aa, Terrapene carolina
LQRRLENMENLLKNRNFWILRLPPGTNGEVPKEWEKLDEWQKELYKNVMKGNYESLISLGKDQSWKSRNLSEWPSPAPLEL

SEQ ID NO: 8388 - protein, 81 aa, Microcaecilia unicolor
VTFEDIAIYFCQEEWEDLEECQKELYKDVMKENYDNLNSVEMDDPKNNNTETHHWKLSVNLEENKMLMKRDREDPPGSDWR

SEQ ID NO: 8389 - protein, 81 aa, Microcaecilia unicolor
QVPVTFEDITVYFSQEHWKYLNEGQKKLYREVMKENYETLISLGADHKNINSEVLTRIKQEEELYIWDPRESEEREVTHSY

SEQ ID NO: 8390 - protein, 81 aa, Microcaecilia unicolor
DQASVTFSDVAAYFLEVDWDSLGEWQKELYKKIVKEIHNFLISRGYSILNPDVIFKIKKEEKHLTQHYELEGKENMNDPSM

SEQ ID NO: 8391 - protein, 81 aa, Microcaecilia unicolor
MRVTFEDIAVSFSQEEWEYLDEEQKELYREVMKENYQTLISLGTGSTTVIPDIMSHIEQGEEPYIRDEPGPEESETGKSKC

SEQ ID NO: 8392 - protein, 81 aa, Microcaecilia unicolor
QQMQVTFEDITISFSQEEWEYLDEGQKELYREVMKENYETLISLGYEKVNPDIISRIKQEEDLYVLDPQESEVTQSYSDKE

SEQ ID NO: 8393 - protein, 81 aa, Microcaecilia unicolor
QKWVTFEDIAVSFSQEEWGYLDEEQKELYREVMKENYQTLISLGTGSTTVTPDIISHIEQGEETYIRDKLGSDGHQITQGR

SEQ ID NO: 8394 - protein, 81 aa, Microcaecilia unicolor
DQALVTFKDVAAYFLEVEWNILGDWKKELYKKVIKEIHDILMSRGYSIVNPDVIFKIIKEDEKYFPQPFEWERKENLTDST

SEQ ID NO: 8395 - protein, 81 aa, Microcaecilia unicolor
QVPVTFEDIAVYFSQEQWEYLDEGQKELYREVMKENYETLISLGTDHESINPEVLSRMKQEQEPHVWDSEKSGKRYTEKDD

SEQ ID NO: 8396 - protein, 81 aa, Microcaecilia unicolor
MKENYQTLISLGYEKINPEILSNIKQEEESYVQDPQESGEREVTHLYPTDNEAVQEQKKEENKAESPVEMEQIPRQLRSIC

SEQ ID NO: 8397 - protein, 81 aa, Microcaecilia unicolor
TVVPVTFSDVAACFLEEEWKVLEEWQKKNYQKVMKEIHAALISLGHRITNPSVLVKIAEEEPCWKVAGASRGNKHQNAAGR

SEQ ID NO: 8398 - protein, 81 aa, Microcaecilia unicolor
QIPVTFEDISIYFSQKEWEELEEWQKELYSDVMKESYDTLISLGVGSPAVTPDIISLIERGEEPYIRDEPGSEENDTGKSS

SEQ ID NO: 8399 - protein, 81 aa, Microcaecilia unicolor
EQMRVTFEDIAVSFSQEEWEYLDEGQKELYWEVMMENYETLISLGDEVLWEKENEENEECTMELVLIPIESKHGCENIFQG

SEQ ID NO: 8400 - protein, 81 aa, Terrapene carolina
PVTFDDVAVYFSEEEWEILAEWQRDLYKEVMKENLETVLSLGLHPLPKPPCSLSPDCPILRPSPHPNWPPRTLSPTCPLTA

SEQ ID NO: 8401 - protein, 81 aa, Terrapene carolina
MMSQGFPVSKPDVISQLERGEEPWVPDLQGSGEKLLSRAACTGVGMVSENKEKPHQEDAEQVEPHGMLSGRSKGNDSGSCA

SEQ ID NO: 8402 - protein, 81 aa, Lithobates catesbeianus
TPIMEPPPPSLNLERSNDKKILNVTQKIIELLTREVPIRCQDVTVYFSMEEWEYIEGHKDLYKDVMMENQPPLTSPGKRRL

SEQ ID NO: 8403 - protein, 81 aa, Lithobates catesbeianus
LLTGEDVTVYFSMEEWEYLERHKDLYKDVMMDNQQILSCVKKKIHLNKKIHKLSLEIIYLLIGENFPPVKSGDQVTITVPP

SEQ ID NO: 8404 - protein, 81 aa, Microcaecilia unicolor
QVPVTFEDIVIYLSQEEWKNLQEEQRELYKDVMKENYEMLISLGAGSLTVTPDIISHIERGEEPYIRNEPVSEERDIGKSN

SEQ ID NO: 8405 - protein, 81 aa, Microcaecilia unicolor
DQVPVTFKDVAAYFLEVEWDIIGEWQKELYKKAIREIHSILTSRGHSILNPDVVFKIKKEDEKYFIQHLEREGKENPNDPR

SEQ ID NO: 8406 - protein, 81 aa, Microcaecilia unicolor
DQALVTFSDVAAYFLEVEWNILGEWQKELYKKVIKEIHSFLISQGYSILNPNVIFKIKNEDEKYFTQHCEWAGNESKNEPS

SEQ ID NO: 8407 - protein, 81 aa, Microcaecilia unicolor
VQMRVTFEEIAVSFSQEEWEYLDEEQKELYREVMKENYQTLISLGSLNVTPKIISHIERGEEPYVRDEPGSEKRETGPSSG

SEQ ID NO: 8408 - protein, 81 aa, Microcaecilia unicolor
QKRIKFEDIAVSFSQEEWEYLDEEQKELYREVMKENYQTLISLGTGSPTVIPDIISHIERGEEPYVREEPGSEEREAGTSR

SEQ ID NO: 8409 - protein, 81 aa, Microcaecilia unicolor
EQVPVTFEDIAVSFSQEEWEYLDEGQREFYWEVMKENYETLTSLGFERINPDTLLRIKQEEEIYDWDPQHSGERESAHSYL

SEQ ID NO: 8410 - protein, 81 aa, Microcaecilia unicolor
MPVTFEDIAVSFSQEEWEYLDKGQKELYREVMKENYEILISLGYERISPDTLSRIKQEEEPYVWDPHESREREVTHSDTVD

SEQ ID NO: 8411 - protein, 81 aa, Microcaecilia unicolor
MRVTFEDIAVSFSQEEWEYLDEEQKELYREVMKENYQTLISLGTGSMTVIPDIMSHIEQGEEPYIRDEPGPEERETGKSNC

SEQ ID NO: 8412 - protein, 81 aa, Microcaecilia unicolor
DQASVTFNNVAAYFLEVEWDILREWQKELYKKVIKEIHSFLILQGCSILNPDVIFKIKKEDEKYFTQHCELVGKESMNDLS

SEQ ID NO: 8413 - protein, 81 aa, Microcaecilia unicolor
LPVTFEDIAVYFSQEQWEYLDEGQKELCREVMKENFETLISLEKDYSRNSDTEPHHKKLSEKPEGEKSLSERDKEETSSFS

SEQ ID NO: 8414 - protein, 81 aa, Microcaecilia unicolor
MSDQALFKDVAAYFLEVDWDILGEWQKELYKKVIKEVHDILISQGYSVVNPDVIFKIKNKDENYFPQHFEWEEKENPDDLI

SEQ ID NO: 8415 - protein, 81 aa, Microcaecilia unicolor
VSDQDLFKGISAYFLEADWDILEEWQKELYKKVIKEVHDILISRGYSIVNPDVVFKIQKEDEKYFTPHFEWEGKENPDDPM

SEQ ID NO: 8416 - protein, 81 aa, Microcaecilia unicolor
EPVTLEDITVYFSQEQWEYLNEAQKKLYVEVMKENYETLISLEKDTPKNSDAETHCWKLSENPEGEMMLPERDKEETSFCS

SEQ ID NO: 8417 - protein, 81 aa, Microcaecilia unicolor
AQVSVTFDDATGYSSEDEWKGLEEGQKMLHMDTMKDNYEVLTSLDSAVANPEVLSRIKEEDELHFSDHSASEGKEDNGAPS

SEQ ID NO: 8418 - protein, 81 aa, Corvus brachyrhynchos
LKNRNFWILRLPPGAKGEVPKVPVTFDDVSVYFNDKEWEKLEEWQKELYKNVMKGNYESLISLDYAISKPGVLSQIEQGEE

SEQ ID NO: 8419 - protein, 81 aa, Lithobates catesbeianus
VPIRCQDVTVCFSMEEWEYLEGHKDLYKDVMMENQQTWSDGKFRNAEAILDLTLEIIYLLTGEDCAVVMKTSLKDISKKKS

SEQ ID NO: 8420 - protein, 81 aa, Microcaecilia unicolor
AQALVTFRDVAAYFLDVEWDILGERQKELYKKVIKEIHDILMSQGYSIVNPDVIFKIEKEDEKYFTQQFEWEGKENPNDST

SEQ ID NO: 8421 - protein, 81 aa, Microcaecilia unicolor
HQASVTFSDVAVYFSEEEWQLLEEWQKELYRNVMMEIHGALISLGYGILNPDVLFRFKKEEEPYYRSQQKSKGKERVVDLN

SEQ ID NO: 8422 - protein, 81 aa, Microcaecilia unicolor
QVPVTFEDITVHFSQEQWDYLDEGQKELYREVMKENCETLISLGTDHESINPKVLSRIKQEKEPQVWDMRKSEDREVNHSY

SEQ ID NO: 8423 - protein, 81 aa, Microcaecilia unicolor
MKENYQILISLGYEKINPDILSRIKQEEEPFVQELQESDEKEGCHSYTDQPIIQERKEERNQGKNPVKVEQSQRQSENICD

SEQ ID NO: 8424 - protein, 81 aa, Microcaecilia unicolor
QQVPMTFEDIAVSFSQEEWEYLDEGQKELYREVMKENYKTLISLGYERINPDILSRIKQEEEPFVQELQESEEREDFHSYT

SEQ ID NO: 8425 - protein, 81 aa, Microcaecilia unicolor
QVPVAFEDIAIYFSQEEWKDLEKWQKELYKDVMKENYQILISIGAGSPAVTPDIISHIEQVEEPYVGDELGSEESKAEKNS

SEQ ID NO: 8426 - protein, 81 aa, Microcaecilia unicolor
QMQVTFEDITVSFSQEEWEYLDEEQKELYREVMKENYQTLISLGTGSPTLIPDIMSCIERGVELYIQHKPGSAERETGKSS

SEQ ID NO: 8427 - protein, 81 aa, Microcaecilia unicolor
ISRTMWVTFEDITVSFSQEEWEYLDEGQKELYREVMKDNYETLISLVNEAEQELKREQNQEESVIQTEGNDDRNISQRMER

SEQ ID NO: 8428 - protein, 81 aa, Microcaecilia unicolor
QQEPVTFQDVTVYFSKEQWEYLDEGQKRLYREVMKENYETLISLGTDHNINSEVLSRIQENEKRHIWDPKESRERDVTHSY

SEQ ID NO: 8429 - protein, 81 aa, Microcaecilia unicolor
DQASITFKDVAAYFLEVEWDILGEWQKELYKRVIKEIHDILMSRGYSIANPDVIFKIKKEDEKYFTQHFEWEGKENLNDPT

SEQ ID NO: 8430 - protein, 81 aa, Microcaecilia unicolor
DQASITFKDVAAYFLEVEWDILGEWQKELYKRVIKEIHDILMSRGYSIVNPDVIFKIKKEDEKYFTQHFEWEGKENLNDPT

SEQ ID NO: 8431 - protein, 81 aa, Corvus brachyrhynchos
EAPAVALENNATGFSTQEWENLEEWQRELYGKVLTGKREALVLLDDVISEPALLSRLQGGEAPCSEEEPAPGEIPAEPADC

SEQ ID NO: 8432 - protein, 81 aa, Lithobates catesbeianus
EVTKKMMELLTGEVPIRCQDVTVYFSMEEWEYLEGHKDLYEVVMMENQQNLSFVKNVRKEFPWNEMILNLTLEILSLLTGE

SEQ ID NO: 8433 - protein, 81 aa, Microcaecilia unicolor
YQASVTFNDVAVYFSQEEWHLLDEWQKRLYKDVMKEIHSVLISLGYTIINPGIFFRIKDGDRPSKEGRRERVHRGREKLNG

SEQ ID NO: 8434 - protein, 81 aa, Microcaecilia unicolor
LLFLSQHFIDPPAVQHNPDLSLEWLQGGSWTGGGGVEKGKRMEQMQVTFENVFVSFSQEEWEYLDEEQKELWREVMHIGSG

SEQ ID NO: 8435 - protein, 81 aa, Microcaecilia unicolor
DQTLVTFKDVAAYFLEVEWNILEEWQKEVYKKVIKEIHGILISRGYSIVNPDVMLKIKKENEKYFAQHCELEGKEDLNDPT

SEQ ID NO: 8436 - protein, 81 aa, Microcaecilia unicolor
MKENYEILISLGYERISPDTLSRIKQEEEPYVWDPHESREREVTHSDTAVNEALQKLKQEQNREETPVEMEQIPGQSKNVC

SEQ ID NO: 8437 - protein, 81 aa, Microcaecilia unicolor
AQASVTFHDVAIYFSEKEWQLLEEWQKELYRNVIKMIHGALTSLGHIIVNPGVVFRIKKEKTPYLWDPCDSEGQERMKDPP

SEQ ID NO: 8438 - protein, 81 aa, Microcaecilia unicolor
MMPLDKTLKGLDKFLEEEWEYLDDGQKELHREVMKENYEILMSLGDEITQEKEREEKREEREKSFTHEEHLSQHLKTHTKE

SEQ ID NO: 8439 - protein, 81 aa, Microcaecilia unicolor
QKQVTFEDIAVSFSQEEWEYLDEGQKELYREVMKENYQTLISLGTGSTTVIPDIMSHIEQGEEPYIRDEPGPEERETGKSN

SEQ ID NO: 8440 - protein, 81 aa, Microcaecilia unicolor
NRALVTFKDVSAYFLEVDWDILGEWQKELYKKVMKEIYDILISRGYSIVNPDVIFKINKEDEKYFTPHFEWERKENPDDPM

SEQ ID NO: 8441 - protein, 81 aa, Microcaecilia unicolor
MKENYETLISLGHERVEPDMLSRIKQEEEAYVKDPQQSREREVIPSYTDHKIRLEQKSEENQEEPPVEMEQIKRQSGDVFE

SEQ ID NO: 8442 - protein, 81 aa, Microcaecilia unicolor
GLPQVTFDDAAIYFSEEQWKNLEEWQREMYKELMKEIYEIMIALGHQIPKPDILSLIERGEEPCALPSKRKKTEESVTETP

SEQ ID NO: 8443 - protein, 81 aa, Microcaecilia unicolor
ALTSVVFSDVAACFWELEWDILKEWQKEIYKKVIKEIHNILMSQGCSIVNPHVIFKIKKEDDKYFTQQYKLEGKENMNDPT

SEQ ID NO: 8444 - protein, 81 aa, Microcaecilia unicolor
QIKTDLFKGVSAYFLEADWDILEEWQKELYEKVIKEVHDILISRGYSILNPDVMFKIQKEDEKYFTPHFEWEGKENPDDPM

SEQ ID NO: 8445 - protein, 81 aa, Microcaecilia unicolor
MRVTFEDIAVSFSQEEWEYLDEEQKELYREVMKENYQTLISLGTGSTTVIPDIISHIEQGEEPYIRDVPGPEERETGKSNC

SEQ ID NO: 8446 - protein, 81 aa, Microcaecilia unicolor
QNPVTFEDIVIYFSQEEWEDLEEWQKELYKDVMKENYKILISLGAGSADVTPDIISHIERGEEPYIRNELGLEKSETRKSS

SEQ ID NO: 8447 - protein, 81 aa, Terrapene carolina
MPVTFEEVAVYFTQGQGALLDPAQRALYRDVMQENYETVTSLGFPIPKPELIARLERGEEPWVPDLQACKERRLPRCTRTG

SEQ ID NO: 8448 - protein, 81 aa, Lithobates catesbeianus
SGCSIQKPEILSRLEDGGEPWLAEDREEREDVAGLGGSIKREAGDGCDNLGLGEMLHYEDPADNIPPSGIKVEEEMLEPPY

SEQ ID NO: 8449 - protein, 81 aa, Terrapene carolina
LQVAFEDVALYFTREEWELLSQPEKQVYRDQMLRNYRVLVSLGKYKISHPLLTPKTLLLVETAPHLPRKKEHHKFNKRNVE

SEQ ID NO: 8450 - protein, 81 aa, Terrapene carolina
PPFFSLPGVGFPISKPDVISQLERGEEPWVPDLQGSEKEVLLRAPCTGSDLYLDSLCLPSGDGLVRENEEEKAHQEDAEQV

SEQ ID NO: 8451 - protein, 81 aa, Lithobates catesbeianus
DPGTVTFNDVAIYFSQRDWQLLADWQRKLYRNIMKEIHGALTALGYEIANPGTLVKIQQHEEPYFRDELSKEEMAASAWVS

SEQ ID NO: 8452 - protein, 81 aa, Xenopus tropicalis
GVGQVTFDDAAIYFSEEQWGNLEEVQKKVYKELIKEIYEIMLSLGYCIPKPEIVSRIERGEDPYGVVSKKQKLQEPQPEGL

SEQ ID NO: 8453 - protein, 81 aa, Terrapene carolina
AAGPVSFEEVAVYFTAGQGALLDPSQRALYRDVMQENYENVTLLGCPVSKPDVISQLERGEEPWILSKWHHMGDYRTAPEG

SEQ ID NO: 8454 - protein, 81 aa, Terrapene carolina
KTKAVTFEEVAVYFTAEEWALLDPTQRALYRDVMWENYENVTWLGKSPWAFPIYSGCKSLLANIRLGSSQHPLCNEETGNP

SEQ ID NO: 8455 - protein, 81 aa, Lithobates catesbeianus
EKKILEVTKKITELLTGEVPIRCQDVTVYFSMEEWEYLEGHKDLYKDVMMEDQPPLTSPGKRRLYCKGESSAEAPPRSPII

SEQ ID NO: 8456 - protein, 81 aa, Lithobates catesbeianus
IRCQDVTVYFSMEEWEYLEGHKDLYKDVMMENQQLLNYVNIEKNNLHNGILILALEIIRCLTGEDCTVIMNSSNENNIGRR

SEQ ID NO: 8457 - protein, 81 aa, Microcaecilia unicolor
MRVMFEDITVSFSQEEWEYLDEGQKELYREVMKENYESLMSLENDYPRNSKTKTHDWKLIEKSKGEKMLSEREKEETPSCS

SEQ ID NO: 8458 - protein, 81 aa, Microcaecilia unicolor
QQMRVTFEDIAVSFSQEEWGYLDEGQKELYREVMKENYQTLISLAGYERISPEVLSRIKVEEEPYVQDSQESGGKEPTRSH

SEQ ID NO: 8459 - protein, 81 aa, Microcaecilia unicolor
MSALALFKDVAAYFLEVDWNFLREWQKELYKKVIKEVHDILISQGYSVVNPDVIFKIKNKDENYFPQHFEWEEKENPDDLI

SEQ ID NO: 8460 - protein, 81 aa, Microcaecilia unicolor
SQALVEFRDVAICFTKEEWMQLEEWQKQLYRNVIQEIHQTLISLGYTILKSDILIRIRDEDEHYISDQDEPQKHECHNGPT

SEQ ID NO: 8461 - protein, 81 aa, Microcaecilia unicolor
DPASVTFSDVAAYFWEMEWDRLMEWQKEVYKLVIKEIHGILMSRGYSIVHPNVIFKIKKEDENYFTQEYDCEAEENINSSI

SEQ ID NO: 8462 - protein, 81 aa, Microcaecilia unicolor
DQALVIFKDVSAYFLEVDWDILGEWQKELYKKVIKEVHDILTSRGYSIVNPDVIFKIKKEDKKYFTQHFEWEGKENPDDLM

SEQ ID NO: 8463 - protein, 81 aa, Xenopus tropicalis
RHHVTPTVGALHAPGSALQKENAKRILELISNIIQLLTGEVAIRCEDVSLYFSLEEWQYLKGNQTRYREVIKENRQQLRPL

SEQ ID NO: 8464 - protein, 81 aa, Terrapene carolina
VPKVPVMFDDSAVFSQEEWENLEDWQKELYKNVMKGNYEYMISLDYAISKPDILSRIERGEEPCARGQQESEERETSADPS

SEQ ID NO: 8465 - protein, 81 aa, Terrapene carolina
PKVPMAFDDVSIQIPREKWENLEEWQKELYKNVMKGNYDSLISLDHAISKPDILSRIEQGEELCAGEPQDLEVREIPTESA

SEQ ID NO: 8466 - protein, 81 aa, Terrapene carolina
GAMPVTFEDVAVYFTQGQGALLDPAQRALYRDVMQENYEMVISLGKGFLSPRLLEAVGSACRTLVRFFLGELDQRRMGSIM

SEQ ID NO: 8467 - protein, 81 aa, Lithobates catesbeianus
GEVPIRCQDVTVYFSMEEWEYIEGHKDLYKDVMMENQPTLTSPDGSSNRNPPERCPRPLYSRDSTQEHQKVPEEVHFEDLI

SEQ ID NO: 8468 - protein, 81 aa, Microcaecilia unicolor
MRVTFEDIAVSFSQEEWEYLDAGQKELYREVMKENYETLIALGYERIRPDILSRIKEQEEPYVWDPRETRHREDTQSDTDH

SEQ ID NO: 8469 - protein, 81 aa, Microcaecilia unicolor
VSDQDLFKDVSAYFLEADWDILEEWQKELYEKVIKEVHDIFISRGYSIVNPDVMFKIQKEDEKYFTPHFEWEGKENPDDPM

SEQ ID NO: 8470 - protein, 81 aa, Microcaecilia unicolor
QMEVTFEDITVSFSQEEWEYLDEEQKELYREVMKENYQTLISLDHHITQERKREKKQGEHPVEMEQIQKHSENVCENISPR

SEQ ID NO: 8471 - protein, 81 aa, Microcaecilia unicolor
VTFEDIAVSFSQEEWEYLDEGQKELYREVMKDNYETLISLVNEAEQELKREQNQEESVIQMEGNDDRNISQRMERRHPRNH

SEQ ID NO: 8472 - protein, 81 aa, Microcaecilia unicolor
AQMQVTFEDIAVFFCHEEWKYLDDGQKELYKEVMKENYETLISLGFLCEKPSLISKIEREEDPCVRDQQDFRERRRRLKSF

SEQ ID NO: 8473 - protein, 81 aa, Microcaecilia unicolor
QMLVTFEDIAVYFSQEQWEYLDEGQKELYKEVMKENYETLISLGIDHESINPEVLSRIKQEEKLHNRDPKDSGEIEVKHSY

SEQ ID NO: 8474 - protein, 81 aa, Microcaecilia unicolor
QMPVIFEDIIIYFSQEEWEVLEEWQKELYKDVMKENYEILISLGSGSLTVTPDIISHIERGEEPYVRDELRSEERETGKSS

SEQ ID NO: 8475 - protein, 81 aa, Microcaecilia unicolor
VLASVTFSDVAAYFREMEWDILEKWQKELYKKVIKEIHSFLLSQGYSILNPDVIFKIKREDEKYLTQRYEWERKESINDPS

SEQ ID NO: 8476 - protein, 81 aa, Microcaecilia unicolor
QIPVTFEDIAVYFSQEEWKDLEDWQKKLYKDVMKENYEILLSLGSITVTPDIISYVEREIRDEPGSEERETGKSSCSEAVA

SEQ ID NO: 8477 - protein, 81 aa, Microcaecilia unicolor
QQVSVTFKDVAAHFSEEEWEVLEEWQKELYKKVMLEVHEALISLGYGILNSDIIFRVKQRDKLYYRDWRDVDGGRSAKTSS

SEQ ID NO: 8478 - protein, 81 aa, Microcaecilia unicolor
AQASITFSDVAAYFLEADWDLLGEWQKELYKKVIKEIHSFLISQGYSILNPEVMFKIKKEDEKYFAQHCQWEGKESVNDPS

SEQ ID NO: 8479 - protein, 81 aa, Microcaecilia unicolor
RKMRVTFEEIAIYFSQEEWEYLDEGQKELYREVMKENHETLMFLAENEVTEEEVKETNREGRPLKWKLRPRHVSVYEGIER

SEQ ID NO: 8480 - protein, 81 aa, Microcaecilia unicolor
SVTFEDIVIYFSQEEWEDLEEWQKELYKDVMKENYQTLLSLGVEVPKNSKAAIYYWELCVNPGGKRILLKRDSEDTSPSEG

SEQ ID NO: 8481 - protein, 81 aa, Microcaecilia unicolor
DLASVIFNDVVAYFWDAEWDVLEERQKDLYKKVIKEIHGFLMSRGYLIVNPDVLIRVKHEGGKYFTQHHDWEENENVNDPL

SEQ ID NO: 8482 - protein, 81 aa, Microcaecilia unicolor
VSDQALFKDVAAYFLEVDLDILGEWQKELYKKVIKEVHDILISQGYSIVNPHVIFKIKNEDEKYFTQHFEWEEKENPDDLI

SEQ ID NO: 8483 - protein, 81 aa, Microcaecilia unicolor
VPVTFEDITVYFSREEWESLEEWQKELYKDVMKGNYQILNSLEKDELRSNNTETHHWKLSENLEDKVFVDEVGVDRSYYDG

SEQ ID NO: 8484 - protein, 81 aa, Microcaecilia unicolor
QVPVTFEDIAVSFSQEEWKYLDEGQKNLYWEVMKENYETLISLADSEVEQEDKRAKNREECPMLWGLIPRQSRKNSEKVSW

SEQ ID NO: 8485 - protein, 81 aa, Microcaecilia unicolor
MDVMKENYETFSSLETGTSIVTPDVISRMDRGEEPYIKDELESVKKETEKSSCSENDDLRNSNLEMHHWKLSAKPEGENMF

SEQ ID NO: 8486 - protein, 81 aa, Microcaecilia unicolor
QQVRVAFEDIAVSFSQEEWEYLDEGQKELYREVMKENYQTLISLGYERINPDILSRIKRKEEPYVQEVQESEEKEDCHSYT

SEQ ID NO: 8487 - protein, 81 aa, Microcaecilia unicolor
DQVPVTFEDVAIHFSQEEWECLEEWQKNLYKDVMKENYQTLISLAGCPTFTPDIISHIERGEEPYIRDELGSEERETGKSS

SEQ ID NO: 8488 - protein, 81 aa, Microcaecilia unicolor
KMRVTFEDIAISFTQEEWEYLNEGQKELYREVMKENYETLMFLAENEVTEEEAKETNREEHPLKWKLHPRQVCVSQGTERG

SEQ ID NO: 8489 - protein, 81 aa, Microcaecilia unicolor
DQALVTFKDVSAYFLEVDWEILGEWQKELYKKVIGEIHVILISRGYSIVNPDVMFKIKKEDDNLDDPMKSLPIVTSAISLS

SEQ ID NO: 8490 - protein, 81 aa, Microcaecilia unicolor
DQALITFSDVAAYFWEVEWDVLGEWQKELYKKVIKEIHNFLISQGYSIVNPDVIFKIKKEDEKYFTQHCDWEEKENTNNPT

SEQ ID NO: 8491 - protein, 81 aa, Terrapene carolina
MAISMPRITAMAESHRRELVSAGFPISKPDLLSWMERGEEPWVPDLQASEDREIPRSSSPGEGSASEEEEEEEEEEEEEEE

SEQ ID NO: 8492 - protein, 81 aa, Lithobates catesbeianus
MEKILEVTKKMMELLTGEVPIRCQDVTVYFSMEEWEYLEGHKDLYKDVMMDNQPPLTSPGKRRLYCKGESSTEGPPRSPII

SEQ ID NO: 8493 - protein, 81 aa, Lithobates catesbeianus
VRALVTFHDVSACFSAKEWGALEDWQKELYKNVMREIHAALLSMGYAILNPEQLLRVEGVKESSPARGKIPEHKNHNVITA

SEQ ID NO: 8494 - protein, 81 aa, Lithobates catesbeianus
VPIRCQDVTVYFSMEEWEYLEGHKDLYKDVMMDNQPPLTSPDGSSNGNPPERCPRPLYSRDSTQEDHTIPHHHQDVVKEEY

SEQ ID NO: 8495 - protein, 81 aa, Microcaecilia unicolor
DQALVTFKDVCACFLEVEWDILGEWQKELYKKVIKEIHDILTSKGYSIVNRDVIVKIKKEDEKYLTQHFEWEGKENPNKSF

SEQ ID NO: 8496 - protein, 81 aa, Microcaecilia unicolor
QIPVIFEDIVIYFSQEEWKDLEEWQKELYRDVMKENYQTLLSVGTGSLTVTPDIISHIERGEEPYIRDEPESEERETGKSS

SEQ ID NO: 8497 - protein, 81 aa, Microcaecilia unicolor
DPASVIFKDVAAYFLDMEWNILGEWQKEFYKKVIMEIHDILTSRGYSIVNPDVIFKIKKEDEKYFTQHFECEGNKNPNDPT

SEQ ID NO: 8498 - protein, 81 aa, Microcaecilia unicolor
EPVTFEDITVHFSQEQWDYLDEGQKELYREVMKENYETLISLEKDDSRNSNTEVHHWRFSEKTEEEKRLSEREKNETSSCS

SEQ ID NO: 8499 - protein, 81 aa, Microcaecilia unicolor
MKENYQTLISLGYERINPDILSRIKRKEEPYVQEVQESEEKEDCHSYTANQLIPQERRREKNQGEDPVPMEQIQRQSESDC

SEQ ID NO: 8500 - protein, 81 aa, Microcaecilia unicolor
QVPVTFEDITVSFSQEQWGYLDDGQKELYREVMKENYETLISLGTDHGSINPEVLSRIKQEEEPPFWDPEDSEDREVTLLY

SEQ ID NO: 8501 - protein, 81 aa, Microcaecilia unicolor
QMRVTFEDIAVSFSQEEWEYLDEEQKELYREVMKENYQILISLGTGSSTFTPEIISHIERGEEPYSRDEPGSEEREPGKSS

SEQ ID NO: 8502 - protein, 81 aa, Microcaecilia unicolor
LETLVTFKDVAGCFLEVEWNILGEWQKELCKKVIKEIHGILMSQGYSIVNPDVLLKIKKEDEKYFAQHCELEGKENLIDPT

SEQ ID NO: 8503 - protein, 81 aa, Microcaecilia unicolor
DQASVIFKDVAAYFLDVEWNILEEWQKELYKKVIKDIHDFLTSQGYSIVNPDVIFKIKTEDEKYFTQHFECEGNKNPNDPT

SEQ ID NO: 8504 - protein, 81 aa, Microcaecilia unicolor
VQMQVTFEDIAVSFSQAEWTYLDEGQKELYRDVMKENYQTLISLGYEGIDPDILSKIKQEEELNIRDPQDSGEREVTHSYA

SEQ ID NO: 8505 - protein, 81 aa, Microcaecilia unicolor
QMPVTFEDITVYFSQEQWEYLDEGQKELYREVMKENYETLISLGIDHESINPETILRINEEEGLPTWDPKESRDRKVTQLY

SEQ ID NO: 8506 - protein, 81 aa, Microcaecilia unicolor
TQVMVTFRDVAAYFLEMEWDILGERQKELYKKIIKEIHGFLISQGYSIINPDIIFKIKNEDEKYLTQCCKWEGKESQNDPN

SEQ ID NO: 8507 - protein, 81 aa, Notechis scutatus
LDLSQDQMQNQGWQRQKLLESLFLREAEEDQGPVSFEEVAVRFSKGEWGMLDPEQRALYREVMVENYGTVVSLGKNPFHPL

SEQ ID NO: 8508 - protein, 81 aa, Notechis scutatus
LVSFEEVAVYFSEEEWSQLDPDQKALHSEVMLENHRNVVSLGNNGQENQDSCELFQVINAKDGTEKFGIRMEFENHDRNQS

SEQ ID NO: 8509 - protein, 81 aa, Notechis scutatus
MVIGFKDVIVFFPPEEWELLTKEQKQLYWDILKENYQSLVLIGCPVTSTEILAWFKSNKCQDLQVLQRLIEDPLPEIPSIG

SEQ ID NO: 8510 - protein, 81 aa, Pantherophis guttatus
YVPFEEVAVEFTEEEWALLDCGQKALCREVMLDVSRNIASLTDDGDWNGLENKKDKQLRLLKWPRGVSAESHSFSFTIPKI

SEQ ID NO: 8511 - protein, 81 aa, Pantherophis guttatus
VSFEEVAVYFSEEESSVLDPDQKALHWEVMLENYRNVASLGNNEQDHKESRESFKVLRHRDIMKKPAIQMEFQRHERKNPS

SEQ ID NO: 8512 - protein, 81 aa, Pantherophis guttatus
NHMSFEDIAIFFSEEEWALLNPDQKLLYREIMLENARNVTCIGKRWENEDSKKEMIEHLPTVNNEIGERMFRCQWGVQSPE

SEQ ID NO: 8513 - protein, 81 aa, Xenopus laevis
YQGSVTFHDVAASFSAEEWSLLEEWQKELYRNVMRAIHAALQTMGFEIINPDVLFRIKKVKEVYSSLMDRSDSTAAFHEGD

SEQ ID NO: 8514 - protein, 81 aa, Xenopus laevis
AKAPVMFDEVAVYFSEEEWGYLAETQKLLYVNVMLDNYETLCYLGLIHEIPEIITRIWQGLDLYELPLNRAGPGSIGIKEE

SEQ ID NO: 8515 - protein, 81 aa, Xenopus laevis
PNDPVTFEDIAVYFSEEEWKGLQEGHKELYREVIQDNYQNLTDLGLVITKPEIVQKIEKGEDPVISVCLTPAQVQHRAHSR

SEQ ID NO: 8516 - protein, 81 aa, Pantherophis guttatus
AVSFKEVAVYFAEEEWALLDRGQKTLYREVMLETYGIVASLSLVTEDFPAQELRCISSRIAKDEEQEAGDLKGSGGQEGQK

SEQ ID NO: 8517 - protein, 81 aa, Pantherophis guttatus
FLVQGIVSFEEVAVHFSEEEWSQLDPAQKALHGEVMLENSRNLAYLGYNEQVNKNCEEQCQPVHLKEENRNFADQMQRTID

SEQ ID NO: 8518 - protein, 81 aa, Pantherophis guttatus
KMPVTFVDIAVYFSAEEWKNLADWQKDLYNNLLKENYESLLAFGANVNVAKPEVHPRAERGAPEPSVPEPPSAKERDVIPE

SEQ ID NO: 8519 - protein, 81 aa, Xenopus laevis
KVHVSFEEVAVYFSDEEWQQLEVWQKEFYNEVMQDILETLLSLEDNLVEGDGKQNSTGYAVMPQWSNDKGAPVTAKQIYDQ

SEQ ID NO: 8520 - protein, 81 aa, Pipra filicauda
AQVPVTFEDVMVYLSRAEWDSLQAGQRELYRDVVLDTYELLTSLGYPGPKPDILYRLERGEEPWIYPSSGHTGSWQEEPLS

SEQ ID NO: 8521 - protein, 81 aa, Pipra filicauda
RTVPVRFEEVALRFSRQEWDTLDEGQRELYRSVMEGNYEMLVSLYCALSKPHLLLWLERGEELSTMTESEPEAADVSPEPA

SEQ ID NO: 8522 - protein, 81 aa, Pantherophis guttatus
ALVPEAFMEVTVCSSDVQHTHLGRRQKTTYKNSVQGNYLTAAAIGRVHCHPSELLSRLDRGEEAWVPQIQSSDESADEGPI

SEQ ID NO: 8523 - protein, 81 aa, Pantherophis guttatus
SMAISFDDIVIYFSPDEWRLLTKDQKQLYWDMLEENYQSLLFVGGRCPISPEEVVSWVENNEYLKICMLSRFLGDLPPGIL

SEQ ID NO: 8524 - protein, 81 aa, Pantherophis guttatus
DSVSFEDVAVYFTEEEWALLDPSQRALHGEVMLENFRNVATLAYGQEHENYREQMIKSLVDQEPSQGIRKICKVSGGEESP

SEQ ID NO: 8525 - protein, 81 aa, Pantherophis guttatus
IPVSFEDVAVFFSEEEWALLDFDQKSLYREVMLENAKNVESMDDREEPEDYKEPGVNSLERTETTKGIFQNRKKPNVTEEN

SEQ ID NO: 8526 - protein, 81 aa, Xenopus laevis
TFYQELFDEVAVYFCKEEWDYLKEEEKELYKDVMLENYMALRSLGYAVVKPIIISKINQGEEPFIRVPPRSKGKVGADLLL

SEQ ID NO: 8527 - protein, 81 aa, Pantherophis guttatus
VSFEEVAVYFVEEEWEILDSNQKALHTEVMLENSQNVTALAACEQEKENSKEESTAQLQTTQNEADEETFGNQEEINSSEK

SEQ ID NO: 8528 - protein, 81 aa, Pantherophis guttatus
MLKTYENMAFVGLSSSKPDLISCLQQGKILLESDQQREFPFPSCTGPEQVSENEETSMQSIQFWPGDRRQQRKHRRKQKEE

SEQ ID NO: 8529 - protein, 81 aa, Pantherophis guttatus
PKVPLTFDDMSVYFNEKEWEKLEEWQKELYKNLMKGNHQSLVSLDYAISKPGILSQTERMTDSCHGEDQDSEEQGRLPDAT

SEQ ID NO: 8530 - protein, 81 aa, Pantherophis guttatus
NSIFFEDVAVFFSVEEWALLDLGQKNLYREVMLDNARNLSSLSDGWWMEGHGQEAAAAFPKGIKEVVERMFGKKGSKENQL

SEQ ID NO: 8531 - protein, 81 aa, Xenopus laevis
LETFVTFDDVAAYFSEDDWQCLEEWQQELYQNAMQEIHGVLLAMGYTISNPDVLVRIKNVGTSNFSDNPDSSKSKKCCNFT

SEQ ID NO: 8532 - protein, 81 aa, Xenopus laevis
EEGTVTFNDVAVYFSFHQWELLEDWQKLLYKNVMKEIHGALTALGYEIANPGVLVKVQQSDEPSYSRNNKEEIKYKGPSQI

SEQ ID NO: 8533 - protein, 81 aa, Xenopus laevis
GKMLITFDDIAIYFSEEEWKSLEDRQKALYKDVMIENYQTLRLLGFLDFKPEIITVIEEGQEPYIKKNQRSIKTVDTIKNC

SEQ ID NO: 8534 - protein, 81 aa, Xenopus laevis
GMVPVSFDEVAVYFSEDEWGYLSDRQRDLYKEVMLENLEVVLSLGYQYPRSVPQTAPALGCSFILSTGKYSDESSPYIHED

SEQ ID NO: 8535 - protein, 81 aa, Xenopus laevis
KNDMRFEDIEVQFSEEEWGFLNEQQKLLYKEVMSENYLMLLSLVGNPDVWPIKYNTLNLDDKVQLLSDLPSCDILSPTVSS

SEQ ID NO: 8536 - protein, 81 aa, Xenopus laevis
KVHVSFDEVAVYFSEEEWKHLEVWQKELYNEVMQDIMKTLWSLEDNLVRGDGKQNPAGYALMPQWSNDKGAPVRTNHSETA

SEQ ID NO: 8537 - protein, 81 aa, Xenopus laevis
AQVPVTFDDVAAYFSEDEWKDLEECQKELYKDMMKENYEALISLGNFTPYSTNSLLLDDGPVSDKEKSKYNDKLESIATPS

SEQ ID NO: 8538 - protein, 81 aa, Gopherus agassizii
RLVTFEEVAVHFTREEGVLLDPTQRALYRDVMQENYETVVLLFSLPAFFCLISHPLVSFLDMCLFGATSHFKIALNVSLLA

SEQ ID NO: 8539 - protein, 81 aa, Gopherus agassizii
KLTFEEVAVYFTQGQGALLDPAQRALYRDVMQENYEMVTSLGKGFLCPQLLEAVECVCLNLQQESPEQVELQERFLRRAEG

SEQ ID NO: 8540 - protein, 81 aa, Gopherus agassizii
MGFEEVAVYFTREEWALLDPAQRALYRAVMQENYENVTSLGFPVSSPDVSSQPQRGEEPLTEEKVGKSINCWDTHKDVKGS

SEQ ID NO: 8541 - protein, 81 aa, Gopherus agassizii
GAELVTFEDVAVYFTKEEWALLDLGQRALYRDVMQENYETVTSLGFPITKPDVISWMERRKELWTPDLQDSEELELLSDVC

SEQ ID NO: 8542 - protein, 81 aa, Gopherus agassizii
PIMPVTFEAVAVYFTEGQGALLDPAQRALYRDVMQENYEMVASLGFPIPKPDLIAWLERGEEPWVLDIQISEESEIPRGSC

SEQ ID NO: 8543 - protein, 81 aa, Gopherus agassizii
FQGPVTFEVVAVYFTRKEWALLDPTQRALYRDVMQENYDNVTSLGFPVSQPDVISQLEQGEKSWVLDLQGSEEREILRVPC

SEQ ID NO: 8544 - protein, 81 aa, Micrurus lemniscatus
CQDSDPFEEVAVDFTEEEWALLDSNQKALCREVMLEVAMNMAALGDGEGLENEKQQSLFKMQSAVSSKGQSDLLTRHNLTH

SEQ ID NO: 8545 - protein, 81 aa, Gopherus agassizii
VGFEEVAVYFSWEEWGLLDKGQRQLYRDVMQENYQTLISLGEAPLPLGDQELMKQGALNSFGSGLFPGPVDSCGIGPCPKP

SEQ ID NO: 8546 - protein, 81 aa, Gopherus agassizii
MPVTFEEVAVYFTQGQGALLDPTQRALYRDVMQENYETVTSLGKGFPSPQILEAVGSVCLNLVSSSLLRCKDPKQTAAPQT

SEQ ID NO: 8547 - protein, 81 aa, Phasianus colchicus
QGLLFAQVAVYFSREEWALLDPAQRALYRDVMLETYQCVASLGEGFAGMLKKIKDVQSGLEQGERFKKSLGNYPGKRARNP

SEQ ID NO: 8548 - protein, 81 aa, Gopherus agassizii
FQGLVTFEEVAVYFTESEWALLDPAQRALYRDVMEENYENVTSLGKLDLSDDGMMNEVENLQQDDAEQVEAHGTLSEVSRG

SEQ ID NO: 8549 - protein, 81 aa, Gopherus agassizii
MPVTFEEVAVYFTQGQGALLDPAQRALYRDVMLENYETVTSPGVCMSDSAMTPVWILSLPAGDRTVSENKEENQQQEDPEE

SEQ ID NO: 8550 - protein, 81 aa, Gopherus agassizii
VAFEDVAVYFSLEEWAALAKWQRELYRDVMKENYELVASLGEAPFPLFSQGRGSGTELRRISDPGNAVLSSPAPSPRALGP

SEQ ID NO: 8551 - protein, 81 aa, Gopherus agassizii
LFLFQGPVTFEEVAVYFTKDEWALLDSVQRTLHRDVMQENLGFPISKPDVISQLERGEEPWVPELQAAVKHSTTELYPHES

SEQ ID NO: 8552 - protein, 81 aa, Gopherus agassizii
GPVTFEEVAVYFTSEEWALLDPTQRALYWDVMQENYENVTSLGKGYCPLSSWKGKWRGKETTTQQEILMGKRKDTCTECGK

SEQ ID NO: 8553 - protein, 81 aa, Gopherus agassizii
KVMTFDDVSVYFSEKEWGKLDDWQKDLYKNLMKGNYESLISLGKDQACGRALQLETGTEKTGDLGFSACRNGGLLPAPDML

SEQ ID NO: 8554 - protein, 81 aa, Gopherus agassizii
LTAASLPREVAVYFIREEGALLDPTQRALYRDIMQENYDNVTSLGFPVSKPSVISQLEGEEEPWVLDLQGSEENEILRSPC

SEQ ID NO: 8555 - protein, 81 aa, Phasianus colchicus
PVSFAQVAVYFSREEWALLDPAQRALYRDVMLETYQCVASLGEGFPIDARKREVRWKKKRNSSNEHAKSVKRYSRLASNQH

SEQ ID NO: 8556 - protein, 81 aa, Gopherus agassizii
FQGRLTFEEVAVYFTREEWSLLDPAQRALYGDVMQENYETVVLLGFPISKPDVILQLERGEEPWVPDLQASEEEVLLRAAC

SEQ ID NO: 8557 - protein, 81 aa, Gopherus agassizii
GMPVTFEEVAVYFTQGQGALLDPAQRTLYRDVMLENYETVTLLALGSACLTLLSWIRKEWGHIVPWLSTMGPCGAASRFQG

SEQ ID NO: 8558 - protein, 81 aa, Gopherus agassizii
LMKSSIGLTFEEVAVYFTKDEWALLDSVQRTLHRDVMQENLGFPISKPDVISQLERGEEPWVPELQGSEKEVLPRAAFPGE

SEQ ID NO: 8559 - protein, 81 aa, Gopherus agassizii
KWMPVTFEKVAVYFTQGQGALLDPTQRALYKDVMLENYELVTSLGFPIPKPDLIARLEQGEEPWVPDIQNEENQQEEGPGK

SEQ ID NO: 8560 - protein, 81 aa, Gopherus agassizii
GPVSFEEVAVYFTREEWALLDPAQRALYRAVMQENYENVTSLGKNSLSSPDVTLITHQRIHTGERPYECSECGKSFTQSSN

SEQ ID NO: 8561 - protein, 81 aa, Gopherus agassizii
MEPVTFEEVAVYFSKKEWALLGPDQRALYRDVMQENYETAPTACSVCELWGSPTTHGGLDLPHPQWPPGSEPPRAVGGPFS

SEQ ID NO: 8562 - protein, 81 aa, Gopherus agassizii
LVGLLLFQGLVTFEEVAVYFTREEGALLDPTQRNVTLLGFLVSQPDVIFQVEQREEPWVPDLQGSEEREILRAPRTGEETL

SEQ ID NO: 8563 - protein, 81 aa, Gopherus agassizii
LEVAVYFTESEWSLLDPAQRALYRDVMEENYENVTSLGKHSCSDLIIYERLDTGEAPYVCLECGKTFKRKKVFSRHQRVHT

SEQ ID NO: 8564 - protein, 81 aa, Gopherus agassizii
DPVTFEEVAVYFTREEWALLDPVQRALYRDVMQENYETVTSLGKESCPLDDERREAHGMLSGRSKENVSRSCALPEKPKAC

SEQ ID NO: 8565 - protein, 81 aa, Gopherus agassizii
RPVIFEEVAVKLTRKEWTLLDPTQRALYWDVMQENYKDVTSLGKGSCPSVLGRGNEELRLTPAPRCPLCSLPHLAYSSPRK

SEQ ID NO: 8566 - protein, 81 aa, Gopherus agassizii
SAEPVQMCLQDQDLLHWNEGMVELVIFEEVTVHFTKEERTLLVPAQRALYRAVMQENYENVTLLVISPFCASVSLPNFWLF

SEQ ID NO: 8567 - protein, 81 aa, Gopherus agassizii
AAKAVTFEEVAVHFTTEEWALLDPAQRTLYRDVMQENYENVTWLGKSLWAFPIYLGCRSSLANIGLGSSQQLLCNEESGTL

SEQ ID NO: 8568 - protein, 81 aa, Gopherus agassizii
QGPVTFEEVAVYFTSEEWALLDPTQRALYWDVMQENYENVTSLDPIILYVYLGLFSNGLQYVNIPFLFLFDLSQALILFWP

SEQ ID NO: 8569 - protein, 81 aa, Xenopus laevis
RKIPIKFEDVAVYFSEDEWNYLEDRQKNLYRNVMMENYYSVSSIGCAKEKPNIIVKIEQGEKTYLGYTPTERTKYVSMLRN

SEQ ID NO: 8570 - protein, 81 aa, Gopherus agassizii
PVTFEEVAVYFTEEEWALLDPGQRALYRDVMQENYENHEEVNPQLGGLEQVEQHGTLLGRSKGNICWSVGQGKTCESQCST

SEQ ID NO: 8571 - protein, 81 aa, Gopherus agassizii
FQGPVTFEEVAVYFTRGEGALLDPTQRALYRDVMQENYETVVLLGFPISKPDVISQLEQGEEPWVPDLHGSEKEVSPRAAY

SEQ ID NO: 8572 - protein, 81 aa, Gopherus agassizii
MLAPCTLIWSDFTLCTGFPIPKPELIVWLEQGEEPWVPDLQACEEKRLPRCPHRGEDGEKPSQSLECGKCFISKTQIIRDQ

SEQ ID NO: 8573 - protein, 81 aa, Gopherus agassizii
DHKPSGTSVPVTFDDVSVYFNEQEWENLEEWQKELYKNVMKENYDTLISLGRARVLLVYFQLSLTASGTVLSDQIHTLSHL

SEQ ID NO: 8574 - protein, 81 aa, Gopherus agassizii
MGGGLVTFEEVAVYFTESEWALLDPAQRALYRDVMEENYENVTSLVSKPDVISWLEQGEEPWVPDLQNAEEKETLRHTCTD

SEQ ID NO: 8575 - protein, 81 aa, Gopherus agassizii
SSPPSPPPPGEEWALLDPVQRALYRDVMQENYETVTSLGKESCPLDDERREAHGMLSGRSKENVSRSCALPEKPKACETLH

SEQ ID NO: 8576 - protein, 81 aa, Gopherus agassizii
FLFQDLVTFEEVAVYFTKEEWALLDPTQRVLYRDVMQENYETKLWGLLKTLSSNNFTPSFISQVLTSFLAQLFCLISHPLV

SEQ ID NO: 8577 - protein, 81 aa, Gopherus agassizii
APTTYTHVFPLRLPISKSDVISQLEKGEEPWVPDLQESEEQEILRGACPGEELLNELKSCQCLKEGAEISYKDLVSSLSLG

SEQ ID NO: 8578 - protein, 81 aa, Gopherus agassizii
NYMPVTFEEVAVYFTQGEWALLDPGQRALYRDVMQENYRNVTSLGFPIPKPSVISQLDRGEEPWGLGSHCCTLGLFQKLPP

SEQ ID NO: 8579 - protein, 81 aa, Gopherus agassizii
NFWILRLPPGTKGLVPQEWGSLEEWQKELYKNVMKGNYETLISLDYAISKPDILARIEQGEEPCIRDQQDSERVEIPVEPC

SEQ ID NO: 8580 - protein, 81 aa, Micrurus lemniscatus
QDLVSFEDVAVFFSVEEWALLDCEQKALYQEVMLENKRNVASLDPLMAFSSSPGTSVLCNGGSTAAELPTQDLVSFEDVAV

SEQ ID NO: 8581 - protein, 81 aa, Gopherus agassizii
IPELLFTWCCCSVNSGVVSGAAGTECWTLFLFQGPMTFEEVAVYFTREEWALLDPGQRAVHRDLSPCPDLNSITFPSLNKP

SEQ ID NO: 8582 - protein, 81 aa, Gopherus agassizii
FQGPVTFEEVAVYFTREEWALLDPVQRALYRDVMQENYETVVLLGKESFSKPDVISQLERGEEPWVPDLQGSEKEVLPRAA

SEQ ID NO: 8583 - protein, 81 aa, Taeniopygia guttata
EQEPVTFKDVMVFLSRAEWDALTAGQRELYRDVVSDTYELLISLGYPGPKPDILHRLERGEEPWICSSPGHARGWLEEPSS

SEQ ID NO: 8584 - protein, 81 aa, Gallirallus okinawae
PKVPVTFDDVSVYFNNKEWEKLEEWQKELYKNVMKGNYESLISLDYAISKPGVLSQIEQGEEPRVRNEQDLEESEIITDAT

SEQ ID NO: 8585 - protein, 81 aa, Xenopus laevis
PQMVPTFDDVAVYFSRSEWKSLSASQREMYKSVMTENYQCVLSLGYPIRKPEIVSMMEVGEELWSKNDSARPGQKEVEGET

SEQ ID NO: 8586 - protein, 81 aa, Gallirallus okinawae
PKVPVTFVDIAVYFSAEEWKNLEEWQKELYNNLVKENYESLISLDGALSRSEAQPRSERGEGPCVPEQRELDQRELPPDAC

SEQ ID NO: 8587 - protein, 81 aa, Xenopus laevis
AKAQVKFDEVAVYFSKQEWGYLTERQKMLYANVMLDNYETLCYLGLIHEIPDIITRIWQGQDHNDLPLNIVGWGSIRIKEE

SEQ ID NO: 8588 - protein, 81 aa, Gopherus agassizii
SQRNLTFEEVAVYFTKEEWALLDPAQRALYRDVMQENYENVTSLGFPVSKPDVISQLERGEESWASDLQVFGCKLDAKLIP

SEQ ID NO: 8589 - protein, 81 aa, Gopherus agassizii
FQGPVTFEEVAVYFTREEAALLDPTQRALYRDVMQENYETVVLLGFPISKPDVILQLERGEEPWVLDLQGSEKEVLPRAAF

SEQ ID NO: 8590 - protein, 81 aa, Gopherus agassizii
GQQVLNIGLSLFQGPVTFEEVAVYFTREEWALLDPTQRALYRDVMQENYENVTSVKNSHTGSDQRFLKSSITGQCQVPQRE

SEQ ID NO: 8591 - protein, 81 aa, Gopherus agassizii
RLHPIPGPVTFEEVAVYFIREEWALLYPAQRALYRDVMQENYETVVLLGKESCLLGEEPWVPDLQDAQKKMLLRAAFTGEE

SEQ ID NO: 8592 - protein, 81 aa, Gopherus agassizii
RGPVTFEEVAVYFTREEWALLDPAQRALYRDVMQENYENMTLLGKNSFYVIQFLIFPHLSSTYFGFLSHFPFLFVVSLCIP

SEQ ID NO: 8593 - protein, 81 aa, Gopherus agassizii
YIGPVTFEEVAVYFSREEWALLDPVQRALYRDVMQENYETVTSLGSPVSEPDVISQLERGEEPWVPDRQSSEKEVPPRATC

SEQ ID NO: 8594 - protein, 81 aa, Gopherus agassizii
MFSIPCAGFPISKPDMISQLERGEEPWVLDLQGSEEGDTQRAACTGSPGGLVSYGQLWLMASYGSCLRPGSSAIPDGYNSV

SEQ ID NO: 8595 - protein, 81 aa, Gopherus agassizii
MELPLFEVAVYFSREEGTLLDPTQRALYRDVMQENYETVVLLGYLVFQRDVISQLEQGEEPWVPDLQGSEEREILRSSCTV

SEQ ID NO: 8596 - protein, 81 aa, Gopherus agassizii
PVTFEEVAVYFTQGQGALLDPAQRALYRDVMQENYKMVICLGKGFPSPQILEARSHTIQCLECGKCFSSKSALNSHKKSHR

SEQ ID NO: 8597 - protein, 81 aa, Gopherus agassizii
SAHGSVRNYISQEEWALLDPTQRALYRDVMQENYENVTLLDKGSCPLCSWKGKRREMVHASHTMPPLLCPVSASPQYAKPF

SEQ ID NO: 8598 - protein, 81 aa, Phasianus colchicus
SSSVSVDRTSCDVATYFSREEWALLDPVQRVLYQDVMLETYECGSLAPNALHGATNSNNLPTLWLFISLFYSFPLSSRKPL

SEQ ID NO: 8599 - protein, 81 aa, Gopherus agassizii
MPVTFEDVAVYFTQGQGALLDPTQRALYRDVMQENYETVTSLGKSVKGFPLAKPDLITRLERGEEPWVSDLQATGDERMSE

SEQ ID NO: 8600 - protein, 81 aa, Gopherus agassizii
SPPPPPRRSPCHCGRPQAGPMTFEDVAVYFTKEEWKKLAGWQRELYRHVMLENYELLASLGELLGLGGRVWGEILSGPCGN

SEQ ID NO: 8601 - protein, 81 aa, Gopherus agassizii
PVFQEVPVTFEEVAVYFTQRQGALLDPAQTALYRDVMLENYETVTSLGKGFPSPRTDTETIWLMKEKQTNPNEENPYQCLK

SEQ ID NO: 8602 - protein, 81 aa, Gopherus agassizii
VTFEDVAVYFTQGQGALLDPAQRALYRDVMQENYETVTSLGKGFLSPQILEAVGWHRSESNGGGGDEDPRAQQTTVKEEAP

SEQ ID NO: 8603 - protein, 81 aa, Gopherus agassizii
FQGPVTFEEVAVYFTREERALLDLSQRDLYRDVMQENYETVVLLGFPVSEPDVISQLEQGEEPWVPDVLGSEKEVPPRAAC

SEQ ID NO: 8604 - protein, 81 aa, Gopherus agassizii
MDLLGEIRGCLFVAVYFTSEEWALLDPTQRALYWDVMQENYENVTSLGKGYRPLSSWKGKWRVKVYAGPAMPPLLCPVSAS

SEQ ID NO: 8605 - protein, 81 aa, Gopherus agassizii
QGQVTFEEVAVYFSREEGTLLDPTQRALYRDVMQENYENVTSLGKGFPVSKPDVISQLERGEEPWVLDLQAGAGMVSENEE

SEQ ID NO: 8606 - protein, 81 aa, Taeniopygia guttata
PKVPVTFVDIAVYFSAEEWKNLEEWQKELYNNLVKENYEALLSLDGAISRSEAQPRSERGDGPCVPEQRELEQRELPPDTC

SEQ ID NO: 8607 - protein, 81 aa, Phasianus colchicus
MMEMMFNVCITEMSLPASKPVLISLLEEGKDPWLPDVHGLEDMAGDLSPASIQDRMTALEEVLQKCDVARWQRGSGSVGKA

SEQ ID NO: 8608 - protein, 81 aa, Gopherus agassizii
RKGNTGKNQQGPTGRGLLLFQGPVTFEEVAVYFTREEWALLDPRQRALCRDVMQENYENVTLVKVHATPTMPPLGWGVVAL

SEQ ID NO: 8609 - protein, 81 aa, Gopherus agassizii
GRMPVTFEEVAVYFTQGQGALLDPAQRALYRDVMQENYKMVICLEFSIPKPELITLLERGEEPWVPDLQDCEERNGGGDED

SEQ ID NO: 8610 - protein, 81 aa, Gopherus agassizii
LGRVTFEEVAVYFTREEGALLDPAQRALYWDVMQENYEMVYNFWTCAFLLSCLFLIVRGKYVEKPLQEDAEQVEPHGTLSG

SEQ ID NO: 8611 - protein, 81 aa, Gopherus agassizii
RNICPEWGLWLFQGAVTFEEVAVYFTEEEWAVLDPGQRLLYRDVMQENYESVTSLGKGFLVPLDIRRFSPQISGSVLNPSE

SEQ ID NO: 8612 - protein, 81 aa, Gopherus agassizii
FQGLVTFEEVAVYFTREEWALLDPTQRALYRDVMQENYETVVLLVSDKFHSPPLFSFSEKKVLPGAACTGEELIKPAQKLF

SEQ ID NO: 8613 - protein, 81 aa, Gopherus agassizii
HGKKQSLEEVAVYFTQGQGALLDPAQRALYRDVMQENYVMVTSRGKGFPSPRLLEAAVGRSVMWPVHLLKFFPDPLNFRGL

SEQ ID NO: 8614 - protein, 81 aa, Gopherus agassizii
GPVTFEEVAVYFTREEGALLDPTQRALYRDDMQEHYENALSSFLGKGVTWPQPPSWLRLHPSSEVTPFYPIPNAANPSETP

SEQ ID NO: 8615 - protein, 81 aa, Gopherus agassizii
VTFEEVAVYFTREEWALLDPAQRALYRDVMQENYENMTLLEELRNPIPSSHLIRHVRIHTIHTGERPYECSECGETFAQRS

SEQ ID NO: 8616 - protein, 81 aa, Micrurus lemniscatus
EEVAVYFSEEEWSQLDPDQKALHSEVMLENHRNVVSLGNNGQENQDSCELFQVISAKDGTEKFGIRMEFESHERNQSKNWN

SEQ ID NO: 8617 - protein, 81 aa, Gopherus agassizii
FQGPVTFEEVAVYFTSEEWALLDPTQRALYWDVMQENYENVTSLGFPVSKPHIISQLEQGAEPWKEEQNSQQGNVEQVAKH

SEQ ID NO: 8618 - protein, 81 aa, Gopherus agassizii
QPEPESWLQVAVYFTSEEWALLDPTQRALYWDVMQENYENVTSLGFPVSKPRIISQLEQGEEPWVPDLQGSEEREILRDPC

SEQ ID NO: 8619 - protein, 81 aa, Gopherus agassizii
FQGPVIFEEVAVYFTSEEWALLDPTQRALYWDVMQENYENVTSLGFPVSKPHIISQLEQGEEPWVPDLQGSEEREILSFSC

SEQ ID NO: 8620 - protein, 80 aa, Gopherus agassizii
LSFLREPVTFKEVAVYFTVEEWALLDPGPRALYWDVMQENYETMTSLGKDSCPLGYEKHLGQILCRDLHWSPRIQGDQAM

SEQ ID NO: 8621 - protein, 81 aa, Gopherus agassizii
VTFEEVAVYFTREEWALLDPTQRALHRNVMQENYENVTSLGDVTVHEKEEQNSQPENVEQVDKHRELSQRSKRNVSRSHEQ

SEQ ID NO: 8622 - protein, 81 aa, Gopherus agassizii
QGPVTFEEVAVYFTREEGALLDPAQRALYRDVMQENYENVASLGSISGIGKASESQQSPEGNQPREKVGKSTDCQRIHQDF

SEQ ID NO: 8623 - protein, 81 aa, Gopherus agassizii
FQGPVTFEEVAVYFSREEGTLLDPTQRALYRDVMQGNYETMVLLAEFLVFQRDMISQLEQGEEPWVPELQGSEEREILRSP

SEQ ID NO: 8624 - protein, 81 aa, Gopherus agassizii
MLLLLLDSFSFRGWEEWALLDPVQRALYRDVMQENYKTVVLLGKKACPLVIRSCGVSKEPDNGKKRRGVLRKGTQEVGWVD

SEQ ID NO: 8625 - protein, 81 aa, Gopherus agassizii
LTFEEVAVYFTREEWSLLDPAQRALYGDVMQENYETVVLLGFPISKPDVILQLERGEEPWVPDLQASEEEGVTSVWILSVS

SEQ ID NO: 8626 - protein, 81 aa, Gopherus agassizii
LGNSEWCRELAVYFTEGEWALLNPAQRALYREVTQENYATVASLGFPVSKPDVISQLERGEEPWVPDLQGSEERELQKGAQ

SEQ ID NO: 8627 - protein, 81 aa, Gopherus agassizii
DEGPVTFEEVAVYFTREEWALLDPTQRALHRNVMQENYENVTSLGFPVSQPDVIFQLEQEEEPGPENVEQVDKHRELSQRS

SEQ ID NO: 8628 - protein, 81 aa, Gopherus agassizii
LNGRVTFEEVAVYFTREEWALLDPAQRALYWDVMQENYEMVVLLVGFPVSKPDVILQLERGEEPWVLDLQGSEKEVLPRAA

SEQ ID NO: 8629 - protein, 81 aa, Gopherus agassizii
LEGLVTFEEVAVYFTESEWSLLDPAQRALYRDVMEENYENVTSLGFPVSKPDVISWLERGEDPWVPDLQDPEKRETLREAC

SEQ ID NO: 8630 - protein, 81 aa, Gopherus agassizii
QPVTFEEVAVYFSEEEWALLDLGQRALYRDVMQENYETLLIVQSPQLLFGFVLPFLIPLSEVPGTGTDSCLDLLSVPSLTL

SEQ ID NO: 8631 - protein, 81 aa, Gopherus agassizii
QMPVTFEDVAVYFTQGQGALLDPTQRALYRDVMQENYETVTSLGKRFPLAKPDLITRLERGEEPWVSDLQAIHTGERPHKC

SEQ ID NO: 8632 - protein, 81 aa, Gopherus agassizii
PHLVPVTFEEVAVYFTQRQGALLDPAQTALYRDVMLENYETVTSLGKGFPSPRLLESVGPAMGGPNDSTVQQTNPNEENPY

SEQ ID NO: 8633 - protein, 81 aa, Gopherus agassizii
MPVTFEDVAVYFTEEEWALLDPTQQAFYRDVMQENYENVTSLGFLISKPDVISQLEQGEEPWVPDIQDQGRRWLLQPLLIA

SEQ ID NO: 8634 - protein, 81 aa, Gopherus agassizii
MGSSPYKYEEWALLDPTQRALYWDVMQENYENVTSLGKEFGGVQFLFLFDLSQALVLVWPSPLYLCLRFLSLITAGDAMLC

SEQ ID NO: 8635 - protein, 81 aa, Gopherus agassizii
SSMPVTFEEVAVYFTHGQGALLDPTQRALYRDVMQGNYEMVTSLGKGFPSPRLLEAMGSVCLTLVRFFPGQLDQRGMFCVM

SEQ ID NO: 8636 - protein, 81 aa, Gopherus agassizii
FQMLVTFEEVVVYFTQGQGALLDPAQRRALYRDVMQENYETVTSLGKGFLFPRLLEAMGSSCLTLIRFFPRQLDQRKMFCV

SEQ ID NO: 8637 - protein, 81 aa, Gopherus agassizii
LTTNFGSMSGFPVSKPHIISQLEQGEEPWVPDLHGSEERRILRAPRTGEETINELRICKCLKETSGMPCRALGRSLSSLLS

SEQ ID NO: 8638 - protein, 81 aa, Xenopus laevis
QKELVKFEDVAVYFSEDEWECLAEGQKELYEEVMMHNFELVTSLGLLIQRDNWTDLESDSFDAPEKQSAGGPELHIIIKEE

SEQ ID NO: 8639 - protein, 81 aa, Gopherus agassizii
VSFEEVAVYFTQGQGALLDPAQRALYRDVMQENYEMVTSLAMGSMCLYLVLFFPSDKSQGRDTLALPSVWERIHCEITACD

SEQ ID NO: 8640 - protein, 81 aa, Gopherus agassizii
GPVTFEEVAVYFTREEWARLDPRQRALCRDVMQENYENVTSLGKDSQEQNSQQGNVEQVDKDRELWQRSKRNVSRSHEQRN

SEQ ID NO: 8641 - protein, 81 aa, Gopherus agassizii
VTFEEVAVYFTREEGALLDPTQRALYRDVMQENYENVTALGKGSCPLISWKGKRRDMVHAKKPGGLRTVNGTQSFQGTKYI

SEQ ID NO: 8642 - protein, 81 aa, Gopherus agassizii
VSFEEVAVYFTQGQGALLDPAQRALYRDVMQENYEMVTSLGVYFPAFVLCECLGGIWRRSPIAQSLCWVFPLCYSSFSPAQ

SEQ ID NO: 8643 - protein, 81 aa, Gopherus agassizii
ARDDGPVTFEEVAVYFTREEWALLDPVQRALYRDMMQAVITLYLYSSSKEEVMRDEEGTQEAPKAPGGGAGKFTFPPPSFS

SEQ ID NO: 8644 - protein, 81 aa, Gopherus agassizii
MPLEELLEEWALLDPAQRALYRDVMQENYENMTLLGLPISKSDVISQLEKGEEPWVPDLQESEEQEILRGACPGEELLNEL

SEQ ID NO: 8645 - protein, 81 aa, Gopherus agassizii
MNSGLEVAVYFTEGQGVLLDPGQIALYRDVMQENYETVTSLGLPIPKPDLVARLEAGEEPWVPDLQASEERKIPRDTHTGE

SEQ ID NO: 8646 - protein, 81 aa, Gopherus agassizii
LVTFEEVAVYFTEGQGALLDPSQRALYRDVMQENYETVTSLVELQGTFFRRAEENFSQCLEQRKAWSNWHKSERKLGNCQR

SEQ ID NO: 8647 - protein, 81 aa, Gopherus agassizii
SGIMPVTFEEVAVYFTQGQGALLDPAQRALYRDVMQENYETVTSLGKGFLAPCMLDFPSVLFLLILPQHNDSCLDCLSPSR

SEQ ID NO: 8648 - protein, 81 aa, Gopherus agassizii
FQGPVTFEEVAVYFTREEWALLDPTQRALYRDVMQENYENVTSLGKDSCPLGSWKGKCGVKVHATPTKHPALFFGITPTCQ

SEQ ID NO: 8649 - protein, 81 aa, Gopherus agassizii
MLVTFEEVAVYFTQGQGALLDPAQRALYRDVMQENYEIVTSLGFPLPKPELIARLEQGEEPWVPDLEASEERDISRGTRTD

SEQ ID NO: 8650 - protein, 81 aa, Gopherus agassizii
LTKVAFEEVAVYFTQGQGALLDPAQRALYRDVMQENYETVTSLGNPVPKPELITQLERGEELWVPDLQTSEEGEIPRGSHT

SEQ ID NO: 8651 - protein, 81 aa, Gopherus agassizii
FQMPVTFEEVAVYFTQGQGALLDPAQRALYRDVMQENYEILTSLGKGFPSPRLLLGSVCRTLVRFFPDHLDQRGMFCVMHS

SEQ ID NO: 8652 - protein, 81 aa, Gopherus agassizii
KHGSARFRDIAIYFSREEWEMLAEWQKELYRDVMKEHYDNLNSLGHADTKPDVLSRIEQGEEPWVVDQQEERERLECTSLG

SEQ ID NO: 8653 - protein, 81 aa, Gopherus agassizii
KHGPVTFEEVAVYFTREEWALLDPTQRALYRDVMQENYEMVVLLGFLNSKPDVISQLEQGEEPCIVDLQGSEKEVLPRAAC

SEQ ID NO: 8654 - protein, 81 aa, Micrurus lemniscatus
DVVCFEEVAVYFSEEEWSQLDADQEELYREVMVENSRNLLSLGFNGQQKKNCKEECQAIHSKGGNRKCVDQMQLKSDETKQ

SEQ ID NO: 8655 - protein, 81 aa, Gopherus agassizii
AALRLPSSEGNTGQLTFEEVAVWFSREEWEMLADWQKELYRAVMLENYENLFLLGNKPGHRFMFRRVQNPFDKHLKYPGMA

SEQ ID NO: 8656 - protein, 81 aa, Xenopus laevis
LKAPARFEEVAVYFTESEWRCLEEGQKEIYKEVMLENYLAFHSLGYRHKKPDIISKIENEKDPCLSDKKNTQKSFHSVPSF

SEQ ID NO: 8657 - protein, 81 aa, Gopherus agassizii
FQVPVTFEEVAVYFTEEEWALLDLCQRNLYIDVMQENYENVTSLGFPIPKLEVISQLEQGKELWVTELQGSGDGLVCENEE

SEQ ID NO: 8658 - protein, 81 aa, Gopherus agassizii
INTVGLLLFQMPVSFEEVAVYFTQGQGALLDPAQRALYRDVMVENYEMVTSLGKGFPSILLLEAVGPTYLNVFRFFLSQLY

SEQ ID NO: 8659 - protein, 81 aa, Gopherus agassizii
FQMPVTFEEVAVYFTQGQEALLDPAQRALYRDVMQENYKTVTSLGKGFPFPQLLEAVGSGTSLERTEGNFSQCWDQREASG

SEQ ID NO: 8660 - protein, 81 aa, Gopherus agassizii
MMPVTFEEVAVYFTKGQGALLDPAQRALYRDVMLETYETVTLLALGSACLTLLSWIRKEWGHIVPWLSTRGSCGKTHTGEK

SEQ ID NO: 8661 - protein, 81 aa, Gopherus agassizii
FQELVTFEEVAVYFTREEGALPNPAQRALYRDVMQENYENVTSLGFPVSKPYIISQLGKGEEPWVPDLQSSEKREILRAPC

SEQ ID NO: 8662 - protein, 81 aa, Gopherus agassizii
EKKSIMPVTFEEVAVYFTQGQGALLDPAQRALYRDVMQENYEMVTSLGNFSQRLEQGNAWGDRHRSEMQLENYPRKKQDEF

SEQ ID NO: 8663 - protein, 81 aa, Gopherus agassizii
LFQQPVTFKEVPVYFLGQWALLEPSQRAFYRDVMQENSETVTLLGFPIPKPSITSWPEQGEELWVLAVQNSEERELPGVVQ

SEQ ID NO: 8664 - protein, 81 aa, Gopherus agassizii
FQMPVTFEEVAVYFTKGQGALLDPAQRALYRDVMLETYETVTLLGFPIPKPDLIVRLEQGEEPWVPDLQADEERKSLRGNF

SEQ ID NO: 8665 - protein, 81 aa, Gopherus agassizii
NFWILRLPPGTKGEVPKEWGKLDDWQKDLYKNLMKGNYESLISLDYAISKPDLLSRIERGEEPCGGAQEDSEESALLADVR

SEQ ID NO: 8666 - protein, 81 aa, Gopherus agassizii
ELQQVTFEEVAVYFSREEGTLLDPTQRALYRDVMQENYENVTSLGFPVSKPDVISQLERGEEPWVLDLQGSEEGEILRAAC

SEQ ID NO: 8667 - protein, 81 aa, Gopherus agassizii
ERKLQVAFEDVALYFTREEWELLSQPEKQLYRDQMLRNYRALVFLGKDQFPLFYSQLFDLNVKLIMDRKGKTKMRFHTHNC

SEQ ID NO: 8668 - protein, 81 aa, Gopherus agassizii
VTLKDVAVYFTKKDWGRLDKRQREFYTNVMQKNLKSSLWVKINFPSLLKSCVVSQEFVKLCPQKLCERYSHCHATTIFLNC

SEQ ID NO: 8669 - protein, 81 aa, Pantherophis guttatus
SVSFREVAIHFTSEEWLLLDPSQKVLYQEVMLETSRMVASLVLQENDQETNLVPLQIIKIEIPEEASTDKRGRRKHEKKNN

SEQ ID NO: 8670 - protein, 81 aa, Pantherophis guttatus
FVSFEEVAVYFSEEEWSQLDPDQKALYSEVMLENYRNVVSLGNNGQENQDSCELFKVINAKDGTEKFGIQMELETHNRKQS

SEQ ID NO: 8671 - protein, 81 aa, Xenopus laevis
VTASVHFSEVAIYFSEEEWQCLRKGEKELYKTVTMDSYYMLLSLDLLNVKPEIVQRIEQGRDPSVSCHQEMLWRKKCMGTQ

SEQ ID NO: 8672 - protein, 81 aa, Gopherus agassizii
FQMPVTFEEVAVYFTQGQGALLDPAQRALYRDVMQENYKMVTSLGFPLPKPELISRLEQGEEPWVPDLQACEERESLSGNH

SEQ ID NO: 8673 - protein, 81 aa, Xenopus laevis
YQMPVTFFDVAASFTEEQWSRLATWQKELYQNVMKELHGAITTLGHKIENPEILFKIKYSDETCVCIDFNSKERENIDSKD

SEQ ID NO: 8674 - protein, 81 aa, Xenopus laevis
SLTQVAFEDVAVYFSELEWALLKDCQKDLYKTVMRDNYEVVASLGFPVLRSKALGRMRHGVTVELEGTEEIDIGDSAQNMK

SEQ ID NO: 8675 - protein, 81 aa, Gopherus agassizii
SLGPVTFEEVAVYFTREEWALLDPTQRALHRNVMQENYENVTSLGFPVSQPDVIFQLEQEEEPGVPDLQGSEEREILRAPC

SEQ ID NO: 8676 - protein, 81 aa, Gopherus agassizii
PVTFEEVAVYFSEEEWALLDLGQRALYRDVMQENYETVTSLGTDSCLDLLSVPAGDGMMSENKEENPQQEGSEQREPQGTV

SEQ ID NO: 8677 - protein, 81 aa, Gopherus agassizii
MGPVTFEEVAVYFTREEWALLDPVQRALYRDVMQENYEMVVLLVGFPISKPDVISQLERGEEPWVADLQGKKYLCFTSTRS

SEQ ID NO: 8678 - protein, 81 aa, Gopherus agassizii
FQGLVTFAEVAVYFTREEGALLDPTQRALYRGVMQENYETVTSLGKGSFSKPYVISQLEGGEEPWVLDLPGSEESEILRSP

SEQ ID NO: 8679 - protein, 81 aa, Gopherus agassizii
EMPVTFEEVAVYFTKGQGALLDPAQRALYRDVMLETYETVTLLALGSACLTLLSWIRKEWGHIVPWLSTRDRHRSEMQLEN

SEQ ID NO: 8680 - protein, 81 aa, Gopherus agassizii
LKTFTSSSEVALYFTREEGALLDLTQRALYRDVMQENYESVVLLGFPVSKPDVISKLERGEEPWVPDLQGRCHSWLPTCPD

SEQ ID NO: 8681 - protein, 81 aa, Micrurus lemniscatus
RRLGIPPENIMKSLVFMGLSPFSGEPKKPPRRPVQDFVTFEDVAVYFSADEWSQLDPDQKALHKEVMLENYRNVASLVALQ

SEQ ID NO: 8682 - protein, 81 aa, Gopherus agassizii
FWILRLPPGSRGEVPKPEWGSLEEWQKELYKNMMKGNYEALISLDYAISKPDLLSRIERGEEPCVGDQGRSEESEIPADPS

SEQ ID NO: 8683 - protein, 81 aa, Gopherus agassizii
VFGLVTFEEVAVYFTQGQGALLDPAQRALYRDVMQENYKMVTSLGFPIPKPELIARLERGEEPWVSVWVRSGSRIQLLSLD

SEQ ID NO: 8684 - protein, 81 aa, Gopherus agassizii
SVEPVSFEEVAVYFSKEEWALLDPGQRALYRDIMQESYETVTCLGKDSCPLRGRLPEETAGNPVSRGLENRSAADPAGDRP

SEQ ID NO: 8685 - protein, 81 aa, Gopherus agassizii
PKVPVTFDDVSVYFSEKEWGKLDDWQKDLYKNLMKGNYESLISLDYAISKPDLLSRIERGEEPCGGAQEDSEESALLADVR

SEQ ID NO: 8686 - protein, 81 aa, Gopherus agassizii
VTFEEVALYFTREEWALLDSAQRALYRDVMQENYENAELIPSSLLFGGRIWGSSVPDFCLTFLQIQTGERRPYECSECGKS

SEQ ID NO: 8687 - protein, 81 aa, Xenopus laevis
DPGTVTFNDVAVYFSLHQWELLEDWQQLLYKNVMKEIHGALTALGYEIANPGILVKVQQSDEPCYSTRNEEQEEIKSKGPS

SEQ ID NO: 8688 - protein, 81 aa, Xenopus laevis
MQTFVTFDDVAAYFSEDDWQCLEEWQKELYQNAVQEIHGDLLAMGYTISNPDVLVRIQNVGTSDFSENQDSTLSKNCCNFT

SEQ ID NO: 8689 - protein, 81 aa, Gopherus agassizii
MEREGEVAVYFTREEWALLDPTQRALYWDVMQESYENVTSLAGFPVSKPPIISQLEQGEEPWVPDLQGSEEREIQRVPCTT

SEQ ID NO: 8690 - protein, 81 aa, Gopherus agassizii
PVTFEEVAVYFTEEEWALLDPGQRALYRDVMQENYENVTLLENDSSLDFLFILTADGIKIEHEEVNPQLGGLEQVEQHGTL

SEQ ID NO: 8691 - protein, 81 aa, Gopherus agassizii
NSPEGCFGEVAVYFTQGQGALLDPAQRALYRDVMQENYETVTSLGFPIPKPELITQLECGEEPWVPDLQACKERRAQQTNP

SEQ ID NO: 8692 - protein, 81 aa, Gopherus agassizii
VYMLVTFEEVAVYFTEGQGALLDPSQRALYRDVMQENYETVTSLGDKTKSENEEGDPQQKCPEQVELQGTFFRRAEENFSQ

SEQ ID NO: 8693 - protein, 81 aa, Gopherus agassizii
VSFEEVAVYFTPGQGALLDPTQRALYRDVMQENYKTVTSLGPEQVETHEMFSERSRENISQNREQEKTWKSPCMSERQLGI

SEQ ID NO: 8694 - protein, 81 aa, Gopherus agassizii
VTFEEVAVYFSREEGTLLDPTQRALYRDVMQGNYETMVLLGKDSCPFSEFLVFQRDMISQLEQGEEPWVPELQGSEEREIL

SEQ ID NO: 8695 - protein, 81 aa, Gopherus agassizii
FQVPVTFADVAVHFTAAEWALLGDSQRELYRDTMLENYGNMASLGIPIHKPDIISCLERGEEPFVPAAQGLEEPEILRGIY

SEQ ID NO: 8696 - protein, 81 aa, Micrurus lemniscatus
FDHVEEVALDFTEEEWRLLDSGQKALCWEVMQEVFRNMAALDDGPANENDMSAKLNLQQLEKNEVEVMFGTQGDITRQERS

SEQ ID NO: 8697 - protein, 81 aa, Xenopus laevis
EEDSIKTDNVAVCFSVEELESFEERQKEPCKNIMREIHQTPTVVGYIYVKPETVSLIRRGEELCVSSNLYSRKRDLRISPA

SEQ ID NO: 8698 - protein, 81 aa, Podarcis muralis
DGECSGEDVAVCFTDKAWTLLDPDQRAQHKEVKEENGGIVDSLDGDDLEGKNKGEHNRIHIAEKSYKYSECGENIRQSSQS

SEQ ID NO: 8699 - protein, 81 aa, Alligator sinensis
MEPWVMLDSRQKALYRDVMQESYETLMSLALFPISKPDLISWMERGEEPSAQDFQGWESPRGVHTADGLVSDNEEEEEDAD

SEQ ID NO: 8700 - protein, 81 aa, Alligator sinensis
MLENYETVASLGFLTSKPDVVSQLEEGDAPWVPDCQECEERRSLRHTSAVGEGVNEEENLQQKRLQAVEQCGTLLGSLRGN

SEQ ID NO: 8701 - protein, 81 aa, Alligator sinensis
LELPAVFEAVAVYFTREEWELLDDEGKELYRDQMLRNYQALVSLGYRGPTPDLICRLQQGQGELWGCAGQEPGESSQREDL

SEQ ID NO: 8702 - protein, 81 aa, Alligator sinensis
TELPEAFEDVAVYFTREEWELLEDAQKGLYRDQMLRNWRALVSLGYRGPTPDLICCIVRGQKELWVCDDEDREDISKSKDL

SEQ ID NO: 8703 - protein, 81 aa, Alligator sinensis
WELPEVFEDVAVYFSRKEWELLEDEDKVLYRDQMLKNYQALVSLGYGGLTPDVICRIQRGEVELWVCDDEDGGETSRLEDL

SEQ ID NO: 8704 - protein, 81 aa, Alligator sinensis
PFLREAFEDVAVYFTRKEWELLGDEDKELYRDQMLKNYRALVSLGYQGLTPDLICCIERGEVELRVSDEEDHGESSRSEDL

SEQ ID NO: 8705 - protein, 81 aa, Paroedura picta
IEGPVSFEEVAVYFPEEEWALLDPGQRALYREVMLENYRSLVSMGSGICKPDLISWLEDLDEMFPLDSGEAKNLTDSLSCW

SEQ ID NO: 8706 - protein, 81 aa, Paroedura picta
AQVPVAFEEVTVYFSGEEWAELADWQKELYQDVMVENYQLVSSLECLLSIPELLSRLAPGGVPCAADPPPPSGSSDPPASG

SEQ ID NO: 8707 - protein, 81 aa, Paroedura picta
PKVPVAFDEVSVYFSEQEWGNLDESQKALYRNVTKGNYESLVSLDYATAKPDLLSQTDHEGGPGCPGEGENDPGIIRREIP

SEQ ID NO: 8708 - protein, 81 aa, Paroedura picta
AAPSAQGLPSFSLEDVSVSFSPAEWALLDPAQRALWREVMRENAENVAFLGRFLRSGVRTCPGATGASVVAISRARESVPA

SEQ ID NO: 8709 - protein, 81 aa, Alligator sinensis
TPEVMTFEEVAVYFTTEEWALLDPGQKALYSAVMQENYETVASLGFPVPRLDVVSQMEEGEEPWVLDLQYSTESEMLRSIL

SEQ ID NO: 8710 - protein, 81 aa, Paroedura picta
EAYQEVIAASAKGQRAFLAPDHGSLYQDVMQESYKTLLSMAPPLQLQPEFPIQKSELLARLEQDQQAWTPEAQKSDENTEE

SEQ ID NO: 8711 - protein, 81 aa, Paroedura picta
PARCLISFEDVAVRFTKAEWGLLNPDQRALYREVMVENYTNVAWLAIPKPSLISWLQESEAPFPAEPKEEERWTGNGQEYE

SEQ ID NO: 8712 - protein, 81 aa, Paroedura picta
AVQSPVSFEEVVVDFSEAEWALLDPGQRALYREVMLENWGSVVFLEEAGKFSHSQRTNTEEILVMFSSIKESMEGRNVLNA

SEQ ID NO: 8713 - protein, 81 aa, Paroedura picta
WDDKVRFEDVAVYFSTAEWAELAGWQRDLYRAVMVENYEAVASLGYPSRKPEVVCRIEREEDPCIEEPLEAPRWRRPPSPW

SEQ ID NO: 8714 - protein, 81 aa, Paroedura picta
APFEGVAACDSEAEWALLDPGQRALCREVMLESYGSVAALAGDDPESEELHQLLPDEVKDEDLKENFQNQRQKESQGENFQ

SEQ ID NO: 8715 - protein, 81 aa, Podarcis muralis
GPVCFEDVTIRFTDEEWAFLDPDQRALHKDVMEETRGIMASLDYDEIKNKGDHDKIPREEKPRENLECGESCSQRSHSTSH

SEQ ID NO: 8716 - protein, 81 aa, Aptenodytes forsteri
DLFLQFALEQRALPRPPGYPGPKPDILYRMERGEEPWVCTSQSPVRWDGPDSPSPGHDGDVGWLGQPPSGWWPGAGRRRGL

SEQ ID NO: 8717 - protein, 81 aa, Alligator sinensis
MELQQIFEDMAVYFTRKEWELLGDEDKVLYRDQMLRNFHALVSLGYGGPTPDVICRIQRGEADLWICDDENHGGILRPEDL

SEQ ID NO: 8718 - protein, 81 aa, Alligator sinensis
LELREVFEDVAVYFTRKEWELLEEHDKVLYQDQMLRNYEALVSLGYGGPTPDLIYRIQQGQVELWVWDDEDGGEISRSEDL

SEQ ID NO: 8719 - protein, 81 aa, Alligator sinensis
SKLREAFEDVAVYFTQEEWALLEAGDKGLYRDQMLRTYQALVSLGYQGPTPDLICRIQQGEMELWVCDGDEEAGESSLSED

SEQ ID NO: 8720 - protein, 81 aa, Alligator sinensis
MAQDLDSDHREEMAISLPRITALAESHRRGLVSAGFPISKPDLLSWMDRGDEPWVPDLQASEGTEIPRDASPAGDGSASEN

SEQ ID NO: 8721 - protein, 81 aa, Alligator sinensis
QKLREAFEDMAVYFTRKEWELLEEEDKELYRDLMLRNYQALLSLGYQGPTPDLICRIEQGEVDLWVCDDENHGENSKAEDL

SEQ ID NO: 8722 - protein, 81 aa, Alligator sinensis
VQEVFEYVAVYFTRREWELLDDDDKVLYQDQMLKNFNTLVSLGYRGPAPDLICSIQQGQVELWVCDDEDCGEISGSDDLLA

SEQ ID NO: 8723 - protein, 81 aa, Alligator sinensis
LQLREVFEDVAVYFTREEWELLDDEDKVLYRDQMLKNHQALVSVGYRGPTPDLICSIQRGQVELWVCEDEDCGEISRWEDL

SEQ ID NO: 8724 - protein, 81 aa, Alligator sinensis
SKLSEAFEDVAVYFTWKEWALLEAADKMLYRDQMLKNYQALFSLGYRGPTPDLICRIQRGEMELWVSDLEEAGESSLSEDS

SEQ ID NO: 8725 - protein, 81 aa, Alligator sinensis
MLAEWQRELYWDVMVESYQTLVSLGCDAPKPKILLLMEEKGKPYAEDAAERAGRDLDCASAVAERLHRSRKVKLEDHEVEI

SEQ ID NO: 8726 - protein, 81 aa, Alligator sinensis
MEPRDAFEDVAVYFTREEWALLDDGDKGLYRDQMLRNYQALVSLGYRGPTPDLICCIQRGKVELWVRDGEDHGEISGSEDL

SEQ ID NO: 8727 - protein, 81 aa, Paroedura picta
RKGAIPFEEVAVYFTEEEWALLDPGQRTLYREVMLETYDSVVSLESWICKPDLISRLEDTDELFFPDAEDVRSSAGSVSCQ

SEQ ID NO: 8728 - protein, 81 aa, Paroedura picta
VGPFSFEEVAVSFTEAEWALLDPGQRALHREVMLENYGSVASLEEHERNEEGKEFVQQLSSDHKNENLKENIRNQSRTKRK

SEQ ID NO: 8729 - protein, 81 aa, Paroedura picta
YAAVEPAAGQPNQGPVSFEEVAVYFTVEEWALLDLCQRLLYREVMLENYGMVSSVGKNPFNAFPRGRISFVMVVREKVGKG

SEQ ID NO: 8730 - protein, 81 aa, Paroedura picta
LQGHASFEDVAVIFTESRWTLLDPQEKGFYRDTMQEKFENVASLGFLSGKPDIISQLEQEEDPWIPDQPALERGEVVLEFS

SEQ ID NO: 8731 - protein, 81 aa, Paroedura picta
VSFEEVAVFFTREEWALLDPAQRALYGEVMQENYELVTSLAGDAAENERQGELGEVSSEGDKDPEEEPWDRDGPLRQLKRK

SEQ ID NO: 8732 - protein, 81 aa, Paroedura picta
PSFSLEDVSVSFSSAEWALLDPAQRALWREVMWENAENVAFVAGKDQRTQEREELHQEMEDRAKNEDLKVKTRNRVRQRFE

SEQ ID NO: 8733 - protein, 81 aa, Phasianus colchicus
PKVPVTFDDIAVYFNEQEWERLDSWQKDLYKAVMKGNYETLISLDYAVSKPDILSRIERGEELCVRDCWEPPQMLNRGGPD

SEQ ID NO: 8734 - protein, 81 aa, Podarcis muralis
HPFSFEDVAVLFTAEEWALLDPAQRALHKEVMEETWRTMISLGKVPCWVIISVLEFSRYFSGTNLPYLDGSQRCHLECQGF

SEQ ID NO: 8735 - protein, 81 aa, Crotalus adamanteus
EEGLVSFEEVAVYFSEEEWSWLDPDQKALHWEVMMENYRNVASLVQDSCELFQVIKVEDGMEESAIQTELENHERNQSENW

SEQ ID NO: 8736 - protein, 81 aa, Paroedura picta
QGRVSFEEVVVCFTEEEWALLDPAQRALHREVMVENYGIVASLAGDGWKSESEEDLLRVSWGRSRAEQTKKQRRKTILPRK

SEQ ID NO: 8737 - protein, 81 aa, Paroedura picta
CPRPHNEGNRRQPGLPSFEEVAVDFTEEEWALLDQGQRALYVEVMLENCGSVATLSDERETKKEGRPPAASVEGVRCKEED

SEQ ID NO: 8738 - protein, 81 aa, Paroedura picta
PQKAETLPPESSYAAVETTGRRPAQGPVSFEEVAVFFTGEEWALLDPCQRALYRQVMLENYGMVVSVGKNPFDDIFKANKE

SEQ ID NO: 8739 - protein, 81 aa, Paroedura picta
AEGRVSFEEVAVYFTPGEWALLHPAQRALYKKVMLENFGIVASLGPGIAKPDLISWLEEEDERLSLTLEDEEGPAAGGVWE

SEQ ID NO: 8740 - protein, 81 aa, Streptomyces griseoruber
SHVDWSAGAVELLTEQRAWPELDRPRRAAVSSFGLSGTNAHVILEQVTAPEPEAVSREPHGPLPWVLSGRTETALRAQAER

SEQ ID NO: 8741 - protein, 81 aa, Deltaproteobacteria bacterium RBG_19FT_COMBO_52_11
KVWLILDEAFIDFTEEESMKEEAGASSRLVILRSLTTFFALPGLRVGYMISNPQVIKKFHQAKEPWRVNALAQVAAVESLK

SEQ ID NO: 8742 - protein, 81 aa, Platysternon megacephalum
DSPFQKPEPGFAELEKRLSDFSLKSAILQEVLLGFKETLRLELENSTGFPVSKPDVVSQLERGEEPWVLGLQGSEEREIQG

SEQ ID NO: 8743 - protein, 81 aa, Platysternon megacephalum
FQVPEAFEEVTVCATEEQWAVLDPAQRALFRDAMPKHCRTVLTTESPSPKPDSICHMDQEEEPCVLDSEDSSEKETPKGPQ

SEQ ID NO: 8744 - protein, 81 aa, Chelonia mydas
EKVPVTFDDVSVYFSKQEWGKLDDWQKDLYKNVMKGNYESLISLDYAISKPDLLSRIERGEEPCGGAQEDSEERVIPMEPS

SEQ ID NO: 8745 - protein, 81 aa, Chelonia mydas
MQENYETVTSLGFPIPKPDLISQLEQGEEPLRNHIHISLQVGPSSRRQRREMAVMEPAQMPVTFEEVAVYFTPGQGALLDP

SEQ ID NO: 8746 - protein, 81 aa, Chelonia mydas
NKQKGLKPPLALYFTEGKWALLGLGQRALYWGVMRENYETVASLGDGPASGNVEEKAQQAGLERVEPRGAVSGSSPGNGFQ

SEQ ID NO: 8747 - protein, 81 aa, Platysternon megacephalum
MPVQFKDVAVTLTEAEWSLLDEEQRQLYGTVMQENYRSISSLGCPVRKPALISQLERGEEPCIPDPPAPEEQETQRDVPTD

SEQ ID NO: 8748 - protein, 81 aa, Dryobates pubescens
EVSKALVESKVTSFSPEEWESLESWQRELYTNVLRGKNEALISLDDAISKPDLLAQLQRVEAPCNEIETASREALAEPTAH

SEQ ID NO: 8749 - protein, 81 aa, Ficedula albicollis
KVPVTFVDIAVYFSAEEWKNLEEWQKELYNNLVKENYEALLSLGKYGALSRSEAQPRSERGDGPCVPEQRELEQRELPPDA

SEQ ID NO: 8750 - protein, 81 aa, Platysternon megacephalum
MARGLNDAWGDVRPRRFLIPKPDVISRLERGEEPWVSDPQGSEERGSLGGACIGFPVSKPDVISPLKGEGEPWIPDLHGSE

SEQ ID NO: 8751 - protein, 81 aa, Ficedula albicollis
MEPCVVLDPRQRALYRDVMQHGYEILVALEFSVPKPDLLSYLDCEEEVTALDLHVSRDTPAAGEVPGGIKRRRVPPLLSFS

SEQ ID NO: 8752 - protein, 81 aa, Chelonia mydas
VTFEEVAVYFTKGEWALLDPGQRALYRDVMRENYETVTSLGDVSQRPEWGEARTSQRWSERQQGNHQKERQDKSMQNVRGV

SEQ ID NO: 8753 - protein, 81 aa, Chelonia mydas
VQGLVTFDDVAIYFCKEEWEELAEWQKELYRDVMRDNYETLIFLANELVSRNNDKESPERLGKHRTLPRARASAFPDCDGG

SEQ ID NO: 8754 - protein, 81 aa, Chelonia mydas
FQGLVTFKEVAVYFTREERALLAPFQRALYRDVMQENYETVVLLGDGIVSENEEEKPQQEDAEPLEPYGTLSGRSKGNDSR

SEQ ID NO: 8755 - protein, 81 aa, Chelonia mydas
ADMPVTFEEVVVYFSEGEWALLDLGQRALYRDVMQENYRNVTSLGFPIPKPSVISQLDRGEELWVPDLQGSQAREIQRNIP

SEQ ID NO: 8756 - protein, 81 aa, Anolis carolinensis
VRPDQVTFEDVAVHFTEEEWALLDPDQRALHWEVMDENLGLVSSLNFLSLPIMIQDIKTLQMTFILNVKEVFLPPNTTSLL

SEQ ID NO: 8757 - protein, 81 aa, Anolis carolinensis
VQGWVTFEDVAVHFSPEEWDLLDPDQKALHTHIMEETHRIITSLADNWMKSNVRTTSGRYFLDRWKFIGHQKHHTEAEGST

SEQ ID NO: 8758 - protein, 81 aa, Gallus gallus
ATLPKPSGGHPPAASLVLAVPSKEPLCLQEPVSFAEVAVYFSREEWALLDPAQRALYRDVMLETYQCVAWLGEGFAAFPPR

SEQ ID NO: 8759 - protein, 81 aa, Anolis carolinensis
FFFQVMFEDVAVHFSKAEWALLDLDQRALHWEVMEENYRMVASLAHFNSDATIIGQCRDTNVYWAIDHIIIESTTSLMIFS

SEQ ID NO: 8760 - protein, 81 aa, Gallus gallus
LQEPVSFAEVAVYFSREEWALLDPAQRALYRDVMLETYQCVAWLAPLPAPKPGLISLLEGGEDPWIPDVRSPEAVPGDLSP

SEQ ID NO: 8761 - protein, 81 aa, Anolis carolinensis
HGPITFEDVAVHFSPEEWVTLNPDQRVLHLQIMEEIDGILESLDVGVRLLESQILSRSEREKDCETYLQHHLTNQTLCPYF

SEQ ID NO: 8762 - protein, 81 aa, Gallus gallus
CQEPVSFAEVAVYFSREEWALLDPAQRALYRDVMLETYQCVAWLAPLPVPKPTLISLLEGGEDPWIPGVCSPEAVPGDLHP

SEQ ID NO: 8763 - protein, 81 aa, Anolis carolinensis
QIPVTFEDVTVHFTLEEWDSLLEWQQALYLEVMEANFELVASLVQAGSVPHTPELIGKTEQGDEPWAPGPQIPGWHQWMVH

SEQ ID NO: 8764 - protein, 81 aa, Anolis carolinensis
FEVPVSFEEVAVYFREEEWALLTLRQKALYREVMLANYETVASLGKDLFPPQHISKLGMQGNMRTQDKMKKQKRCQQIKNK

SEQ ID NO: 8765 - protein, 81 aa, Anolis carolinensis
PKAPVTVDEVSVYFSKPEWEKLEEWQRELYKNVMKGNYESLVSMDYAIAKPELLSRIERGEEPCAEDRGLSEEEEAVREVG

SEQ ID NO: 8766 - protein, 81 aa, Anolis carolinensis
LVPITFEDVAVHFSLEEWALLNPGQKVLHMQIMEEIHGIVDSLVSPLPSSRWDVIQGMDHHGQVWLLKQQGSLKNLPRDII

SEQ ID NO: 8767 - protein, 81 aa, Anolis carolinensis
KMPVTFVDIAVYFSAEEWKNLADWQKDIYNNLVKENYESLLNSGVDVNISKPESHPRVERGADQHVSEQQITTKEREVPAE

SEQ ID NO: 8768 - protein, 81 aa, Gallus gallus
HPSQEPVTFGDVAVYFSREEWALLDPARRALYWDVMLETYECIASLASKPVVIPLLEGGEDPWIPDVHSLKDMAGDICSAG

SEQ ID NO: 8769 - protein, 81 aa, Gallus gallus
FQEPVSFAEVAVYFSREEWALLDPAQRALYRDVMLETYHCVASLVPLPVHKPLVITLLEGGKEPWIPDVCSPEKMVEELGP

SEQ ID NO: 8770 - protein, 81 aa, Anolis carolinensis
SSSQVNFEDVSVNFTDEEWALLDPGQRALHQQVMEENLGIVSSLGKVKNNMEQFEKLQVTSGFSFSLELSESQVTRFFGHG

SEQ ID NO: 8771 - protein, 81 aa, Anolis carolinensis
GLVTFDEVAVCFTEEEWALLDAGQRALHKEVMEENRGLVASLDPFCSDQFLLSISTVGRRERNEEETQTKTEAKQTLMINS

SEQ ID NO: 8772 - protein, 81 aa, Gallus gallus
AREPVSFVEVAVYFSREEWALLDPAQRALYRDVMLETYESVASLGPFPAPKPVVISLLEGGDDPWIPDVHSPEAVSGDFSP

SEQ ID NO: 8773 - protein, 81 aa, Gallus gallus
LCLQEPVSFADVAVYFSREEWALLDPAQRVLYRDVMLETYECVASLAPKPAMISLLEGGEEPWIPDVRGLEDTAGDLSPAG

SEQ ID NO: 8774 - protein, 81 aa, Anolis carolinensis
VPEAFVEVTVHSNELHCSLVGRCRRALCKKAMQEKYRNMTSFGGFPVHTSDLLSRLKRLNRGEEAWVPDLQSSDESADEGP

SEQ ID NO: 8775 - protein, 81 aa, Gallus gallus
PKVPITFDDIAVYFNEQEWERLDSWQKDLYKAVMRGNYETLISLDYAVSKPDILSRIERGEELCVKDCWEPPQTLNRDGPE

SEQ ID NO: 8776 - protein, 81 aa, Anolis carolinensis
GPDQVTFEDVSVDFSEEEWALLGPSQKTLHQQIMEENLGIVSSLVGFWQAEADASQRTSVCQSSLYRERPFKCLQCEKSFS

SEQ ID NO: 8777 - protein, 81 aa, Anolis carolinensis
SWVPTTFEEVAVSFLPEEWDVLNPNQRALYNEVMEETHSIVSTLGIFPIHSLIIVYILKCNISYLIQEMQFKSNQFKIKNQ

SEQ ID NO: 8778 - protein, 81 aa, Ficedula albicollis
KVPVAFNDASFNFSEEEWKSLNEWQKELYRHIMKGNYEAVISMGADAAISKPELLTRIEQGEDPNTEDQEDSEGGETPTDP

SEQ ID NO: 8779 - protein, 81 aa, Anolis carolinensis
VEQDQVTFEDMAVTFSDAEWALLDPDQQILYKEVMEENYKMVVSFGGDGQESENGQVSFGKKTWIYRHKKPHKSPRKEKPF

SEQ ID NO: 8780 - protein, 81 aa, Anolis carolinensis
MQVAFDEVALPFTEQEWALLDANKRALYWDVMQENYRHVISLVGILVLSWDCRSFLQHKKKDYGMSHYHMTNASSVIFSKG

SEQ ID NO: 8781 - protein, 81 aa, Gallus gallus
MEEPVTFEDIAIYLSRAEWDMVAEEQRELYRSVMLDNYELLASLGYPGPKPDILHRLERGEEPWVNTPQSTVKWDGPDRPL

SEQ ID NO: 8782 - protein, 81 aa, Anolis carolinensis
QVTFGDVALYFTEEEWKLLDQNQKSLYYAVMMKNYENVSFLRDSWWKTKVNMKYRKSLSLELGLATHLHTHECLQCGKHFA

SEQ ID NO: 8783 - protein, 81 aa, Anolis carolinensis
PLPEVTLEEVAVYFSEEEWALLDPNQRALYGEVIEENLAIMASLECWMSEGWIIETTVTGNLAAMMLYFRKLSHPLPIGLV

SEQ ID NO: 8784 - protein, 81 aa, Anolis carolinensis
QVNFEDVSVNFTDEEWALLDPGQRALHQQVMEENLGIVSSLGKVKNNMDAFSLLQLVFHPPQVEHCLPFNRRLRQRKYPIS

SEQ ID NO: 8785 - protein, 81 aa, Anolis carolinensis
CFFVQVTFQEVAVSFSEEEWALLDPDQRALHQQVMKENVETVSSLIFYPWKLAFSLAKEGTDSWKLQQATYAKRKPFKCLE

SEQ ID NO: 8786 - protein, 81 aa, Anolis carolinensis
PKVPVTFEDNSAYFSEQEWSNLEEWQKELYKNVMKSNYESLVSLDYAIAKPDLLSRIEQGKRPYEEGEEEEVSKGREITAE

SEQ ID NO: 8787 - protein, 81 aa, Platysternon megacephalum
RPAQVAFEDVAVRFSPAEWAALAEWQRELYWAVMRENFELVASLGSADPKPESSCEMERGEEPQQGQEREIPEAPGMGEGI

SEQ ID NO: 8788 - protein, 81 aa, Anolis carolinensis
NQGPFAFEDVAVHFSLEEWALLNPDQKVLHVQIMEEIHEIVDSLAHKQSLDSVISKMLCQVNQSLWNSHLQKTSKNCKSPI

SEQ ID NO: 8789 - protein, 81 aa, Gallus gallus
PSVPVTFKDVFVEFSGDEWALLDDEQKELHRSVMQSNCEMLLSLYCDLAKPEDLLQMERGEPCVPAEPDLEGTAVSLKPGA

SEQ ID NO: 8790 - protein, 81 aa, Thamnophis sirtalis
MMQNYQAVVSVDMAVSKPELLARIEQGEDSEQTKSKEEYPREESGLGDQPGSPISALHGSSWIEEEDLSLVKSMGALEDRE

SEQ ID NO: 8791 - protein, 81 aa, Thamnophis sirtalis
IPLIFDDVAVFFSGEEWPLLDFNQKNLYREVMLENARNLATLGDGWENENYKETAFQTVESEIGEKTLQNQQGPQWPEANQ

SEQ ID NO: 8792 - protein, 81 aa, Thamnophis sirtalis
MITFEDVSIHFTEEEWTLLNHKEKNLYWNVMHQNYDNVACLASDQIKGESQEEDPLQEVFEPAVEWLEKSKETVLQHPEEK

SEQ ID NO: 8793 - protein, 81 aa, Micrurus surinamensis
LQGVVSFEDVAVYFSKEEWSQLDADQKALHGEVMLENSRNLLSLGFNGQENKYWKEEYQAINLKEVKRKFVDQLQPKSDET

SEQ ID NO: 8794 - protein, 81 aa, Micrurus surinamensis
VQDFVTFEDVAVYFSAEEWSQLDPEQKALHKEVMLENYRNVASLVALQRLKKEQIVSGRISEKPRSESVVSESALDHIKQS

SEQ ID NO: 8795 - protein, 81 aa, Micrurus surinamensis
ITEHPTRRKDLSDPTQEEWAHLDPHQKSLHREVMLENSRNVASLGTQRTFPHTPRKRTATGGKPYKCLECGKIFSKSSNLT

SEQ ID NO: 8796 - protein, 81 aa, Micrurus surinamensis
ETMIETPIQEGLVSFEEVAVYFSEEEWSQLDPDQKALLWEVMLENYRNVASLGDDEQDHKEPRESFQGFRHGDVMEKRAIQ

SEQ ID NO: 8797 - protein, 81 aa, Chelonia mydas
VPVTFEDVAVRFSAEEWEILEGWQKELHKEVMEENYQLLISLGQPVPTLALLALTAEREAAGGQIRSVSGERELASKGGSS

SEQ ID NO: 8798 - protein, 81 aa, Micrurus surinamensis
WSDPFEEVTVDFTEEEWALLDSDQRALCSEVTLEAFRNIIALGDGMENVNAKQERLMLLQRANNEGEVTSDHQENPKRERN

SEQ ID NO: 8799 - protein, 81 aa, Micrurus surinamensis
MLDSGQKALCREVMLELFRNMAALCDGLVSEKEKQLRLLTLQREVSAKSHSFPFTLSKILNRKYKLHTFAKYERNFHLSKK

SEQ ID NO: 8800 - protein, 81 aa, Chelonia mydas
AQGPVTFEELAVYFTEGEWALLDPAQRALYREVMQENYATVASLGFPVSKPDVISRLERGEEPWVPDLQGSEERELQTGDG

SEQ ID NO: 8801 - protein, 81 aa, Chelonia mydas
MTFEEVAVYFTEGQGALLDPAQRALYWDVMQENYEMVTSLGFPIPKPELIARLERGEELWVPDLQVAKERESPRGTRTGGE

SEQ ID NO: 8802 - protein, 81 aa, Chelonia mydas
AQGLVTFEEVAVYFTREEGALLDPTQRALYRDVMQENYETVVFLGDGRVSENEEEKLQQEDAEQVEPHGTLSGGSKGNGSR

SEQ ID NO: 8803 - protein, 81 aa, Chelonia mydas
VLCDMPVLRCCLDCDLGQLEHRLLPQRDRGWGVTVSKASSVPSQGIPVSKPDVISQLKRGEEPWAPDLWGSEEREVLRGSR

SEQ ID NO: 8804 - protein, 81 aa, Chelonia mydas
PVTFEDIAIYFTREEWEMLAEWQKELYRDVMKEHYDNLISLGHAGTTPDVLSRIERGEEPWVMDQQEERERLECTLHGEQL

SEQ ID NO: 8805 - protein, 81 aa, Micrurus surinamensis
DQSQATSTRDSALIDSSPFSAGDEKVEHPTQVLVSFEEVAVHFSKEEWSRLDPDQKSLYREIMLENSRNLAFLSKDPRSLF

SEQ ID NO: 8806 - protein, 81 aa, Chelonia mydas
ECLLFQGPVTFKEVALYFTDPGQRALYRDAMQENHANGTSQGSPIPKPDAVSQRQQEEEPWVPDLQGSRERENPRGDCPVQ

SEQ ID NO: 8807 - protein, 81 aa, Chelonia mydas
FMMPVTFEEVAVYFSEDEWALLDEKQRELYRDVMQENYKTLISLGFTMAKPDVLSQMERGEEFWIPDIQGSEEREIPRSTT

SEQ ID NO: 8808 - protein, 81 aa, Chelonia mydas
GKDAGDLRGVAVYFTQGQGALLDPAQRALYRDVMQENYETVTSLAGFPLPKPDLITQLERGEEPWVPDLSSPAEREIPRGA

SEQ ID NO: 8809 - protein, 81 aa, Chelonia mydas
TKGPVSFEEVAVYFTQGQGALLDPAQRALYRDVMQENYETVTSLGYPIPKPELITQLEQGEELWVPDLQASEEGEIPRGTH

SEQ ID NO: 8810 - protein, 81 aa, Pogona vitticeps
MENYELVTSLGYPVLKPDLLSRIERAGEQCAGDQLDSSRGIPTDPCPGYRFFKPESLSWIERWEELGVTDRQKLEEGKLCS

SEQ ID NO: 8811 - protein, 81 aa, Pogona vitticeps
GGVTSVTFEDVTLFFTKGQWNLLDQHQRALYKEVMQENYDNMASLGFPLGKPDLISWLEQDPWFPDQLALEEVGTTSQYSP

SEQ ID NO: 8812 - protein, 81 aa, Columba livia
PKVPITFDDISVYFNEQEWERLDRWQKDLYRAVMRGNYETLISLDYAVSKPDILARMERDEELFVRDARKAPLTGAADGLE

SEQ ID NO: 8813 - protein, 81 aa, Columba livia
QDVVTFKDVAIYFSPEEWVRLSAGQRELYQEVMLDNYELVTSLDRESKLLYKMDPEEESCEGVPYSSADSGAPDSSSTSAC

SEQ ID NO: 8814 - protein, 81 aa, Chelonia mydas
PEEPVTFEDVAIYFTQGQGALLDPAQKALYRDVMQENYEMVTSLRFPIPKPELIVRLEGGEEPWVSDLQACEEKEIPRGTH

SEQ ID NO: 8815 - protein, 81 aa, Chelonia mydas
FMMPVMFEEVAVYFSEDEWALLDEKQRELYRDVMQENYETLLSLGFPIAKPDVLSQMEQGEEPWFPDLQGSKERENPRGTS

SEQ ID NO: 8816 - protein, 81 aa, Chelonia mydas
LQMPVTFEEVAVYFTEGQGALLDSSQRALYRDVMQENYETVTSLGLPIPKPDLIAQLEAGEEPWVPDLQVFEERKIPRGTH

SEQ ID NO: 8817 - protein, 81 aa, Chelonia mydas
MAAVGPVQVGIIGELLVGSCWQEKGSKDIGGFPVSKPDVISQLERGEEPWAPDLRGSKEREILRGSRLAGDGMVRETMEQN

SEQ ID NO: 8818 - protein, 81 aa, Chelonia mydas
MEPCVLLDPHQKALYRDVMQESYDTLMSLEFPLLKAEVISRVEPCRRGSKEREIPAASGTGLGCAQQASSSPAGVGTASET

SEQ ID NO: 8819 - protein, 81 aa, Chelonia mydas
PKVPMAFDDVSIQIPREKWENLEEWQKELYKNVMKGNYESLISLDHAISKPDILSRIEQGEELCAGELQDLEVREIPTESS

SEQ ID NO: 8820 - protein, 81 aa, Chelonia mydas
PKVPVTFDDVSVYFNEPEWGSLEEWQKELYKNMMKGNYEALISLDYAISKPDLLSRIERGEEPCVGDRGRSEESEIPADPS

SEQ ID NO: 8821 - protein, 81 aa, Chelonia mydas
AQMPVTFEEVAVYFTQGQGALLDPAQRALYRDIMQENYETVTSLGVPIPKPDLIARLERGEEPWVPDLQDSKERENPRGTR

SEQ ID NO: 8822 - protein, 81 aa, Chelonia mydas
MFAEWQKELYREVMTENYEMLLSLGYPGPKPDLLYRLERGEEPWVHTPQGPVAWESPSPGGDVLSGSGEQQGRLWASILQC

SEQ ID NO: 8823 - protein, 81 aa, Chloebia gouldiae
PKVPLTFDEISVYFNELEWERLERWQKDLYRAVMRGNYETLPDILSQMERDEELSDKESQKSPWTQTGDGQEPLRAAEERG

SEQ ID NO: 8824 - protein, 81 aa, Strigops habroptila
MEPYVLLDPRQRALYRDVMQESYDTLMALEFPVSKPDLLPRLDHGDEPTALDLHVPRDTPAAEDGAGAEQEPPQEEKEPKE

SEQ ID NO: 8825 - protein, 81 aa, Pogona vitticeps
MQNNYATVALLGLPADEPELICKVEPEEEPWIPKEQAARERRILPASKSGAETPEVAVPSYRQYRGTTWTYPEVIDLLVIW

SEQ ID NO: 8826 - protein, 81 aa, Pogona vitticeps
RVSFEDVAMYFTKEEWHLLDWSQRLLYKEVMMENYENVAYLDDWRKTNSCSKCGKLFTHRLELAKHQQMEREEKLYKCPVW

SEQ ID NO: 8827 - protein, 81 aa, Pogona vitticeps
QDPVDFEDVAVYFTKEEWGLLDANQRSLYWEVMLDNYKILSSLDNWRGMNMCTKWPQEADTGEKPYKCHECGECFAHSLDL

SEQ ID NO: 8828 - protein, 81 aa, Pogona vitticeps
VEDEEPVTFEDVAVYFTAEEWDLLDLNEKSLYSEVMMENYENVTSLVPMPELLSHVEVGDDLWVPYSSSLDAMEASGTRSE

SEQ ID NO: 8829 - protein, 81 aa, Pogona vitticeps
VTFEEVAVSFTQEEWALLDPDQRALHQEVMEENWQTISSLGHNWREKYICLKSEKNFRHKLELAKDQRTYIEEESCVQEKP

SEQ ID NO: 8830 - protein, 81 aa, Columba livia
GKMSVTFEDVALYFSPEEWAKLSGCQRQLYQEVMLENYQMVASLGWANVKPEIICKMEREETPCVPDVPGKQQRHQSPVPV

SEQ ID NO: 8831 - protein, 81 aa, Pogona vitticeps
MMEQYVLLDPRQRALYQDVMQESYETLMALGRNTFPFKFPLSKPDLLSHLEQRDEATAFDLQHPRGSPPAVPESKEEVNPV

SEQ ID NO: 8832 - protein, 81 aa, Pogona vitticeps
KMQMAFEEVAVDFTEEEWVFLNANERTLYWDVMQENYEHVISVGVFLVLAERNHSSHLPLASSCSSMKGLSQVTFGEVAVY

SEQ ID NO: 8833 - protein, 81 aa, Pogona vitticeps
VAKALEELAVNFSEEEWALLDPRQKALHTEVMKETFTHAMSLGVGMMLGIYPSPSLLSGGAKTASPQTMGKSRWRAVQCFS

SEQ ID NO: 8834 - protein, 81 aa, Pogona vitticeps
LLSFDEVAVYFTEREWDLLDAGQRALYKDVMLENYGMVTSLVTPLTPSLEEMVKPDLISRLEKGEDGFALDSEEEKRWGGT

SEQ ID NO: 8835 - protein, 81 aa, Pogona vitticeps
VAFEDVAVYFTAEEWDLLGPNQKSLYSEVMMENYENVSYLADNWKKTIAFAHSQKDFIHKLHQRTHKEDEHHTRAEPCEST

SEQ ID NO: 8836 - protein, 81 aa, Pogona vitticeps
PKVPVSFEDNSAYFSEQEWGNLEEWQKELYKNIMKSNYESLVSLDYAIAKPDLLSRLEQGERPCQEEEEEEEGEVSKGREI

SEQ ID NO: 8837 - protein, 81 aa, Pogona vitticeps
DQGPVPFEEVAVSFSQEEWALLDPDQRALHQEIMEENQQMISSLDMSDSSVLSFLPFSFIRDNWREKNAYSKSGKSFAHHF

SEQ ID NO: 8838 - protein, 81 aa, Aythya fuligula
PKVPLTFDDISVYFNEQEWETLDSWQKDLYKAVMRGNYETLISLDYAVAKPDILSRLERDEELCTRGCREAPQTDTQDGQE

SEQ ID NO: 8839 - protein, 81 aa, Pogona vitticeps
DQVTFEEVAVSFTEEEWALLDPDQRALYKEVMEEVYGLVASLGALSSSNYHAAEKPYKCLECGKSFTEKGNLTVHQRKHTG

SEQ ID NO: 8840 - protein, 81 aa, Pogona vitticeps
VMMAFEDIVVHFTEEEWALLDDGQRALHQGVMEENVASLISLATSTREKRSEEEEGTDIDEKQKEFLKGSTALSDRRSLGS

SEQ ID NO: 8841 - protein, 81 aa, Pogona vitticeps
QVAEALEELSVSFSEEEWALLDPDQRALHKEVMEETLTHLVSLGIGMMLESYPCSTLFGEVGTAPAEPDLAGTSCWSSVGC

SEQ ID NO: 8842 - protein, 81 aa, Pogona vitticeps
PVTFEEVAVCFTQEEWALLDPDQRALHREVMEENARIVTSLDNWRKSYLCRNCGGSFMPRLNLARHETTHGKEERNVRENL

SEQ ID NO: 8843 - protein, 81 aa, Columba livia
VTFEDVALYFSPEEWAKLSGCQRQLYREVMLENYQMVASLGWANIKPEIICKMEREETPCMPERPREQQMLQSPVPGGYWG

SEQ ID NO: 8844 - protein, 81 aa, Columba livia
MSVTFEDVALYFSPEEWAKLSGCQRQLYREVMLENYQMVASLGWANVKPEIICRMEQEETLCLPDPRGGQQRHHSVPDAHS

SEQ ID NO: 8845 - protein, 81 aa, Pogona vitticeps
ASEGLVTFEDVAVHFTEEEWLLLDSTQRSLYREVMLNNYEMLSSLVPKPEPISETEEEEGPSWVLDSQEWEGLEKLDTRPG

SEQ ID NO: 8846 - protein, 81 aa, Pogona vitticeps
GNGRTFRNNEMTPSAPPRSLSLCGIKEAAFVKPEQGLVSFEDVSVHFTTEEWALLDQDQKALHKEVMGENCENLAFLGNNP

SEQ ID NO: 8847 - protein, 81 aa, Pogona vitticeps
DEEPVTFEEVAVRFSEGEWGLLDPGQRALYRDVMVENYGNVASLEGAPVLKPDLISWLEEKDERFDEDSEDDRERVPTGEA

SEQ ID NO: 8848 - protein, 81 aa, Pogona vitticeps
MMENYEALLSLGCLPEKPDIIRRIEQQEEVWVGELWRPRPWSKPEVPWPAGDGIRIEDEERGKQIQPGQPRAGRRGPRRKK

SEQ ID NO: 8849 - protein, 81 aa, Pogona vitticeps
KMPVTFVDIAVYFSAEEWENLAEWQKDLYHNLVKENYESLLTLGANVNVSKADPHSRVERRPEPCASEQQATKEQDLAPDP

SEQ ID NO: 8850 - protein, 81 aa, Pogona vitticeps
DQRPVAFKDVAVYFTEGQGALLDPGQKALYKEVMMENYENVASLGFPVPKPNLILCLEQGEDPWLPDPFSFSGTRPGVLRK

SEQ ID NO: 8851 - protein, 81 aa, Pogona vitticeps
PPDQLLVSFEEVAVSFSREEWDRLDPGQRTLYKEVMLENYKNVVSVVPRPVLIFYLEEGDDPFPQDPSVRDGSAGGCSGNT

SEQ ID NO: 8852 - protein, 81 aa, Pogona vitticeps
PDQVTFEEVAVSFMEDKSALLDPCQKPLYQEAMKENVGMAAILGRNGQKNKKEGEKRRTLAEIEEQRTKTEAKNLHKCLEC

SEQ ID NO: 8853 - protein, 81 aa, Pogona vitticeps
PHNQLVSFEEVAMYFTKEEWDLLDPGQRALYKEVMLENYRNILCLGLLKPDLVCQPEVKEEPSDWILEEKKWSKDDEQMGG

SEQ ID NO: 8854 - protein, 81 aa, Columba livia
MLENYQMVASLGWANVKPEIICKMEREETPCVPEPPRKRQRHRTSLPGSVGPRTQRVANGVPEGESQFKCPHLHRLPDFQP

SEQ ID NO: 8855 - protein, 81 aa, Pogona vitticeps
DQLVSFEEVAVYFRKGEWDLLDPSQQDLYKEVMLENYRNVALLGNVMATEGGSGLATGGGGGQDKMSVYLLKQLMSFQEVA

SEQ ID NO: 8856 - protein, 81 aa, Pogona vitticeps
GPMTFEEVAVHFTQEEWVLLEPDQRALHREVMEDNCGIVASLVPDLKHVSEMEPRVDPWILNGNKRSDIGSVTSLVPKLEV

SEQ ID NO: 8857 - protein, 81 aa, Pogona vitticeps
QFHQRVSFKEVAVYFTKREWDLLTPAQKSLYKEVMLENYRIVASLEIAKPDLISWLEKGEDPFVQDPEEERRWEGDDWNSE

SEQ ID NO: 8858 - protein, 81 aa, Pogona vitticeps
QVAEVLQDLMVYFSKEECALLNPGQRALHMEVMEETLVNVVSLGIGMALGTCPPSSLLAGGAETASTQPDLVGTSRWIVVQ

SEQ ID NO: 8859 - protein, 81 aa, Columba livia
LQVPVTFVDIAVYFSAEEWKNLEEWQKELYNNLVKENYESLISLDGAMSRNEAQPRGERGDGPCIPEQRDLEQRELPPDAC

SEQ ID NO: 8860 - protein, 81 aa, Columba livia
GKMSVKFEDVALYFSPEEWAKLSGCQRQLYRGGMLEKYQMVASLGWATEKPEIICKIEREETPCVLDPPGEHQSNQTHVSA

SEQ ID NO: 8861 - protein, 81 aa, Columba livia
PQVPVTFEDVAVQFSAEEWASLDDEQKDLYRTVMEDNYASLVSVYCALSKPELLSRIERGEEPCAPVELDLEGAGVSPEPP

SEQ ID NO: 8862 - protein, 81 aa, Pogona vitticeps
VAFEEVAVFFTQEEWTLLDLDQKALYQEVMEENWKTVLSLEAGRMLATSIPSSVPRDGEKLNQGPVAFKEVAVFFTQKEWT

SEQ ID NO: 8863 - protein, 81 aa, Columba livia
MLENYQMVASLGWATVKPEIICKMEREETACVPKLPGEWQRHQSPVPAVSPGTQKETKHVPEGLPGPTSLLPGMPSPGTRH

SEQ ID NO: 8864 - protein, 81 aa, Meleagris gallopavo
LQEPVSFAEVAVCFSREEWALLDPAQRVLYRDVMLETYQCVASLASLLTPKPVLISLLEGGEEPWIPDVRSPEATPGDLSP

SEQ ID NO: 8865 - protein, 81 aa, Pogona vitticeps
MEDEWLVEDSQQKPVYRQTHRETHESLVALTGPPSSKPNEIFLVEEEEEPCILEPGNRENTRRGNKAGEGLGSEEEELSDE

SEQ ID NO: 8866 - protein, 81 aa, Pogona vitticeps
PVTYEEVAVHFTQEEWALLDPDQRALHQEVMEEIWQMVSSLDKWREKKVCPGYEKTCTHKLEVAGHPRTHRQETCTQEKPY

SEQ ID NO: 8867 - protein, 81 aa, Columba livia
LQMSVTFEDVALYFSPEEWAKLSGCQRQLYREVMLENYQMVASLGWATIKPEIICKIERDETPCVPELPGERPRHQSPVPA

SEQ ID NO: 8868 - protein, 81 aa, Aythya fuligula
AEEPVTFVEVAVYFSREEWELLHPAQQVLYRDVMLETYESITSLGLLPSPKPVVISQLEEGEDPWIPDLHGVEDVTGDLSP

SEQ ID NO: 8869 - protein, 81 aa, Columba livia
GKMSVTFEDVALYFSPEEWAKLSGCQRQLYREVMLENYQMVASLGWATVKPEIICKMEREETPCVLDPPGEQQMHQSPVPA

SEQ ID NO: 8870 - protein, 81 aa, Pogona vitticeps
VTFEEVAVHFTEEEWEWLDPDQKALHREVTEEICWMLYTLDDEQHGENNPGLSVEPFERIDHEAGKQRYGKSRGEKWYRGN

SEQ ID NO: 8871 - protein, 81 aa, Pogona vitticeps
GPLVSFEDLAMYFTEGEWALLTQDQRALYVEVMLENYKNVASLGWVAPKPGIHLLARGKESQPPNPLDLDEDYYFSSSADP

SEQ ID NO: 8872 - protein, 81 aa, Columba livia
PKVQVMFDSGTADVSALEREDLEEWQREPRKNVLRGENEPLVSLDYALSKPDLLSRLPSGETPCDEVTSRGVPAEPSAEYG

SEQ ID NO: 8873 - protein, 81 aa, Columba livia
GKMSVTFEDVALYFSPEEWAKLSGCQRQLYREVMLENYQMVASLGWATVKPEIICKMEREETPCVPELPGEWQRHQSPVPV

SEQ ID NO: 8874 - protein, 81 aa, Pogona vitticeps
MAVSFTEEEWALLDPGQRALLWEVMEENVANVVSLAAGLKKGRFTEEPHQVILEKITKEEEKPQRRKTESKEKWRRSFVSL

SEQ ID NO: 8875 - protein, 81 aa, Pogona vitticeps
APELVTFEDVAVPFSAEEWSLLEGWQKQLHQDVMLQNYTLLLSLGNSLPSAEVSSLIHQLEETTVGQNFSQAGGEEGAHGG

SEQ ID NO: 8876 - protein, 81 aa, Pogona vitticeps
PKVPLLFDDTSCSFSEQEWKSLDEGQRDLYRYIMKSNYKAVVSVDAALSKPDLLSRLEHADVGDAGEGEERGPLRDSTLGS

SEQ ID NO: 8877 - protein, 81 aa, Pogona vitticeps
MLESYGIITSLVAPLIPSLGEMAKPELISLLEKGEDPFIQDSEEERRWEGTCSGDDWDSESCHKALLVCVEIRKHEERNFL

SEQ ID NO: 8878 - protein, 81 aa, Pogona vitticeps
TSQDLVSFDEVAMYFTQREWDRLNLDQRALYKEVMLENFSMVSSLEISKPVLITQLEEGKEPFVGASEEGNLMATQAGSGP

SEQ ID NO: 8879 - protein, 81 aa, Pogona vitticeps
QAPPFSFEEVAVYFTEEEWKLLDAEQRDLYWDVMQENYENVASLAIPIPKPELISRLERGEEPWIPNPQTTEDKKIPVNIY

SEQ ID NO: 8880 - protein, 81 aa, Pogona vitticeps
PKVPLTFGDSSVDFSEREWSSLEEEQKELYKAVMRSNYEMLVSLDDAVSKPKVLSQVERGEDPESLEGREMPVDPSYEESQ

SEQ ID NO: 8881 - protein, 81 aa, Pogona vitticeps
MRENYGASVALGSPVAQPDMVARLEEGGPHPAKDEREAKLREPPDGASAAGPVAQGTEQAAKGEQQHLQPPPPPPPPPGVD

SEQ ID NO: 8882 - protein, 81 aa, Pogona vitticeps
PKVPVTFNDNAVNFSTQEWANLEEWQKELYKNITKGHFEPLISLDAAISRGEVPPQTEPAELPRVADQEFVGEKGFPPEPR

SEQ ID NO: 8883 - protein, 81 aa, Pogona vitticeps
QSPVSFEDVVVYFTGEEWTLLDAGQKLFYREVMLENYGNVATLENEMASLVQSGLSPVPPANQKDIADDLQNPVSLEDVAV

SEQ ID NO: 8884 - protein, 81 aa, Pogona vitticeps
VMTFEDIAVYFTEEEWALLDPGQRALHREVMEENLINLVTLATDRREGRTEEEEGGVSMGTVSDKQWKYYLEHQKSISSRT

SEQ ID NO: 8885 - protein, 81 aa, Pogona vitticeps
EEAQEPVTFEEVAVYFTKEEWDLLDLGQRFLYREVMMENYENVSTLVPKPELLSNMEHGEELWVPELPDFDEAGILAITRP

SEQ ID NO: 8886 - protein, 81 aa, Micrurus surinamensis
GFPIQGPVSFGEVAIHFNSEEWLLLDPSQKALYQEVMLETSRMVASLAFDVQKKENDREPDLVPLQIIKSEIPEETSTNTW

SEQ ID NO: 8887 - protein, 81 aa, Columba livia
MAVTFEDVALYFSPEEWAELAGWQRRLYREVMLDNYELVASLGWAAVKPEIICKLEREEAPCVPDPPGVRRGQQSPGPDVS

SEQ ID NO: 8888 - protein, 81 aa, Micrurus surinamensis
PQELFCRRIPWEDPSQDTSGGGQRMKLSSFYDGDQTTVEPPNQEGLVSFEEVAVYFSEEEWSQLHPDQKALHSEVMIENHR

SEQ ID NO: 8889 - protein, 81 aa, Micrurus surinamensis
EEEWALLNSGQKALCREVMLDGCRNISSLSDGDCNGLENKDTQLGLLKWQKGVSAESHSFSFAIPKILNRDHKPQRSVKHD

SEQ ID NO: 8890 - protein, 81 aa, Micrurus surinamensis
SQELFFKRIQLGPLCQTFDHVEEVALDFTEEEWRLLDSGQKALCWEVMREVFRNMAALGKARICSGLFIEGEQETHLHTIA

SEQ ID NO: 8891 - protein, 81 aa, Pogona vitticeps
KVLLTFQEVTVHFTEEEQALMDPGQKALHREVMKENYGMVLSLHDWKKSDKKNEQRRRKMGEKQKWRKKCFIPHDIGQGTE

SEQ ID NO: 8892 - protein, 81 aa, Pogona vitticeps
QESSVAFEDIAVYFTKSQWTLLEPCEKALYRDVMQENYENVVAIGLSAVKPSLISHLEQEGDPWFPDPLVMEQKEILPGCN

SEQ ID NO: 8893 - protein, 81 aa, Pogona vitticeps
PQDSVTFEEVAVSFSREEWALLTDWQKNLYKDVMRDNYEMLNSLDLAAHKPDIILRIERGQEPCVGRLQRSKARERPNHVF

SEQ ID NO: 8894 - protein, 81 aa, Pogona vitticeps
WPCWLVFFEEVAVSFTRQEWDLLNPGQKALYKEVMLEIHGMITSLAIPEPDLVFSLEEGDDPFVQDPEEQKRLSGTCLGHK

SEQ ID NO: 8895 - protein, 81 aa, Pogona vitticeps
PVTFEEVAVNFTQEEWALLDPDERSLHRDVTAENRQMVASLNCGKSRLAAMGPLEFLATISSCHDHELWEHYVRDQGSYTR

SEQ ID NO: 8896 - protein, 81 aa, Pogona vitticeps
GNLMATQAGSGPSPLYGQVEKAAIKPLRQLVSFEEVAVCFTKGEWDLLEPAQKVLYKEVMLANYGVVASLGEDTFPLIEIN

SEQ ID NO: 8897 - protein, 81 aa, Pogona vitticeps
DQKPVTFEDVAVYFTKSEWTLLDPEQRAMYRDVMLKSYENVASMGFSPSKPALITCLEQGEVLWARIQPEHQKREMLPRPS

SEQ ID NO: 8898 - protein, 81 aa, Pogona vitticeps
VTFEEVAVDFTQEEWALLDPDQRALHKEVMEENWGMVASLAGNERGRKVCVKCGNLFTHNCDLSAEQQTHVAEESLTTERP

SEQ ID NO: 8899 - protein, 81 aa, Pogona vitticeps
MFEDVAVYFTRGEWKALSEWQKDLYRAVMVENYEAVASSGGPSVKPKLICRIERDEDPSVDETPEAPLRKRPQSPWLGDGI

SEQ ID NO: 8900 - protein, 81 aa, Chelonia mydas
AQMLMTFEEVAVYFTQGQGALLDPTQRALYRDVMQENYETVTSLGFPIPKPDLIAQLERGEEPWVPDLQACEEREITRGTC

SEQ ID NO: 8901 - protein, 81 aa, Chelonia mydas
IPKVPVIFDDSAVFSQEEWENLEDWQKELYKNVMKGNYEYMISLDYAISKPDILSRIERGEEPCARGQQESEERETTADPS

SEQ ID NO: 8902 - protein, 81 aa, Chelonia mydas
MLRNYRALVSLGSSGSTPDLIHRIELGEAELWIWDAEGSRESSRCESPSSGHGIPGGTRKWSECGESAAGTQDPTSHRGIH

SEQ ID NO: 8903 - protein, 81 aa, Chelonia mydas
AQMPVTFEEVAVYFTQGQGALLDPAQRALYRDVMQENYETVTSLGFPIPKPELIAQLERGEEPWVPDLQACEEREILRGTR

SEQ ID NO: 8904 - protein, 81 aa, Chelonia mydas
VTFEDVAMYFSPAEWALLGEQQRQLYRHVMWENYQTLVSLDFPDAEETWDWSAIESSLGFFLTQSSSLGAGARNQNRAEGQ

SEQ ID NO: 8905 - protein, 81 aa, Chelonia mydas
QELVTFKEVAVYFTEEQWALLDPHQRALYRDVMQQNYENVTSLEDVSQSPEQREACERQQGNNPGMKLGKSTYQVGGLKDL

SEQ ID NO: 8906 - protein, 81 aa, Chelonia mydas
AQGPVTFEEVAVYFTREEGALLDPPQRALYREVMQENYETVVLLGDGMMSENEEDNPQEKDADQVKPHGTLSGRSKGNICR

SEQ ID NO: 8907 - protein, 81 aa, Chelonia mydas
PKVPVTFDDISVYFNEQQWGNLDEWQKELYKNVMKSNYEMLMSLDYAISKPDILSRIERGEELSVGDQGDAEEREIPTDPS

SEQ ID NO: 8908 - protein, 81 aa, Chelonia mydas
KPHQHRLNGSAIHGVQYIPPLPPVVTESPGDALELLPTKPGRTLGFPVPKPDMISQLERGEEPWVLDLQGSEEGEILSGAC

SEQ ID NO: 8909 - protein, 81 aa, Chelonia mydas
MQENYETVTSLGLPIPKPDLIIRLEAGEEPWVPDLPASKKRKITRDTCTTGDETMSENEDENPLQECPEQVELQGTLLRQG

SEQ ID NO: 8910 - protein, 81 aa, Chelonia mydas
AVELVTFEEVVVYFSEEEWALLDPGQRALYRDVMQENYETVTSLGFPISKPVVISWLERGEEPWVSDIKGYKERESPRDAH

SEQ ID NO: 8911 - protein, 81 aa, Chelonia mydas
MEKWLFLDPRQRALYRDVMQESYETLMSLKYPIPKPDVISRLEQGEEPWVPPDLQGSGGRDLPRDASPGTASETEGEAPQT

SEQ ID NO: 8912 - protein, 81 aa, Chelonia mydas
MPVTFEEVAVYFTEGQGALLDPSQRALYRDVMQENYETVTSLGLHITKPDLIARLEGGEEPWVPDLQASKERKIPRGSRTV

SEQ ID NO: 8913 - protein, 81 aa, Chelonia mydas
MPVTFEEVALYFTQGQGALLDSAQRALYRDVMQENYKTVTSLGFPLPKPDLITRLEQGEEPWVPDLQACEKKEIPRGSHTV

SEQ ID NO: 8914 - protein, 81 aa, Chelonia mydas
MLRNYRTLVSLGYSGSTPDIIHQIELGEPELWTWDAENSRQSSGPESPSSAGLRIPGGTRTQSECGEGAAGKDPTSHRGIR

SEQ ID NO: 8915 - protein, 81 aa, Chelonia mydas
KTAPVTFDDVAVYFSAEEWEELAEWQKELYKDVMRDNYEALISLGHAAAKPDIIQLLEHGEEPCVKGHKDSGNGKAFNFIS

SEQ ID NO: 8916 - protein, 81 aa, Chelonia mydas
VTFDDVAVYFSREEWEMLAEWQKELYQEVMRENYANLISLAGDWPRQRSKKKNEEECAEKLEAPELPTGIGLANGSEKAKI

SEQ ID NO: 8917 - protein, 81 aa, Pogona vitticeps
PVTLEDVAVSFTEEEWTLLDPGQRALLWEVMEENVANMVSLAAGLKKGRFTEEPHQVILEKITKEEEKPQRRKTESKEKGR

SEQ ID NO: 8918 - protein, 81 aa, Pogona vitticeps
EQGPVTFDEVAVNCTEAEWALLDQNQRACHRDVMEETRENVLSLAREVRHSENQEELCWVRLKTVICKESHLQGSRTEENT

SEQ ID NO: 8919 - protein, 81 aa, Pogona vitticeps
VQGPVTFEEVAVYFTQEEWALLDPNQKALHQEVMEENWQMLSSLDLSDSSVDPLQHLSFFLRNNWRKKNLYPKSGKSFTHQ

SEQ ID NO: 8920 - protein, 81 aa, Columba livia
SVTFEDVALYFSPEEWAKLSGCQRQLYREVMLENYQMVASLGEDSLWHCQAGVEPEFTSFIAVSAGTQREAEEVHEEPVAP

SEQ ID NO: 8921 - protein, 81 aa, Pogona vitticeps
GVLVTSEDIVVHFMEEEWALLNEGQRALHRDVMEANVASLISVAMSTREKRSEEEEGAMFFGAVMAKKQKEPLKCSKTVQR

SEQ ID NO: 8922 - protein, 81 aa, Pogona vitticeps
PVAFEEVAVLFTWEEWTLLDPNQRNMHKEVMKENWQTVSSLDNWREKNVSTSEDTFTQKLECARHQRTHTEEESCIRDKSY

SEQ ID NO: 8923 - protein, 81 aa, Columba livia
PKVPVAFNDASFNFEEEDWKSLNEWQKELYRHIMKGNYEAVISMDAAISKPDLLSRIEQGEDPGAEDQDDSEGGESPTEPS

SEQ ID NO: 8924 - protein, 81 aa, Pogona vitticeps
EADLWWIRLGSEGDATSSEGSEMYLQPPSRDSLTREKMGAVQPDQDLMSLDEVAVSFTAEEWALLDPRQKSLYREVMEEIS

SEQ ID NO: 8925 - protein, 81 aa, Pogona vitticeps
DPVAFEEVAVYFSQEEWAELDPNQRALHKEVMKENWQTVSSLKNYCGKSFAYKLELAAHQGTYTEEESYMQEKICESVMCR

SEQ ID NO: 8926 - protein, 81 aa, Pogona vitticeps
MGSITFEDVTVYFTQEEWALLDPGQKALHQEVMEENWQTVSSLADIWREKNVCPKCGKSSRHKFKLPEHQRIHTEDKWCIQ

SEQ ID NO: 8927 - protein, 81 aa, Pogona vitticeps
FQGPVTFDEVAVNFTEAEWALLDQNQRACHRDVMEETHENVVSLAREGRHSENQEELCWIGLEIFLFKESHLQGRRSEANT

SEQ ID NO: 8928 - protein, 81 aa, Pogona vitticeps
QTVTSFKEVAVYFTTEEWDHLDPGQRVLYKDVMLENYRNVTFLGKIMATQEGSGSSPLGNGRERSALQLSKLVSFQEVAIY

SEQ ID NO: 8929 - protein, 81 aa, Pogona vitticeps
VAFEDVAVYFTEEEWALLDRNQKALYWEVMEENLVTVFSLGGEQESEKGGEASKAALLERVTWEEKEEQQTTSETKEKNEG

SEQ ID NO: 8930 - protein, 81 aa, Pogona vitticeps
MEDEWLVEDSQQKPVYRQTHRETHESLVALRPPSSKPNEIFLVEEEEEPCILEPGNRENTRRGNKAGEGLGSEEEELSDEE

SEQ ID NO: 8931 - protein, 81 aa, Pogona vitticeps
MQENYDNMASLGFPLGKPDLISWLEQDPWFPDQLALEEVGTTSQYSPPCTMECPFPPRSKKRESMATVEEAQEPVTFEEVA

SEQ ID NO: 8932 - protein, 81 aa, Columba livia
WQEPVTFEDVAVYLSHAEWDAMAPEQRELYCSVMLDNYQLLASLGYPGPKPDIVYRLERGEEPWGCAPQSPLSWDGPRSPS

SEQ ID NO: 8933 - protein, 81 aa, Pogona vitticeps
TQEPVAFEEVAVYFRAGEWALLGPDQRALYREVMLENFGHMATLGLFVSKPNLISWVEGGEESFFLDPEGIEKEKNTDVAA

SEQ ID NO: 8934 - protein, 81 aa, Pogona vitticeps
PVAFEEVAVLFTWEEWTLLDPNQRNMHKEVMKENWQTVSSLADNWREKNVSTSEDTFTQKLECARHQRTHTEEESCIRDKS

SEQ ID NO: 8935 - protein, 81 aa, Pogona vitticeps
IHCPSSLLPGGMETRSMKPEQVAEALEELAVDFSEEEWALLDPGQRALHTEVMKEILTHAASLSKRNALSSIGSALVNRFL

SEQ ID NO: 8936 - protein, 81 aa, Pogona vitticeps
PRFWGPATFEDSTAAAAASPEEWEKELYKNVMKGKQESLISLDYALSKPDVLSRIEGGEDPWDHEDDDNNNKGQPDLEGRE

SEQ ID NO: 8937 - protein, 81 aa, Pogona vitticeps
LQLVSFEEVAVYFTKGEWDLLDPGQRYLYKEVTLENYSNVILLGSAMATEGGSRLSPEGNGQERMAEHLPQLMAFKEVAVH

SEQ ID NO: 8938 - protein, 81 aa, Pogona vitticeps
DPVTFEDVVVYFTKEEWALLNSGQRALHRQVMEENFANVTSLSPDGRENRTEEELHKVCFGGFIDTKGKRYLEYGKNANGK

SEQ ID NO: 8939 - protein, 81 aa, Pogona vitticeps
YQVTFEEVAVYFSEEEWALLDADQRALHQEVMEQNYGMVASLGGGHWQREDEGESNGLALERARRPEWEEQSPRNQAKQNF

SEQ ID NO: 8940 - protein, 81 aa, Pogona vitticeps
MQENYETLISLAEEMAISLPRITTLAESHRRGLASAGFPVSKPDLLSWMDRGEDPWVPDLQESEGSLLPTDTSSPGEELRR

SEQ ID NO: 8941 - protein, 81 aa, Pogona vitticeps
MMEQYVLLDPRQRALYQDVMQESYETLMALEFPLSKPDLLSHLEQRDEATAFDLQHPRGSPPAVPESKEEVNPVQEDPTGP

SEQ ID NO: 8942 - protein, 81 aa, Pogona vitticeps
DQLVSFEEVAVYFRKGEWDLLDPSQQDLYKEVMLENYRNVALLGNVMATEGGSGLATGGGGGQDKMSVYLLKLMSFQEVAV

SEQ ID NO: 8943 - protein, 81 aa, Columba livia
GKMSVTFEDVALYFSPEEWAKLSGCQRQLYREVMLENYQMVASLGWANIKPEIICKMEREETLCVPAPPREWQRDQSPVPA

SEQ ID NO: 8944 - protein, 81 aa, Micrurus surinamensis
ETEVETPVQEGLVSFEDVAVYFSEEEWTELDPDQKALHWEVMLENYRNVASLGDDEQDHKEPRESFQGFRHGDVMEKRAIQ

SEQ ID NO: 8945 - protein, 81 aa, Aythya fuligula
MEPWVMLDPRQKALYRDVMQESYETLMSLAQGLVSEKAAEEGAAQQIPEELEARPSRSPERAKTLGSNRRKTKRPDKAVPH

SEQ ID NO: 8946 - protein, 81 aa, Columba livia
MLENYQMVASLGWANVKPEIICKMEREETPCVPDGPGEQQRHQSPVPAVSPGMQRETERVPEGLPEPTALLPGMPNPDVRC

SEQ ID NO: 8947 - protein, 81 aa, Platysternon megacephalum
VPVTFEDVAVRFSAEEWEILEGWQKELHKEVMEENYQLLISLGQPVPTLALLPLTAEWEAAGGQIRNVSGERELASGSGSS

SEQ ID NO: 8948 - protein, 81 aa, Platysternon megacephalum
MEQYVLLDPRQRALYRDVMQESYETLMALEFPLSKPDLLSRLDRGDEPTALDLHMPRGGRAGESLSRKERIPATSRMASHQ

SEQ ID NO: 8949 - protein, 81 aa, Chelonia mydas
AQVLVTFEDVAVYFSREQWGLLDDMQRALYRDVMQENYQTLVSLPGSSIPKPDVISQMERGEEPWVPDLQSSQEREIPRGA

SEQ ID NO: 8950 - protein, 81 aa, Chelonia mydas
MQPMGRMFETPDIHWFPVSKPDVISRLEQGEEPWVPDLQGSEEKELQKGAQTGDGMVSENKKYSQQEDAEQVEPHGTLSGR

SEQ ID NO: 8951 - protein, 81 aa, Chelonia mydas
MYFAEIQWALLDPAPRPVYRDMVPENYGTLLSRDSSMINPALQQGGPETTQPHGTLPGMRSEGNVYQAPGHAATCQSQARP

SEQ ID NO: 8952 - protein, 81 aa, Ficedula albicollis
EAPAVALENDATGFSTQEWENLEEWQRELCGKVLTGKREAPVLLDDVITEPALLSRLQGGEAPCSEEEAAPREMPAEPGAA

SEQ ID NO: 8953 - protein, 81 aa, Platysternon megacephalum
FLMPVTFEEVAVYFSEDEWALLDEKQKELYRDVMQENYETLISLGFLIAKPDVLSQMERGEEMWIPDLQGSEEREIPRGTT

SEQ ID NO: 8954 - protein, 81 aa, Terrapene carolina
AEPVTFEEVAVYFTAEEWALLDLGQRALYRDVMQENYEIMTSLGKDSCPLGYEKHLGQILCRGLHWSPRIQADQTLSLGQG

SEQ ID NO: 8955 - protein, 81 aa, Geotrypetes seraphini
DQVPLTFDDVALYFSEEEWHCLEERQKILYRNVMMENFETLTSLGFSTTIPDIILRIERGEDPYVCDPQDANERGITWRHQ

SEQ ID NO: 8956 - protein, 81 aa, Geotrypetes seraphini
AQMQLKFEDVAVSFSQEEWEYLDEGQKELYREVMKENYETLISLGSVRISPDLLSWIKQDGEPNIQDPQESGEREVRRSDT

SEQ ID NO: 8957 - protein, 81 aa, Geotrypetes seraphini
MQVEFEDIAVSFSQEEWEYLDEGQKELYREVMKENYETLISLATGSPTFTPKIISYIERGEEPYIRGEPESEERESGKGSC

SEQ ID NO: 8958 - protein, 81 aa, Geotrypetes seraphini
AQVPVTFEDITIYFCQEEWKYLEEWQKELYKDVVKENYQTLISLGSLTVTPDIISYVEQGEEPYIRHEPGSKERETGRNSS

SEQ ID NO: 8959 - protein, 81 aa, Geotrypetes seraphini
MMENFETLTSLGFSTTIPDIILRIERGEDPYVCDPQDANERGITWRHQRNQPRAGQNKTDFSKAGVVSQHVRVPSGHRLHP

SEQ ID NO: 8960 - protein, 81 aa, Geotrypetes seraphini
MQENYDSLESLGFAMKKPEVVSRIEQGEEPWVMENAGSSISGTNTILTILERLEKRMARIEHHQILFLTHLFKHLKPAATL

SEQ ID NO: 8961 - protein, 81 aa, Geotrypetes seraphini
DQELVTFKNVAAYFLEAEWDILGEWQKELYKKVIKEIHGILTSQGYSIVNPDSLFKIKKEDEKYFIQHFEQEGKENLNDPS

SEQ ID NO: 8962 - protein, 81 aa, Geotrypetes seraphini
MASVTFSDVAAYFWEVEWDILGEWQKELYKKVVKEIHRFLIIQGYSILNPDVIFKIKKEDEKYFTQYSVLEGKENMNDPTM

SEQ ID NO: 8963 - protein, 81 aa, Geotrypetes seraphini
QTSVIFKDVAAYFLEAEWDILGEWQKELYKKVIKEIHDILLSRGYSIVNPDVMFKIKKEDEKYFPWQFEWEGKENSNKPTK

SEQ ID NO: 8964 - protein, 81 aa, Geotrypetes seraphini
GRAKVVFSDVAIYFSEGEWQLLEDWQKELYTNVMKEIHGALVSLGYTIVNSDTVFKIKPKEEPSLRNHIDTKEGGGGGKAS

SEQ ID NO: 8965 - protein, 81 aa, Geotrypetes seraphini
TVVSVTFNDVAICFLEEDWKVLEEWQKESYQKVMEEIHAALFSLGHRITNPSVLVKIIQEDPCKVAGASNGDLVYNPDVSL

SEQ ID NO: 8966 - protein, 81 aa, Terrapene carolina
FQMLVTFEEVAVYFTQGQGALLDPAQRALYRDVMQENYETVTSLGFPIPKPELIARLERGEEPWVPDLQPCKERRLPRCTR

SEQ ID NO: 8967 - protein, 81 aa, Geotrypetes seraphini
DQALVTFKDVAAYFWEVEWNILGELQKELYKKVIKEVHGILLSRGYSIVNPDVIFKIKKEDEKYFTQHFEWEGKENPQDSM

SEQ ID NO: 8968 - protein, 81 aa, Terrapene carolina
MRSVWLCVFPAEIGIVKSLLSRVSCTFEPLGSPGCPVAKPDVISQLERGEEPWVPDLQGSEEGEIPRGACAGEGSLNQFKN

SEQ ID NO: 8969 - protein, 81 aa, Terrapene carolina
FQMPVTFEEVAVYFTQGQGALLDPAQRALYRDVMQENYEMVTSLGFPIPKPELIARLERGEEPWVPDLQACKERRLPRCTR

SEQ ID NO: 8970 - protein, 81 aa, Lithobates catesbeianus
IRCQDVTVYFSMEEWKYIEGHKDLYKDIMMENPWTLKSPDAIDLTHDVTYHYKGDNLIVIKVEDDEESYVRGDEPCDEEEE

SEQ ID NO: 8971 - protein, 81 aa, Notechis scutatus
QWSDPFEAVTVDFTEEEWALLDSDQRALCAEVTLEAFRNIIALGDAIEKEKQEWLMSLPTANYEGEVTFDQTNPKKQESSH

SEQ ID NO: 8972 - protein, 81 aa, Xenopus tropicalis
HRESVSFTDVAATFSEGEWNILSDWQRELYGTVMRQIHSVLMDLGYHIHNSEILFRITKNEEPGRYHRYVAARSKEGHAPD

SEQ ID NO: 8973 - protein, 81 aa, Geotrypetes seraphini
VTFEDITVAFSQEEWEYLDEGQKELHREVMKENYEILKSLEKDDPKNNPWKLSEKPEGVKMLSEGEKENWGEKEKNQNPKY

SEQ ID NO: 8974 - protein, 81 aa, Lithobates catesbeianus
IRCQDVTVYLSMEEWEYLEGHKDLYKDVMMENHQILNYVKLEKRKILLSDIMLNLTLEIIYLLTGENYEVVKLVSGEQITT

SEQ ID NO: 8975 - protein, 81 aa, Meleagris gallopavo
MEPYVLLDPRQRALYRDVMQESYETLMSLEFPISKHNLLSHRDEPTALDLHVPKETLLGDNGAAQEPPQEDPKATKPTEEG

SEQ ID NO: 8976 - protein, 81 aa, Terrapene carolina
MSVTFEDVAMYFSPAEWALLGEEQRQLYRHVMWENYQTLVSLGIQISKPVVISSIERGEELWAQSPTEDEDEDILSGTSPG

SEQ ID NO: 8977 - protein, 81 aa, Geotrypetes seraphini
GEVSVTFSDVVACFTEQEWELLKERQKEVYRAVMMEVHEALISLGYEIANRDVLFRVQEEKSACRRDGFEGKNSLCTPPTG

SEQ ID NO: 8978 - protein, 81 aa, Geotrypetes seraphini
MAAAIPEVEWNLLEDWQKQLYKDVMKESYKTILSLGYSVAKQNIMTEPTAEEKACNSGVRNPESGNIAGSSSAVDQCSRKK

SEQ ID NO: 8979 - protein, 81 aa, Geotrypetes seraphini
MKENYEALSSLGFPIATPDIITLIEHGKEPYIKNEPGLEERYQGESNCLGSDPERRCWYFTENLEADRILSGEQEATLCSG

SEQ ID NO: 8980 - protein, 81 aa, Geotrypetes seraphini
QMWVTFEDVAVSFSQEEWEYLDDGQKELYQEVMKENYETVMSLAGEEFSQEKEKEENAEHSLKTEVHEMNLKAVNLFKCSL

SEQ ID NO: 8981 - protein, 81 aa, Geotrypetes seraphini
DQASVKFKDVAAYFLEKEWDILGEWQKEVYMKVIKEIHDILILRGYSILNPDIIFKIKKEDEKYFAQHCELEGKENLNNPT

SEQ ID NO: 8982 - protein, 81 aa, Geotrypetes seraphini
AQIWVTFDDIAVSFSQEEWEYLDEGQKELYREVMKENYETLISLGSPAVAPEIISYIERGEEPYVRDESRLGERATGESSC

SEQ ID NO: 8983 - protein, 81 aa, Geotrypetes seraphini
MVTFEDIAVSFSEEEWAYLDEEQKKLYREVMEENYQTLVSLAEQELKQERESEKNQGKYRLEMEQIQRQSGNVCANISQRT

SEQ ID NO: 8984 - protein, 81 aa, Xenopus laevis
VRALVTFHDVAACFSAEDWRQLEDWQKELYKNVMREIHSALVAMGYTIQNPEQLLRVHELKETSQDTGKGKERNNLLTAGA

SEQ ID NO: 8985 - protein, 81 aa, Geotrypetes seraphini
AQMQVKFEDVAVSFSQEEWEYLDEGQKELYREVMKENYETLISLGSVRISPDLLSWIKQDGETHIQDPQESGERDVRHSDM

SEQ ID NO: 8986 - protein, 81 aa, Geotrypetes seraphini
MQVSFEDIAVSFSQEEWEYLEEEQRELYREVMKENYQTLISLGTGCPNLTPEIISRIERGEEPYIRGEPGSEERETGKSNC

SEQ ID NO: 8987 - protein, 81 aa, Geotrypetes seraphini
MKQIHRALFSLGYSIANPDVLFRIKQDDEPYFRDPFDSEGSNNIGGKDAGYPFIRPDVLFRIKQEEMEEAYYWDPQEPEGG

SEQ ID NO: 8988 - protein, 81 aa, Geotrypetes seraphini
MKENYETLLLLGCPGLKPVIISSIEQGEEPCVRKLQERAELYPTAGDESFKGEDTKHLDHLEKKSDEEGDVYYTIEHGEHS

SEQ ID NO: 8989 - protein, 81 aa, Geotrypetes seraphini
EQASVTFNDVAAYFWEVEWDVLGEWQKELYKKVIKEIHSLLMSRGYSIVNPDVIFKIKKEDEKYFTQHCEWERKEKANDPS

SEQ ID NO: 8990 - protein, 81 aa, Geotrypetes seraphini
HQASVTFSDVAVYFSEEEWQLLEEWQKELYRNVMMEIHGALISLGYGILNPDVLFRFKKEEDPYYRSQQKSKGKERVVDLN

SEQ ID NO: 8991 - protein, 81 aa, Geotrypetes seraphini
MRVTFEDITVSFSQEEWGYLDEGQKELYREVMKENYETLISLGYEKVNPDILLRIKQEEDHYVLDSQESGATRSYSDKEVV

SEQ ID NO: 8992 - protein, 81 aa, Geotrypetes seraphini
DLVPITFTDVAAYFWEAEWDVLEERQRELYKKVIEEIHEILMSRGYSIVNPDVLFRIKQQDEKYFSQHHDWKEKENINGPA

SEQ ID NO: 8993 - protein, 81 aa, Alligator sinensis
TELREAFEDVAVYFTREEWELLEDAQKGLYRDQMLRNCQALVSLGYQGPTPDLILCIQQGQKELWVSDEEGHQDISRSEDL

SEQ ID NO: 8994 - protein, 81 aa, Xenopus tropicalis
FQAPVKFEEIAVYFSEEEWGCLAEWQKLLYANVMLDNYETLCYLGFIHEIPDIITKIWQGRDLYELPLNTSHGSIRIKEEL

SEQ ID NO: 8995 - protein, 81 aa, Notechis scutatus
MENYELVTSLGYPVLKPDILSRIERVGEPCVGDQLDSTRGIPTDPCPGYRFFKPESLSWIERWEELGVTDRQKLEEGKLCA

SEQ ID NO: 8996 - protein, 81 aa, Geotrypetes seraphini
DQVSVTFSDVAAYFWEMEWDILGEQQKELYEKVIKEIHGILISQGYSIFNPDTIFKIRKEDGKYFTQNCEWKGEENVNESP

SEQ ID NO: 8997 - protein, 81 aa, Microcaecilia unicolor
QQMRVTFEDIAVSFSQEEWEYLDEEQKELYREVMKENYQTLISLGYERINPDILSRIKQEEDPFVRELQESEEKEDCLSYT

SEQ ID NO: 8998 - protein, 81 aa, Pipra filicauda
MEPWAPLDPRQKELYRDVMHESYETLLSLAQGLLSEKAAVEDAGAAEPAEGPGAVSEREKPLGSHRRKAKRPDRAVPPGTP

SEQ ID NO: 8999 - protein, 81 aa, Pogona vitticeps
DQGPVTFEEVAVYFTWEEWTLLDPDQRALHREVMEENWQTVSSLKNIWREKSICPQCGKSFTHKVELDGHQRAHTEEESRI

SEQ ID NO: 9000 - protein, 81 aa, Pogona vitticeps
MQENYENVVAIGLSAVKPSLISHLEQEGDPWFPDPLVMEQKEILPGCNSEFPEVIIKLEQEEQPWVLNSQTFPIIDSGYAD

SEQ ID NO: 9001 - protein, 81 aa, Geotrypetes seraphini
MLAEWQKELYKETMKENYETLTSLGSSPEKPSLISKIEREEDPCIRNQQDSQDRRRPRSCWRGSPVEKPELTVRIKQETDS

SEQ ID NO: 9002 - protein, 81 aa, Geotrypetes seraphini
MRVTFEDIFISFSQEEWKYLKEGQKQLYREVMEENYETLISLDHQITQERKREKKQGEDPGEIEQVQRQSGNICENISQGI

SEQ ID NO: 9003 - protein, 81 aa, Pantherophis guttatus
LQDLVTFEEVAIYFSAKEWETLTDGQKSLYLDVMKDNYEALVSLGLAAQPPSVLLQIEGWEKPCAGRAQFPKSRGESKDNF

SEQ ID NO: 9004 - protein, 81 aa, Terrapene carolina
MRSVWLCVFPAEIGIVKSLLSRVSCTFEPLGSPGCPVAKPDVISQLERGEEPWAPDLQGSEEREIPRGACAGEGSLNQFKN

SEQ ID NO: 9005 - protein, 81 aa, Alligator sinensis
MQEKYETMNSLAGFPLSKPEVISQLEQDGEPSIKDLQGFPGKEIQRNINAGKGTVTVSKDDSPYQEGPEQVHLNRVVPGSP

SEQ ID NO: 9006 - protein, 81 aa, Microcaecilia unicolor
QVPVTFEDIVIYFSQEEWEDLEERQKELYKDVMKENYETLSSLGTGSLTVTPDIISHIERGEEPYIRDGPGSDERETGKSG

SEQ ID NO: 9007 - protein, 81 aa, Microcaecilia unicolor
QMRVTFEDIAVSFSQEEWRYLDEGQKELYREVMEENYETLLFLETNHQFIDPDVLSKIKQHSRKPGKREVGGSYSDNEAKE

SEQ ID NO: 9008 - protein, 81 aa, Micrurus lemniscatus
DADQKALHREVMLENSRNLSSLGFNGQENKNCKQECQAIHPKEGKMNFADQLQPKSNETKQSQIGIKKDFPLVIWLSNHTN

SEQ ID NO: 9009 - protein, 81 aa, Micrurus spixii
CQDSDLFEKVAVDFTEEEWALLDSNQKALCREVMLEVAMNMAALGDGEGLENEKQRSLFKIQSAVSSKGQNDLRTRHNLTH

SEQ ID NO: 9010 - protein, 81 aa, Micrurus spixii
QEGLVFFEDVAVYFSEEEWTELDPDQKALHREVMLENYRNVASLGDDEQDHKEPRESFQGFRHGDVMEKRAIQTKFQRQKR

SEQ ID NO: 9011 - protein, 81 aa, Micrurus spixii
IPVSFEDVIIFFSVEEWALLDFDQKSLYREVMLENAKNVESMGDRGEPEYYKEPGVSSLEKTETTKGIFQNQKKPNVTEEH

SEQ ID NO: 9012 - protein, 81 aa, Pantherophis guttatus
GSVTFEEVAVYFTEEEWALLDPSQRALHEEVMLENSRNVAALAYGQAHENNKEPSLALFQGIQSENGMVGNRGAAPKSAKS

SEQ ID NO: 9013 - protein, 81 aa, Pantherophis guttatus
LVSFEEVAVDFSEEEWSLLDSDQKALHSEVMLENYRNVVSLSNNGQENQHFCELFQVINAKDGTEKFGIRMELETHDRNQS

SEQ ID NO: 9014 - protein, 81 aa, Patagioenas fasciata
QDAVTFKDVAIYFSPEEWVRLSAGQRELYQEVMLDNYELVTSLDRECKLLYKMDPEEEPCEGVPCRGVDSGALDNSSTSAC

SEQ ID NO: 9015 - protein, 81 aa, Micrurus spixii
PKVPMTFEDNAVYFSEQEWGNLEEWQKELYKNVMKSNYESLVSLDYAIAKPDLLSRIEQGERPCAEEEEATMTDRVIPSEP

SEQ ID NO: 9016 - protein, 81 aa, Micrurus spixii
DVVCFEEVAVYFSEEEWSQLDADQKELYREVMVENSRNLLSLGFNGQEKKNCKEECQAIHSKGGKRKFVDQMQLKNDETKQ

SEQ ID NO: 9017 - protein, 81 aa, Micrurus lemniscatus
PKVPLNFSDTSVHFNEQEWKNLEEWQRELYRTIMRSNYDMLVSLDHAISKPDILSQMDQGEEVRMEESEVLENREIPKDPS

SEQ ID NO: 9018 - protein, 81 aa, Micrurus lemniscatus
QGSVSFEDVAVYFTEEEWALLDSSQRALHREVMQENSRNLAALGYGQEHENYQEYNFTLLQSEEKMLGIQRLLQKSMKSCL

SEQ ID NO: 9019 - protein, 81 aa, Aquila chrysaetos
AQEPVTFEEVAVYFTKEQWALLDPVQRTLYLDVMLENYETVMSLGLPTARLDLLTQMQEGGERWGPDLQEMEKKEALSSRR

SEQ ID NO: 9020 - protein, 81 aa, Patagioenas fasciata
PKVPITFDDISVYFNEQEWERLDRWQKDLYRAVMRGNYETLISLDYAVSKPDILARMERDEELFVRDGREPPLTGAADGLE

SEQ ID NO: 9021 - protein, 81 aa, Patagioenas fasciata
WQEPVTFEDVAVYLSHAEWDAMAEEQRELYRSVMLDNYQLLTSLGYPGPKPDIVYRLERGEEPWGCAPQSPLSWDGPRSPS

SEQ ID NO: 9022 - protein, 81 aa, Micrurus spixii
AQRVVELPNQSLKIFFTYGNQNWIQYSKYGLNKENLVSFEEVTVHFSEEEWSQLDSDQKDLYSEVMLENHRNVVSLGKSFL

SEQ ID NO: 9023 - protein, 81 aa, Micrurus spixii
QDLVSFEDVAVFFSMEEWALLDSEQKALYREVMLENKRNMASLDPLMAFSSSPGSSVLCNGGSTAAELPTQDLVSFEDVAV

SEQ ID NO: 9024 - protein, 81 aa, Micrurus lemniscatus
RRIPWEDQSQDTSGEKQRMKLSSFYDGDQTAVEPPNQEGLVSFEEVAVYFSEEEWSQLHPDQKALHSEIMLENHRNVVSLG

SEQ ID NO: 9025 - protein, 81 aa, Patagioenas fasciata
PKVPVAFNDASFNFEEEDWKSLNEWQKELYRHIMKGNYEAVISMDAAISKPDLLSRIEQGEDPNVEDQDDSEGGETPTEPS

SEQ ID NO: 9026 - protein, 81 aa, Patagioenas fasciata
PKVPVTFDDVSVYFNAKEWEKLEEWQKELYKNVMKGNYESLISLDYAISKPGVLSQVEQGEEPRVRTEQDLEESEIMTDAT

SEQ ID NO: 9027 - protein, 81 aa, Patagioenas fasciata
MSVTFDDVALYFSPEEWAKLSGCQRQLYREVMLENYEMVASLAVGPLVQREPEVVLVGLPAPTTPLPGMEHGDSVCDQPGG

SEQ ID NO: 9028 - protein, 81 aa, Micrurus spixii
QDLVSFEDVAVFFSMEEWALLDSEEKALYWEVMLENKRNMASLDPLMAFSSSPGSSVLCNGGSTAAELPTQDLVSFEDVAV

SEQ ID NO: 9029 - protein, 81 aa, Micrurus spixii
FEEVAVYFSEEEWSQLDADQKELYREVTVENSRNLFSMGFNGQANKNCKEEPQAIHPKGGKRKFVHQKQPKNDECGKIFCS

SEQ ID NO: 9030 - protein, 81 aa, Micrurus spixii
FFSVEEWALLDSEQKALYREVMLENKRNVACLGQDTVLFHQLFLRLEVSSQGKQPSSTQAQNGGDGWEMEDSGQEAAAPLH

SEQ ID NO: 9031 - protein, 81 aa, Micrurus lemniscatus
VSFEDVAVYFSKEEWSQLNADQKALHGEVMLENSRNLFSLGFNEQENKNCNEECQAIHLKKEKGKFAGQMQSNSDETKQSQ

SEQ ID NO: 9032 - protein, 81 aa, Micrurus lemniscatus
VQDFVTFEDVAVYFSADEWSQLDPDQKALHKEVMLENYRNVASLVALQRMKKEQIPSVRISEKPRSESVVSELAFDNMKQS

SEQ ID NO: 9033 - protein, 81 aa, Micrurus spixii
QNLVSFEDVAVFFSMEEWALLDSEQKALYRKVMLESKRNLAFLRPLMAFSSSPGTSVLCSGRSTAAELPTQIFNIMSKKRR

SEQ ID NO: 9034 - protein, 81 aa, Micrurus spixii
DDPYQDTTRGKNSRMLTVRDGGAETMVETPIQEGLVSFEEVAVYFSEEEWSELDPDQKALHWEVMLENHRNVASLGDNGQD

SEQ ID NO: 9035 - protein, 81 aa, Anolis carolinensis
MAKTVSAQIEQDLLASDQGSLYREVMQESYNTIFMASPLQTSELLAHLERRQESWDPDLQSSESATAAAEADAAATTTEAT

SEQ ID NO: 9036 - protein, 81 aa, Anolis carolinensis
VQALMGFEEVAVSFSEEEWALLDPDQRALHQDVMKEQHRGTISLRFIVSNSELVKGITQVPNHKKDTRYIHEHTIDKQIHT

SEQ ID NO: 9037 - protein, 81 aa, Gallus gallus
PKVPVTFVDIAVYFSAEEWKNLEEWQKELYNNLVKENYESLISLDAALSRSDAQPRLERGDVPCVPDQQDLEQREMPPDAC

SEQ ID NO: 9038 - protein, 81 aa, Anolis carolinensis
PFSQVSFEDVVVYFSEEEWRLLDEEQIALYKEIMMETYKNVAFLKATPVAPDTHTHTHTHTHTNNLWRKKERKKNEPVSRD

SEQ ID NO: 9039 - protein, 81 aa, Anolis carolinensis
FLQVTFEEVAVFFSEEEWALLDPGQWALHREVMEENLGLVSSLGEILLRETQLEIPNNCEDDIMCELLLRFPPTRQRDFWG

SEQ ID NO: 9040 - protein, 81 aa, Anolis carolinensis
DQSLFIIDEVAVSFSPEEWALLEPDQRALHKQIMAEIHEIMAFLAMVEVECDLLYAAENWRKTYACAKYGMCSRQILDLSS

SEQ ID NO: 9041 - protein, 81 aa, Gallus gallus
MEPYVLLDPRQRALYRDVMQESYQTLISHLERHRRLHRGEKPYWCGLCGKGFAWSSHHDRHRLTHTGEKPFSCAQCGKGFG

SEQ ID NO: 9042 - protein, 81 aa, Anolis carolinensis
NQCLVMFEEVAVNFSPEEWALLDSDQRALHREVMEENHEIVTSLGGHERSLPQDGGNWKKMDLDDKFDLARHQQTHTEENL

SEQ ID NO: 9043 - protein, 81 aa, Anolis carolinensis
RQGPIAFEEVAVHFSPEEWVLLTPDQKGLHVEIMEEIHGIVDSLGKTPSSRGISNRRRQKKKPGWAEQQIGSGAYHTHPSL

SEQ ID NO: 9044 - protein, 81 aa, Gallus gallus
CQEPVSFAEVAVYFSREEWALLDPAQRALYRDVMLETYQCVAWLASLPAPKPGLISLLEGGEDPWIPGVRSPEAMPGDLSP

SEQ ID NO: 9045 - protein, 81 aa, Gallus gallus
QVPASGEDDAACLPEQEWGGVDSRQQELYRMAVKGSYEAVVSLGPGDTNSKPALLLSTEDGEDSASRTHGLLEEGAVLGHS

SEQ ID NO: 9046 - protein, 81 aa, Anolis carolinensis
MQVAFEEVVVFFSEQEWALLNLNRRALYWDVMQENYENVISLGFPVTRPSTTTDLEQDEELWGLQFQGHQEQGIFTDPFGA

SEQ ID NO: 9047 - protein, 81 aa, Anolis carolinensis
VTFEDVAMYFSEDQWTLLDPDKRTLYKEVMMENYANVSALEGILLPKPELISWLEQRKEPWVQDLQELNEIENVSTCSVLI

SEQ ID NO: 9048 - protein, 81 aa, Anolis carolinensis
YGLIAFEDVSVHFSLEEWVLLNPDQIVLHLQIILLLCHHNCSLFIYSHYLVSSQFSQLMPYNPEYQGLENPTISVQSWKWN

SEQ ID NO: 9049 - protein, 81 aa, Gallus gallus
KPSGGHPPGQRPSPAGRPSPTEPGTPLPSRFAEVAVYFSREEWALLDPAQRALYRDVMLETYQCVAWLGEGFAAFPAFPPR

SEQ ID NO: 9050 - protein, 81 aa, Anolis carolinensis
GPIALEDVAVDFSLEEWVLLNPDQKALHKQIMEEIFNNIIYSALSPLRGEKGGIEIEDKDEIMGSWMNEDDQYEITDEEIV

SEQ ID NO: 9051 - protein, 81 aa, Anolis carolinensis
QVTFEEVAVDFTEEEWALLDPGQRALQMEVMEENFRLLFSLGKSTSFLFLMTDASETRDIHNLTDHQSISNEKTLVPFPIW

SEQ ID NO: 9052 - protein, 81 aa, Anolis carolinensis
RNVMFEDVAVHFSEAEWALLNTDQRSLHREVMEENYRMVSSLGDDGQGSENGGAPNKMWLKTGRRKKEAERSPRIEVEGYN

SEQ ID NO: 9053 - protein, 81 aa, Gallus gallus
STYLRSLSFAEVAMYCSREEGALLDAAQQTLYQDVTVETYGSVASLAPKPMVISVLEGEEGPSIPDVHSLKDTAGDLSPAG

SEQ ID NO: 9054 - protein, 81 aa, Anolis carolinensis
HFVQEPVTFEDVAVYFTKEEWNLLDPKQMALYREVMMENYENVSSLVPKPELISQMEQKREPWVPDAQDGGEVENSDIRSG

SEQ ID NO: 9055 - protein, 81 aa, Anolis carolinensis
PQEPLTFEDVAIAFAPKEWAQLVGWQKALYHEVMRDNYETLRSLELVEHKPEILLRMERGEAPWAGGENPAGLPCHAGDQK

SEQ ID NO: 9056 - protein, 81 aa, Anolis carolinensis
LLFQVTFEDVSVYFSEEEWALLDLDQQALHWVVMGENYKTLASFGFCFLMPSYCFSFLQGVAEKESENVGAPCKVWLETNS

SEQ ID NO: 9057 - protein, 81 aa, Thamnophis sirtalis
QAQPISFEEVAVCFSKGEWSLLGPSQRVLYKEVMQENYENVTSLVISLTGLGPNSWMEEEDEAILGLRSQVSEKGNNQVVS

SEQ ID NO: 9058 - protein, 81 aa, Thamnophis sirtalis
NFWILRFPPGTKGEATKVPLLFDDVACNFLEQEWSGLNESEKVLYRHIMMHNYQVVVSVGKSGLASGLGPQRSAAGISETN

SEQ ID NO: 9059 - protein, 81 aa, Thamnophis sirtalis
MYFAEIQWALLDPCQRPVYRDIVQDNFGTLLSLDGGTMNTNSQPGGPEGMQKQVQGRPESSAYGGQPSAGQPSEEAGKGWV

SEQ ID NO: 9060 - protein, 81 aa, Anolis carolinensis
MAVSFSEEWALLDPDQRAFYQQVMKENVETVSSLTTDREGESSQYQDCGEKKELGLSGQQATYAKRKPFKCLVCGKCFCNK

SEQ ID NO: 9061 - protein, 81 aa, Anolis carolinensis
AQNPVTFEDVAVYFTDEEWALLDPSQKTLYRNAMFDNYETVTSLERLLSFKPVLISWLEEDRDKEKLIQSSAEKERFTGDG

SEQ ID NO: 9062 - protein, 81 aa, Anolis carolinensis
LVAFDDIAIYFTQEEWDLLDLEQRSLYEEVMTESYKIVSSLDNQRGANTCAMCWRCFLQRLDHSTHRRIDTEASDAKEQPY

SEQ ID NO: 9063 - protein, 81 aa, Anolis carolinensis
VLQVRVSFAEVAVLFSEAEWGLLGPEQRSLYKEVMMENYGHTTSPGSPKPALISRLEDGGDPFDLGWMDRDGPAVGKLKPG

SEQ ID NO: 9064 - protein, 81 aa, Thamnophis sirtalis
NGGLTAVELPMQDLVSFEDVAVVFSVEEWALLNSKQKALYQEVMLENKRNMASVGDGWEMEDSGQEAAAPLPKDKNNVAEK

SEQ ID NO: 9065 - protein, 81 aa, Thamnophis sirtalis
WKRLVSFKDVAVYFTEGQGALLDPAQRALYKEVMVENYENMASLGFPVPKPNLITRLEQGEPPWRLDFQGVDANNSGALGK

SEQ ID NO: 9066 - protein, 81 aa, Thamnophis sirtalis
VTFEDVVVGFSLEEWSLLEDSQKELHQEVMLETCSLLLSLGHSVPTLGFSSLTCQPDGTTKTLLRSSWRRQLPLVAGGNKT

SEQ ID NO: 9067 - protein, 81 aa, Anolis carolinensis
EDLVTFEEVAVHFTKEEWALLDPGQRALYKEVMEETCRIVASVGFSLIPPYYPRYSLIQASAGPFSLDKERKEEKQQSGAK

SEQ ID NO: 9068 - protein, 81 aa, Anolis carolinensis
EVTFEDVAVNISKEEWDLLDPNQRSLYIDVMMENYETLSSLVFFVSFFLADNWKRMSIRVDGTYEAGFTQKLDPPGAEPLQ

SEQ ID NO: 9069 - protein, 81 aa, Anolis carolinensis
MEPWVYLDPRQRALYRDVMQESYETLMSLAADKLLNSNNNDEEDDDDDDEEEEDEGPEELRPGTSQSTPRRKSLESRCSDC

SEQ ID NO: 9070 - protein, 81 aa, Anolis carolinensis
VTFQEVAVSFSVEEWALLDPDQRALHQQVMKENLETVSSLNMCSHFLYCQETHREGESSQYRDCGEKKELGLSDQEATRKA

SEQ ID NO: 9071 - protein, 81 aa, Anolis carolinensis
FVQVTFQEVAVSFSEEEWALLDPDQRALHQQVMKENVETVSSLSKAPSFISTLLIDSEFKHPSHNLKQHRAIHTGEKPYTC

SEQ ID NO: 9072 - protein, 81 aa, Anolis carolinensis
FQRPLTFKDVAVYFTEGQGSLLDPDQKALYKEVMMENYENVASLGLLLSKPTLIFHLEQGEEPWLPDTRPFRNSYSVVYDH

SEQ ID NO: 9073 - protein, 81 aa, Anolis carolinensis
VNIEDVSVHFSKEEWTLLDRHQQALHWEVMGENYKMLASFVFLYKLHTNTQTIQSFFCSFSMSYHNNSLSPKGPGVAVCGV

SEQ ID NO: 9074 - protein, 81 aa, Anolis carolinensis
VAFQDVSVYFTQEEWDLLEEDQRALYYSVMQENSENVASLVLFCDPELQLSEPEDCEHDTVIQIGQKEKIMESKEEENPKG

SEQ ID NO: 9075 - protein, 81 aa, Cathartes aura
LFLQFVLEQHALLHPPGYPGPKPDILYRMERGEEPWVCTPQSPARWDGPDSPPPGRDGDVSWLEEPPSGWWPGAGGRRVLE

SEQ ID NO: 9076 - protein, 81 aa, Anolis carolinensis
VTFEDVSVHFSEEEWALLDPDQQALHWEVIGENYKTLASFGKDPSSSWSSFSREERERLEEASRKWPVIAAAAVLVGSFQG

SEQ ID NO: 9077 - protein, 81 aa, Anolis carolinensis
LFQSLVTFQDVAVFFTKQQWTLLDQNQRALYWEVMRENYDNVASLAGFPLAKPELISRLEQDPWFPDCLVLEKISPGIWGY

SEQ ID NO: 9078 - protein, 81 aa, Anolis carolinensis
PKVPVTFDDVSVYFNDKEWEKLEAWQKELYKNLMKENHESLISLDYAISKPGVLTQTEPGPDGDEQDSEEQGSPPDPTTAG

SEQ ID NO: 9079 - protein, 81 aa, Anolis carolinensis
MEQYVLLDPRQRALYRDVMQESYEMLMALEFPLPKTDLLSQLERGNEATFDLQAPGNLPPVTALVNENIEDENSVQDVAKE

SEQ ID NO: 9080 - protein, 81 aa, Anolis carolinensis
HKGPVTLQDVAIHFSIEEWALLDPDQRALHAQIMEETRGIMASLETLPRGCPDMLPSGWEASLMSPYDAVDICTHMPPMDP

SEQ ID NO: 9081 - protein, 81 aa, Anolis carolinensis
DQVTFEDVFVHFSEEEWALLDPDQQALHWEVMGENYKMLASFVLEMRSVSEVLLHRIMLDHNPVAWVLFNRTGTFKSELCI

SEQ ID NO: 9082 - protein, 81 aa, Thamnophis sirtalis
PKVPVTFDDMSVYFNEKEWEKLEEWQKELYKNLMKGNHQSLVSLDYAISKPGVLSQTERTTDEQDSEEQGRLPDPTAAGIR

SEQ ID NO: 9083 - protein, 81 aa, Thamnophis sirtalis
NHMSFEDIAIFFSEEEWDLLNPDQKLLYREITLENARNMTSIGERWEDDDSKEEMIEHLPSVKNEIGERMFQCQWGVQSPE

SEQ ID NO: 9084 - protein, 81 aa, Thamnophis sirtalis
NTSGKEKLPFINCSPFSGGVERSAELVTQVLVLFEEVAVHFSKEEWSWLNPDQKALHREVMLENTRNVAFLAGMPLLTKVI

SEQ ID NO: 9085 - protein, 81 aa, Micrurus corallinus
NSISFEDVAVFFSVGEWALLDLEQKDLYQEVMLDNARNLASLSDEWQIEASGQEEAAPLPKGIKEVVERMFGKKASEENQL

SEQ ID NO: 9086 - protein, 81 aa, Micrurus corallinus
TISFKDVVIYFTKEEWALLDPDQKVLHEEIMLETCRNVAFLSNERKNKQETEREPSRVIKVEVGGETFQNQCPSKNQEEIQ

SEQ ID NO: 9087 - protein, 81 aa, Micrurus corallinus
ELPQVAFEEVAVHFTEQEWALLNVGEKVLYKDVMQENFEHVMSLGILLALKESKIAPCLLLVTPYSSSVAFHQVSFEEVAM

SEQ ID NO: 9088 - protein, 81 aa, Micrurus corallinus
FAFVRPSCSGGTEGVAEAPAQVAEQISEDVGNHIPKGLVSFEDVAVYFSEEEWSQMDAHQKALHKEVMLENSQNVASLARE

SEQ ID NO: 9089 - protein, 81 aa, Micrurus corallinus
KNSISFEDVAVFFSVEEWALLDLEQKTLYQEVMLENARNMASLNTSVFLTDDDNQEKEVCTGCGKMLRDKLGLCDCCKSHT

SEQ ID NO: 9090 - protein, 81 aa, Thamnophis sirtalis
MERFSLYGEAETVAVLPIQIPVSFQDVTVFFSEEEWALLDFDQKSLYREVMLENAKNVESLGKRFAFFWVQINGEVYSDER

SEQ ID NO: 9091 - protein, 81 aa, Thamnophis sirtalis
GSVSFEDVVVYFSEEEWALLDSSQRALHREVMLENSRNLAAVGYGQEHKDYQGPSLALFESVEKMFGIQGVLQKRAKSFLK

SEQ ID NO: 9092 - protein, 81 aa, Thamnophis sirtalis
QAPPFSFEEVAVYFTEVEWTLLDAEQRDLYWDVMQENYETVASLAVAIPKPELICRLERGEEPWIPAQAASEEKKIPLNLY

SEQ ID NO: 9093 - protein, 81 aa, Thamnophis sirtalis
AQDSVSFEEVAVYFTEDEWALLDPSQRALHGEVMLENFRSVAALAYGQEHENYRDQMIKSEVDMLVGQEPSQRIKKICKVS

SEQ ID NO: 9094 - protein, 81 aa, Thamnophis sirtalis
VTFDEEQAVHFSTPEWAKLEDWQKELYRNITRGSYEPLVSLDSAIAKADVLPPQAALGVAPHIADQPLAVGKGLPPAAKPA

SEQ ID NO: 9095 - protein, 81 aa, Thamnophis sirtalis
PKVPMTFEDNTVYFSEQEWGNLEEWQKELYKNVMKSNYESLVSLDYAIAKPDLLSRIEQGERPSAKEEEAAVTDRVITSEP

SEQ ID NO: 9096 - protein, 81 aa, Thamnophis sirtalis
ELPQVAFEEVAVHFTEQEWALLNVGEKVLYRDVMKENFEHVMSLGILLALKESKIAPCLLLVTPYSSSVTFRQVSFEEVAM

SEQ ID NO: 9097 - protein, 81 aa, Thamnophis sirtalis
QGSNPFEEVTVDFTEEEWMLMDSDQRVLCREVTLEAFRNIIDLSDAMEKENQEWLMSLPTANYEGEVTFDHQTNPKIQEES

SEQ ID NO: 9098 - protein, 81 aa, Thamnophis sirtalis
LESFVSFEEVAVYFSEEEWSQLDPDQKALHSEAMLENHRNMVCFAHFLHQMKTECRFFNGTQRVRFVDRQMYNRQEFVRFD

SEQ ID NO: 9099 - protein, 81 aa, Thamnophis sirtalis
LVSFEEVAMYFSEEEWSQLDPDQKALHLEVMLENHRNVVSLGINGQKNQDSRELFQVISAKDGTEKFGIQMEFESNERNQS

SEQ ID NO: 9100 - protein, 81 aa, Thamnophis sirtalis
MLEEVSVTFSEEEWALLDPDQRALHRDVMAENSGITSSLGCDWPESENGEIHEILFGKIGSEEEDKQRPDTEAGRVKDESP

SEQ ID NO: 9101 - protein, 81 aa, Micrurus corallinus
LVSFEEVAVYFSEEEWSQLNPDQKALHLEVMLENHRNVVSLGNNGQENQDSCELFQVISAKDGTETFGIQMEFESHERNQS

SEQ ID NO: 9102 - protein, 81 aa, Thamnophis sirtalis
RLFTLEDVTVHFTQEEWALLDPAQKALHREIIEEIKGILASLGDEWRIRDKSIPNTNQRFRLEGKPYRCSECGKAFATKTN

SEQ ID NO: 9103 - protein, 81 aa, Micrurus corallinus
VSFEDVAVYFSKEEWSQLDADQKALHGEVMLENSRNLAFLGFNEKENKNCNDECEAIHLKKEKGKFAGQMKSNSDETKQSQ

SEQ ID NO: 9104 - protein, 81 aa, Micrurus corallinus
AQGFVSFEEVAVYFTEEEWALLDPSQRALHEEVMLENSRNVTALGKPRLWMETTETSPPCGGAATSQGLASFEEVVVYFTE

SEQ ID NO: 9105 - protein, 81 aa, Micrurus corallinus
VKWPVAFEEVAVYFTPEEWDLLNEEQRILYYTVMQENSENVTSLELLISKPDPRLHLDWEEVSQMADLHTLKGKDTIDQGF

SEQ ID NO: 9106 - protein, 81 aa, Thamnophis sirtalis
PKVPVTFDDMSVYFNEKEWEKLEEWQKELYKNLMKGNHQSLVSLDYAISKPGVLSQTERATDSCHRHDQDSEQQRSLPDAT

SEQ ID NO: 9107 - protein, 81 aa, Thamnophis sirtalis
LPQDLVSFEEVAVYFSEEEWSQLDPDQKALHGEVMLENSRNLASLGKHLTRPVVSCQFSGSGAHAHKRPGGWAEPSAATTT

SEQ ID NO: 9108 - protein, 81 aa, Thamnophis sirtalis
VPMTFEDNTVYFSEQEWGNLEEWQKELYKNVMKSNYESLVSLDDEVAQTSFRSQGKRDLERNLEGPDLLDKGEMHVRPNMG

SEQ ID NO: 9109 - protein, 81 aa, Thamnophis sirtalis
MKSNYEMLVSMDYAIAKPEILTRIEQGDSLYDTTVETMSENDTPAHPGTESPVAPVDVSLWLKEEVEGPQGGGIIRPPEEI

SEQ ID NO: 9110 - protein, 81 aa, Pseudonaja textilis
QGLFTLQEVAVHFTKEEWTLLEPDQKAPHRETMEEISGILQVGCWCGNPCRTPSIYVFSPPGECGKCFSQSGILTAHQAMH

SEQ ID NO: 9111 - protein, 81 aa, Pseudonaja textilis
MLEEVSVTFSEEEWALLNPDQRALHRDVMAENSGIASSLGKFPLKKKKGWCCDSGIGIYSHVEKSFLSEHLEAKRNLPVRE

SEQ ID NO: 9112 - protein, 81 aa, Pelodiscus sinensis
AEPVTFEEVAVYFSEEEWALLDPGQRALYWDVTQENYEAVNWLVDVFVGDTVQQSAHLPQGISWAIPDAGRCTFTAAGNGT

SEQ ID NO: 9113 - protein, 81 aa, Pelodiscus sinensis
MAVVEPVSFEEVAVYFSEEEWALLDPGQRALYWDVMQENYEAVNWLVSKAYVISWVVRGKELWIPDLQGCEEGEIISDTHT

SEQ ID NO: 9114 - protein, 81 aa, Pseudonaja textilis
VSFEEVAIHFNNEEWLLLDPNQKTLHREVMLETSRIVDSLGKGSFRGKLSQTGETLNESSRLSFVQSPPPLDETKARGFLQ

SEQ ID NO: 9115 - protein, 81 aa, Pseudonaja textilis
AMAVDFTPEEWALLDWSQKALWREVMLEIFLNIAALGKTRSLLHSLEIFRDRKSGNIFLCIGLGSQAKRKQYGCGQYERNV

SEQ ID NO: 9116 - protein, 81 aa, Pseudonaja textilis
FSGSQQREVSVTFSEEEWALLNPDQRALHRDVMAENSGIASSLGKDYIALHCINFRERTENVRLHFIIYQKSFCFSLLSGS

SEQ ID NO: 9117 - protein, 81 aa, Pseudonaja textilis
DGFGQSRTICIGWGLNYSPFEWFQALVSFEEVSMYFSEEEWRLLDESQRKIFTKVMMENYENVRELGESWTGLGKCNGLGE

SEQ ID NO: 9118 - protein, 81 aa, Pseudonaja textilis
WMCCSNPAALRNILSLPPQGPVTFEEVAVRFSKGEWGMLDPEQRALYRDVMITFSSVARRGGASAAILGLCVRRSVCIWSC

SEQ ID NO: 9119 - protein, 81 aa, Pseudonaja textilis
PKVPLNFSDASVHFNEQEWRNLEEWQRELYRTVMRSNYDMLVSLDHSISKPDILSQMDQGEEIRIEESEVLENREIPKDPS

SEQ ID NO: 9120 - protein, 81 aa, Pelodiscus sinensis
VAEPVSFEEVAVCFSEEEWGLLDLGQRALYRDVMQENYEAVSWLAFPLSKPQDLFSVVLGQQVWHLLSAGTEEALTFGQEG

SEQ ID NO: 9121 - protein, 81 aa, Micrurus corallinus
LFFRRIPWEDPSQGTSGEKQRMKLSGFYDGDQKADEPPNQESLVSFEEVAVYFSEEEWSQLDPDQKVLHLEVMLENHRNVV

SEQ ID NO: 9122 - protein, 81 aa, Micrurus corallinus
SQEMFFRRISQDDPNQDRTRGKNRRKFTVPDGGTETMIETPIQEGLVSFEDVAVYFSEEEWTELEPDQKALHREVMLENYR

SEQ ID NO: 9123 - protein, 81 aa, Pseudonaja textilis
MSFEEVAVYFSKEEWSQLDAGQKALHREVMLENSRNLASLTIHLKEGKEKRYQCMECGKTYIHTSSLNSHKRIHTEEKPYQ

SEQ ID NO: 9124 - protein, 81 aa, Pseudonaja textilis
GLVSFEEVAVYFSEEEWSQLDPDQKVLHLEVMFENHRNVVSLGKSFLKIRKKYPGKSVNLFKGKIQLNEHYYTPNKREDAI

SEQ ID NO: 9125 - protein, 81 aa, Pseudonaja textilis
SLVGGSKGGGPTASYLCSSGAWTSFSSPRNLAWSGAVYFSEEEWSQLDPDQKALHSEVMLENHRNMVSLGKTFRTVLSFVL

SEQ ID NO: 9126 - protein, 81 aa, Pelodiscus sinensis
AEPVTFKEVAVYFSVEEWALLDPGQRALYWNVMQENYEAVSWLGCKTRMSCSSAARGLQSQGKEMAAVELVTFEEVAVYFS

SEQ ID NO: 9127 - protein, 81 aa, Pseudonaja textilis
ENLVSFEEVAVYFSEEEWSQLDPDQKALHSEVMLENHRNVVSLGKCFLEKFPEKIRKKYTGKSVKLIKAKVQVNEHYLTQN

SEQ ID NO: 9128 - protein, 81 aa, Pelodiscus sinensis
VTFEEVAVYFTRAEWALLPPAQRALYRAVMQENYEYMTSLDLTLPCLSITPTCCATHVLLSKGKTSKKNICRSQEKHSTHY

SEQ ID NO: 9129 - protein, 81 aa, Pelodiscus sinensis
VVEPVNFEEVAVYFSEEEWALLDPGQRALYRDVMQENYEAVSWLGIPVSKAHVLSWMERGEELQILDLQGCEEGDGMLNEN

SEQ ID NO: 9130 - protein, 81 aa, Callipepla squamata
SQEPVSFEEVAVYFSREEWALLDPAQRALYRDVMLEMYECVASLAPLPGPKPMVISLLEEGEEPGSQMWVALRPWQEMSAH

SEQ ID NO: 9131 - protein, 81 aa, Callipepla squamata
PSVPVTFRDVFVQFSRDEWALLDDEQKELHQSVMQSNYEVLMSLYCDLAKPEVLLQMERGEPCLPAEPDLQGAAVSLNPAA

SEQ ID NO: 9132 - protein, 81 aa, Callipepla squamata
LQEPVSFEEVAVYFSREEWALLDPAQRALYRDVMLETYECVASLAPLPAPKPMVISLLEEGEEPWVPDVGSPEAVAGDVSP

SEQ ID NO: 9133 - protein, 81 aa, Callipepla squamata
EPVSFEEVAVYFSREEWALLDPAQRALYRHVMLETYECVASLAPLPAPKPMVISLLEEGEEPWIPDEGSRQAVAGDVSPGE

SEQ ID NO: 9134 - protein, 81 aa, Callipepla squamata
PKVPLTFDDIAVYFNEEEWERLDSWQKDLYKAVMRGNYETLVSLDYAVSKPDILSRIERGEELFVKDCWESPQTSNQVSPE

SEQ ID NO: 9135 - protein, 81 aa, Callipepla squamata
WQEPVTFEDIAVYLSRAEWDVVSEEQRELYCSVMLDNYELLASLGYPGPKPDIVHRLERGEEPWVSTPQSPVKWDGPDRSL

SEQ ID NO: 9136 - protein, 81 aa, Callipepla squamata
MSFEEVAVYFSREEWALLDPAQRALYRDVMLETYECVASLAPLPAPKPMVISLPEEGEEPWIPDVGSPEAVAGDVRPGEVV

SEQ ID NO: 9137 - protein, 81 aa, Alligator mississippiensis
PKVPVTFDDVSVYFNEKEWEKLEEWQKELYRNVMRSNYESLISLDYAISKPGTLSQVEQGRESSIGDQQDLEEREIITDPS

SEQ ID NO: 9138 - protein, 81 aa, Alligator mississippiensis
LREVFEDVAVYFTRKEWELLEDKDKVLYRDQMLRNFQALVSLGKTLVLASPWTYVYSEFYCLLPVFQQSHPHAPLTGLLCQ

SEQ ID NO: 9139 - protein, 81 aa, Alligator mississippiensis
DPGQLHKGQDKLPKQKLREAFEDMAVYFTRKEWELLEEEDKELYRDLMLRNYQALLSLDHCISTSVPGDHGSSTREINATQ

SEQ ID NO: 9140 - protein, 81 aa, Alligator mississippiensis
GSLSPEPSKLQQGQGKLAKQVETTELQEAFEDVAVYFTREEWELLEDAQKGLYRDQMLRNWRALVSLGKVFSGFSPQPCQR

SEQ ID NO: 9141 - protein, 81 aa, Alligator mississippiensis
TQVPVMFAEVAVVFTTAEWALLDESQRMLYRETTLETYQNLASLGVPVLKPHVVTCLEHGEEPVVVAAQGPGDVETSAGTC

SEQ ID NO: 9142 - protein, 81 aa, Alligator mississippiensis
SPQKKQASLELQEVFEDVAVYFTQKEWELLEDEDKVLYQDQMLKNYQALVSLGKTLVLASLWSYVNTQVLQSLPVSTVSSL

SEQ ID NO: 9143 - protein, 81 aa, Callipepla squamata
LQEPVSFEEVAVYFSREEWALLDPAQRALYRDVMLEMYECVASLGEGFAAFPPLLGTLGCAECASARGPQSKPHAVPSRET

SEQ ID NO: 9144 - protein, 81 aa, Pantherophis guttatus
SDDISDGKNKTNLTPFYGGAEILVEAPKEALMSFKEVAVYFSEEEWSQLDADQKALYREVMLENHRNVASLGENIKELLSE

SEQ ID NO: 9145 - protein, 81 aa, Pantherophis guttatus
SFEVNLAVNFTSEEWLLLDPSQKALYQEVMLETSRMVASLVDDPDTENYQEPGVVPSQIIKIEIQGDTTADKCDKGRNEEN

SEQ ID NO: 9146 - protein, 81 aa, Pantherophis guttatus
DLVSLEDVAVFFSVEEWALLDSEQRALYREVMLENKRNVASLAGDGWEMEDSGQEAAASLPKDKKEVAEKIYGKQSSEESQ

SEQ ID NO: 9147 - protein, 81 aa, Pantherophis guttatus
RLFTLEDVAVHFTEHEWALLGPEQKALHREVMEEISGIVASLGNKWRIMDKSKPSTNQRFRLEGKPYKCSECGKAFATKTN

SEQ ID NO: 9148 - protein, 81 aa, Pantherophis guttatus
QTQPVSFEEVSVCFSKGEWSLLGPSQRVLYKEVMQENYENVTSLVLSLTGLGPNSWMEEEDEAVLGLRSQLSEKGGNQDVS

SEQ ID NO: 9149 - protein, 81 aa, Pantherophis guttatus
PQDVVSFDDVAVYFSKEEWSQLEADQKVLHREVMLENSRNLASLVAVYFSKEESSQLDADQKTLHGEVMLENSWNLFSLGL

SEQ ID NO: 9150 - protein, 81 aa, Alligator mississippiensis
PWGEQLGVPDKCVVMHEEWAELAAWQRELYRDVMMDNYELVASLGSAGPKPEVICQIERGEEPHVGAPQGERDGGIPEAPG

SEQ ID NO: 9151 - protein, 81 aa, Lepidothrix coronata
PKVPLTFDDISVYFNELEWERLERWQKDLYRAVMRGNYETLVSLDYAMSKPDILSQIERDEELGDKEDQEPPWTRAGDRQE

SEQ ID NO: 9152 - protein, 81 aa, Pantherophis guttatus
FRRIPWEDPSPDTSGEKQRMKLSGFSDGDQTAVDPTNQESLVSFEEVAVSFSEEEWFQLDPDQKVLHSEVMLENHRNVVSL

SEQ ID NO: 9153 - protein, 81 aa, Pantherophis guttatus
TQNLVSFEDVAVFFSMEEWALLDLEQKALYREVMLENKRNMASLGQDTVLFHQLFLRLEMSSQRRQPSSAPAQYGAGDGWE

SEQ ID NO: 9154 - protein, 81 aa, Pantherophis guttatus
WRLFTLEDVAVHFTEHEWALLEPDQKALYREVMEEISGILATLEGDKREIEADGESPTNQTYKYLICGNGFRQKAELNSHQ

SEQ ID NO: 9155 - protein, 81 aa, Alligator mississippiensis
AQRWEAFEDVALYFTQKEWELLRDGDKVLYQEQMLRNYQALVSLGYQGPTPDLICRIQRGDMELWVCDDEDPKESMWSEGL

SEQ ID NO: 9156 - protein, 81 aa, Notechis scutatus
GLVSFEEVAVYFSEEEWCQMDAHQKALHEEVMLENSQNVASLGAHEQENEGCKEPFQEISQKKEERLKEREKPVKKRKKNK

SEQ ID NO: 9157 - protein, 81 aa, Notechis scutatus
GPGDADATELLQTSLEPGSFSSDRGMTARPLSQELLSFEDVAVHFTDEEWMLLDAGQQDLYREVMAENSGMVASLSKDPWA

SEQ ID NO: 9158 - protein, 81 aa, Pantherophis guttatus
RPGQVTFEDVAVYFSREEWEELSEWQRELYQAVMMENYEAVLSLGPLPIKPRIINQIEQKEAVVTGELWKPCKWTEAQDQW

SEQ ID NO: 9159 - protein, 81 aa, Pantherophis guttatus
DLVSLEDVAVFFSVEEWALLDSEQRALYREVMLENKRNVASLGDGWEMEDSGQEAAASLPKDKKEVAEKIYGKQSSEESQL

SEQ ID NO: 9160 - protein, 81 aa, Dipodomys ordii
APGSVTFRDVAIDFSQEEWKWLQPAQRDLYRCVMLENYGHLVSLGLCISKPDVVSLLEQGKEPWLGKGGVNRDLFSVSDGK

SEQ ID NO: 9161 - protein, 81 aa, Octodon degus
MLENYQNLVALGPPVCKPDVISHLERGEEPWRVYREGSGGSCSEREPVPEVKEQSLLQGCCRRDLPWEAVTGPLKRPSAHS

SEQ ID NO: 9162 - protein, 81 aa, Rattus norvegicus
KVPVTFVDIAVYFSEDEWKNLDEWQKELYSNLVKENYKTLMSLDTDGPVSKPDAPVQAEPREEPCVWEQHHPEEREIPGTA

SEQ ID NO: 9163 - protein, 81 aa, Rattus norvegicus
DAVTYEDVHVNFSPEEWALLDPSQKSLYKDVMVETCRNLTAIGYKLEDSNIEEHCQRSRGPRRYNICHCGYEPCEHWGHGK

SEQ ID NO: 9164 - protein, 81 aa, Rattus norvegicus
NQGESYVSLEDVCLRFTAEEWGLLDDAQKLLYHNVMLENFSLVLSLGLPISKSFPGTQVYPSWPYLFQKDKHTTVEPSINI

SEQ ID NO: 9165 - protein, 81 aa, Mesocricetus auratus
IQELVSFEDVTVQFTEEEWALLDPLQRTLYRKVMLENWKNLTSLGYCLDKPNLISQLEQEDKAMTENRGSIPGISPELETV

SEQ ID NO: 9166 - protein, 81 aa, Mesocricetus auratus
LRESVTFKDVVVNFTQEEWRHLDPTQRDLFRDVTLENYTHLVSIGLQVSKPDMISQLEQGTEPWIEESCIPVGSMEDWKIR

SEQ ID NO: 9167 - protein, 81 aa, Mus musculus
MGVVTYDDVHVNFTQEEWALLDSSQKNLYRDVMLETYRNLAAIGYSWEDHNPEEHFQSSRRHGRHEKSHIEEKPSEFTQCG

SEQ ID NO: 9168 - protein, 81 aa, Mus musculus
MDLVTYDDVQVNFTQDEWALLDPSQKSLYKGVMLETYRNLTAIGYIWEEHTIEDHFQTSRSHGRHERSCSPEQPSDFIQCG

SEQ ID NO: 9169 - protein, 81 aa, Mus musculus
FETLKDLAMDFTVEDWKDLESEWDQRDLFWDVTLNHYQDMFSFNTSQPSLTSQPDVREELEATSTEVPETKSSPLQSGFVE

SEQ ID NO: 9170 - protein, 81 aa, Mus musculus
AVTFRDVAVVFSEEEMGLLDAAQRKLYHDVMLENFLNLLAVGSQSPNKVDTLDSTGLRHLSLGWLPCWHMTGHDVKKLAST

SEQ ID NO: 9171 - protein, 81 aa, Mus musculus
MDLVTYDDVQVNFTRDEWALLDPSQKSLYKGVMLETYRNLTAIGYIWEEHTIEDHFQTSRSHGRHERSCSAEQPSEFIQCG

SEQ ID NO: 9172 - protein, 81 aa, Cavia porcellus
QTVEVTFEDVAVLFTRDEWRKLDALQRSLYRDVMLENYRNLASLAGFPFTKPRVISLLQQGEDPWKVEKEIPGGPSLGWKN

SEQ ID NO: 9173 - protein, 81 aa, Cavia porcellus
RPRALKFADVAVYFSLEEWGCLRPAQRTLYRNVMRETYGHLGALGCAGPKPALISWLERNTDDWEPAALDPQEYPRGVTVQ

SEQ ID NO: 9174 - protein, 81 aa, Cavia porcellus
KNEKLIFSDVSIDFSQEEWECLDSAQRDLYRDVMLENYRNLISLGLYIPKPQVISLLEQGKEPWMIGRELTRGLCLDLESM

SEQ ID NO: 9175 - protein, 81 aa, Cricetulus griseus
ISFEDVVVDFSWEEWQLLNPTQKSLYRDVVLENCSSLVFLGYQTIKPDVAFKLDQQEASLINEGILNQNFLEIWLDTSEVR

SEQ ID NO: 9176 - protein, 81 aa, Cricetulus griseus
MNGLLSFRDVSVDFSQEEWECLDCAQRALYMDVMLENYCNLLFVENHRTCGKCEEILHRGTKHFIHDHENIQEKTYKCNEL

SEQ ID NO: 9177 - protein, 81 aa, Cricetulus griseus
TQEFVSFEDVTVEFTEEEWALLDPLQRTLYRKVMLENWKNLASLGYCLDKPSLISQLEQEEKAITEDTGSHTGISTDLQTV

SEQ ID NO: 9178 - protein, 81 aa, Octodon degus
MDVMLENYCHLISLGYDMTKPDMILKLEQGEEPWTSFADHACLKENWKAEDFLMKFKEHQDKYSRSVVCINHNKLIKQKSS

SEQ ID NO: 9179 - protein, 81 aa, Peromyscus maniculatus
SQGLLTFRDVTVDFPQEEWECLDSAQRALYIDVMLENYSNLVSVENFYICDPVHQHVKTEKESCQYYELGKVLHDPSTSAF

SEQ ID NO: 9180 - protein, 81 aa, Rattus norvegicus
GPLENDGVCFSEQEWENLEDWQKELYRNVMESNYETLVSLKVLGQPEEEVELGAEMVGDLVEEGTHLADRAMVKQEMLYKQ

SEQ ID NO: 9181 - protein, 81 aa, Rattus norvegicus
MLSFWDVAIDFSPEEWECLEPVQWNLYRDVMLENYSNLVFLGLTFSKPFLVTFLEQRQGPWDMQRQAAAPVHPGRALSDPD

SEQ ID NO: 9182 - protein, 81 aa, Mus caroli
TNGLLTFKDVAIEFSQEEWECLDSAQRTLYRDVMLEIYSILVSVGLSISKPELLTCLEQNEEPSIAKGIEPVLSCFHNKEL

SEQ ID NO: 9183 - protein, 81 aa, Mus musculus
CERWMSFEDVTVNFSQEEWQHLDSAQRCLYQEVMLEIYSHLLAVGYSIPSPGVIFRMEKGKEAQTAKAEFPGQRCQEKSGN

SEQ ID NO: 9184 - protein, 81 aa, Cavia porcellus
VVFSDVSIDFSQEEWECLNDDQRDLYRDVMLENYSNLVSMVLESRCETKKLFVKKEIDEIKSTQWEIMGRLTRHDLQCSGF

SEQ ID NO: 9185 - protein, 81 aa, Cricetulus griseus
MESLSFEDIAVYFTWQEWQDLDIAQKLLYRDVMLENYSSLVSLGCCMIKPELILMLEREFGPWRVADTSLWNFPGYYMTRP

SEQ ID NO: 9186 - protein, 81 aa, Cricetulus griseus
GLLTFRDVAVDFSREEWRCLDSGQRALYMDVMLENYSNLLSVGIIACKADLVPCLEQIQMPWNVKREEMVARPETQQMCSN

SEQ ID NO: 9187 - protein, 81 aa, Cricetulus griseus
RRPWKLPASGVTVDSFQEEWQCLDPSQRAPYRHWMLQNRSSLVCVEFTDHPDLLLTCAAEQRSLNGEREETEAKEAEKLKG

SEQ ID NO: 9188 - protein, 81 aa, Rattus norvegicus
SQGLVTIKDVSLCFSQEEWRSLDPSQTDFYGEYVMQENCGIVVSLRFPIPKLDMLPQLEGGEEQWVPDPQDVEGRDIRKVT

SEQ ID NO: 9189 - protein, 81 aa, Mesocricetus auratus
WERLVSFEDVTVTFSQEEWQQLDSAQRCLYQDVMLEIYSHLLAVGDLRLDTPQQQIFVKASFLNDASSDVTGHGSYSILEK

SEQ ID NO: 9190 - protein, 81 aa, Rattus norvegicus
PQVPVTFREVAVYFCREEWECLSFSQRTLYRDVMLENFRNLNELGCCGRKPSLISRLEQWDEPWVDKWDSSELERQKSVCP

SEQ ID NO: 9191 - protein, 81 aa, Rattus norvegicus
YQVSVTFDDVAVDFTQEEWILLDQAHRDLYREVMLENYQNLASAGCEVIKPSLISWLEEEDLHREDLQEWEMPLGTQESTL

SEQ ID NO: 9192 - protein, 81 aa, Rattus norvegicus
MVTFRDVAVVFSEEELGLLDAAQRKLYREVMLENFRTLLSVAHQPFKPGLIAQLENDEKLWMVAADAQAGGLSGRRSGHTV

SEQ ID NO: 9193 - protein, 81 aa, Mesocricetus auratus
YQDAVTFDDVTVEFTPDEWTLLDLTQRNLYREVMLENYENLTSVGCQFFIPSLTPWLKQEELETVESTVPQQLELQPRIDD

SEQ ID NO: 9194 - protein, 81 aa, Mus caroli
QGLLTFGDVALDFSQEEWECLDSAQRALYIDVMLENYINLVSVEKHHMCGKYEKVLDQHSEHQHVNIQEKSYKYKELGKMV

SEQ ID NO: 9195 - protein, 81 aa, Mus caroli
PQCLLTFRDVAVDFPQEEWECLDSAQRALYIDVMLENYRNLVSVENYCICDTVHQHVKTEKESCQGNKLGEMLHEPSNCAL

SEQ ID NO: 9196 - protein, 81 aa, Mus caroli
PQGQLTFKDVAVDFSQEEWECLDCAQRALYMDVMLENYNNLFFVENHCVCSKYENVLDQDTQHIFHKHVNIQKKSCKCNDR

SEQ ID NO: 9197 - protein, 81 aa, Mus musculus
DKALMAFHDVAVAFSQMEWELLSPAQRILYRDVMLENYSHLVSLGIAFSKPKLITQLEQGAEPWRDGSGCFLDLCPEPRTE

SEQ ID NO: 9198 - protein, 81 aa, Mus musculus
AVTFRDVAVVFSEEELGLLDAAQRKLYHDVMLENFRNLLAVGGQSPGKTTHLHTTGLRFLSLGRLPCWQVTSHDANKLAGA

SEQ ID NO: 9199 - protein, 81 aa, Mus musculus
MDLVTYDDVHVNFTQEEWALLDPSQKSLYKGVMLETYRNLTAIGYIWEEHTIEDHFQTSRSHGRRERSCTAEQPSEFIQCG

SEQ ID NO: 9200 - protein, 81 aa, Mus musculus
MEEMLSFRDVAIDFSAEEWECLEPAQWNLYRDVMLENYSHLVFLGLASCKPYLVTFLEQRQEPSVVKRPAAATVHPGGKPY

SEQ ID NO: 9201 - protein, 81 aa, Mus musculus
MEEMLSFKDVAIDFSAEERECLDPAQWKLYRNVMLENYDNLVFLGLTSSKPYLVTCLEQIQEPSDVKRGAATSMLPECREY

SEQ ID NO: 9202 - protein, 81 aa, Cavia porcellus
NFWILRLPPGSKGEVPKEWGRLEDWQKELYKHVMRGNYETLVSLDYAISKPEVLSQIEQGEEPCTWRRAAPKIPDVPVDPS

SEQ ID NO: 9203 - protein, 81 aa, Cavia porcellus
MTLKDVAMDFTPEEWGKLDPAQRDVMLENYRNLVSLYMETIPESKDSISVQEFSKESHQDVIMDRLTRNNVYDSTLETALE

SEQ ID NO: 9204 - protein, 81 aa, Cricetulus griseus
PVSFDDVVVNFTSGEWALLDSSQKKLYRDVMKETFMNLISIGRIVEENIDVDYDKLQRNLRIQVTEQFCDYEYGIQCGKPH

SEQ ID NO: 9205 - protein, 81 aa, Cricetulus griseus
IGNLDLHPLRELSVAILLTCPSLEDHDQEHSHFLSAEFFRDLGADETLQSLSESKPELVTCLEENKEPWMVNIDEAEGLEQ

SEQ ID NO: 9206 - protein, 81 aa, Cavia porcellus
QQGCVAFEDVTIYFSQEEWGLLSEAQRLLYCDVMLENFALIASLGLTSFRCHVIAQLKMGKEPWVPDRVGMTSAMARGAFR

SEQ ID NO: 9207 - protein, 81 aa, Cavia porcellus
LQVLVSFEDVTVDFSREEWQQLDSTQRCLYHDVMLENYSHLLSVGFEVPKPEVIFKLEHGEEPWTWEKETPHHSCSGWTFG

SEQ ID NO: 9208 - protein, 81 aa, Octodon degus
FEGSVSFEDVAVDFTQQEWRRLDSAQRTMHKDVMLETYSNLASVGLCVAKPEMIFKLERGEELWILEEEPSGHAYTESLSL

SEQ ID NO: 9209 - protein, 81 aa, Octodon degus
EAVTFEDVAVKFTMEEWALLDLSQKNLYRDVMWENFRNVAAIERNWDDQQIEDEYKSCRRNGRSEEVRKCCQYKLCQKHGE

SEQ ID NO: 9210 - protein, 81 aa, Octodon degus
WSQMPVTFEDVALYLSREEWGRLDHTQQNFYRDVLQKKNGLALGFPFRRPFWAPQVSRKVEASSSGRQTGTEEEDSDPGSG

SEQ ID NO: 9211 - protein, 81 aa, Rattus norvegicus
AVTFRDVAVVFSKEEMGLLDAAQRKLYHDVMLENLRNLLAVGGQSPNKMKTVDATGIRCLLLGQLLYWEITGHDANKLARA

SEQ ID NO: 9212 - protein, 81 aa, Rattus norvegicus
FQETVTFGDVAVHFSREEWQCLDSGQRALYREVMLENHSSVAGLAGFLVFKPELISRLEQGQEPWALDLQGAEGTEAPRIC

SEQ ID NO: 9213 - protein, 81 aa, Rattus norvegicus
SQSLLTFRDVAVHFSQEEWECLDSSQRALYIDVMLENYSNLVSVENYCICETVHQHVKTEKESCQCNELGEMLRGPSNCAL

SEQ ID NO: 9214 - protein, 81 aa, Rattus norvegicus
SEGLVSFEDVSVDFTWDEWQDLDEAQRKLYRDVMLETYSSLMSLNQCDPKPELILKLEKEAGPWKEDNSPNQSVPDVKNVN

SEQ ID NO: 9215 - protein, 81 aa, Mesocricetus auratus
AWVPALFDEVAIYFSDEEWEVLTEQQKALYREVMRMNYETVLSLEFPFPKPDMISRLEREEEYPNSDEWRLQGVTFAENQE

SEQ ID NO: 9216 - protein, 81 aa, Mesocricetus auratus
HKKSMVFSDVSLDFSQEEWECLGPAQRDLYRDVMLENYSNLLSVAGLHIPKPQVISLLEQGKEPWMIGKELTRGLCSALES

SEQ ID NO: 9217 - protein, 81 aa, Mus caroli
QVDAVTFEDVAVDFTQEEWTSLDPVQRNLYRDVMLENYQNLATVGGQMFKPSLISWLEQKVELTVIEQGILQEWEMHLKTK

SEQ ID NO: 9218 - protein, 81 aa, Mus musculus
MDAVTYDEVHVNFTQEEWALLDHSQKSLYRDVMLETYKNLTAIGYNWDDHNIEEHCQSSRRHGSVCALGSLQRKLKEKFWK

SEQ ID NO: 9219 - protein, 81 aa, Mus musculus
MEEMLSFRDVAIDFSPEERDYLGPAQWDLYRDVMLENYSHLVFLGLAVAKPYLVTFLEQNQGSSGVKSHAAATIPGTTGNE

SEQ ID NO: 9220 - protein, 81 aa, Mus musculus
MLSFWDVAIDFSPEEWDCLEPAQWDLYRNVMLENFSHLVFLGLAVSKPFLVTFLEQRQGPWDMKRQGMATVYPGCDYTMVA

SEQ ID NO: 9221 - protein, 81 aa, Cavia porcellus
ANDSVTFGDVAIDFSQEEWEFLDSAQKDLYRDVMWENYSNFISLGASISKPDVITLLEEEGKEPGMVVKEGTRTFCSDLES

SEQ ID NO: 9222 - protein, 81 aa, Cavia porcellus
QCESVTFKDVVVDFTQEEWKQLDPGQRDLFRDVTLENYTHLVSIGLQVSKPDVISQLEQGTEPWTEEPGVTGHTDWEPRRE

SEQ ID NO: 9223 - protein, 81 aa, Cavia porcellus
GPVSFKDVAVDFTQEEWQQLDSDEKTTYRDVMLENYNNLLSVGYDVSKPNVIIKLEQGEEPWTIEDDFSHTWPDVWKVNDL

SEQ ID NO: 9224 - protein, 81 aa, Cavia porcellus
SVAFEDVAVYFSWEEWDLLDEAQRHLYLEVMLENLALMSSLGCSCRVEDEVVPSELGLSVDLSRVMTPKEGLSSQNAYAYE

SEQ ID NO: 9225 - protein, 81 aa, Cavia porcellus
EPLTLEDVTVTFMQEEWQLLDPAQKNLYRNVMLENYSNLVSVGYEGSKPDALFRLEQGGPWIIDEIYSHICPENDQVGNHL

SEQ ID NO: 9226 - protein, 81 aa, Cricetulus griseus
MLGLLGPPEFSLQYHMAYFRERYHIIKPDVIIKLEQGEEPWIVEGTFSPQSYPDEIWQGNDLMEKAQGDEKKQSRSAVFNY

SEQ ID NO: 9227 - protein, 81 aa, Cricetulus griseus
SVTFDDVTVEFTPDEWTLLDLTQRNLYREVMLENYENLTSVELELQPRIDDSELQNYFKMQSSDELEMTESQNGRELYNWT

SEQ ID NO: 9228 - protein, 81 aa, Cricetulus griseus
RREMLSFWDVAIDFSPEEWECLEPAQWNLYRDVMLENYSHLDFLGLAVSKPFLVTFLEQRQGPWDVKIQAEAPVNPGTIPN

SEQ ID NO: 9229 - protein, 81 aa, Cricetulus griseus
GSVSFTDVTVDFTQEEWEQLDPSQRILYMDVMLENYSNLLSVEVWRADDQVEKDPRDPDEQARPLTTPKNQPPIEERGSLF

SEQ ID NO: 9230 - protein, 81 aa, Cricetulus griseus
KMLSFQDVAIDFSAEERECLDPDQWDLYRDVMLENYSNLEFLGLASSKPYLVTFLEQSQGSNDMKRQTASTLQTGKQHFIG

SEQ ID NO: 9231 - protein, 81 aa, Cricetulus griseus
SKDLLTFRDVSVDFTKEEWQCLDSDQRALYIDVMLENCNNLIFVENYYRSDPVHQRVRIQKKSCQCSELGKVLHDPSTRAF

SEQ ID NO: 9232 - protein, 81 aa, Cricetulus griseus
FQHLLTFGDVAVDFPQEEWECLDSAQRALYIDVMLENYNNLLSVENYCKCDSVHHHVKNEKESCQCNKSGKMLHEPSTCIL

SEQ ID NO: 9233 - protein, 81 aa, Dipodomys ordii
TRDLVTFKDVAVEFSQEEWALLDTWQRTLYSEVTLENCRNLVSLGCHVDVPSLAAQLELCPQVGTEESGVVQDTCAELEHA

SEQ ID NO: 9234 - protein, 81 aa, Dipodomys ordii
MEEWEYLDPAQRSLYKDVMVENYGNLVSLDVLNRDKHEEPIVKQEIEEIEEDVEPQGVIVTRIKSEIEQDPMGQETFELVG

SEQ ID NO: 9235 - protein, 81 aa, Octodon degus
LRAVSFEDITVDFSREEWQYLDLAQKSLYRDVMLENYFNLVSVVVGCQVPNPEVIFNWEPEEDPCSMGSENSSQNYLGGDI

SEQ ID NO: 9236 - protein, 81 aa, Peromyscus maniculatus
QDAVTYEDVHVNFTHEEWALLDPSQKSLYKDVMLETYWNLTILGYKWEDYNIEEYYQGSRRHGRYINCQCSYNSCEHKGYG

SEQ ID NO: 9237 - protein, 81 aa, Peromyscus maniculatus
LTFRDVAVDFSQEEWEYLDSIQRALYIDVMMENYSNLVSVENYCMCEIVHQHMDSEEIYSKCNNDVDEILHESNRYTVYKT

SEQ ID NO: 9238 - protein, 81 aa, Mus musculus
MLENYRNLASVGFPLLKPAVISQLEERKDLENLFQLATGTDSQGLWTECTAVQSGNNLTKEVHEEEKSTLFELQKDFSQET

SEQ ID NO: 9239 - protein, 81 aa, Mus musculus
PQGLLTFKDVAVDFSQDEWKYLDRAQRALYVDVMLENYKNLFFVESHYLTHKYENILDEDTQCIVHEHMNLQSYKCHELGK

SEQ ID NO: 9240 - protein, 81 aa, Mus musculus
VQDLVTFKDVAVLFTQEEWGQLSSAQRALYQDVMLENYSNLVSLAGLLGSQPDMFFPLEEVEECVSEEAPEGFVLDAADEP

SEQ ID NO: 9241 - protein, 81 aa, Mus musculus
AQRLMTFRDVAVDFSPEEWECLSLDQRSLYRDVMLESYSHLVSVGQLQRSNAEILQSTLKDTDACTGLAPSYLQMVPQTLD

SEQ ID NO: 9242 - protein, 81 aa, Mus musculus
YMAPTASSFTTRTAQCRNTVAAIEEDAVTYDDVHVNFTGEEWNLLNPSQKSLYKDVMLETYWNLTVIGAGRPVETQGVHQP

SEQ ID NO: 9243 - protein, 81 aa, Cavia porcellus
MELLTFRDVAIDFSSEEWEYLDLAEQNLYTEVMLENYRNLVFLGLSFCKPDLITFLEQSKEAWIVKSQGTAAIFPGMTSHH

SEQ ID NO: 9244 - protein, 81 aa, Cavia porcellus
MMAFEDVAVYFSREEWVLLDKAQRALYRHVMLENFALVASLGFFSSPPRVVVQLECGEEPWVPTGKDLILGRNAHKRLDLG

SEQ ID NO: 9245 - protein, 81 aa, Cavia porcellus
APVPVAFDDVSIYFSTPEWEKLEEWQKELFKNIMKGNFESLISMDYAVSQPDVLSQIQPEAEHNTEDQAGPEESEIPAVSS

SEQ ID NO: 9246 - protein, 81 aa, Cricetulus griseus
YQDSVTFDDVTVEFTPDEWTLLDLTQRNLYREVMLENYENLTSVGCQFFIPSVTPWLKQEELETVESTVPQELELQPRIDD

SEQ ID NO: 9247 - protein, 81 aa, Cricetulus griseus
WSHMPVTFEDVALYLSHEEWGRLDHTQQNFYKDVLQEKNGLALEFPFSRPFWVPQVQGKGEMASSSRPAGAERRSLGSGIV

SEQ ID NO: 9248 - protein, 81 aa, Cricetulus griseus
LQGTVFFKDVAIDFSQKEWECLTSAQRALYRDVMLENYNNLVSVGLSVSKPELINSLEQSKQFWNGNTGESEGKEQVLCYH

SEQ ID NO: 9249 - protein, 81 aa, Cricetulus griseus
MQGLVTFSDVTVTFSKEEWECMDSAQWNLYTDVMLANYNNLVFVENYYKCDPVHQHMETEKESCQCNEIGEVLHDPSTCAL

SEQ ID NO: 9250 - protein, 81 aa, Castor canadensis
KPGPVSFADVAVYFSPEEWGSLRPAQRALYRDVMRETYGLLGALGLPGPKPALISWMEQESEAWSPAAQDPEEGESLGGAL

SEQ ID NO: 9251 - protein, 81 aa, Peromyscus maniculatus
MAMYLTREEWRPLDPTQRDLYRDVMQENYGNVVSLDFEIRSENEANSKPELSEDVEFVTMSEEPVGDAEKNPESEEAFESG

SEQ ID NO: 9252 - protein, 81 aa, Octodon degus
SQGLVSFKDVAVDFTQEEWQQLDPAQRTLYKDVMLENYSHLVSMAYPVSKPDIISKLEQGEDPWIIKTDMASCNYPDANYT

SEQ ID NO: 9253 - protein, 81 aa, Peromyscus maniculatus
SQEHVSFKDVCVDFTKEEWYLLDPAQKVLYRDVILENYSNFVSVGHCVTKPDVIFKIEQGEDPWIPENRFQCHPERKWKVD

SEQ ID NO: 9254 - protein, 81 aa, Peromyscus maniculatus
FQEAVTFKDVALVFTTEELGLLDLTQRQLYQDMMLENFKNLVAVGCFPLKADMVSLLEAEERLWLKETEVQRNGSSPQESA

SEQ ID NO: 9255 - protein, 81 aa, Peromyscus maniculatus
IQELVSFEDVTVQFTEEEWALLDPLQRTLYRKVMLENWKNLVSLGHHLDKPNLISQLEQEDKAIIEERGSIPGICPDLETV

SEQ ID NO: 9256 - protein, 81 aa, Peromyscus maniculatus
PQDPLTFRDVTVDLSQEEWECLDCAQRTLYMDVMLENYSNLVFVENHHICGKYKKFLDQGSKYIIHQHLNIQEKSYKCSEL

SEQ ID NO: 9257 - protein, 81 aa, Peromyscus maniculatus
RLGVVSFEDVTVDFSQEEWRRLDPAQRRLYQDVMLEIYSHLLAVGYPIPSSGAILRIKQRKEAWMGEVKFPHQQCGCREVE

SEQ ID NO: 9258 - protein, 81 aa, Rattus norvegicus
EEGCVSFEDVAVYFSWEEWTLLDDSQRLLYQTVMTEIFTLVSSLRLELSGIQDLTQAESCGDLSVPALRFLTPCLWTGCWI

SEQ ID NO: 9259 - protein, 81 aa, Rattus norvegicus
SCERLVSFEDVTVDFSQEEWQHLDSAQRCLYQEVMLEIYSHLLAVGYPRPEAILQMKNRKDTRLGQVDFLHQRCGQGQSEH

SEQ ID NO: 9260 - protein, 81 aa, Rattus norvegicus
QDQEPVTFKDVAVAFTQEEWEQLDLVQRTLYRDVMLETYGHLLSVGNQIAKPEVISLLEQEEPWSLEQGYPKSSCPEWMRN

SEQ ID NO: 9261 - protein, 81 aa, Mus caroli
EMGLVSFEDIAVEFTWQEWQDLNEGQRTLYRDVMLENYSNLLFLGHCKTKPELIFNLEQRLGSWIVEASHQCVPDFQNMST

SEQ ID NO: 9262 - protein, 81 aa, Mus musculus
MDLVTYDDVHVNFTQEEWALLDPSQKSLYKGVMLETYRNLTAIGYIWEEHTIEDHFQTSRSHGRHERSCTAEQPSEFIQCG

SEQ ID NO: 9263 - protein, 81 aa, Cavia porcellus
FKGLVTLKDVTVEFTKEEWQLLTPAQKALYKHVMLENYRQLVSIGYRVSKSNVILKLKQGKEPWRQEVKLPRRKASENLGN

SEQ ID NO: 9264 - protein, 81 aa, Cricetulus griseus
EEGCVSFEDVAVYFSWEEWKLLDDSQRLLYQTVMTEIFTLMSSLGLVPSGIHGVTQLGSWGEPALRFLTPGCWIKAESDTA

SEQ ID NO: 9265 - protein, 81 aa, Cricetulus griseus
FQEPVTFLDVAVDFTQEEWGQLDPTQRTLYRDVMLETFGHLLCVGPDLPKPAVISQLEQGAELWVTERGGTRACHPAWILG

SEQ ID NO: 9266 - protein, 81 aa, Cricetulus griseus
SQEQVSFKDVCVDFTKEEWYLLDPAQKGLYRDVTLENYSNFVSVGYCVTKPDVIFKIEQGEDPWIPENGFQCHPESKWKAD

SEQ ID NO: 9267 - protein, 81 aa, Cricetulus griseus
KPELVSFEDVAVYFSPHEWGCLRPAQRALYREVMRETYGLLGALGFPGPKPALISWMEQESEAWSPAAQDPAEGESLGGAL

SEQ ID NO: 9268 - protein, 81 aa, Cricetulus griseus
MEPLTFKDVAIDFSGEEWECLNSEQQNLYKDVMLENYRNLIFLGLAVSKPYLVTCLEQRKEPWNVKRQKTMVLFPAMFPHY

SEQ ID NO: 9269 - protein, 81 aa, Cricetulus griseus
MLENYSNLVFLGLALSKPHLVTVLEQSTEPWSVKRKSAAASHSGSKPHKCKECGKSFDRNSVLVQHQRIHTGERPYACEEC

SEQ ID NO: 9270 - protein, 81 aa, Cricetulus griseus
EQGLVSFEDVAVDFTWQEWQELDAAQRTLYRDVMLENYSSLVSLGHCVTKPELIFRLEHGFGPWSIGETSLWNLPGVLEVP

SEQ ID NO: 9271 - protein, 81 aa, Cricetulus griseus
CAADQRGLEGERRQKLKMQDLVTFSDVTVTFSKEEWECIDSAQWNLYTDVMLENYNNLVFVVSSFPENYCKCDPVNHHVKT

SEQ ID NO: 9272 - protein, 81 aa, Cricetulus griseus
LQDLLTFGDVAVDFSQEEWECLESASKALYIDVMLENYHNLVFVEKYHMYVKNMKVLDQESKHIVYHPVNIQEKSYENNEM

SEQ ID NO: 9273 - protein, 81 aa, Cricetulus griseus
KVKQFSFQSLLTFKDLAINFSKEEWEYLNTSQKDLYKDVMLENYSNLVSVGLSESKPELVTCLEQNKEPWMVHIVEAEGLE

SEQ ID NO: 9274 - protein, 81 aa, Cricetulus griseus
VTFEDVALYLSHEEWGRLDHTQQNFYKDVLQEKNGLALGIVEMGKMVPTLAVATLEDTKPLRKPRARWALREEPQCGQHEA

SEQ ID NO: 9275 - protein, 81 aa, Octodon degus
SQGLVTFEDVAVYFSLEEWERLDADQRGLYQDVMQENYGILVSLGYPVPKPDLIFRLEHGEEPWVPDSPHPEEGDIVTGVY

SEQ ID NO: 9276 - protein, 81 aa, Octodon degus
SLGLVSFEDVAVDFSWEEWQDLDDAQKTLYRDVMLETYSSLVSLGHCSPKPEVIIKLELGAQQWMGEEHPSQAHTGHCTPS

SEQ ID NO: 9277 - protein, 81 aa, Peromyscus maniculatus
PHEPVKFEDVSLTFSKEEWAQLEFQQKCLYKEIMLENYNNMVSVERHFSKPNVISQLEEVEDFWPVEREIPQDIFPESSGP

SEQ ID NO: 9278 - protein, 81 aa, Peromyscus maniculatus
CERLVSFEDVTVDFSQEEWQQLDPAQRRLYQDVMLEIYSHLLAVGELQLDTPHQQTFVKASLLNDASSEVAGHGSYCSVLE

SEQ ID NO: 9279 - protein, 81 aa, Rattus norvegicus
PKVPVTFDDVAVHFSEQEWGNLSEWQKELYKNVMRGNYESLVSMDYAISKPDLMSQMERGERPAMQEQEDSEEGETPTDPS

SEQ ID NO: 9280 - protein, 81 aa, Rattus norvegicus
ETVTFGDVAVHFSREEWQCLDSGQRALYREVMLENHSSVAGLGFLVFKPELISRLEQGQEPWALDLQGAEGTEAPRICQTG

SEQ ID NO: 9281 - protein, 81 aa, Mus caroli
VSFEDLVVHFTQDEWALLAPSQKTLYGDVMLETFRNFTAIGYEWEDETIEDHCEEPEINLRNIVTHSEYTQYEREEYEEKP

SEQ ID NO: 9282 - protein, 81 aa, Mus caroli
MTYEDVHVNFSQEEWALLDPSQKSLYKDVMLETYWNLTCIGYMWEDCNIEDQHQSSGRHRRCINCPSAYGKKQCTNLFPRT

SEQ ID NO: 9283 - protein, 81 aa, Mus musculus
AVTFRDVAVVFSEEELGLLDAAQRKLYHDVMLENFRNLLAVGGQVPNKMENLHTTGVRCLSLGQLPCGHMASHDANKLARA

SEQ ID NO: 9284 - protein, 81 aa, Mus musculus
PQDLLTFRNVAVDFSKEEWEYLNSSQRALYMDVMWENYSNLVFVENHCICGKYEEDMDQSSNHIIYQHANIEEKSYKYHEL

SEQ ID NO: 9285 - protein, 81 aa, Mus musculus
VSFEDLVVHFTQDEWDLLAPSQKTLYGDVMLETFRNFTDTGCEWEDQKIEDHFEEPEINLRNIITHSEYTQYEHEEYEEKP

SEQ ID NO: 9286 - protein, 81 aa, Mus musculus
MESVSFEDVAVKFTQEEWAVLDPSQKKLYKDVMQETLKNLASIGNKSGKQKVINEYGKLWRKLSSHLAGKFSDYNENHQCA

SEQ ID NO: 9287 - protein, 81 aa, Mus musculus
MEEMLSFWDVAIDFSPEEKECLEPAQWDLYRDVMLENFSHLDFLGLAVAKPYLVTFLEQNQGSSGVKSQTSATIPPGTTGN

SEQ ID NO: 9288 - protein, 81 aa, Mus musculus
FQEMLSFRDVAIDFSAEEWECLEPAQWNLYRDVMLENYSNLVFLGLASCKPHLITCLEQIQEPSDVKRGAATSMLRGEKCY

SEQ ID NO: 9289 - protein, 81 aa, Cavia porcellus
MLENYNNLLSLGIPVPTPPGICWLQQGEDPYTEEREKPPDTCPDFKSWPDIGAVPVRQDIFTEEICHGIVKKKSSNFGPWN

SEQ ID NO: 9290 - protein, 81 aa, Cavia porcellus
SEDLVTFGDVSINFTQEEWKWLSPVQRNLYRKVMLENYRSLVSLGISVSKPDVISLLEQGKEPWMMKKGTRDLCPDWEYVF

SEQ ID NO: 9291 - protein, 81 aa, Dipodomys ordii
GSVSFTDVTVDFSQEEWERLDPSQRILYMDVMLENYSNLLSVEVWKADEQMEGDPKTPDEQARQFLILKNQTPVEERGYLF

SEQ ID NO: 9292 - protein, 81 aa, Cavia porcellus
SLGPALFRDVAVVFSQEEWAWLEPAQRDLYRDVMLETYSNLVSLGLAISKPDVISFLEQGREPWVEEKVKAGGLCPVLESE

SEQ ID NO: 9293 - protein, 81 aa, Peromyscus maniculatus
AHSEVMFRDVTVNFSQEEWECLNSYERDLYKDVMLENYSHLVSLAGCSISKPDVITLLEQGKEPWMIVRDERRRWSQDLET

SEQ ID NO: 9294 - protein, 81 aa, Peromyscus maniculatus
LSFEDVVVKFTKEEWALLDPSQKKLYKDVMQETLRNLTAIGNKLENKKVANEYKNLCRKLRSQLAEIFCEYKESLQSTELF

SEQ ID NO: 9295 - protein, 81 aa, Peromyscus maniculatus
FQRSVSFKDLTVDFTHEEWQCLGPAQRLLYRDVMLENYRNLLSVGFRVSKPDVILKLEQGKEPWVVEESPSQNHPEDDDAL

SEQ ID NO: 9296 - protein, 81 aa, Rattus norvegicus
SQGPVLFEDVFVAFTQKEWQLLDAAQRHLYREVMLETYRHLQAVGHSITKPELICKLEHGEGPWDPPGHGLSEAQRVDTMT

SEQ ID NO: 9297 - protein, 81 aa, Rattus norvegicus
KAVTYEDIHVNFTREEWALLDPSQKSLYRDVMLETYENLTAIGSYWEEHIIEENCQNSRRHGSHLDWNERIHTGEKTNEVV

SEQ ID NO: 9298 - protein, 81 aa, Mesocricetus auratus
SQVSVTFEDVAVLFTRDEWKKLDHSQRSLYREVMLENYSNLASLGFPFAKPEMISVLQQGEEPWKVEKRSLGFSLGCNSSL

SEQ ID NO: 9299 - protein, 81 aa, Mus caroli
AQRLMTFRDVAVDFSPEEWECLSLDQRSLYRDVMLESYSHLISVGLFVYRPHLFSLLEKGQDPWMILRNETRGPYPDIDFS

SEQ ID NO: 9300 - protein, 81 aa, Mus musculus
YKGPVTLRDVAVEFSKAEWKLLTPAQKSLYKNVMLETFSNLFSVGYRVVKPSVIAKLKKGKEPWPLEEFFRKSRGDKRRTA

SEQ ID NO: 9301 - protein, 81 aa, Mus caroli
QASVTFEDVAVRFTQEEWALLDPSQKILYGDVMQETYRNLTSVGINWECWDLEAYFRSLERNLRVQLVKRDCELKNNDPCG

SEQ ID NO: 9302 - protein, 81 aa, Mus musculus
VCGSVTFRDVAVDFSQEEWACLDATQKVLYRNIMLETYSNLVAVVGRCIPKPDLIVLLEQEKEPWMAVKKETGRPSQGLET

SEQ ID NO: 9303 - protein, 81 aa, Mus musculus
MATSEPAESDAEWEQLEPVQRDVYKDTKLENCSNPASMGNQDPKQDIVSVLEEEEPSSGKGKKASPSSLKKIARPKTAGTS

SEQ ID NO: 9304 - protein, 81 aa, Mus musculus
PRRWMAFEDVAVYFSQEEWMFLNAAQRALYRHVMLENFALVDSIGPSVSRPRVIIQLQRGEEPWVPNRTNRGPGRGAHRRS

SEQ ID NO: 9305 - protein, 81 aa, Mus musculus
AVTFRDVAVVFSEEELGLLDAAQRKLYHDVMLENFRNLLAVGGQSPNKMEIVDATGLRCLSLGQLLCWGETSHNINKLARA

SEQ ID NO: 9306 - protein, 81 aa, Dipodomys ordii
SQVSVTFEDVAVLFTRDEWRKLDPSQRSLYREVMLENYSNLASLGFPFTKPKVISVLQQGEDPWKVGKEGAGNTTLGWKHS

SEQ ID NO: 9307 - protein, 81 aa, Dipodomys ordii
PQLPESLEDMAVYISQEEWGHQDPRKKALSRDTGQESYENMDSLEACIPNQEALSTQMEQDGKPWDPSIQGCKEGMSSRSP

SEQ ID NO: 9308 - protein, 81 aa, Octodon degus
MKPAQRILYRDVMLENYSNLVTVGCEVTKPDVIFKLEQEEEPWVMEEEMFWRHFPEVWEVDEHIKKQQKTLVRKGTSVSKK

SEQ ID NO: 9309 - protein, 81 aa, Cricetulus griseus
PKVPMTFDDLAVYFSELEWATLEDWQKELYKHVMRDNYETLVSLDCAISKPDILNWIERGEEPFPAGPCGQGRGTEEEAAC

SEQ ID NO: 9310 - protein, 81 aa, Peromyscus maniculatus
VVGLVSFEDVSVDFTWEEWQDLDDAQRKLYRDVMLETYSSLLSLNQCDAKPELILKLEQGAGPWKEEDAPNQRLPAMENVK

SEQ ID NO: 9311 - protein, 81 aa, Peromyscus maniculatus
EMGLVSFEDIAVEFTWQEWQDLNESQRTLYRDVMLENYKNLLFLGHCKTKPELIFNLEHRLGSWIVGEASDQSIPDSQEMN

SEQ ID NO: 9312 - protein, 81 aa, Cricetulus griseus
VKQFSFQSLLTFKDLAINFSKEEWEYLNTSQKDLYKDVMLENYSNLVSVGLSESKPELVTCLEQNKEPCMVNIVEAEGLEP

SEQ ID NO: 9313 - protein, 81 aa, Mesocricetus auratus
QGLLTFGDVALDFSQEEWECLDSSQRALYIDVMLENYSNLVSVENHGMRGKPKKVLNQDSSHNVHQHGNTQENSYKSNQLD

SEQ ID NO: 9314 - protein, 81 aa, Mesocricetus auratus
FVTLKDTAMDFTLEDWEELELELNKRDPFWDLTLSNCQDLFLLNPPKPSLVSQPDIREELEATVRGGGLEATDTEVTETKS

SEQ ID NO: 9315 - protein, 81 aa, Mesocricetus auratus
MLENYSNLLSVAGLHIPKPQVISLLEQGKEPWMIGKELTRGLCSALESMCESKLLSLKKEVYEIESCQRELMGLKKHGLEY

SEQ ID NO: 9316 - protein, 81 aa, Mus caroli
MLSFRDVAIDFSPEERDCLGPAQWDLYRDVMLENFSHLVFLGLAVAKPYLVTFLEQNQGSSRVKSHAAAAIPGTTGNEFNN

SEQ ID NO: 9317 - protein, 81 aa, Mus caroli
MAHVMTFRDVAVDFSPEEWECLSLDQKSLYRDVMLENYSHLVSVGLCIYQPHGFPVQEKKQDACMDLGNEPNRFCPATDSG

SEQ ID NO: 9318 - protein, 81 aa, Mus caroli
PSRTVTFKDVAVDLTQEEWQQMKPAQRDLYRDVMLETYSNLVTVGCQVTKPDVIFKLEQAEEPWVLEEEMFWRRSPEAARG

SEQ ID NO: 9319 - protein, 81 aa, Mus musculus
PVTFEDVAVNFSLGEWALLDSYQKKLYRDVMMETFMNLISIGKTEEESMDVNYPQLQRNSRIQVVEKFCDYEHSSQCGKTH

SEQ ID NO: 9320 - protein, 81 aa, Mus caroli
PQESVTFKDVAVNFTQEEWHHVGPAQRSLYRDVMLENYSHLVSLGYQVSKPEVIFKLEQGEEPWISEKETQRPFCADWKTR

SEQ ID NO: 9321 - protein, 81 aa, Mus musculus
NQGESCVSLEDVCLRFTAEEWGLLDDTQKLLYHNVMLENFLLVLSLGLPISKSFPGTRVYPSWPYLLQKDKHMTSGPSINI

SEQ ID NO: 9322 - protein, 81 aa, Mus musculus
PQGLLTFKDVALDFSLEEWECLNFAQRRLYMDVMLENYNNLLFVENHCIRGKNGKVLDQDSQYIVHEHMNIQEKSSKWDKL

SEQ ID NO: 9323 - protein, 81 aa, Mus musculus
QCLLTFKDVFLDFSSEEWECLNFAQRTLYMDVMLENYNNLLFVENHCICGNYEKEKVLEQDTQHIFNEHGHIQEKSFKCNE

SEQ ID NO: 9324 - protein, 81 aa, Cavia porcellus
HAQGRVTFGDVAVDFSWEEWKLLDETQRLLYLDVMLENIALVASLGLISSRIHVVQLEVGKQTRLPDTADFTPAILRSTGS

SEQ ID NO: 9325 - protein, 81 aa, Cavia porcellus
GSLLFEDVSVTFTQKEWQLLDSSQRRLYRDMMLENYRHLESLGLCVTKPELICRLERGEEPWIPKMGHGLLEGSADQGTAG

SEQ ID NO: 9326 - protein, 81 aa, Cavia porcellus
MLENYRNLVWLGLSISKPNMISLLEQGKEPWMVQRELSRGHCTDWGSWCEMKELSSEWFTDEEEIPPGMVMRRIRSRSLQC

SEQ ID NO: 9327 - protein, 81 aa, Cavia porcellus
TARSQETMTLKDVAMDFTPEEWGKLDPAQRDVMLENYRNLVSLWLPVSKPENYSLDNGKEPLRFERKAPKRSYSDMETIPE

SEQ ID NO: 9328 - protein, 81 aa, Cricetulus griseus
PQGLLTFRNVSVDFSQEEWECLDSSQRALYMDVMWENYSNLVFVENHCICGKNEIVLNQGSKHIVHEDVKTQEKSHSCHEL

SEQ ID NO: 9329 - protein, 81 aa, Cricetulus griseus
RPRALKFADVAVYFSSEEWGCLRPAQRTLYRDVMRETYGLLGALGCAGPKPALISWLERNTDDWEPAALDPQEYRRWVTFQ

SEQ ID NO: 9330 - protein, 81 aa, Cricetulus griseus
REKVAFEDVAVNFTSGEWALLDSFQKKLYRDVMKETFLNLISIEETVEENIGEDCKDLSRSTTQVIKEDYGYGCDHKCDKT

SEQ ID NO: 9331 - protein, 81 aa, Cricetulus griseus
IRGLVTIKDVSLCFSQEEWRSLDPSQTDFYGEYVMQENCGIVVSLRFPIPKLDMLSQLEGGEEQWVPDHQDLEGRDILKVT

SEQ ID NO: 9332 - protein, 81 aa, Cricetulus griseus
PAALEAPRDVAVDFSQEEWECLDSGQRALCIDVMLENYSNLVFVEKYQKSDPVRHHVKTEKESCQCNELGKVLHDPSTCSH

SEQ ID NO: 9333 - protein, 81 aa, Cricetulus griseus
GNQFCFQSLLTFKDVAINFSKEEWECLHTSQKDLYRDVMLENYSNLVSVGLSESKPELVTCLEENKEPWMVNIDEAEGLGQ

SEQ ID NO: 9334 - protein, 81 aa, Cricetulus griseus
LQGSVSFEDVSVDFTQEEWNQLDPTQRSLYRDVMLENYSHLVSLGYPITKPEVITSLEQGMLGTIKREISSSSCTEDGQAE

SEQ ID NO: 9335 - protein, 81 aa, Cricetulus griseus
MLSFWDVAIEFSPEERECLDPAQWSLYRDVMLENYSNLLFLGLAVPKPHLVTFLEQRQESSGVKRQAAATVHPGRIPNDYN

SEQ ID NO: 9336 - protein, 81 aa, Cricetulus griseus
KNVLSYEDVHIHFTCEEWTLLDTSQKNIYKDVMLETYKNLNDIGKVAKLQRRLRYIHNLLQPLHIRVVLKAIKKTHTGGKP

SEQ ID NO: 9337 - protein, 81 aa, Cricetulus griseus
FQGLLTFSDVTVYFTKDEWECLDCAQRALYIDVILENYSNLLSVENYYKCDPVHQHVKTEKESCQCNEPGKVLHDPSTCAL

SEQ ID NO: 9338 - protein, 81 aa, Ictidomys tridecemlineatus
SQASVSFKDVTVELSPEEWQHMGPAQRTLYREVMLENYSHLVSVGFCFPKPELIFTLEQGEDPWSLEKEKGFLNWSSPEDS

SEQ ID NO: 9339 - protein, 81 aa, Octodon degus
FQAKVTFEDVAVFLSQEEWDRLGPAERGLYRNVMMETYGNVVSLGLPGSKPNVICQLERGEDPWVPYEHGAPESRGLGSGC

SEQ ID NO: 9340 - protein, 81 aa, Peromyscus maniculatus
MQGLLTFGDVAVDFPQEEWECLDSAQRALYIDVMLENYSNLVSVENYCKCDPVHQHVTNEKEYSQYNKLDKVLHDPSTSTL

SEQ ID NO: 9341 - protein, 81 aa, Peromyscus maniculatus
LQEVVTFRDVAVEFSEEEWKWMEPAQRDLYRDVTLENFSHLLSLGLVLSKPDVIFLLEQGKEPWLVTNYMTRPWHPDLESK

SEQ ID NO: 9342 - protein, 81 aa, Heterocephalus glaber
GWVPALFDEVAIYFSDEEWEVLTEQQKALYREVMRMNYETVLSLEFPFPKPDMISRLEREEESHNSDEWQLQKGTFAENED

SEQ ID NO: 9343 - protein, 81 aa, Peromyscus maniculatus
EMGSVSFEDVAVDFTRQEWQDLDAAQRTLYRDVMLENYSSLVFVGHCTTKPELIFKLEHGFGLWSKAEASVWNFPDVQKVC

SEQ ID NO: 9344 - protein, 81 aa, Rattus norvegicus
PQAKVTFEDVAVLLSQEEWARLGPAQRGLYRNVMMETYGNVVSLGLPGSKPVVISQLERGEDPWVLDGQETELSQGLGSDH

SEQ ID NO: 9345 - protein, 81 aa, Rattus norvegicus
ARGLMAFEDVAVYFSQEEWMFLNAAQRALYRHVMLENFALVDSIGPSVSRPRVIIQLQRGEEPWVPNRTIAGPGRGTHRRS

SEQ ID NO: 9346 - protein, 81 aa, Rattus norvegicus
VSFEDLVVHFTQDEWDLLEASQKSLYGDVMLETFRNLTDTGYEWEDQKIEDHCEDPEINLRDIVSHSEYTREYEHEEYEEK

SEQ ID NO: 9347 - protein, 81 aa, Rattus norvegicus
EMGLVSFEDIAVEFTWQEWQDLNEGQRTLYRDVMLENYSNLLFLGHCKTKPELIFNLEQRLGSWIVEASHQSIPDFQKVNT

SEQ ID NO: 9348 - protein, 81 aa, Octodon degus
CSWKPLTFTDVAVMFSPEEWVFLDSAQRSLYRDVMLENYSNLASIDQLCKTSTVSYMEKREELWSIKRGIFSEPQLQPQES

SEQ ID NO: 9349 - protein, 81 aa, Octodon degus
PQEPVTFEDVAVTFSPEQWASLESGQRSLYRRVMLDNYALVAALAASPACKPALIARLERGEALWNSEALGSGLPGAGNWV

SEQ ID NO: 9350 - protein, 81 aa, Peromyscus maniculatus
FRESVTFKDVVVNFTQEEWKHLDPTQRDLFRDVTLENYTHLVSIGLQVSKPDVISQLEQGTEPWTEESCIPIASVEDWKIR

SEQ ID NO: 9351 - protein, 81 aa, Peromyscus maniculatus
SQAPVTFEDMAMYLTREEWRPLDPTQRDLYRDVMQENYGNVVSLDFEIRSENEANSKPELSEDVEFVTMSEEPVGDAEKNP

SEQ ID NO: 9352 - protein, 81 aa, Mus musculus
VCGSVTFRDVAVDFSQEEWACLDATQKVLYRDMMLETYSNLVAVVGRCISKPDLIVLLEQEKEPWMAVKEETDRPSPDLEL

SEQ ID NO: 9353 - protein, 81 aa, Mus musculus
MLSFRDVAIDFSAEEWECLEPAQWHLYRDVMLENYSHLVFLELADSKPQLVTFLEQRQQSTGVKRQEVLQTPCRELWGRNP

SEQ ID NO: 9354 - protein, 81 aa, Mus caroli
SQVSVTFEDVAVLFTRDEWKKLVPSQRSLYREVMLENYSNLASLAGFPFTKPKVISLLQQGEDPWKVEEEGPGGFSLGLKC

SEQ ID NO: 9355 - protein, 81 aa, Mus musculus
PQGLLTFKDVALDFSLEEWESLSFAQRTLYMDVMLENYNNLLFVENHCICGKYEKVLDQDSQYIVHEHMNIQEKSSKWDKL

SEQ ID NO: 9356 - protein, 81 aa, Mus musculus
PQGLLTFKDVAVDFSQEEWECLDCAQRALYMDVMLENYNNLFFVENHYICHKYENFLDQDTQHIVHEDINIKLKSYKCHEL

SEQ ID NO: 9357 - protein, 81 aa, Mus musculus
DSTGCCERRLVKLRTPNMDLLTYDDVHVNFTQEEWALLDASQKSLYKGVMVETYRNLTAIGYSWEEHTIEDHFQTSRSLGR

SEQ ID NO: 9358 - protein, 81 aa, Cavia porcellus
TRLPLTFEDVAIYFLEEEWQDLEVWQKELYNDVMKTNYETFVSLGGALPKPELISWIEQGREPCRSWGESQHPGNVALSSA

SEQ ID NO: 9359 - protein, 81 aa, Cavia porcellus
VTFEDIAVYFSQEEWGLLDETQRFLYLDVMMENFELTTSLVCEHETKDGEALSTLKKVQPCDICVPVVKDILHLDDLPVQK

SEQ ID NO: 9360 - protein, 81 aa, Cricetulus griseus
PKVPVAFDDVSIYFSTPEWEKLEDWQKELYKNIMKGNCESLISMDYAMSQPDVLSQIQPEGEHSTDDQPRPEASEIPADAS

SEQ ID NO: 9361 - protein, 81 aa, Cricetulus griseus
FQGLVSFEDIAVVFTWEEWQELDAAQRTLYRDVMLENYSNLVFLELCTVKPKLIFNLEHGCGPWSLAEASVWSPPNVHKVS

SEQ ID NO: 9362 - protein, 81 aa, Cricetulus griseus
VQEPVTFRDVAVSFSQDEWLHLDSAQRSLYREVMLENYRNLASLGILFSKPKVISQLEQAEDFQMVESGMLRGVYLGWKSL

SEQ ID NO: 9363 - protein, 81 aa, Peromyscus maniculatus
NFWILRLPPGSKGEVPKEWAKLEDWQKELYKHVMRGNYETLVSLDYAISKPEVLSQIEQGKEPCTWRRTGPKVPEVPVDPS

SEQ ID NO: 9364 - protein, 81 aa, Peromyscus maniculatus
MASPSPLLEPKEWDYLDPARRSLYKDVMMDSYGNLVSLDVLNRNKNEEPTVKEEIEEDIDPPGVIVTRIKSEIDQDPIGRE

SEQ ID NO: 9365 - protein, 81 aa, Peromyscus maniculatus
FKGPVTLRDVTVEFTKAEWKLLTPAQKALYKNVMLENYRHLVAVGYRVVKRSVISKLKQGKEPWILEKELPNRNRAGAFEK

SEQ ID NO: 9366 - protein, 81 aa, Peromyscus maniculatus
ISVKAEPQIFEDVAMYFTEQELASLTLDQKALYKDVVLENFAHVAFLGIRLDGSNPACQPGSSVPVPGERHAESRRGRQIC

SEQ ID NO: 9367 - protein, 81 aa, Peromyscus maniculatus
PQVKVTFEDVAVLLSQEEWARLGPAQRGLYRNVMMETYGNVVSLGLPGSKPVVISQLERGEDPWVLDGQETEQSQGLGSGH

SEQ ID NO: 9368 - protein, 81 aa, Peromyscus maniculatus
VKGLVSFEDVSVDFTWEEWQDLDDAQRKLYRDVMLETYRSLESLGHCITKPEVIFKLEQGTGPWRVEEVPEQSRPDVQKVN

SEQ ID NO: 9369 - protein, 81 aa, Peromyscus maniculatus
EMEPVTFEDVAVNFTSGEWTLLDSSQRKLYRDVMKENFLNLISIEKTQEDVEEDYQNLRRNLGSQVVEKDGEYEHDSHCEK

SEQ ID NO: 9370 - protein, 81 aa, Peromyscus maniculatus
MEPLTFKDVAIDFSGEEWECLNFEQQTLYKDVMLENYRNLVFLGLAVSKPYLVTCLEQRKEPWNVKRQKTVLLFPALFPHY

SEQ ID NO: 9371 - protein, 81 aa, Peromyscus maniculatus
SQELVSFEDVAVDFTWEEWQELDAAQRTLYKDVMLENYSSLVSLGHCVNKPELIFKLEQGLGPWNVAEASDRNLPGLPMWT

SEQ ID NO: 9372 - protein, 81 aa, Peromyscus maniculatus
NAVTYDDVHVAFTWEEWTLLNPSQKNLYKDVMLETYRNLITIGYSRDEHNIEEHCKISRRQERNERSRTGQQPPEYPQCVK

SEQ ID NO: 9373 - protein, 81 aa, Peromyscus maniculatus
DCLTFEDVAVNFTLEEWDLLNPSQKQLYTDVMQETFKNLVAIGQTEEGQRIEEDEHFRRNLRNEVVELLYERSEGRQCEEI

SEQ ID NO: 9374 - protein, 81 aa, Peromyscus maniculatus
LNAVSYDDVHANFTWEEWTLLNPSQKNLHKDVMLETYRNLTTIGYNWEDYDTEEHCQSSRRHERVYHVSLWIQDISASGYG

SEQ ID NO: 9375 - protein, 81 aa, Peromyscus maniculatus
EMEPVTFDDVAVNFSPGEWALLDFSQKKLYRDVMTETFMNLISIGRTEENIEEECANVRSPLRTPVIERECKYGDGCQCGE

SEQ ID NO: 9376 - protein, 81 aa, Mesocricetus auratus
MEMLSFWDVAIEFSPEERKYLDPAQWNLYRDVMLENYSHLDFLGLAVPKPQLVTFLEQRQEPSEVERQAAATVHPGTRSKN

SEQ ID NO: 9377 - protein, 81 aa, Mesocricetus auratus
HGELLSFKDVSIDFSPEEWECLDPAQWNLYRNVMLENYRNLVSLGLTVCKPYLISLLEQGLAPWNVKRQESGTMYPENLCD

SEQ ID NO: 9378 - protein, 81 aa, Mesocricetus auratus
VKIEDVADVAVSFILEEWGHLDQSQKSLSRDGREENCESITPVDYESREGNSELIVRQISNGADSPWATAESPEKNGAQSQ

SEQ ID NO: 9379 - protein, 81 aa, Mesocricetus auratus
MLENYSSLVSLGHCVSKPELIFRLEHGFGPWSIGETSLWNLPGVLEVPALDKSYLENPESPVWPVGRISRNLSNREMLEAE

SEQ ID NO: 9380 - protein, 81 aa, Rattus norvegicus
MLENYSNLVFLGLASSKPYLITLLEQIKEPSDMKKREAITLHPGGKCYMCEECGQVFEWKKVLQNHQKIHLRAKPYKCEEC

SEQ ID NO: 9381 - protein, 81 aa, Mesocricetus auratus
TQGLVTFEDVAVYFSLEEWERLDVEQRDLYREVMQENYGILVSLGYPIPKPDLIFHLEQGEEPWVPDSPHPEEGDIVTGVY

SEQ ID NO: 9382 - protein, 81 aa, Mus musculus
PQTQITFKDVAVDFSQEEWECLDCAQRALYMDVMLENYNNLFFVENHCMCPKFEDMLDQDLQHIVHEHVNIQVKSYECHEL

SEQ ID NO: 9383 - protein, 81 aa, Mus musculus
VCGSVTFRDVAVDFSQEEWACLDATQKVLYRDMMLETYSNLVSVVGSCISKPDLIVLLEQEKEPWMAVKEETDRPSPDLET

SEQ ID NO: 9384 - protein, 81 aa, Cavia porcellus
LTGLMTFEDVAVYFSLEEWERLDADQRGLYQEVMQENYGILVSLGYPVPKPDLIFRLEHGEEPWVPDSPHPEEGDIVTGVY

SEQ ID NO: 9385 - protein, 81 aa, Cavia porcellus
LEGSVSFEDVAVDFSQQEWYQLDPAQRTMHKDVMLETYSNLASVGLCMVKPEMIFKLERGEELWILEEESSGHGYAESLSV

SEQ ID NO: 9386 - protein, 81 aa, Cavia porcellus
LQESFSFDDLSVDFTQKEWQLLEPHQKNLYRDVMLENYSSLVSLGYIVMKPDVIFKLEQGEEPWSRDEVQHSNCSEVWQVE

SEQ ID NO: 9387 - protein, 81 aa, Cavia porcellus
ALTLVSFEDVAVTFTAEEWRHLDLAQRSLYQEVTLQTCELLVSLGHPVPKAELMCLLEYGQRLWMMKRALLQHTCTGQKAK

SEQ ID NO: 9388 - protein, 81 aa, Cavia porcellus
PQAKVTFEDVAVFLSQEEWDRLGPAQRGLYRNVMMETYGNVVSVGLPGSKPNVICQLERGEDPWVLDEHGTTKSQGLGSDC

SEQ ID NO: 9389 - protein, 81 aa, Cricetulus griseus
SQESLTFKDVAVDLSPEEWGQLTPAYRDLYREVMLENYRNLVSVGYQLSKPSVISQLEKGEGPWMAESQGPEDPMIGVKNK

SEQ ID NO: 9390 - protein, 81 aa, Cricetulus griseus
TQGLVTFEDVAVYFSVEEWERLDVEQRDLYREVMQENYGILVSLGYPIPKPDLIFHLEQGEEPWVPDSPHPEEGDIVTGVY

SEQ ID NO: 9391 - protein, 81 aa, Cricetulus griseus
GNQFSFQSLVTFKDVAINFSKEEWECLHTSQKDLYRDVMLENYGNLVSVGLSESKPELVTCLEENKEPWMVNLDEAEDLEQ

SEQ ID NO: 9392 - protein, 81 aa, Cricetulus griseus
PQGLLTFWDVAVDLSQEEWECLDSAQRTLYVDVMLENYSNLVFVDNHHMCVEYKKDLHHGSKDIVHDYMNLQEKPFKCIEL

SEQ ID NO: 9393 - protein, 81 aa, Cricetulus griseus
FQGLVTFSDVTVTFSKEEWECMDSAQWNLYTDVMLENYNNLMFVENYYKCDPVHQLMETEKESCQYNELGKVFHDPSTCAL

SEQ ID NO: 9394 - protein, 81 aa, Cricetulus griseus
MGPVSFKDVTVDFTQEEWQHLDPDQKALYRDVMLENYCHFVSVGFPITKPDMIRKLEQGKELWTERIFPSQSYLEEKPYQC

SEQ ID NO: 9395 - protein, 81 aa, Cricetulus griseus
AVTFKDVALVFTREELRLLDPTQKQLYQDVMLETFKNLIAVGGRDQREAATLRRTALKPLAQEELCCWHIWKQVAQKSSRC

SEQ ID NO: 9396 - protein, 81 aa, Cricetulus griseus
VTFHDVAVDFSQDEWQLLGPMQRNEYCDVMLETLGNLVSVGWQPTSGKQELTPESPTSVAEPVHIPKPKDFSRNDTQSTVS

SEQ ID NO: 9397 - protein, 81 aa, Cricetulus griseus
MSFLGLLTFRDVAVDFQQEEWECLDSTQRALCIDVMLENYSNLVSVGKNILFVEFLNCLFKRKMSITGKSNLKSSIFTYIK

SEQ ID NO: 9398 - protein, 81 aa, Cricetulus griseus
FQGVLTFRDVAVDFSQEEWECLDSGQRALCIDVMLENYSNLDFVENYRKCDPVHQHVKTEKESCQCNELGKVLHDPSTCAL

SEQ ID NO: 9399 - protein, 81 aa, Cricetulus griseus
YQVSKPEVIFKLEQGEEPWISEREIQRPFCPDWKTRPDTKSLGIQRGKSEVSHSTNVLSHAILGDIWDASIQKHQEGWKRH

SEQ ID NO: 9400 - protein, 81 aa, Cricetulus griseus
KVPVTFVDIAVYFSEDEWKNLDEWQKELYSNLVKENYKTLMSLDSDGPVSKPDAPVQAEPREEPCVWEQHHPEEREIPVAA

SEQ ID NO: 9401 - protein, 81 aa, Peromyscus maniculatus
FQNSLTYDDVHINFTCEEWALLDASQKRLYKDVMLETYSNLTAIGYKWEDHNIEEHCQRFRRRGRHKRSRTEERPYECKQC

SEQ ID NO: 9402 - protein, 81 aa, Peromyscus maniculatus
PQSLLSFRDVAIDLSMEEWECLDFAQRALYMDVMLENYYNLVFVENHRICDKYENVLDQGTKPIFCDHVNIQGKLFQCNEL

SEQ ID NO: 9403 - protein, 81 aa, Peromyscus maniculatus
PQGLLSFRDVAVDISQEEWEYLDCAQKALYMDVMLENYNNLLFVENHFICGKYEKVLHQDTKHFIHDHENVKEKSYKCNEL

SEQ ID NO: 9404 - protein, 81 aa, Peromyscus maniculatus
LQEMLSFRDVAIDFSAEEWECLGPAQWSLYRDVMLENYSNLVFLGLAFSKPYLVTFLEQRQEPSDVKRQAAAIQTDIKPYK

SEQ ID NO: 9405 - protein, 81 aa, Peromyscus maniculatus
MLENWKNLVSLGHHLDKPNLISQLEQEDKAIIEERGSIPGICPDLETVLKAKWLTPKEHVFSKEDANGGKTVKLEERDHHG

SEQ ID NO: 9406 - protein, 81 aa, Peromyscus maniculatus
MNAVTYDDVHVDFTQEEWALLDPSQKNLYKDVMIETYRNLTTIGYSWEDNNIEEHCQSSRRHGRHERNHTGVKSCGYTQSG

SEQ ID NO: 9407 - protein, 81 aa, Peromyscus maniculatus
GLLTFRDVAVDFPQEEWEYLDSAQKALYIDVMLENYNNLVFVENHCKCDPVHQHVKTEKESCRCNELVKVLHDLSTCALYK

SEQ ID NO: 9408 - protein, 81 aa, Peromyscus maniculatus
DAVTYEDVHVNFTHEEWALLDPSQKSLYKDVMLETYWNLTSIGYKWEDHNFEENCQSSRRHGRHINCPSGYKPCEHEEYGK

SEQ ID NO: 9409 - protein, 81 aa, Mesocricetus auratus
MLSFWDVAIDFSPEEWECLEPAQWNLYRDVMLENYSHLDSLGLAVSKPFLVTFLEQRQGPWDVKIQAEAPVHPGTIPSDCN

SEQ ID NO: 9410 - protein, 81 aa, Mesocricetus auratus
MEKRGMALDQAKHKEEWECLGPAQRDLYRDVMLENYSNLLSVAGLHIPKPQVISLLEQGKEPWMIGKELTRGLCSALESMC

SEQ ID NO: 9411 - protein, 81 aa, Mesocricetus auratus
WSHMPVTFEDVALYLSKEEWGRLDHTQQNFYRDVLQEENGLALGFPCSRPFRVPRVQGKGEMTSPSRSAGAERRGLGSGVV

SEQ ID NO: 9412 - protein, 81 aa, Mesocricetus auratus
AAGSVSFEDVAVDFTWREWQGLDAAQRILYKDVMLETYSSLVFVGHCTTKPELIFKLEQGFGPWCKAEASVWNVRACVPIE

SEQ ID NO: 9413 - protein, 81 aa, Mesocricetus auratus
SEGLVTFEDVSVDFTWEEWQNLDDAQRKLYRDVMLETYSSLLSLNQCDPKPELILKLEQEAGPWKEEDIPNQSLPDMQHVN

SEQ ID NO: 9414 - protein, 81 aa, Mesocricetus auratus
MEKVVFEDVAVNFTSGEWALLDSSQKKLYRDVMKETYLNLIFIEKAVEKNIGEDCKHLIRNTRTQAIDKDCGYACDHDCDK

SEQ ID NO: 9415 - protein, 81 aa, Mesocricetus auratus
TVDESGLKLPASRVLGLKDTVTYEDVHVNLTHEEWALLDPSQKSLYKDVMLETYWNLTSIGYKWEDQNIEEHCQSSRRHER

SEQ ID NO: 9416 - protein, 81 aa, Mesocricetus auratus
SQDLLTFGDVSLDFSQEEWECLESASKALYIDVMLENYRNLVFVEKYHMYVKNMNILDQGSKHIVYHPVNIQEKSYENSEI

SEQ ID NO: 9417 - protein, 81 aa, Mesocricetus auratus
HMGLLTFQDVAVDFTQEEWECLDSAQRTLYIDVMLENYSNLVSLGIISCKADLVPCLEQIQMACNVKKEEMVARPGFVDSD

SEQ ID NO: 9418 - protein, 81 aa, Mesocricetus auratus
GSVSFTDVTVDFTQEEWEQLDPSQRILYMDVMLENYSNLLSVEVWRADDHVEKNPRDPDEQARPLTTLKNQPPVEERGNLF

SEQ ID NO: 9419 - protein, 81 aa, Ictidomys tridecemlineatus
TARSQEKMTFKDVAMDFTPEEWGKLDPKQRDMMLENYRNLVSLWLPVSKPENYNLDSGKEPLKLERKTPKCSYSDVETLPE

SEQ ID NO: 9420 - protein, 81 aa, Mesocricetus auratus
MNTVTYDDVHVNFTWEEWTLLDPSQKNLYKDVMLETYRNLTAVGYSWEDHNVEEHCQSYRRHSRLERSHTGEKSSVHTQCV

SEQ ID NO: 9421 - protein, 81 aa, Ictidomys tridecemlineatus
MITNYETLLSLDDRLSKPELISWIEQEEEPFKSWGESQEPRNMIHSADMYFDPYIEGEFFGGSQETVKSGETKCHFQFSPL

SEQ ID NO: 9422 - protein, 81 aa, Ictidomys tridecemlineatus
SQEAVTFEDVAVYFTQNQWASLEPAQKALYQEVMLENYANITSLAALPFPKPDLIFQLELGEAPWVPDSWRPVGEEALGGR

SEQ ID NO: 9423 - protein, 81 aa, Ictidomys tridecemlineatus
MFENYRNLAWLGLSISKPNMISLLEQGKEPWMVERKMSHDQCADWESWCEMKELSPKLFIDEEEISQCMVTERLTSHGLEC

SEQ ID NO: 9424 - protein, 81 aa, Ictidomys tridecemlineatus
SQGPVLFEDVSVDFTQKEWQLLDPAQRRLYRDVMLENYRHLESLGHCVTKPELIRRLEQGEEPWILKREVPSHSHAEVQRA

SEQ ID NO: 9425 - protein, 81 aa, Marmota monax
MFEEVSVCFTSEEWACLGPIQRALYWDVMLENYGNVTSLEWETMTENEEVTSKPNISQRADAQKGISKRLQGSVSQVPGFE

SEQ ID NO: 9426 - protein, 81 aa, Marmota monax
VQEPVTFEDVAVDFTQEEWGQLDLVQRTLYRDVMLETYGHLLSVGNQMAKPEVISLLEQGEEPWLVEQTCPESSCPEWMRD

SEQ ID NO: 9427 - protein, 81 aa, Marmota monax
SKAPVTFGDLAIYFSQEEWEWLSPIQKDLYEDVMLENYTNLVSLGLSSRRPNVIALLEKGKAPWMVEPPRRRQGPDSRSKC

SEQ ID NO: 9428 - protein, 81 aa, Peromyscus maniculatus
SQNLLTFRDVTIDFHQEEWECLDFAQRALYIDVMVENYNNMVFVENYCKCDPVHQQVKTEKESYQCNELGKVLHDPSICAL

SEQ ID NO: 9429 - protein, 81 aa, Peromyscus maniculatus
SQDLVTFEDVAVYFIWKEWKRLEPAQRDLYRDVMLENYGNVFSLDGESKTGNDQILSEGMGSHEMILGRLQTDVSQGLKFE

SEQ ID NO: 9430 - protein, 81 aa, Peromyscus maniculatus
VSFEDLAVNFTQEEWDLLDPSQKILYGDVMLETCRNFTAIGYEWEDHTIEDHHEEPEINLRHIISHSEYTQYEPEDCEQKP

SEQ ID NO: 9431 - protein, 81 aa, Rattus norvegicus
WFQDLKFEDVVIYFSLEEWECLHHSHRNLYRAVMLDNYSNLLSLSLANMKPRVVSLLEQGKEPWMVMRNGTKVWCADWESK

SEQ ID NO: 9432 - protein, 81 aa, Rattus norvegicus
MEEMLSFWDVAIDFSPEEWECLEPVQWNLYRDVMLENYSNFVFLGLTFSKPFLVTFLEQGQGPWDMQRQAAAAVHPGIALN

SEQ ID NO: 9433 - protein, 81 aa, Mesocricetus auratus
PQESVTFKDVAVDFTQEEWHHVDPAQRSLYRDVMLENYSHLVSLGYQVSKPEVIFKLEQGEEPWISEREIQRPFCPDWKTR

SEQ ID NO: 9434 - protein, 81 aa, Mesocricetus auratus
METVTFEDVAVDFTLEEWALLDSSQKKLYRDVMKETFFNLISIEKTLEENTEEDYQDLRRNMRSPVLEEDCGYECDTECDK

SEQ ID NO: 9435 - protein, 81 aa, Mus caroli
SKNLLTFEDVSVNFTQEEWQWLSDTQRNLYRKVTLENYRSLVSLAGIPVYKPAVISLLEQGKDPWMVQKKGARDTCPDWEY

SEQ ID NO: 9436 - protein, 81 aa, Mus caroli
CQALVTFEDVAVTFTDDEWKRLVPVQRALYKAVMLENYESIISLGLPVPRPDLILQFKRRGEPWMRGFHGSEEKAWPESVS

SEQ ID NO: 9437 - protein, 81 aa, Mus caroli
YQDSVTFDDVAVEFTPDEWTLLDLTQKNLYREVMLENYENLTSVGCQLFIPSLTPWLKQEEPEAESAVPQQLELQPTIDDS

SEQ ID NO: 9438 - protein, 81 aa, Mus caroli
CERWMSFEDVTVNFSQEEWQQLDSAQRHLYQEVMLEIYSHLLAVGYSIPSPGVIFRMEKGKEAQTAKAEFPGQRCQEKSGN

SEQ ID NO: 9439 - protein, 81 aa, Mus caroli
GSVSFTDVTVDFTQEEWEQLDPSQRILYMDVMLENYSNLLSVEVWKADDEVEKDPRDLQRQAGSLTAIKSQPPTEERGSLS

SEQ ID NO: 9440 - protein, 81 aa, Cavia porcellus
SVTFEDVAVYFSWEEWDLLDEAQRHLYLEVMLENLALMSSLGCSCGVDDEVAPSELGLYVDLSRVMTLKEGLSSQNAYTYE

SEQ ID NO: 9441 - protein, 81 aa, Cricetulus griseus
QGVLTFRDVAVDFSQEEWECLGSAQRALCIDVMLENYSNLVFVENYCKCVPGHQYVKIEKESCQCNVFGKVLHDPSTCALY

SEQ ID NO: 9442 - protein, 81 aa, Cricetulus griseus
EKQFSFQSLLTFEDVAINFSKEEWECLNTSQRDLYRGFLLKNYSNLVSVGHSESKPELVTCLEQNKEPWKVNIEEAERLEP

SEQ ID NO: 9443 - protein, 81 aa, Cricetulus griseus
FWGLLTFRDVTVDFSQEEWQCLDSAQRTLYIDVTLENYNNLLCVENYCICDPVHHHVKTEKESHQCNELGKVLHDPSTCAL

SEQ ID NO: 9444 - protein, 81 aa, Cricetulus griseus
QQEMVTFKDVAVVFSKEELVLLDAAQRKLYRDVMLDTFRTLLSVAHEPFKPGLIAQLENEEKLCMVEAQAGGNDASGSAGS

SEQ ID NO: 9445 - protein, 81 aa, Cricetulus griseus
SQGLLTFKDVTVDISQEEWVCLDSAQRALYIDVMLENYSNLIFAENYCKCDPVHQHVKTEKESCQCNELGKVLHDPSTCAL

SEQ ID NO: 9446 - protein, 81 aa, Cricetulus griseus
MLENFSNLVFLGLASSKPYLVTFLEQSQGSNDMKRQGSAAMQTVLCVHKRSHTGEKPYICEVCDKDFHAASLLKAQARIHT

SEQ ID NO: 9447 - protein, 81 aa, Cricetulus griseus
SQEQVSFKDVCVDFTKEEWYLLDPAQKGLYRDVTLENYSNFVSVGYCVTKPDVIFKIEQGEDPWIPENGFQCHPERKWKAD

SEQ ID NO: 9448 - protein, 81 aa, Cricetulus griseus
EMEPVTFEDVAVNFSPGEWAFLDSSQKKLYRDVMTEIFMNLISIGKTEENIEEECANDRNLRTQVVERDCKYGDACQCEAH

SEQ ID NO: 9449 - protein, 81 aa, Cricetulus griseus
PKGTVTFKDVAIDFTPEEWKQLDPIQRNLYRNVMLENYNNLITVGSPLTKPDVIFKLEQEEEPCIVEKEMVKRHSPGEIWG

SEQ ID NO: 9450 - protein, 81 aa, Cricetulus griseus
PVTFEDVAVDFTVGEWALLDSTQKKLYSTVMEETFLNLISIGKALKENIEEDRKELSGNMGAQVTEKACGYECASRCNTNQ

SEQ ID NO: 9451 - protein, 81 aa, Castor canadensis
LQEQVSFKDVCVDFTKEEWCLLDPTQKILYRDVILENYSNLTSVGYCVTKPDVIFKIEQGEEPWILEKGFPSQCHPERKWK

SEQ ID NO: 9452 - protein, 81 aa, Peromyscus maniculatus
MLSFWDVAIEFSAEERECLEPAQWNLYRDVMLENYSNLVFLGTTPNDYNIYKKAIDCKSLYIPHQRIHTREKPYKCEECGK

SEQ ID NO: 9453 - protein, 81 aa, Peromyscus maniculatus
SQGLVTIKDVSLCFSQEEWRSLDPSQTDFYGEYVMQENCGIVVSLRFPIPKLDMLSQLEGGEEQWVPDPQDLEGRDILKVT

SEQ ID NO: 9454 - protein, 81 aa, Peromyscus maniculatus
IVVHMAFRDVAVDFSQEEWSLLNPAQRSLYKEVMLENYSNLVSLGIPFSKPKLITQLEQGKETWQEERTCPQVACQAQAKR

SEQ ID NO: 9455 - protein, 81 aa, Peromyscus maniculatus
PKVPVAFDDVSIYFSTPEWEKLEEWQKELYKNIMKGNYESLISMDYAMNQPDVLSQIQPGEHSTDDQPRPEASEIPADASE

SEQ ID NO: 9456 - protein, 81 aa, Peromyscus maniculatus
QQGCVTFEDVAICFSREEWRLLDKTQRLLYLNVTLQNFALINSLGCGHRTEDEEQRVSTRASWVWRSETTLSPPKTHLCEK

SEQ ID NO: 9457 - protein, 81 aa, Peromyscus maniculatus
MDAVTYEDVHVNFTHEEWALLDPSQKSLYKDVMLETYWNLTSIGYKWEDYNIEEYYQGSRRHGRYINCQCSYNSCEHKGYG

SEQ ID NO: 9458 - protein, 81 aa, Peromyscus maniculatus
MEEWALLSPSQKKLYRDVMQETFRNLAAIGMEQEDQNFEKDYRCSQRNPKSQMGKSLCEHNEDNQCVENFSWILDPTLYKD

SEQ ID NO: 9459 - protein, 81 aa, Peromyscus maniculatus
EQDAVTYEDVHVNFTHEEWALLDPSQKSLYKDVMMETYWNLTCIGYKWEDHNIEEHCQSCRRNGSRCVICHSGHNPCEHKG

SEQ ID NO: 9460 - protein, 81 aa, Peromyscus maniculatus
EAVTYEDVHVNFTHEEWALLDPSQKHLYKDVMLETYWNLTCIGYKWEDHNIEEHCQSCRRNGRCVICHSGHNPCEHKGHGK

SEQ ID NO: 9461 - protein, 81 aa, Peromyscus maniculatus
MEDMLSFWDVAIYFSAEEWECLGPAQWNLYRDVMLENFSNLVFLGLTSCKPYLVTFLEQRQEPSDVRTQGAAATQAGKKCY

SEQ ID NO: 9462 - protein, 81 aa, Peromyscus maniculatus
MDPSQRNLYKDVMVETYMNLTAIGYNWEDLEVEEHCQNSLKHGRQERPHTTEKSCEYMGCGKAFVCHSHPQRHEKTQTGEK

SEQ ID NO: 9463 - protein, 81 aa, Peromyscus maniculatus
MEELLSFTDVAINFSVEECECLEPAQWNLYKEVMLENYSNLVFLGLVFSKPYLVTFLEQNTEPWIVKRKAPAASRPGSKPH

SEQ ID NO: 9464 - protein, 81 aa, Peromyscus maniculatus
EAVTFKDVAVVFSEEELGLLDAAQRKLYHDVMLENFRMLLSVGSRNLNEMESLQEAGWRHLPREELFCSRIWQQVTRELTQ

SEQ ID NO: 9465 - protein, 81 aa, Mesocricetus auratus
STNLLTFRDVSVDFSREEWECLDSAQRALYIDVMMENYSNLLSVENYYIHDRVHHHVKTEKESCQCDELDKVLHDPSTCAL

SEQ ID NO: 9466 - protein, 81 aa, Mesocricetus auratus
MVTFRDVAVDFSQEEWDCLTPSQRHLYSHVMLENYRILVSLGLCFSKPRVILLLEQGKEPWTVKTELTDSLSTEWESMYVT

SEQ ID NO: 9467 - protein, 81 aa, Mesocricetus auratus
LREDAVTYEDVHVNLTHEEWALLDPSQKSLYKDVMLETYWNLTSIGYKWEDDNIEEHSQSSRRHGRHIICHSGYKPCEYLG

SEQ ID NO: 9468 - protein, 81 aa, Mesocricetus auratus
MLENYSNLLSVGLHIPKPQVISLLEQGKEPWMIGKELTRGLCSALESMCESKLLSLKKEVYEIESCQRELMGLKKHGLEYS

SEQ ID NO: 9469 - protein, 81 aa, Mesocricetus auratus
MLENYSHLVSLGYPITKPKVITSLEQGILDIIKREIPSSSCTDDGQAEDCLEWHEKNQNAHLEQAISIVEKNVTEERSCEY

SEQ ID NO: 9470 - protein, 81 aa, Mesocricetus auratus
MSFEDVTVTFSEEEWQQLDSAQRRLYQDVMLEIYSHLLAVGFPIPSPGVVFRLEKGKEAQAGKVEFPGQQSQEKSGIDTSP

SEQ ID NO: 9471 - protein, 81 aa, Mesocricetus auratus
MEDMLSFWDVAIYFSAEEWECLGPAQWNLYREVILENYNNLVFLGLASSKPYLVTFLEQTAPDMKRQAAGTMQPGKEQYIG

SEQ ID NO: 9472 - protein, 81 aa, Peromyscus maniculatus
SKAPVTFGDLAIYFSQEEWEWLSPIQKDLYEDVMLENYQNLVLLGLACRRPNIITLLEKGKAPWVVEPSRRRRGPESGSKC

SEQ ID NO: 9473 - protein, 81 aa, Octodon degus
LQAHMAFRDVAVDFSQEEWRLLSPAQRSLYREVMLETYSHLVSLGIPFSKPKLITQLEQGKEMWREERKCPPAICPAEPKS

SEQ ID NO: 9474 - protein, 81 aa, Octodon degus
AQVQVTFRDVAVEFSQEEWESLDLTQRALCQEVIMENYRNLVSLGICLPNLNVICMLEHGKEPWTVENEMKIAKTPSGWEY

SEQ ID NO: 9475 - protein, 81 aa, Octodon degus
FKGPVTLKDVTVEFTKEEWKLLTPAQRTLYKDVMLENYRHLVSVGYRVNKSNVISKLKQGKEPWILEVEFPCRQSSENLRN

SEQ ID NO: 9476 - protein, 81 aa, Octodon degus
VSVSFTDVTVDFTQEEWEQLDPSQRILYMDVMLENYSNLLSVEVWKADDQMEREHRNPDEQARQFMILKNQTALEERGNLF

SEQ ID NO: 9477 - protein, 81 aa, Cricetulus griseus
GNQFCFQSLLTFKDVAINFSKEEWECLHTSQRNLYRDVMLENYSNLVSVGLSESKPELVTCLEENKEPWMVNIDEAEGLEQ

SEQ ID NO: 9478 - protein, 81 aa, Mus caroli
MLSFRDVAIDFSAGELECLEPAQWDLYRDVMLENFSHLVFLGFSFSKPLLVRFLEKNQELRNVKRKAAAVPRGKKLYKCKE

SEQ ID NO: 9479 - protein, 81 aa, Mus musculus
SQELVTFEDVAVYFIWREWKRLEPAQRDLYRDVMLENYGNVFSLDGDSKTGNDRVISEGMGSCEMILGRFQKDVSQGLKFE

SEQ ID NO: 9480 - protein, 81 aa, Mus musculus
MDLVTYDDVHVNFTQDEWALLDPSQKSLYKGVMLETYKNLTAIGYIWEEHTIEDHFQTSRSHGRHERSCSAEQPSEFIQCG

SEQ ID NO: 9481 - protein, 81 aa, Cavia porcellus
IQDLLTFRDVAIEFSQEEWKCLDPAQRTLYREVMLENYMNLVSLGISPFDQSVFSMLEQEAEPWSMDGQVKASRNSDRWEN

SEQ ID NO: 9482 - protein, 81 aa, Cavia porcellus
YQEFVTFEDVAVYLTREEWGCLDPVQRNLYREVMLENYGNVVSLGILLRLPTTRIHCVNSCPALSHTQASAFSGETLAVLS

SEQ ID NO: 9483 - protein, 81 aa, Cavia porcellus
SRGSVSFKDVTVDFTQEEWQHLDPKQKSLYRDVMLENYSHLVAVGYCVTKPELIVRLEQAKEPWILKEEFPRPSFQEFWKT

SEQ ID NO: 9484 - protein, 81 aa, Cavia porcellus
FQELLTFKDVTVDLSLEEWECLDSAQRNLYRDVMLENYRNLVFLGLAVSKPYLITLLEQSKKPWIVKCQKAAAMHSAMSYA

SEQ ID NO: 9485 - protein, 81 aa, Cavia porcellus
KQGQVNFEDVFVCFSQEEWELLDEAQRFLYRDVMLENFALMASLGCWRGEEDKKIPCEQSVSIKGVSQIRISRGSPSTQKA

SEQ ID NO: 9486 - protein, 81 aa, Cricetulus griseus
MDGLLSFRDVSVDLSQEEWECLDCVQRALYTDVMLENYSNLLFVENHRICGKHENVLHQGTNYCIHGHEYIQEKTNTCNEP

SEQ ID NO: 9487 - protein, 81 aa, Cricetulus griseus
RGTEPVTFRDVAVFFSQDEWLRLDSAQRSLYREVMLENYSNLASLGIQASIPRVIGKLQKGQDPCMEREDLEDTCLDFQIW

SEQ ID NO: 9488 - protein, 81 aa, Cavia porcellus
LQGMVSFEDVVVDFTWEEWKNLDDAQRTLYRDVMLETYSNLLSLGNCITKPDVIFKLEQEAQLWVVDKIPNQIFPDFKKTQ

SEQ ID NO: 9489 - protein, 81 aa, Cavia porcellus
QEIPVSFKDVVVGFTQEEWHWLNPVQRALYRDVMLETYSNLVSVGYEGTKPDVILRLEQEEAPWVCEAPCPGCCCWEDIWQ

SEQ ID NO: 9490 - protein, 81 aa, Peromyscus maniculatus
MLENYSHLVSLGCQVSKPEVIFKLEQGEEPWISEREIQRPFCPDWKTKPDTKSSSLQRGKSDVSHSTNILSYATLGDIWDD

SEQ ID NO: 9491 - protein, 81 aa, Peromyscus maniculatus
CQGVVTFGDVAVVFSREEWEWLSPEQRSLYWRVMLDNYSNLASLGLCASKPDMIALLEQGEDPWVTKRKRTGGRCPDLKAV

SEQ ID NO: 9492 - protein, 81 aa, Peromyscus maniculatus
MLENYSHLVSLGYPITKPDVITSLEQGVLGIIKREIPSSSCTEDGQTEDYLEWHQENQNIHLEQAVSIFEKNVTERSYEYD

SEQ ID NO: 9493 - protein, 81 aa, Peromyscus maniculatus
SQEALTFKDIAVDFSQEEWAQLAPAYRDLYREVMLENYRNLVSVGYRLSKPRVISQLEKGEGPWMAESQGPEDPIFDEKRK

SEQ ID NO: 9494 - protein, 81 aa, Peromyscus maniculatus
EKNGVTYDDVHVDFTWEEWALLDPSQKSLYKDVMLEIYRNLTDIGYSCEDHNIEEHCGSSRIHGRYERSHTEEKPSEYSHC

SEQ ID NO: 9495 - protein, 81 aa, Peromyscus maniculatus
FQGLLTFRDVAVNFPQEEWECLDSAQRALYIDVMLENYNNLVFVENYCKCDPVHQQVKTEKESYQCNELGKVLHDPSICAL

SEQ ID NO: 9496 - protein, 81 aa, Peromyscus maniculatus
MDAVTYEDVHVNFTQEEWALLDSSQKSLYKDVMLETYENLISVGYKWEDQNIEEHCQSSRRHGRYKPCEHKGYGKKQCTSL

SEQ ID NO: 9497 - protein, 81 aa, Peromyscus maniculatus
QGLLSFRNVDVDFSKEEWEYLDCAQRALYMDVMLENYNNLVFVVLAQHDLNPSTLDADARVYEYHRICHKYGKVLDQGTTH

SEQ ID NO: 9498 - protein, 81 aa, Peromyscus maniculatus
MLENYSNLVFLGLAFSKPYLVTFLEQRKEPWSVKRHAKVGAHAGSKSYKCKECGKTFDWKPLLIKHQSIHTGGKPYICKEC

SEQ ID NO: 9499 - protein, 81 aa, Peromyscus maniculatus
FWGLLSFKDVSVELSSEEWQLLDPAQQQMYREVTLENYSNLLSVGYLDTKPELIFKLEQGKEPWVINAKMSTQSCPEGWKK

SEQ ID NO: 9500 - protein, 81 aa, Peromyscus maniculatus
QEPVTFEDVAVNFTLEEWALLDSSQKKLYSTVMKETFLNLISIEKALEEKTEEDYKDISRNMGIRVIEKDCEYECDSNCDK

SEQ ID NO: 9501 - protein, 81 aa, Ictidomys tridecemlineatus
SRSLENDGVCFSEQEWENLEDWQKELYRNVMESNYETLVSLKVLGQPEGEADLGTEMLGDLEEEGPDAAHPVDGAVVKQEV

SEQ ID NO: 9502 - protein, 81 aa, Ictidomys tridecemlineatus
LQGPVSFKDVAVDFTQEEWQQLDPEEKMTYRDVMLENYSNLVSVGYDVTKPNVIIKLEQGEEPWTIEDDFPSQSHSEVWEI

SEQ ID NO: 9503 - protein, 81 aa, Dipodomys ordii
YQEFVTFEDVAVHLTREEWGCLDPVQRDLYREVMLENYGNVVSLGFPISKPDEITPLEQDLQVFDPETKDREVLRDDCSDG

SEQ ID NO: 9504 - protein, 81 aa, Rattus norvegicus
PKVPVAFDDVSIYFSTPEWEKLEEWQKELYKNIMKGNYESLISMDYAMNQPDVLSQIQPEGEHSTDDQPRPEASEMPADPS

SEQ ID NO: 9505 - protein, 81 aa, Mesocricetus auratus
PGLHVTFEDVAIHFSQEEWMLLDKAQRFLYCTVMLENLALVASLGSCPGVGGEEVTSERGAPPEGVMTEASPSTQETHLIE

SEQ ID NO: 9506 - protein, 81 aa, Mesocricetus auratus
MESVSFEDVAVKFTQEEWALLDPPQKKLYKDVMQETLRNLASIGNKLENQKIVNEYENLWRKLSSQLVEQFCDYKGSLQCT

SEQ ID NO: 9507 - protein, 81 aa, Mesocricetus auratus
SQAPVTFEDMAMYLTREEWRPLDPTQRDLYRDVMQENYGNVVSLDFEIRSENEVNQKQELSEDVEFVTMSEEPIGDAEKNP

SEQ ID NO: 9508 - protein, 81 aa, Mus musculus
PQGLLTFRDVAVDFPQEEWECLDSDQRALYIDVMLENYRNLVSVENYCICDTVHQHVKTEKESCQGNKLGEMLHEPSNCAL

SEQ ID NO: 9509 - protein, 81 aa, Mus caroli
CLTFEDVAVNFTLEEWDLLDPSQKQLYTDVMQETFKNLIAIGQIEEVQRSKDVDEDSRRNLRRGLVELLYEPNEGRRCDGI

SEQ ID NO: 9510 - protein, 81 aa, Mus caroli
FRESVTFKDVVVNFTQEEWKHLDPIQRDLFRDVTLENYTHLVSIGLQVSKPDMISQLEQGTEPWTEDSCIPVGSLEDWKKR

SEQ ID NO: 9511 - protein, 81 aa, Mus musculus
SQGLLAFKDVAVEFSQEEWGCLDSAQRSLYINVMLENYNNLVSVENYCIRDTVDQHVNTEKESCQYNELGKILHEHFKCAL

SEQ ID NO: 9512 - protein, 81 aa, Mus musculus
MDAMTYEDVHVNFSREEWALLDPSQKSLYKDVMLETYWNLTCIGYMWEDCNIEDHCQSSRRHGRCINCPSAYGKKQCTNLF

SEQ ID NO: 9513 - protein, 81 aa, Mus caroli
DQELVSFEDVIVDFTQEEWTSLNPDQRNLYRDVMLENYQNLATVGYQLIKPSLISWLEQEEFSKGQKIVFPEWKLQLETKC

SEQ ID NO: 9514 - protein, 81 aa, Mus caroli
FETLNDVAMDFTVEDWKDLESELDQRDLFWDVTLNDYQDMFSFNTPQPSLTSQPDVREELEATSTEVPETKNSPLQNGFLE

SEQ ID NO: 9515 - protein, 81 aa, Mus musculus
PQGLLTFKDVALYFSLEEWECLSFAQRTLYMDVMLENYNNLLFVENHCIHGKYGKVLGEESQYIVHEHVNIQEKSSKWDKL

SEQ ID NO: 9516 - protein, 81 aa, Mus musculus
MLSFWDVAMYFSAEEWEYLGPAQWKMYRDVMLENYSNLVFLGLASTKPYLVTFLEQRQELSDVKRQAATAKYSGGKSYTCK

SEQ ID NO: 9517 - protein, 81 aa, Mus musculus
MTFRDVAVDFSPEEWECLSLDQKSLYRDVMLENYSHLVSVGLCIYQPHGFPVPEKEQDACMDLGNEPSRFCPDTDSRWQMK

SEQ ID NO: 9518 - protein, 81 aa, Cavia porcellus
VVFEDVALRFSQKEWGLLSLAQRSLYRDVMLENFALISSLGCLCRVKDEESSPKQVKNSGIHVGEQLCTCGEQGANQATTG

SEQ ID NO: 9519 - protein, 81 aa, Cricetulus griseus
VSGSIENDGVCFSEQEWENLEDWQKELYRNVMESNYETLVSLKVLGQPEEEAELGAEMVGDLVEEGTHLDRAMVKQEGPAG

SEQ ID NO: 9520 - protein, 81 aa, Octodon degus
SQAPVTFEDMAMYLTREEWRPLDPTQRDLYRDVMQENYGNVVSLDFEIRSENEVNPKQEISEDVEFGTTSERPGGNVEENP

SEQ ID NO: 9521 - protein, 81 aa, Peromyscus maniculatus
CERWMSFEDVTVNFSQEEWQQLNSAQRRLYQDVMLEIYSHLLAVGYPIPSPGVIFRMEKGKEAQAGQAEFPGQHCQEKSGI

SEQ ID NO: 9522 - protein, 81 aa, Peromyscus maniculatus
VDCLKSSNKDGAVDFTQEECTTKDPTQNIIPSDVTVEDYKNLVSVGCQTLTKPSALTCLKEELVSTQREVLQELEKQLQTK

SEQ ID NO: 9523 - protein, 81 aa, Rattus norvegicus
TARPQEAVTFKDVAMDFTPEEWGKLDPVHRDVMLENYRNLVSLWLPISKPDDYDSEDGKELLKLERKSPKCSDSDVETRPE

SEQ ID NO: 9524 - protein, 81 aa, Mesocricetus auratus
QGYLTFKDVAVDFSQEEWECLDSVQRALYIDVMLENYRNLVSVENYCMCAIVHQQVDCEEKYSKCNELDEMLHESTRCTVY

SEQ ID NO: 9525 - protein, 81 aa, Rattus norvegicus
SEGLVTFKDVAIDFTPEEWKQLDPTQRNLYRNVMLENYNNLITVGPPLSKPDVIFKLEQEEEPCVVEKEVLRRRRPGEILG

SEQ ID NO: 9526 - protein, 81 aa, Mus musculus
MLENYSNLLFLGHCKTKPELIFNLEQRLGSWIVEASHQCVPDFQNMSTLNKSSPDTKARHVWQVALNSETSKELAGIGNTC

SEQ ID NO: 9527 - protein, 81 aa, Mus caroli
AWVPALFDEVAIYFSDEEWEVLTEQQKALYREVMRMNYETVLSLEFPFPKPDMINRLESDEECPNSDEWRLQGVTFAENEE

SEQ ID NO: 9528 - protein, 81 aa, Mus musculus
PQGLLTFKDVAVEFSLEEWERLSFAQRSLYIDVMLENYNNLLFVENHFICAKCGKALDEDSQYIVHEHMNIQEKSSKWNKL

SEQ ID NO: 9529 - protein, 81 aa, Mus musculus
MEEMLSFRDVAIDFSEEEWECLGPAQWNLYRDVMLENYSHLVFLGLALSKPYLVTCLEKIQETSGVKRGGAPFMLPGGKCY

SEQ ID NO: 9530 - protein, 81 aa, Mus musculus
MDALTFDDVHVHFTREEWSLLDPSQKRLYKDVMLENYRNLTAIGYNWKDHNIEEHCQNDRRYGRHKITPAGEKPYEYTQWD

SEQ ID NO: 9531 - protein, 81 aa, Mus musculus
QCLLTFKDVFLDFSSEEWECLNFAQRTLYMDVMLENYNNLLFVENHCICGNYEKEKVLEQDTQHIVNEHGHNRKKSSKCNE

SEQ ID NO: 9532 - protein, 81 aa, Mus musculus
LQEAVTFNDVAIDFSPEEWDWLNPAQRSLYRTVVLENYRNLVSVGGKSVQKTHELSLRQLVFEDVAVENTTSLGCESLTSG

SEQ ID NO: 9533 - protein, 81 aa, Cavia porcellus
SQGLVTIKDVSLSFSQEEWRSLDPSQTDFYGEYVMQENCGIVVSLRFPIPKLDMLPQPEGGEEQWVPNPQDLEERDILRIT

SEQ ID NO: 9534 - protein, 81 aa, Cavia porcellus
AQVEVTFEDVAVLFTRDEWRKLDALQRSLYRDVMLENYRNLASLGFPFTKPRVISLLQQGEDPWKVEKEIPGDPSLGCKSS

SEQ ID NO: 9535 - protein, 81 aa, Cavia porcellus
MLENYFNLVSVGCQVPNPEVFFSWEPGEDPCSLGRENSSHSYTGEDIGLEASQPEPSEEFFLQPDRIHLFIRDLELWKDDK

SEQ ID NO: 9536 - protein, 81 aa, Cavia porcellus
KPGVVRFADVAVYFSPEEWGCLRPAQRALYRDVMCETYGLLGALGFPGPKPALISWMEQESEAWSSAAQDPEEGESLVGAL

SEQ ID NO: 9537 - protein, 81 aa, Cricetulus griseus
SKASVTFGDLAIYFSREEWEWLSPIQKDLYEDVMLENYQTLVSLGLVCRRPNIITLLEKGKAPWMVEPSRRRRGPESGSKR

SEQ ID NO: 9538 - protein, 81 aa, Cricetulus griseus
LQHLVTFRDVSVDLSQEEWECLDCAQRALYVDVMLENYRNLVFVGNRCICHNYENVLDQSSMPIVHQHANTQVKPYKCNQP

SEQ ID NO: 9539 - protein, 81 aa, Castor canadensis
PKVPMAFDDVSIYFSTPEWEKLEEWQKELYKNIMKGNYESLISMDYAMNQPDVLSQIQPEGEHNTEDQAGPEESAIPADPS

SEQ ID NO: 9540 - protein, 81 aa, Peromyscus maniculatus
LKEPVTFRDVAVDFTQEEWGQLDPTQRTLYRDVMLETFGHLLSVGPDLPKPAVISQLEQGAELWVAERGGSRACHPGWILG

SEQ ID NO: 9541 - protein, 81 aa, Peromyscus maniculatus
MEEMLSFWDVAIDFTPEEWECLEPAQWDLYRDVILENYSHLDFLGLTVSKPYLVTFLEQRQGPWDVKKQAGTTPNNYNNYS

SEQ ID NO: 9542 - protein, 81 aa, Peromyscus maniculatus
VAFDDVAINFTQEEWALLDTSQKNLYTDVMQEVFRNLNYIENGWEDQNIEEDKNPEINLRHIITDSGYNLYENQEYSEKPY

SEQ ID NO: 9543 - protein, 81 aa, Peromyscus maniculatus
MDAVTYEDVQVSFTREEWTLLDPSQKSLYKDVMVETYRNLTAIGYKWEDQNIKKHHQCSRRHGRHERSNSAEKDYECEQCG

SEQ ID NO: 9544 - protein, 81 aa, Peromyscus maniculatus
HKKSMVFSDVSLDFSQEEWECLGPAQKDLYRDVMLENYSHLLSVAGLHIPKPQVISLLEQGKEPWMIGKELTRGLCSALES

SEQ ID NO: 9545 - protein, 81 aa, Peromyscus maniculatus
MLENYSSLASLGIQASVPRVIGKLQKGQDPCMEREDPEDSCLDLQIWPDMEALPPKQDIFIEEPSHGLIKHESTEGVHWKT

SEQ ID NO: 9546 - protein, 81 aa, Peromyscus maniculatus
PQGLLTFRDVSVYISQEEKECPDSSQRALYIDVMLENYNNLVSVGNYCKCDPDHQHVKTGKEPCQCNELGKVLHDPSTCAL

SEQ ID NO: 9547 - protein, 81 aa, Peromyscus maniculatus
MVLVSFEDVAVDFTWEEWQGLDAAQRTLYKDVMLENYSSLVSLGHCMAKPELIFNLEHGFGPWRTADASVWNLAGVNKMSS

SEQ ID NO: 9548 - protein, 81 aa, Peromyscus maniculatus
MDLVTFEDVTVNFTQDEWALLDSSQKNLYREVVGEIFMSLASMGERWDQNIEDWYRKQGRILSNHIIGRLGDSKRGSRGGE

SEQ ID NO: 9549 - protein, 81 aa, Peromyscus maniculatus
SQGLLTFRDVTVDFPQEEWECLDSAQKALYIDVMLENYNNLVFVENYCKCDPVHQHLKTEKESCQYKELGKVLHDHSRCAL

SEQ ID NO: 9550 - protein, 81 aa, Peromyscus maniculatus
MLENYRSLVWLGHCLAKPELISKLEQGLVPWSGAEATEQCLPDVHKWSALAETRQQAQEKYLGQLEITKRNSSNEDMVEVE

SEQ ID NO: 9551 - protein, 81 aa, Peromyscus maniculatus
MDLMTFGDVAIHFSPEEWECLDCVQRDLYRDVMVENYRNLLSVVVSSHYTQYISSKENIKHSFQEVIRRHEECGIDSSHLR

SEQ ID NO: 9552 - protein, 81 aa, Peromyscus maniculatus
GCVTFEDVAVYFCQEEWELLDEAQRLLYLTVMLENFALITSLVCWHEADAEETTCVQSVSPVEEPQVRTSKEGLPTKKTHP

SEQ ID NO: 9553 - protein, 81 aa, Octodon degus
SCEGSVSFRDVTIDFTREEWQHLDPGQRNLYRDVMQETYSHLLSVGYQVPEPEVFILEQEKEPWTSQGDSSHQSCQEKLQK

SEQ ID NO: 9554 - protein, 81 aa, Peromyscus maniculatus
GSVSFTDVTVDFTQEEWEQLDPSQRILYMDVMLENYSNLLSVEVWKADDQVDKDPTDPGEQGRPLRTLKNQPPTEERGSLF

SEQ ID NO: 9555 - protein, 81 aa, Peromyscus maniculatus
VSFEDLAVNFTQEEWDLLDPSQKILYGDVMLETCRNFTAIGYECEDQKIEEHYEDPEVNIRHIISHSEYTQYEPEDCEQKP

SEQ ID NO: 9556 - protein, 81 aa, Rattus norvegicus
TQGLVTFEDVAVYFSLEEWERLDVDQRDLYRDVMQENYGILVSLGYPIPKPDLIFHLEQGEEPWVEDSPHPEEGDVVTGVY

SEQ ID NO: 9557 - protein, 81 aa, Mesocricetus auratus
EMGLVSFEDIAVEFTWQEWQNLNEGQRTLYRDVMLENYSNLLFLGHCKTKPELIFNLEQRLGSWIVGEASNQSIPEFQGMN

SEQ ID NO: 9558 - protein, 81 aa, Mesocricetus auratus
MLSFQDVAIEFSPEEWEYLEPAQWNLYRDVMLENYSHLDFLGLVLSKPHLVTFLEQRQRSTGVKKQEAATVHTGKAVNKCK

SEQ ID NO: 9559 - protein, 81 aa, Mesocricetus auratus
MEEWAMLDPSQKELYKDVMKEILRNVISIGNIRKHQKIENEYQNSGRKLRCQLVEKLHDCKEDHECAEIFNFSTEGTVNHT

SEQ ID NO: 9560 - protein, 81 aa, Mesocricetus auratus
SQGPLTFRDVTVEFPQEEWECLDSAQRALYIDVMLENYSNLVSVENYYICDPVHQRVKTEKESCQCNDLDKVLHDPSTYAL

SEQ ID NO: 9561 - protein, 81 aa, Mus caroli
AVTFRDVAVVFSEEELGLLDAAQRKLYHDVMLENFRNLLAVGGQVPNKMENLHTTGVRCLSLGKLPCWHMASHDANKLARA

SEQ ID NO: 9562 - protein, 81 aa, Mus musculus
AQRLMTFRDVAVDFSPEEWECLSLDQRSLYRDVMLESYSHLVSVGLFVYRPHLFSLLEKGQDPWMILRDETRGPYPDIDFS

SEQ ID NO: 9563 - protein, 81 aa, Cavia porcellus
WSQMPVTFEDVALYLSREEWGRLDHTQQDFYRDMLQKKNGLALGFPFSRPFWAPQVPRKVEALSSSRQTGAEEEQGDYGSG

SEQ ID NO: 9564 - protein, 81 aa, Cavia porcellus
MDVMLENYCHLISLGCDMTKPDVILKLEHGEEPWTSFADHACLKENWKAEDILMKFRTPRSTFTLVKKPASLKNLPPKYDT

SEQ ID NO: 9565 - protein, 81 aa, Cavia porcellus
VVRFADVAVYFSPEEWGCLRPAQRALYRDVMCETYGLLGALADTSTKEEEIDEPGGKGPGMTSGKEWPEALIEHNPDSSIS

SEQ ID NO: 9566 - protein, 81 aa, Cricetulus griseus
FKGPVTLRDVTVEFTKAEWELLTPAQKALYKNVMLENYRHLLAVGYRVVNRSVISKLKKGKEPWVSEKELPNRRRADKQRN

SEQ ID NO: 9567 - protein, 81 aa, Cricetulus griseus
EEPVTFEDVAVNFTLGEWALLDSSQKKLYRDVMTETLMNLISIGKTKGKENVEDNYQNLRKNVRTQVVERNCVYGAGGRCG

SEQ ID NO: 9568 - protein, 81 aa, Cricetulus griseus
RNQFSFQSLVTFKDVAINFSKEEWECLHTSQKDLYRNVMLENYGNLVSVGLSESKPELVTCLEENMEPWMVNKNEAEDLEQ

SEQ ID NO: 9569 - protein, 81 aa, Cricetulus griseus
GETGKVPVTFDDITLYLLQEEWMQLNHPQKDFSASNKPTAPLGPTAANPELFHEFGQGTEPWLGSIQGQQSLLNHHTGKTH

SEQ ID NO: 9570 - protein, 81 aa, Cricetulus griseus
SLTFDDVAVDFTQEEWVIMDQTQRDLYREVMLENYQNLFSAGLSTHIQKHVGQKPYVCKLCGRSFTISSNLTEHLRSHTGE

SEQ ID NO: 9571 - protein, 81 aa, Cricetulus griseus
DSVTFEDVTVNFTQDEWALLDSSQKNLYREVVGEIFMNLASMGKDDGFLLSQTGFFAHHNHIIERFGDSKQGSRCGERFSQ

SEQ ID NO: 9572 - protein, 81 aa, Cricetulus griseus
QQESVSFEDVAVKFTQKEWAMLDPSQKKLYKDVMQETLRNLAFIGKKLGKQKVVTKYENLWRKLSSQLVEKFCEYKESLQC

SEQ ID NO: 9573 - protein, 81 aa, Cricetulus griseus
SNSVLSFRDVSVDLSQEEWECLDCAQRALYMDVMMENYSNLLFVENHCICGKYETVLDQGTKLIVHDHVNIQEKPSQYNEL

SEQ ID NO: 9574 - protein, 81 aa, Cricetulus griseus
VTFEDVAIFFSKEEWRLLAEAQRQLYLRVMLENFALVTSLGMETGKLPFDQVSGEGLSLVMPPKASPANQESHPSDIYLPV

SEQ ID NO: 9575 - protein, 81 aa, Peromyscus maniculatus
MESVSFEDVAVRFTKEEWALLDPSQKKLYKDVMQETLRNLAAIGNKLENQKVVNEYENLCRKLSSQLVEIFCEYKESLQCT

SEQ ID NO: 9576 - protein, 81 aa, Peromyscus maniculatus
ALALLSFEDVAVTFTVEEWGHLDLAQRTLYQEVMMETCGLLVSLGHRVPKPELIYLQEHRQGVWAGQSGLSQCTCTDEEAK

SEQ ID NO: 9577 - protein, 81 aa, Peromyscus maniculatus
SQGLVTFKDVALCFSQDQWSDLDPTQKEFYGEYVLEEDCGIVVSLSFPIPRLDDTSQIREEEPQFPDAHESPEPAEPEILS

SEQ ID NO: 9578 - protein, 81 aa, Peromyscus maniculatus
DAVTYEDVHVNFTQEEWALLDSSQKSLYKDVMLETYENLISVGYKWEDQNIEEHCQSSRRHGRYITCHSRYKPCEHKGYGK

SEQ ID NO: 9579 - protein, 81 aa, Peromyscus maniculatus
MNAVTYDDVHVDFTWDEWALLDPSQKNLYKNVMLETYRNLTAIGYKWEEHNINEKFQRSRRNRRHERSHTGEKSYECNQCG

SEQ ID NO: 9580 - protein, 81 aa, Peromyscus maniculatus
AKNAVAYEDVHVDFTQEEWALLDPSQKSLYRDVMLETYRNLTAIGYKWEDHNIEDRCQSSGRHERRHTGENPSEYTQSVKA

SEQ ID NO: 9581 - protein, 81 aa, Peromyscus maniculatus
LQDSVTFKDVAVDFSQEEWEQLNPAQRSLYRTVVLENYQNLVSVGACISKPHLISLLEHGKEPWEVKGEVTRSTLQDGEPI

SEQ ID NO: 9582 - protein, 81 aa, Peromyscus maniculatus
PQNAVTYNDVHVDFTWEEWALLDPSQKNLYKDVMLETYRNLITIGYSWEDHNIEEHFQSSRRHERHERSDNEENSSVYTQC

SEQ ID NO: 9583 - protein, 81 aa, Peromyscus maniculatus
DQLTFSDVAIDFSPDEWECLDPPQQNLYRDVMLENYRNLVSVALSHHCTQNFSPEQILKYSFKKVTHGRPGSYGLKSLRNW

SEQ ID NO: 9584 - protein, 81 aa, Peromyscus maniculatus
SCERLVSFEDVTVNFSQEEWQQLDPAQRRLYQDVMLEIYSHLLAVGYPRPEAIFKVKEVHFPHQRCQCQGESEHGSPHQIC

SEQ ID NO: 9585 - protein, 81 aa, Peromyscus maniculatus
AMTAVTYDDVHIDFTWEEWTLMDPSQKNLYKDVMWETYRNLTAVGYSWEDHDIEEHCQSSGKLRRYKEHHIGEKPSEYTQC

SEQ ID NO: 9586 - protein, 81 aa, Mesocricetus auratus
DAVTYQDLHITFTQEEWALLDSSQRNLYKDVMLETYMNLNAIGYKWEDNDIEQHCRSPQRHGRHERSPTREKPSAYMQCDK

SEQ ID NO: 9587 - protein, 81 aa, Mesocricetus auratus
MLENYSNLASLGFPFAKPEMISVLQQGEEPWKVEKRSLGFSLGCNSSLQTTKSTQTKDSSFQGLMRKQLKRDKSWDFTSGK

SEQ ID NO: 9588 - protein, 81 aa, Mesocricetus auratus
MESLSFEDIAVYFTWQEWQDLDVAQKLLYRDVMLENYSSLVSLGCCMIKPELILMLEREFGPWRVADTSVWNLPGYCMTRP

SEQ ID NO: 9589 - protein, 81 aa, Mesocricetus auratus
CLKTCNKDEAVDFIQEEWTTKDPAHNSVPGDVTVEDYTSLASVEGEKQLHTKDLALEQEFLTRHSFMETQKVDAVTFEDVT

SEQ ID NO: 9590 - protein, 81 aa, Mesocricetus auratus
SLGPLSFKDVAVAFTQEEWRQLGSEEKTTYRDVMLENYSNLVSVGYHIIKPDVIIKLEQGEEPWIVEGAFSPQSYPDEIWQ

SEQ ID NO: 9591 - protein, 81 aa, Mesocricetus auratus
SQDLLTFGDVAVDFPQEEWECLDSAQRALYIDVMLENYSNLVSVENYCKCDPVHHHVKTEKESCQCNELDKVLHDPSTCAL

SEQ ID NO: 9592 - protein, 81 aa, Mesocricetus auratus
HSVTYDDVHITFTQEEWALLDASQKSFYNDVMLETYRNLSAIGYRWEDHYIEEHSQSSRRHGRHKGTHTGENPYEYNQCGK

SEQ ID NO: 9593 - protein, 81 aa, Mesocricetus auratus
QGSVSFTDVTVDFTQEEWEQLDPSQRILYMDVMLENYSNLLSVVWRADDHVEKNPRDPDEQARPLTTLKNQPPVEERGNLF

SEQ ID NO: 9594 - protein, 81 aa, Ictidomys tridecemlineatus
EDVAVNFTQEEWALLDPFQKKLYRDVMQETFINLASIGENWEDQNTEDKYKSQGIHLRKKISHEGILACQFGETIRQTPNL

SEQ ID NO: 9595 - protein, 81 aa, Mesocricetus auratus
VCGSVTFGDVAVDFSQEEWACLDATQRVFYRDMMLETYSNLVTVVGSSISKPDLITLLEQEREPWMVVKEETDSPSPDLES

SEQ ID NO: 9596 - protein, 81 aa, Ictidomys tridecemlineatus
SQAPVTFEDMAMYLTREEWRPLDPTQRDLYRDVMQENYGNVVSLDFDIRSENEVNPKQEISEDVEFGTTSERPVGNAEENP

SEQ ID NO: 9597 - protein, 81 aa, Dipodomys ordii
MAQLMTFRDVAIQFSQEEWEYLNPEQRNLYTDVMSENYSNFVSVGLSIYQPHVISLLEKEQEAWIELDEERRGFCPDLQST

SEQ ID NO: 9598 - protein, 81 aa, Peromyscus maniculatus
GAEPVTFRDVAVFFSQEEWLHLDSAQRSLYREVMLENYSSLASLGIQASVPRVIGKLQKGQDPCMEREDPEDSCLDLQIWP

SEQ ID NO: 9599 - protein, 81 aa, Peromyscus maniculatus
MMLETYSNLVTVVGSSVSKPDLIALLEQEREPWMVVKEETDRPSPDLESCYNTENISPENHTYDINLPTQSIKQLSKNFDL

SEQ ID NO: 9600 - protein, 81 aa, Peromyscus maniculatus
MQGQLTFRDVAIEFSQEEWECLDAAQRALHRDVMLENYSNLVSLGVTRPNLNAMSMLEQQKGPWTVESEAIITRKSNGQEY

SEQ ID NO: 9601 - protein, 81 aa, Cricetulus griseus
VKQFSFQSLLTFKDLAINFSKEEWKYLNTSQKDLYKDVMLENYSNLVSVGLSESKPELVSCLEQNKEPWMVNIEEGECLEQ

SEQ ID NO: 9602 - protein, 81 aa, Mesocricetus auratus
MDVTIDFGREEWQHLDPDQRSLYRDVMQETYSHLHSVEELQQIGDQKETYQQIGNKSGSDVIFIKKTLDTKGHHGCKVIRK

SEQ ID NO: 9603 - protein, 81 aa, Rattus norvegicus
EQLTFRDVAVDFSPDEWECLDPPQQRLYRDVMVENYRNLVSVALSHHCTQNFSPEQILKYSFTKGTNGSCGLKSLYLREDC

SEQ ID NO: 9604 - protein, 81 aa, Ictidomys tridecemlineatus
SISFEDVTVNFSREEWQHLDPVQRRLYWDVTLENYHHLISVGEDIRKTQQQEISGEVSFHCERFDQPTGEDSLCSILEELW

SEQ ID NO: 9605 - protein, 81 aa, Octodon degus
SQESLSFRDVFVDFTLEEWQQLDSAQKNLYRDVMLENYSHLVSVGYLVAQSDAIFSLGQGEEAWGADRGTQIRSCPDVSIF

SEQ ID NO: 9606 - protein, 81 aa, Rattus norvegicus
AQGLVTFRDVAVDFSQEEWEFLDPAQKNLYRDVMWENYSNFISLDLESRFKTDTSSLDKDICEVYSVQWELIEKIKNLSPQ

SEQ ID NO: 9607 - protein, 81 aa, Mesocricetus auratus
SQELVTFEDVAVYFIWKEWKRLEPAQRDLCRGVMLENYGNVLSLDGESKTGNDQVISEGMGSHEMVLGRFHTDASQGGRFG

SEQ ID NO: 9608 - protein, 81 aa, Mus caroli
AHSMVMFRDVTVDFSQEEWECLSSYERDLYRDVMLENYSHLVSLAGCSISKPDVITLLEQGKEPWMIVRAEKRRWSRDLES

SEQ ID NO: 9609 - protein, 81 aa, Mus caroli
SRTPVSFEDVAVSFTQEEWEYLTSTQKNLYQKVMSETFKNLTFVGSKKKPQEPSSDLQDKNEEQKSSSCTGVFKGGPLFFC

SEQ ID NO: 9610 - protein, 81 aa, Mus caroli
SQESVTFQDIAVDFTEKEWPLLDSSQRKLYKDVMLENYSNLSSLVGYQVGKPRLISHLEQEEDLRMEERGIQQGPSPDWGT

SEQ ID NO: 9611 - protein, 81 aa, Mus musculus
RERLVSFEDVTVDFSQEEWRRLDSVQRHLYQDVMLEIYSHLLAVGYPVPSPGAIFRIKKRKEARTGEAKLPHPCWCQEVES

SEQ ID NO: 9612 - protein, 81 aa, Mus musculus
VCGSVTFRDVAVDFSQEEWACLDATQKVLYRDIMLETYSNLIAVVGSCISKPDLIVLLEQEKELWMAVKEETDRLSPDLES

SEQ ID NO: 9613 - protein, 81 aa, Mus musculus
QDAVTYEDVHVNFTKEEWTLLHPSQKSLYRDVMLETCRNLTAIGIISVTLDPSLVSIRDMERSNVLLQVTVFFKLTEESIL

SEQ ID NO: 9614 - protein, 81 aa, Cavia porcellus
NQESVTFQDVAVDFTEKEWPLLDTSQRKLYRDVMLENYSNLTSLGYHIGKPSLISHLEQEADPRTEERGTQQGTCPDWETP

SEQ ID NO: 9615 - protein, 81 aa, Cavia porcellus
VQEPVTFWDVAVDFTQEEWGQLDPTQRTLYRDVMLETFGHLLSVGHQIAKPEVISLLEQGEEPWSVEPVHSQSSCPEWMRN

SEQ ID NO: 9616 - protein, 81 aa, Cricetulus griseus
SMDAVTYDDVHINYTQEEWDLLNPSQKRLYKDGMLDTYRNLTDTGYSWEDHNIEEQCQSSRRCRRLIEMMCFRKRGFFDTS

SEQ ID NO: 9617 - protein, 81 aa, Ictidomys tridecemlineatus
RESGKAPVTFDDITVYLLQEEWMLLSQQQKDFYGSDKLVPPLGPTVTSPELFCEFGKVSKPWPGNVQGQRSLLDHHPGKDQ

SEQ ID NO: 9618 - protein, 81 aa, Ictidomys tridecemlineatus
SRGTVTFKDVAIAFTQEEWKQLDPAQRNLYRNVMLENYNNLITVGYPFTKPEVIFKLEQEEEPWVVEEEVFSRHCSGEILG

SEQ ID NO: 9619 - protein, 81 aa, Peromyscus maniculatus
WSQMPVTFEDVALYLSREEWGRLDHTQQHFYRDVLQEKNGLALGFPFSTPFWVPQVQGKGEVASSSRPPGAEERRGLGSGI

SEQ ID NO: 9620 - protein, 81 aa, Peromyscus maniculatus
SRLTFRDVAVDFSHEEWECLDSAQRALYMDVMLENYSNLVFLDNHHMCVEYKNDLHHDSKHIVHDYVNIQEKAFKCNDLCK

SEQ ID NO: 9621 - protein, 81 aa, Cricetulus griseus
CNSWISPSDVAINFSKEEWECLHPSQKDLYRDVMLENYSNLVSVGLSESKPELVTCLEENKEPWMVNIDEAEGLGQGVFCY

SEQ ID NO: 9622 - protein, 81 aa, Mus caroli
SQCLLTFGDVSVDFSQEEWECLDSAQRALYIDVMLENYSNLVSVENYSTCDTVHQHVNTGKESCQRNNLGEMLRNPSHDAL

SEQ ID NO: 9623 - protein, 81 aa, Mus musculus
MLLREEWECLSPSQRTLYRNVMLENFRNLNELGCCSRRPGLITRLEQWDEPWVDDWDRSEFPDGQKSFCPGSRKVAHSRIG

SEQ ID NO: 9624 - protein, 81 aa, Mus caroli
VTFEDVALYLSQEEWGRLDHTQQNVYRDVLQGKNGLALGFPFSRPFWVPQIQGKGQAASRITGAEERRGLGSGAVEVGKVV

SEQ ID NO: 9625 - protein, 81 aa, Mus caroli
PQSQLTFKDVAVDFSQEEWECLDCVQRALYIEVMLENYNNLFFVENHCMCPKFENMFDQDLQHIVHEHLNTQVKSYECHEL

SEQ ID NO: 9626 - protein, 81 aa, Mus musculus
IVGLVSFEDVSVDFTWDEWQDLDDSQRKLYRDVMLETYSSLLSLNQCDAKPELILKLEQGAGPWKEDNAPDQSLPALQPMK

SEQ ID NO: 9627 - protein, 81 aa, Mus musculus
PKVPVAFDDVSIYFSTPEWEKLEEWQKELYKNIMKGNYESLISMDYAMNQPDVLSQIQPEGEHSTDDQPRPEASEIPADPS

SEQ ID NO: 9628 - protein, 81 aa, Cavia porcellus
FRGSVSFEDVAVDFTQEEWNRLDPAQRTLYRDVMLENYSHLVSLGFPLTKPDVIASLEQGVLGIIKKEIPNLNCTDDGQAE

SEQ ID NO: 9629 - protein, 81 aa, Cavia porcellus
SDIFEESVTFKDVAVDFTQEEWHHMDSAQRTLYRDVMLENYSHLVSLGYQVSKPEVIFKLEQGEEPWISEGEIQRPFCPGK

SEQ ID NO: 9630 - protein, 81 aa, Cavia porcellus
LQIRVTFKDVLVDFTREEWKLLDAAQQIMYKDVMLENYKNLVSLGHQLPKPDVILRLEKGEEPWLMQKGFYHRTHPDLETA

SEQ ID NO: 9631 - protein, 81 aa, Cavia porcellus
SQEQVSFKDVCVDFTKEEWCLLDPTQKLLYRDVILENYSNLVSVGHCIAKPEVIFKIEQGEDPWVLEKRFPSHHNPERKWK

SEQ ID NO: 9632 - protein, 81 aa, Cavia porcellus
MITCLEQSKEPWNVKRQETVVMHPAVSSHFAQDVSSEKGTKQSLQTVTKGRYSICGLDNLHLKKEWEHVDDHKGQDACYNG

SEQ ID NO: 9633 - protein, 81 aa, Cricetulus griseus
LETVTFEDVAVDFTLEEWTLLDSSQKKLYRDVMKETFWNLISIQKTLEENIEEDYKDLSRNMGTPVLEEDCGYECDTECDK

SEQ ID NO: 9634 - protein, 81 aa, Cricetulus griseus
ILECMKYNDLHIDFTLEEWTLLDTSQKNLYKDVMLETYKNLSDIGYIWEDHTIEEHCAGSKRHERHERSKTRQRLSIYIQC

SEQ ID NO: 9635 - protein, 81 aa, Cricetulus griseus
MGMPGHFSEGFVQRCHVGEYSNLVSEGLFESKPELVSCLEQNKEPWLVKVTAKFTMKGKISSVQHVGSLLPMGFLFRFIRE

SEQ ID NO: 9636 - protein, 81 aa, Cricetulus griseus
VTFDDVAVDFTQEEWILLDQAHRDLYREVMLENYQNLASAGHQTQSYLLVGRRGFAQRRSPRMGNATWHQRVNISSGVFEE

SEQ ID NO: 9637 - protein, 81 aa, Cricetulus griseus
MLENYKSLVWLGYCLDKPELISKLEQGLVPWSSAEATEQCQPDVHKWSALAKTRQKAQEKYLGQLEITKRNTSNEDMIEVE

SEQ ID NO: 9638 - protein, 81 aa, Cricetulus griseus
MLKKKRKGCGLDFSWEEWQDLDDAQRILYPDVMLEIPSSFVSLGHCILKPEAIVKLEQGAEPCTGEEPQDQNLPGVQKVDD

SEQ ID NO: 9639 - protein, 81 aa, Cricetulus griseus
GLLTFREVTVDFSQEEWELMDSAQRALYIDVMLENYNNLVFVGNYCKSDPVHQHVKTEKESCQCNELGKVLHDPSTCALYR

SEQ ID NO: 9640 - protein, 81 aa, Peromyscus maniculatus
SQDLVTFGDVSVNFTQEEWEWLNDAQRDLYRKVTLENYKSLVSLGIPVYKPAVISLLEQGKDPCVVQKEGARDASPDWDYV

SEQ ID NO: 9641 - protein, 81 aa, Peromyscus maniculatus
MDAVTYNDVHVDFTQEEWALLDPSQKNLYNNVMLETYMNLSAIGYTWEDHKVEEHCQSSQRHGRHERSYTGDQSSEWTLCV

SEQ ID NO: 9642 - protein, 81 aa, Peromyscus maniculatus
MDAVTYKDVHVNFTHEEWALLDPSQKSLYKDVMLETCENLTAIGYKWEDQNIEEHCQSSRRHGRYIICHSGYKPCDPKGYG

SEQ ID NO: 9643 - protein, 81 aa, Peromyscus maniculatus
AMNAVTYDDVHVNFTQEEWALLAPSQKNLYKDVMLETYWNLTTIGYNWEDHNIEEHCESSRRHKRHKRNYTEEKTHEVIQY

SEQ ID NO: 9644 - protein, 81 aa, Mesocricetus auratus
CQTLVTFEDVAVTFTDEEWRHLVPVQRALYKAVMLENYESIISLGLPVPQPDVILQLKKRDEPRTQGLHGSEEKEWPESIS

SEQ ID NO: 9645 - protein, 81 aa, Ictidomys tridecemlineatus
GPVSFKDVAVDFTQEEWQQLDPDEKVTYRDVMLENYSNLVSVDEVWQVEDPMEKLQEDEDMFFINKTLGEERGNVSGKAFN

SEQ ID NO: 9646 - protein, 81 aa, Ictidomys tridecemlineatus
CQGSVTFEDVAVIFTDEEWRHLVPVQRALYKAVMLENYESIVSLGLPVPQPDVIFQLKRGIEPWTEGLHGSEDRKCPENVS

SEQ ID NO: 9647 - protein, 81 aa, Ictidomys tridecemlineatus
MLENYGNVASLGFSLLKPAVISRLEGGGKLVGPSLLATGNRTGQGLYLDIQTGSNLSKEMCEEKISTSFELHKDSSQETDF

SEQ ID NO: 9648 - protein, 81 aa, Ictidomys tridecemlineatus
PTLALVSFEDVVVTFTGEEWRHLNLAQRTLYQEVMLEICGLLVSLGHPVPKPETILDHEQGLWTEKRHLSQSTCAGEKAKP

SEQ ID NO: 9649 - protein, 81 aa, Ictidomys tridecemlineatus
FQGLVTFGDVAVAFSPEEWEWLSPTQRSLYRRVMLENYRSLASLGLCASKPDVISSLEQGRGPWTMRRRGTRGPCPGEFID

SEQ ID NO: 9650 - protein, 81 aa, Ictidomys tridecemlineatus
SQASLTFEDIAVNFTSKEWQSLTYFQRHLYKDVMLENYGNMVSLGFSFPKPPLISHLEREAEPCVQDLQYGRFLSCSFPVP

SEQ ID NO: 9651 - protein, 81 aa, Marmota monax
MAMYLTREEWRPLDPTQRDLYRDVMQENYGNVVSLDFDIRSENEVNPKQEISEDVEFGTTSERPVGNAEENPEGEEAFGTG

SEQ ID NO: 9652 - protein, 81 aa, Marmota monax
MAFRDVAVDFSQEEWSLLSPAQRTLYKEVMLENYSNLVSLGIPFSKPKLITQLEQGKETWREERKCLLSTCPAEAKPELQP

SEQ ID NO: 9653 - protein, 81 aa, Marmota monax
RPRALKFVDVAVYFSPEEWGYLRPAQRALYRDVMRETYGHLGALGCAGPKPALISWLERNTDDWEPAALDPQEYRRGLTVQ

SEQ ID NO: 9654 - protein, 81 aa, Marmota monax
MAKPEVISLLEQGEEPWLVEQTCPESSCPEWMRDHESSALIPTQSTFNEEPSHGMKLKRYIWDDPWFSRLGVWGCKDQLEM

SEQ ID NO: 9655 - protein, 81 aa, Marmota monax
IQESLTFGDVTVTFTRLEWRHLDAVQQALYRDVVMENYGNLVSVGLLSSKPKLITQLEQGEEPWMEVQEVPSVQEYWPKTK

SEQ ID NO: 9656 - protein, 81 aa, Marmota monax
LQESFSFEDLCVAFSQKEWLLLGPHQKALYKDVMLENYHVLVSLGYEVMKPDVIFKLEQGEEPWVGDGETPRSDSAVLGLE

SEQ ID NO: 9657 - protein, 81 aa, Peromyscus maniculatus
MLSFWDVAIEFSAEERECLEPAQWNLYRDVMLENYSNLVFLGLAVSKPHLVTLLEQRQDSSDVKRQAAANVQPGTTPNDYN

SEQ ID NO: 9658 - protein, 81 aa, Octodon degus
MAMYLTREEWRPLDPTQRDLYRDVMQENYGNVVSLDFEIRSENEVNPKQEISEDVEFGTTSERPGGNVEENPESEETFEGG

SEQ ID NO: 9659 - protein, 81 aa, Peromyscus maniculatus
CQTSVTFEDVAVTFTDEEWRHLVPVQRALYKAVMLENYESIISLGLPVPQPDVILQLKRRDEPWTQGHHGSEEKEWQENVS

SEQ ID NO: 9660 - protein, 81 aa, Octodon degus
LQGRVSFKDVAVDFTQEEWQQLDPDEKTTYRDVMLENYNNLISVGCDVTKPNVIIKLEQGEEPWTIEDDFSHTCSEVWKVD

SEQ ID NO: 9661 - protein, 81 aa, Peromyscus maniculatus
TVTFRDVAVVFSEEELGLLDATQRKLYRDVMLENFRNLLSVGGQGPNKMEVLHAIGLRCLSLGRLPCWQLMIPDVNTLART

SEQ ID NO: 9662 - protein, 81 aa, Peromyscus maniculatus
MFRDVTVNFSQEEWECLNSYERDLYKDVMLENYSHLVSLAGCSISKPDVITLLEQGKEPWMIVRDERRRWSQDLETRYSSK

SEQ ID NO: 9663 - protein, 81 aa, Peromyscus maniculatus
MGSVSFEDVSVDFTQEEWNQLDPIQRSLYRDVMLENYSHLVSLGYPITKPDVITSLEQGVLGIIKREIPSSSCTEDGQTED

SEQ ID NO: 9664 - protein, 81 aa, Rattus norvegicus
APLPLTFEDVAIYFSEQEWQHLETWQKELYKQVMRTNYETLISLDNGLPKPELISWMELGRENFGSWGEGQKVDRGIRCSV

SEQ ID NO: 9665 - protein, 81 aa, Mus musculus
KPGTVSFADVAVYFSPEEWRYLRPAQRALYREVMRETYGLLTYLDVGCAKPALISWVEEESEVWGPGAQDPEVAMCRTEVH

SEQ ID NO: 9666 - protein, 81 aa, Mus caroli
DKALMAFHDVAVAFSQMEWELLSPAQRILYREVMLENYSHLVSLGIAFSKPKLITQLEQGAEPWRDGSGCFLDLCPAEPRT

SEQ ID NO: 9667 - protein, 81 aa, Mus musculus
MGVVTYDDVHVNFTQEEWALLDPSQKNLYRDVMLETYRNLAAIGYSWEDHNPEEHFQSSRRHGRLEKSHIEEKPSEFTQCG

SEQ ID NO: 9668 - protein, 81 aa, Mus caroli
VCGSVTFKDVAVDFSQEEWACLDATQKVLYRDMMLETYSNLVAVVGRCISKPDLIVLLEQEKEPWMAVKEETDRPSPDLES

SEQ ID NO: 9669 - protein, 81 aa, Mus musculus
SQCLLTFGDVSVDFSQEEWECLDSAQRALYIDVMLENYSNLVSVENYSTCDTVHQHVKTQKESCQRNNLGEMLRDPSHDAL

SEQ ID NO: 9670 - protein, 81 aa, Cavia porcellus
CQESVTFEDVAVVFTDEEWRHLVPMQRALYKAVMLENYESIVSLGLPVPPPDVIFQLKRGDKPWIEGLQGPEEKECPLIIF

SEQ ID NO: 9671 - protein, 81 aa, Cavia porcellus
KKLNLYLRKELCCVFFFSSGSTISKPDVIAFLEQEKEPWIGVRKETSRRCPDYGAEEIPPENYTSEINLSKQGIKQISNTL

SEQ ID NO: 9672 - protein, 81 aa, Cricetulus griseus
MEWELLSPPQRALYREVMLENYSHLLSLGIAFSKPKLITQLEQGAEPWRDGSECLRDLCLAESRTELEPHLSCPIAFASPE

SEQ ID NO: 9673 - protein, 81 aa, Cavia porcellus
LQVPVTFEDVTVTFTQEEWGQLDPGQRTLYQEVMLENCGLLVSLGCPVPTPELIQQLEHGQPPWTLSLGVQSTQPGDSGKT

SEQ ID NO: 9674 - protein, 81 aa, Cricetulus griseus
MAFEDVAVYFSQEEWVFLDAAQRALYRHVMLENFALVDSIGLSISRPRVIIQLQRGEEPWVPNRTNTGPGRGTRRRPSLGS

SEQ ID NO: 9675 - protein, 81 aa, Cricetulus griseus
LLCPSLEDHDQVHSHFLSTEFFRDLGADETIQRLLSSESWTRTHPQQDMSLSESKPELVSCLEENKEPWMVNIDEAEGLEQ

SEQ ID NO: 9676 - protein, 81 aa, Cricetulus griseus
QDCVTFEDVAICFSHEEWRLLDKAQRHLYVSVTMQNFALINSLGCGHRREDEEPRVSAGASKVWLSETTPSIPKTHLCEKC

SEQ ID NO: 9677 - protein, 81 aa, Cricetulus griseus
VTFADVAIDFTQEEWILLDTKQRNLYREVMLENYQNLATLEWAMRLKTGGTLLQQDIFQVKISNEIQLSDSYSGKELSKPP

SEQ ID NO: 9678 - protein, 81 aa, Peromyscus maniculatus
MLENYGHLVSLGLTISKPDVIAILEQGREPWLEERGTAGGLPSALESGYGAKILSAKPRVNEMESPRWGMMGGLASCGLEG

SEQ ID NO: 9679 - protein, 81 aa, Octodon degus
MLDNYALVAALAASPACKPALIARLERGEALWNSEALGSGLPGAGNWVMKEELDLEPEADAEMPGAQPGSATRSVSSAGQA

SEQ ID NO: 9680 - protein, 81 aa, Octodon degus
AQGSVSFKDVTVDFSQEEWQHLDSAQKTLYMDVMLENYCHLISLGYDMTKPDMILKLEQGEEPWTSFADHACLKENWKAED

SEQ ID NO: 9681 - protein, 81 aa, Rattus norvegicus
VTFQDVAISFSHEEWRLLDETQKLLYLSVMLQNFALINSQGCGHRTEDEERRVSTRASKVLRSETVPFTQKSHLCEKCVPI

SEQ ID NO: 9682 - protein, 81 aa, Rattus norvegicus
SQCLLTFRDVAVDFSQEEWECLASPQRALYIDVMLENYSNLVSVENYCICDTVCQPVKTERESCQCNELGKMLHDPSHGGL

SEQ ID NO: 9683 - protein, 81 aa, Mus musculus
GCVTFEDVAVYFSQEEWELLDESQRLLYLDVMLENFTLITSLAHWSEAEAEDKTCAPQIRTAKEGLPTKKPHPSDICSTVL

SEQ ID NO: 9684 - protein, 81 aa, Mus musculus
MDLVTYDDVQVNFTQDEWALLDPSQKSLYKDVMLETYRNLTAIGYIWEEHTIEDHFQTSRSHGRHERSCSAEQPSEFIQCG

SEQ ID NO: 9685 - protein, 81 aa, Cavia porcellus
EPVTFRDVAVDFTQEEWGQLDPTQRTLYRDVMLETFGHLLSVGPKLPKPDVISQLEQGAEFWVGEQGHTQHCRSGWEPDIP

SEQ ID NO: 9686 - protein, 81 aa, Cavia porcellus
MVKPEMIFKLERGEELWILEEESSGHGYAESLSVLCGNTSVGDNAFNILRHQKIQTLNENVDYNRCDKGFHEETAFVRCKR

SEQ ID NO: 9687 - protein, 81 aa, Cricetulus griseus
MLENYSNLISVGYDVTKPNVIIKLEQGEEPWMMEGDCHAQSHLEISKVGDTIEKIQENEDKHTRQADDLNNQRAEKGDTSD

SEQ ID NO: 9688 - protein, 81 aa, Cricetulus griseus
IQGVLTFRDVAVDFSQEEWECLDSAQRALCIDVMLENYSNLVFVEEYCKCDPVHQHVKTEKESCQCNELGKVLHDPSTCAL

SEQ ID NO: 9689 - protein, 81 aa, Cricetulus griseus
SQDLLSFKDVSVDFTREEWQCLDSSQRALYVDVMLENYNNLVSVENYYICDPVHQHKKTEKKSCQCTEFGKILHDPSTCAL

SEQ ID NO: 9690 - protein, 81 aa, Cricetulus griseus
MLETYSNLVTVVGSSISKPDLITLLEEEREPWMVVKEETDRPSPVGSSISKPDLITSLEQEREPWMVVKEETDRPSPDLES

SEQ ID NO: 9691 - protein, 81 aa, Cricetulus griseus
VQGLVSFEDVAVDFTWQEWQELDAAQRTLYRDVMLENYKSLVWLGYCLDKPELISKLEQGLVPWSSAEATEQCQPDVHKWS

SEQ ID NO: 9692 - protein, 81 aa, Cricetulus griseus
KMQDLVTFSDVTVTFSKEEWECMDSAQWNLYTDVMLENYNNLVFVENYYKCELVHRHVKTEKESCQCNELGKVLHDPSTCA

SEQ ID NO: 9693 - protein, 81 aa, Cricetulus griseus
LSEEKRAEEVASLRLTAKSQEWGKLDPACRDVMLENYRNLVSLWLPVSKPDSYNLDDGKELLKLEKKPRKCSYSDMETRPE

SEQ ID NO: 9694 - protein, 81 aa, Cricetulus griseus
MLSFRDVAIDFSPEEREYLEPAQWNLYRDVMLENYSNLDFLGKTVNKCKDYSKAFHCNSLPIQHQTAHLGEKPYKCEVCGK

SEQ ID NO: 9695 - protein, 81 aa, Ictidomys tridecemlineatus
MHKDVMLETYSNLASVGLCVAKPEMIFKLERGEELWILEEESSDHGYSGSLSLLCGNSSVGANALRLDNSLLQHQRLHSLH

SEQ ID NO: 9696 - protein, 81 aa, Marmota monax
SQRSVSFKDLTVNFTHEEWQQLDPDQRLLYRDVMLENYSNLISVGFRVSKPDVIFKLEQGEEPWIVEEISRESYTEDDDAL

SEQ ID NO: 9697 - protein, 81 aa, Marmota monax
FQVPALFDEVAIYFSDEEWEVLTEQQKALYREVMRMNYETVLSLEFPFPKPDMITRLEGEEESHNSDEWQLQRGTSTENEE

SEQ ID NO: 9698 - protein, 81 aa, Marmota monax
SVTFRDVAVLFSQDEWLHLDSAQRTLYREVMLENYSNLVSLGWENLFETTVSKEENLEVMEKLIVDDFRLGKVYMNEDKLE

SEQ ID NO: 9699 - protein, 81 aa, Marmota monax
GSVTFKDVTMAFTQKEWKQLEPAQKNLYKDVMLENYSNLASMGYQAPKPDMISKLEKGEEPWLGKGKKPSQNRLNKKARSK

SEQ ID NO: 9700 - protein, 81 aa, Marmota monax
TFKEAVTFKDVAVAFTEEELGLLDPAQRKLYQDVMVENFRNLVSVEHQFFKRDISYAEREEKLWMMKTATQRETSLGENNQ

SEQ ID NO: 9701 - protein, 81 aa, Marmota monax
YQGVVVFSDVTVDFSQEEWEYLDSVQRVLYRDVMLENYSNLVSVGLSISKPAVITLLEQGHEPWTDGPVPAKSQSLHKWQK

SEQ ID NO: 9702 - protein, 81 aa, Heterocephalus glaber
CWGLLSFKDVSMEFSWEEWQLLDSTQRHLYREVTLENYSNLLSVGYHGTKPELIFKMEQGEEPWIINAKMSTPSCAGWEEW

SEQ ID NO: 9703 - protein, 81 aa, Mus musculus
YQDSVTFDDVAVEFTPDEWTLLDLTQKNLYREVMLENYENLTSVGCQLFIPSLTPWLKQEESEVAESAVPQQLELQPTIDD

SEQ ID NO: 9704 - protein, 81 aa, Mus musculus
MVTFRDVAVVFSEEELGLLDAAQRKLYHDVMLENFRMLLSVGDKNPEEMESLEEVGLRHLSHEALFCSQIWQQVSRDLMKA

SEQ ID NO: 9705 - protein, 81 aa, Cavia porcellus
MAMYLTREEWRPLDPTQRDLYRDVMQENYGNVVSLDFEIRSENEVNSKQEISEDVKFGTTSETPSGNVEENPDSEETFESG

SEQ ID NO: 9706 - protein, 81 aa, Cavia porcellus
EPWAVTFADVAVYFSSEEWGCLRPAQRALYRDVMRDTYSLLSALGGGGTKPALISWVEEEADLWDPDAQDPEVAKWPTEAD

SEQ ID NO: 9707 - protein, 81 aa, Cavia porcellus
SQELVTFEDVAVYFIRKEWKRLEPAQRDLYRDVMLENYRNVFSLDGESRTENDQEISEDTGLHGLLLGRFQKDMSQGLKFE

SEQ ID NO: 9708 - protein, 81 aa, Cavia porcellus
ECLTFRDVAIEFSPEEWKCLNAAQRTLYREVMLENYRTLVSLGIFLPNVSVISILEQGKEPWTVENEMKIARNSSRWECCK

SEQ ID NO: 9709 - protein, 81 aa, Cavia porcellus
SQGLVTFGDVAVDFSQEEWEWLNSVQRSLYRKVMLENYRNLASLGLCASKPDVISSMEQGQDPWMAGRGRTGDWHPDLKAV

SEQ ID NO: 9710 - protein, 81 aa, Cavia porcellus
MGLVSFDDVSVDFTWEEWKDLSDAQRNLYKEVMLETYSNLVALGHCSIKPDVIFKLEQGSGPCVLGEALRQCLPDVQKLTS

SEQ ID NO: 9711 - protein, 81 aa, Cricetulus griseus
MLSFQDVAIEFSPEEREYLEPAQWSLYRDVMLENYSNLNFLGLAVPKPHLVTFLEQTQGPCDMTIQATDTVHPGTTPNDYN

SEQ ID NO: 9712 - protein, 81 aa, Cavia porcellus
SKGSVSLKDVTVDFTEEEWQQLDTAQKALYRDVMLENYRHFISVGFHITKPHMICKLEQGEELWTERIFPSQSYLNVLVKF

SEQ ID NO: 9713 - protein, 81 aa, Cricetulus griseus
APASVSFEDVAVTFTVEEWGRLDLAQRMLYQEVMMETRGLLASLGHRVPKPELLYPQEHCQGVWAVKTGLPQGTCTGEEAK

SEQ ID NO: 9714 - protein, 81 aa, Cricetulus griseus
IEDAVTYSDVHVDFTLEEWALLHPSQKNLYKDVMLETYTNLAAIGYKWEDHKIEEHCQSSRRHERHERSHTGEKPSEYTQC

SEQ ID NO: 9715 - protein, 81 aa, Cricetulus griseus
PKVPVSFDDVSVYFTKTEWKLLDLKQKNLYKQVMLENYSHLVSVGFAVSKPNLVSQLERGEKPWITDGGIGATTGSCAGNG

SEQ ID NO: 9716 - protein, 81 aa, Cricetulus griseus
EMLSFRDVAIDFSAEERECLGRDQWSLYRNVMLENYSHLVYLGLSFSKPLLVRFLEKNPELRNVKRQGPPGKKPYKCKECG

SEQ ID NO: 9717 - protein, 81 aa, Cricetulus griseus
TQSLLTFVDVVINFCKEEWECLNTSQKDLFRGVILENYSNLFSVGVSESKPELVTCQEQNKEPWKHPQITVPYISSNDFHE

SEQ ID NO: 9718 - protein, 81 aa, Cricetulus griseus
CLTFDDVAVNFTLEEWDLLDPSQKQLYTDVMQETFKNLVAIGQTEEGQRIEDDGHFRRNLRNGIVELLFEPSEGRQCEEIF

SEQ ID NO: 9719 - protein, 81 aa, Cricetulus griseus
GSLCKKVKLSNNSQNWNVLTYDDVHIDFTWEEWTLLDTSQKNFYKDVMLETYKNLREIGYSWEALQLKNIFQVLKDMKEET

SEQ ID NO: 9720 - protein, 81 aa, Cricetulus griseus
LQGSVSFEDVAVDFTWREWQELDASQRTLYRDVMLETYSSLVFVGHCTTKPELIFKLEQGFGPWSKAEASVWNVRGVKKAC

SEQ ID NO: 9721 - protein, 81 aa, Cricetulus griseus
SSRRAGSVSFEDVAVDFTQQEWHRLDSTQKNVHKDMMLETYNHWHLWASAHDFQVRTGKELWILEEESSDRDYSGPLSLLC

SEQ ID NO: 9722 - protein, 81 aa, Cricetulus griseus
MLENYSNLLFLGHCKTKPELIFNLEQRLGSWIVGEASDQSIPEFQGMNTLSKICPETKARHVWQVALDSDTSKKLTGVGKA

SEQ ID NO: 9723 - protein, 81 aa, Cricetulus griseus
KEKQFTFQSLLTFEDVAVNFSKEEWECLYTSQRNLYIGVMLENYSNLVSVGLSESKPELVTCLEQNKEPWMVNIEEVEGMA

SEQ ID NO: 9724 - protein, 81 aa, Peromyscus maniculatus
MDPSQRNLYKDVMVETYMNLTAIGYNWEDLEVEEHCQNSLKHGRHEKTQTGEKSYEYNQCGKALSHNRALQLHERTHTGEK

SEQ ID NO: 9725 - protein, 81 aa, Peromyscus maniculatus
SVSFEDVAVRFTKEEWALLDPSQKKLYKDVMQETLRNLAAIGNKLENQKVVNEYENLCRKLSQLVEKFCEYKESLQSTELF

SEQ ID NO: 9726 - protein, 81 aa, Peromyscus maniculatus
MIPRSVSFMDVTIDFSREEWQHLDPDQRSLYQDVMQETYSHLRSVGYQVPKTEVFMLEQGKETWSLRNESPCQHCAEELQQ

SEQ ID NO: 9727 - protein, 81 aa, Peromyscus maniculatus
SQGLLTFRDVTVNFSQEEWECLDTAQRALYIDVMLENCNNLLFLENYFKCDTVHQHVKTESESCQYNKFGKVLHDPSIYAL

SEQ ID NO: 9728 - protein, 81 aa, Peromyscus maniculatus
VQDLVTFKDVAVLFTQEEWRQLSSAQRALYRDVMSENYSNLVSLGLSGSKPDVFFHLEKADKCVSEDAPGGFVLGGITMTT

SEQ ID NO: 9729 - protein, 81 aa, Peromyscus maniculatus
ELGVVSFADVAVYFSPEEWGCLRPAQRALYREVMRETYGLLGALGGGGAKPALISWVEEEAELWGPGAQDPAVAMRPTEAD

SEQ ID NO: 9730 - protein, 81 aa, Peromyscus maniculatus
MLENYKNLLFLGHCKTKPELIFNLEHRLGSWIVGEASDQSIPDSQEMNTLTKFCPETKARHVWQVVFDHDTSKELTRVGKA

SEQ ID NO: 9731 - protein, 81 aa, Peromyscus maniculatus
TQGQVLFRDVSVTFTQKEWQLLDAAQRRLYREVMLETYKHLQAVGCDVTKPELICKLEQGDVPWELPGGSLSEVQRADCMT

SEQ ID NO: 9732 - protein, 81 aa, Peromyscus maniculatus
MEVVTYEDVHVNFTHEEWALLDPSQKSLYKNVMLDWNLSAIGYKWEDHNIEEHYQSFRRHGRYIICPYRFKPCEHKGHGNK

SEQ ID NO: 9733 - protein, 81 aa, Peromyscus maniculatus
MDPVTFEDVAVSFTEEEWALLDVFQKNLYRDVMRETYRNLTSIGTKWEQWNLEAYYRSLKRNMRIQMVKRDDELADNGQYR

SEQ ID NO: 9734 - protein, 81 aa, Peromyscus maniculatus
VSFEDVAVRFTKEEWALLDPSQKKLYKDVMQETLRNLAAIGNKLENQKVVNEYENLCRKLRSQLVEKFCEYKESLQSTELF

SEQ ID NO: 9735 - protein, 81 aa, Peromyscus maniculatus
TQVSLTFEDVAVAFTQEEWGQLDPAQKTLYQEVMLEISGFLVSLGYPVPRLELLCQLEQGQEPWAVAKSQSTCSGDSGKTK

SEQ ID NO: 9736 - protein, 81 aa, Mesocricetus auratus
PHEPMEFEDVFLTFTKEEWAQLDHQQKCLYREIMLENYNNMISVEHHFSKPNVISELEEVEDFWPMDREIPQDTFPGSSRP

SEQ ID NO: 9737 - protein, 81 aa, Mesocricetus auratus
MESVSFEDVAVNFTPEEWALLNSSQKRLHRDVMQENFRNLAAIAKNQEDPTLEDDYEYLRKILPFAVQTGYRLCENQDYAE

SEQ ID NO: 9738 - protein, 81 aa, Mesocricetus auratus
KYGTVSFADVAVYFSPEEWSCLRPAQRALYREVMLETYGLLGALGGGGAKPALISWVEEEAELWGPGAQDPEVAMCQMEAD

SEQ ID NO: 9739 - protein, 81 aa, Mesocricetus auratus
VVGLVTFEDVCVDFTWDEWQDLDDAQRKLYRDVMLETYSSLESLNQCDAKPELILKLEQGAEPWKEEDVPNQSLPAVENVK

SEQ ID NO: 9740 - protein, 81 aa, Mesocricetus auratus
LQRLLTFRDVAVDLSREEWECLDSVQRALYMDVMLENYNNLIFVEKNCLCGKYEKILGQGINHILHNCETIQEKSYKCEKL

SEQ ID NO: 9741 - protein, 81 aa, Ictidomys tridecemlineatus
SQESVTFQDVAVDFTEKEWPLLDSSQRKLYKDVMLENYSNLTSLGYQVGKPSLISHLEQEEEPRTEERGSQHGTCPDWETP

SEQ ID NO: 9742 - protein, 81 aa, Marmota monax
MASPSPPLEPKEEWDYLDPAQRSLYKDVMMENYGNLVSLDVLNRDKDEEPTVKQEIEEIEEEVEPQGVIVTRIKSEIDQDP

SEQ ID NO: 9743 - protein, 81 aa, Marmota monax
FQESVTFKDVAVDFTQEEWGQLDSPQRALYRDVMLENYQNLLALAGPPVCKPDVISHLERGEEPWQVHSKVTGRTCSEWEP

SEQ ID NO: 9744 - protein, 81 aa, Heterocephalus glaber
TVTFEDVAVNFTMEEWTLLNPSQKKLYRDVMRETFRNMTAIGRACDDQEVEEDCRNYWRNLSNEEVEKCYQYKGWNQYEKI

SEQ ID NO: 9745 - protein, 81 aa, Mus caroli
MLDNYRNLASLGLCASKPDMITSLEQGRDPWMMKRKMRKGQRLDLKAMQETKEFPPKDLSEETLSLAVLRKQLLPCRPKCS

SEQ ID NO: 9746 - protein, 81 aa, Mus caroli
MVLVSFEDVAVDFTWEEWQDLDAAQRTLYRDVMLETYSSLVSLGHCMAKPELIFNLEQGLGPQSTEGASVWNLSGVGKVSS

SEQ ID NO: 9747 - protein, 81 aa, Mus musculus
DMGLVSFEDVAVDFTWQEWQELDAAQRTLYRDVMLENYRSLVWLGHCLAKPELISKLEEGFEPWGVAEATEQCLPGAEDQT

SEQ ID NO: 9748 - protein, 81 aa, Mus musculus
MLENYSNLVSLGLAFSKPYLVTFLEKRQQSWDVKQQATVATYPGTKPYKYKECNKTFVRKSLLIQHQRVHTGEKPYKCEQC

SEQ ID NO: 9749 - protein, 81 aa, Cavia porcellus
ETVTFRDVAIDFTKEEWKQLDPAQRNLYRNVMLENYNNLITVGYPFTKPDVIFKLEQEEDPWVVEEEVLRRHYPGEIWGID

SEQ ID NO: 9750 - protein, 81 aa, Cavia porcellus
YQELVTFRDVAVDFSQEEWDCLDSSQKHLYSNVMLENYRILASLGLCFSKPSVILLLEQGKEPWMVKRELTNGLSSGWKSV

SEQ ID NO: 9751 - protein, 81 aa, Cavia porcellus
VSVSFTDVTVDFTQEEWEQLDPTQRILYMDVMLENYSNLLSVEVWKADDQMEREHENPDEQARQFMILKNQTALEEGGNLF

SEQ ID NO: 9752 - protein, 81 aa, Cavia porcellus
GPVSFKDVAVDFTQEEWRQLDASEKMTYRDVMLENYSNLVSVDEVWQADDLMERVQGNVSEKAFSVEMSPVASRKISSRCD

SEQ ID NO: 9753 - protein, 81 aa, Cricetulus griseus
NVLSYEDVHIHFTCEEWTLLDTSQKNIYKDIMLETYKNLNDIGYSWEDHTIEEHFPCSKRYERKSSQTAETPSIHTQFVTA

SEQ ID NO: 9754 - protein, 81 aa, Cricetulus griseus
DILTFKDVAIGFSREEWECLDSAQRALYRDVMLENYSNLVSVGYLIFHAGEKPCKCSLCEKCFRSSTYIMRHKRMHTEEKQ

SEQ ID NO: 9755 - protein, 81 aa, Cricetulus griseus
ISFRDVAVDLSQEEWECLDCAQRALYLDVMLENYSNLVFVENVIESLTHRLIHVFPNCINFPENHCIYGKYEKILDQGTKH

SEQ ID NO: 9756 - protein, 81 aa, Cricetulus griseus
SQEMVTFKDVAVVFSKEELVLLDAAQRKLYRDVMLDTFRTLLSVAHEPFKPGLIAQLENEEKLCMVEAQAGSKGGHAVESH

SEQ ID NO: 9757 - protein, 81 aa, Cricetulus griseus
KPRSFGRAARNADFSAEERECLGPDQWNLYRDVMLENFSNLVFLGLASSKPYLVTFLEQSQGSNDMKRQGSAAMQTGNKPL

SEQ ID NO: 9758 - protein, 81 aa, Cricetulus griseus
VGFLKNCNKDEAVDFTQEEWATKDPPQNDIPSDVTAENCKNPASVGCQTLTKPNALTCLKEELVTTQRGGVQEVEKQLHTK

SEQ ID NO: 9759 - protein, 81 aa, Cricetulus griseus
AETIFFQSLLTFKDVAINFSKQEWEFLNTSQRELYRHVMLENYSNLVSVGLSESKPELVTCLEENKEPWIMNIDEAEGLEP

SEQ ID NO: 9760 - protein, 81 aa, Cricetulus griseus
FQSLLTFKDVAINFSKEEWECLHTSQKDLYRDVMLEHYGNLVSVGLSESKPELVTCLEENKEPWMVNIDEAEGLGQECLAI

SEQ ID NO: 9761 - protein, 81 aa, Cricetulus griseus
VLQGLEFKDVVIYFSREEWECLHHSHRNLYQNVMLENYSNLISLDWVSGREGKNLLPKDGYKIRSLQQKMAKKQTHLNVED

SEQ ID NO: 9762 - protein, 81 aa, Cricetulus griseus
HKDAVTYEDVHVNFTQEEWALLDPSQKSLYKDVMLETWENLISIGYKWEDPNIEDHCQSPRKHGRSLQDLYHERVLDFVKG

SEQ ID NO: 9763 - protein, 81 aa, Cricetulus griseus
GCVSFEDVAVYFSWEEWKLLDDSQRLLYQTVMTDIFELVSSLRLELSGISDITQVESCGDLSAPALRFTTPCLWTGCWIKV

SEQ ID NO: 9764 - protein, 81 aa, Cricetulus griseus
EKQFSFQNLLTFEDVAIIFSKEEWECLNTSERYLYRGVMLENYSNLVSVGLSGSKPELVTCLEQYKEPWMVNIEDSEVLEP

SEQ ID NO: 9765 - protein, 81 aa, Cricetulus griseus
ARGKSKSKASVTFGDLAIYFSREEWEWLSPIQKDLYEDVMLENYQTLVSLGLVCRRPNIITLLEKGKAPWMVEPSRRRRGP

SEQ ID NO: 9766 - protein, 81 aa, Peromyscus maniculatus
MGLVLFEDVAVHFTRREWQELDAAQRTLYRDVMLENYSNLLFLEPRMAKPKLIFNLERGHGPWSLAEASVPSFAGVHKVSA

SEQ ID NO: 9767 - protein, 81 aa, Peromyscus maniculatus
FQGLLTVRDVIVDFSQEEWECLDSSQRALYIDVMLENYSNLVSVGQQVIYSLFLKEKLKEKKQKEMADSPVNMSQGLLTFR

SEQ ID NO: 9768 - protein, 81 aa, Mesocricetus auratus
PQGLLSLRDVSVDFSQEEWECLDFDQRALYMDVMLENYNNLLFVDFHHVCGKWETVLHQGTKHFIHDNENIQEKSYTCHES

SEQ ID NO: 9769 - protein, 81 aa, Mesocricetus auratus
PKVPVTFDDVAVHFSEQEWGNLSEWQKELYKNVMRGNYESLVSMDYAISKPDLMSQMERGERPGMQEQEDSEEGETPTDPS

SEQ ID NO: 9770 - protein, 81 aa, Mesocricetus auratus
PQSLLSFRDVAVDLSQEEWECLNCAQRALYMDVMLENYNNLLFVGNHCTFGKYETVLDQGTKHIVHDHMNIQEKPSQYNEI

SEQ ID NO: 9771 - protein, 81 aa, Mesocricetus auratus
VKGLVTFEDVCVDFTWEEWQNLDDAQRKLYRDVMLETYRSLESLGHCITKPEVIFKLEQGTWPWRVEDAPEQRWPDVQKVN

SEQ ID NO: 9772 - protein, 81 aa, Mesocricetus auratus
SQGLVTIKDVSLCFSQEEWRSLDPSQTDFYGEYVMQENCGIVVSLRFPIPKLDMLSQPGGEEQWVPDHQNLEGRDTLKVMY

SEQ ID NO: 9773 - protein, 81 aa, Mesocricetus auratus
EEGCVSFEDVAVYFSWEEWKLLDDSQRLLYQTVMTDIFELVSSLRLELSGISDITQVESCGDLSVPALRFTTPCLWTGCWI

SEQ ID NO: 9774 - protein, 81 aa, Ictidomys tridecemlineatus
GPVSFKDVAVDFTQEEWQQLDPDEKVTYRDVMLENYSNLVSVGYHIIKPDVIIKLEQGEEPWIVEGEFPPQSYPDEVWQVE

SEQ ID NO: 9775 - protein, 81 aa, Ictidomys tridecemlineatus
NFWILRLPPGSKGEVPKEWGKLEDWQKELYKHVMRGNYETLVSLDYAISKPEVLSQIEQGKEPCTWRRAGPKVPDVPVDPS

SEQ ID NO: 9776 - protein, 81 aa, Marmota monax
AQESVTFRDVAVLFSQDEWLHLDSAQRTLYREVMLENYSSLVSLGIPFSTPKVICQLQQGEDPCMVEREAPPDTCPDFKTL

SEQ ID NO: 9777 - protein, 81 aa, Marmota monax
AQESVSFKDVTVDFSQEEWQHLDSAQKTLYMDVMLENYCHLISVGCDITKPDMILKLERGEEPWMSFAGHACLEENWKAED

SEQ ID NO: 9778 - protein, 81 aa, Marmota monax
VTFEDVVVTFTLGEWTLLDPSQKQLYRDVMWDTFKNLASIKKERGDQTTEDVHQNPRREISQEEGRCCEHKESNQCGESVS

SEQ ID NO: 9779 - protein, 81 aa, Heterocephalus glaber
MMFSDVSIDFSQEEWECLTDDQRDLYRDVMLENYSNLVSMAGLCISKPNVISYLEQGKEPWLVDRELRRAQWPESRYETKK

SEQ ID NO: 9780 - protein, 81 aa, Heterocephalus glaber
TVTFEDVAVNFTMEEWTLLNPSQKKLYRDVMRETFRNMTAIADSLACREPLIGHLSQNVPLIAHTALKPYKYLGSEESHYK

SEQ ID NO: 9781 - protein, 81 aa, Cricetulus griseus
MLENYNNVISVEHHFSKPNVISQLEEVEDFWPVERESPQETFPGQKRVPHIIMDICEPQFAGSELGSGHREEQPVVLATDT

SEQ ID NO: 9782 - protein, 81 aa, Cricetulus griseus
SQESVTFQDIAVDFTEKEWPLLDSSQRKLYKDVMLENYSILTSLGYQVGKPSLISHLEREEELRMEERGMQLGASPDWGTP

SEQ ID NO: 9783 - protein, 81 aa, Cricetulus griseus
VEGSVSFEDVAVDFTQQEWYRLDSTQRNMHKDVMLETYSHLASVGLCVAKPDMIFKLERGEELWVLEEESSDHDYSGPLSL

SEQ ID NO: 9784 - protein, 81 aa, Cricetulus griseus
MLENYRNLVFLGLAVSKPYLVTCLEQRKEPWNVKRQKTMVLFPAMFPHYDQDFSPEQNIKYSFQELINGSHRNYGLDNVYF

SEQ ID NO: 9785 - protein, 81 aa, Cricetulus griseus
NLENLLRNRNFWVLRLPPGSKGEAPKVPVTFVDIAVYFSEDEWKNLDEWQKELYSNLVKENYKTLMSLGKDASPPLVRALC

SEQ ID NO: 9786 - protein, 81 aa, Cricetulus griseus
VIYDDVHINFTQEEWALLNSSQKSLYKDVMLDTYRNLTAIGYSCEDHNIEEHCQSSRRHRRKSPISQAQSRLLHLLGRVAP

SEQ ID NO: 9787 - protein, 81 aa, Peromyscus maniculatus
MATLGVSPTFGYQVGKPNLISHLEQEEELRMEERDIQWGTSPDWGTSAKIKWSIVMEDIFGEETSNGVTLEKSHLLEKSSE

SEQ ID NO: 9788 - protein, 81 aa, Peromyscus maniculatus
KVPISFKDLAVRFSEEEWRILQEGQREFYRDVMRENYETLVSVGTSELLPLSAFLSPTEPGGATAGEGHHDKGQEPPLERG

SEQ ID NO: 9789 - protein, 81 aa, Peromyscus maniculatus
MAELKEEWDYLDPARRSLYKDVMMDSYGNLVSLDVLNRNKNEEPTVKEEIEEDIDPPGVIVTRIKSEIDQDPIGRETFELV

SEQ ID NO: 9790 - protein, 81 aa, Peromyscus maniculatus
RPRALKFADVAVYFSPEEWGCLRPAQRLLYREVMRETYGLLGALETRTRQKNEEKEVFPPKEAPRKGKRGRKPSKPRLVPR

SEQ ID NO: 9791 - protein, 81 aa, Peromyscus maniculatus
LQETVTFRDVAVVFSEEELGLLDAAQKQLYRDVMLENFRTLLSVAHQPFKPDLIAQLEKEEKLCMEETQGGGYSGSEGGHA

SEQ ID NO: 9792 - protein, 81 aa, Peromyscus maniculatus
MNTVTYDDVRIDFTWEEWTLLDPSQKNLYKDVMLETYRNLTSIGYIWEDHNIEEYCQSSRGHERQERSQTEEIPSVYTQCD

SEQ ID NO: 9793 - protein, 81 aa, Peromyscus maniculatus
YQELVSFEDVTVAFTQEEWSSLNPAQRSLYRDVMLENYQNLVTVGYQLIKPSLVSWLEQEEFSTGQKIVFPEWKMQLENKC

SEQ ID NO: 9794 - protein, 81 aa, Peromyscus maniculatus
MDAVTYEDVHVTFTQEEWALLDPSQKRLYKDVMFETYQNLTDIGYKWEDQNIEEHCQSSRRHGRYIICHSGHKPCDPKGYG

SEQ ID NO: 9795 - protein, 81 aa, Peromyscus maniculatus
MEEWILLDPSQKNLYKDVMLETYRNLSIIGYSSEDHNIEEHCQNSRRHERHERSQTGDKPSVYPQYGKAFTYHSHLQMHER

SEQ ID NO: 9796 - protein, 81 aa, Peromyscus maniculatus
MEEWALLDPSQKNLYNNVMLETYMNLSAIGYTWEDHKVEEHCQSSQRHGRHERSYTGDQSSEWTLCVNSFAYQSHLQRHER

SEQ ID NO: 9797 - protein, 81 aa, Ictidomys tridecemlineatus
MPLTFQDVAVYFSPAEGQQLGPQQRALYRDVMLENYGNVASLGFPVPKPELISQLEQGEELWVMDLLGAEESEVLRNCRTD

SEQ ID NO: 9798 - protein, 81 aa, Ictidomys tridecemlineatus
TLGPVSFKDVTVEFSGEEWQHLDLAQRSLYRDVMLENYFNLISVGCPVPKPEVIFNLEQAEPRVWDEEASGQHCADGDIGF

SEQ ID NO: 9799 - protein, 81 aa, Marmota monax
MLENCRNLASLGCHVDKHSLISQLEQEDKTVTEERGILPSTCPDLDTVLKTKWLTPKKHVFRKEQTKSIKMERSHRGVKIN

SEQ ID NO: 9800 - protein, 81 aa, Heterocephalus glaber
PQGSVTFRDVAIGFSQEEWKWLQPAQRDLYRCVMLENYGHLVSLGLSIFKPVVVSLLEQGNEPWLGKGDMSRDLFSVSQSN

SEQ ID NO: 9801 - protein, 81 aa, Heterocephalus glaber
FQEFVTFEDVAVYLTREEWGRLDPVQRDLYREVMLENYGNVVSLGFPISTPDGISQLEQDLQVFDLETKNREVLRGDSSDG

SEQ ID NO: 9802 - protein, 81 aa, Heterocephalus glaber
SIVFKDVAITFSRREWRKLEPFQKELYKDVLQENLRNLEFLECEPKGELEVSVQNCNVFMEDLTLEKIIEECFKDDGCGLI

SEQ ID NO: 9803 - protein, 81 aa, Heterocephalus glaber
LKESVTFKDVAVDFTREEWHHMDSAQRSLYRDVILENYSHLVSLVYQVSKPEVIFKLEQGEEPWISEGEIQRLFCSDWKTR

SEQ ID NO: 9804 - protein, 81 aa, Heterocephalus glaber
EAVTFEDVAMNFSREEWALLDPSQKKLYRDVMWETLRNLAAIGESFSSRRPLIGHLSADGPIMANTQLKSYEQHGFQEKLS

SEQ ID NO: 9805 - protein, 81 aa, Mus caroli
SQVSVTFEDVAVLFTRDEWKKLVPSQRSLYREVMLENYSNLASLGFPFTKPKVISLLQQGEDPWKVEEEGPGGFSLGLKCS

SEQ ID NO: 9806 - protein, 81 aa, Mus musculus
VSFEDVAVHFTQDEWDLLDPFQKSLYRDVMLETCRNLAAIGYIWEEQNVEDDCKNFGRIQRHVISDSEYLLDEQEGYGNKP

SEQ ID NO: 9807 - protein, 81 aa, Mus musculus
MDAVTYEDVHVNFSQEEWALLDPSQKSLYKDVMLETYWNLTCIGYKWEDHNIEDQHQSSGRHGRCINCPSAYGKKQCTNLF

SEQ ID NO: 9808 - protein, 81 aa, Mus musculus
LLHGCCSLETHSIRDKNAVTYGDVHVNFTQEEWALLDPSQKKLYKDVMLETYRNLNAIGFNWDDKNTEEHCPSTRRWRRYP

SEQ ID NO: 9809 - protein, 81 aa, Mus musculus
MDLVTYDDVHVNFTQEEWALLDASQKSLYKGVMVETYRNLTAIGYSWEEHTIEDHFQTSRSHGRYERRSSAEQHSEFIQCG

SEQ ID NO: 9810 - protein, 81 aa, Mus musculus
MEEMLSFRDVAVDFSAEEWECLEPAQWNLYRDVMLENYSHLVFLGLAFSKPYLVTFLEQRQEPLNEKRQVATTMHPDIKPY

SEQ ID NO: 9811 - protein, 81 aa, Mus musculus
KKEMLSFWDVAIDFSPEEWECLEPAQWDLYRDVMLENFSHLVFLGLAVSKPFLVTFLEQIQGPWDMKRQGTAPVYPGIIPN

SEQ ID NO: 9812 - protein, 81 aa, Mus musculus
FQGLLTFRDVAVDFSQEEWECLDSAQRALYIGVMLENYSNLVSVGIIVCKADLVPHLEQIYIPWNVKIKEMVAKPGRESYR

SEQ ID NO: 9813 - protein, 81 aa, Cricetulus griseus
WEEMLSFWDVAIEFSPEERECLEPAQWNLYRDVMLENYSHLNFLGATPNDYNVYNKTIECNSVSVQHQRIHTKEKPYKCKE

SEQ ID NO: 9814 - protein, 81 aa, Cricetulus griseus
RGAFCRFSTCLTHGKCIEEPFWLQPTRSDSTAKQLIPTLLIFLLTGYDVTKPNVIIKLEQGEEPWMMEGDCHAQSHLEISK

SEQ ID NO: 9815 - protein, 81 aa, Cricetulus griseus
EKQFSFQSLLTFEDVAINFSKEEWECLNTSQRDLYRFVMLENYSNLVSVGLSVSKPELVTCLEQNKEPWMVNIEDSEVLEP

SEQ ID NO: 9816 - protein, 81 aa, Peromyscus maniculatus
KVPVTFVDIAVYFSEDEWKNLDEWQKELYSNLVKENYKTLMSLDTDGPVSKPDAPVQAEPREEPCVWEQQHPEEREIPVAA

SEQ ID NO: 9817 - protein, 81 aa, Peromyscus maniculatus
SAKLVTFEDVAVYFTQTEWDSLSPEQRALYRDVMLENYRNLASMGFPLLKPALISQLEEGKDLENLSQLATGTDSQGLWTE

SEQ ID NO: 9818 - protein, 81 aa, Peromyscus maniculatus
MEEMLSFCDVAIEFSAEERECLKPAQWNLYRDIMLENYSNLDFLGLAVSKPHLVTFLEQTQGPGDVKRQATDSVHPGTIPN

SEQ ID NO: 9819 - protein, 81 aa, Peromyscus maniculatus
MQNMLSFKDVAINFSAEEYECLDSAQWNLYRDVMLENYSNLVFLGLSFSKPLLVRFLEKNQELRKSQAAAVRQGKKPYKCK

SEQ ID NO: 9820 - protein, 81 aa, Peromyscus maniculatus
AMNAVTYDDVHVDFTWEEWALLDPSQKRLYKDVMLETYGNLTAIGYKWKDHHIEEHCESSRRHGRHGRSHTGEKPSEYAQS

SEQ ID NO: 9821 - protein, 81 aa, Peromyscus maniculatus
GQVAFTFEDVAVIFTQEEWGQLAPAQRTLYQEVMLENRGLLVSLGYPVPRPELMCRLEHGQELWPVMKDLFPSIHAGNNGK

SEQ ID NO: 9822 - protein, 81 aa, Peromyscus maniculatus
AMELVSFEDIAVYFTWQEWQDLDIAQKLLYRDVMLENYSSLVSLGCCMVKPELILTLEHEFGLWRVADTSVWNLPDVRNLS

SEQ ID NO: 9823 - protein, 81 aa, Mesocricetus auratus
SKGSVSFKDVTVDFTQEEWQQLDPAQKALYRDVMLENYCHFISVGFHITKPDMIRKLEQGEELWTERIFPSQSYLEDEDVL

SEQ ID NO: 9824 - protein, 81 aa, Mesocricetus auratus
VQDLVTFKDVAVLFTQEEWGRLSSAQRALYRDVMLENYSNLASLGLSGSKPDVFFHPEKADKCTPEHASEGVVLGGITMTM

SEQ ID NO: 9825 - protein, 81 aa, Mesocricetus auratus
SQGVLTFGDVSVDFTPEEWQCLDSAQRALCIDVLLENYKNLIYVEKYCKYHPVHIHVKTENESCQCDELGKVLHDPSTCAL

SEQ ID NO: 9826 - protein, 81 aa, Mesocricetus auratus
TEDAVTYDDVHINFTQEEWALLNPSQKSLYKDVMLDTYMNLSAVGYSWDDHSIEEHCQSSRRPIRCLQSHKTTLHEGKHHE

SEQ ID NO: 9827 - protein, 81 aa, Mesocricetus auratus
GSLENDGVCFSEQEWENLEDWQKELYRNVMESNYETLVSLKVLGQPEEAAAELGAEMVGDLVEEGTHLDRTMVKQEVLYKP

SEQ ID NO: 9828 - protein, 81 aa, Mesocricetus auratus
AQGLVTFRDVAVDFSQEEWDFLDSAQKSLYRDVMRENYSHFVSLGPSISKRDAITLLDEGGKEPEIIVREGRRYCPDLESR

SEQ ID NO: 9829 - protein, 81 aa, Mesocricetus auratus
PEGILTFEDLAIDFSHGEWECLDSAQKALYRDVMLENYSNLVSVGITVSKPELINSLEQSKEPWDVNTRETEDKEQCCLIF

SEQ ID NO: 9830 - protein, 81 aa, Mesocricetus auratus
MLFKDVSVVFTQKEWQLLDTAQRRLYREVMLETYRHLQAVGCNVTKPELIRKLERGEGPWESPGCSLSEVQRANNMTTSEE

SEQ ID NO: 9831 - protein, 81 aa, Mesocricetus auratus
PADRDAVTYDDVHIGFTQEEWVLLNPSQKSLYKDVMLDTYRNLTAIGYRWQDHNIEEHCENSRRHRRKFSCTTKPYESLQN

SEQ ID NO: 9832 - protein, 81 aa, Mesocricetus auratus
FQSEVVFRDVTVDFSQEEWECLNSSERDLYKDVMLENYSHLVALGCSISKPDVITLLEQGKEPWMIVRDEKRRWSQELEPR

SEQ ID NO: 9833 - protein, 81 aa, Mesocricetus auratus
PKVSGSLENDGVCFSEQEWENLEDWQKELYRNVMESNYETLVSLKVLGQPEEAAAELGAEMVGDLVEEGTHLADRTMVKQE

SEQ ID NO: 9834 - protein, 81 aa, Marmota monax
MLENYSNLVSMGFYIPKPQVISLLEQGKEPWMVGRELTRGLCSDLESMCESKLLSLKKEVYEIESCQREIMGLTKPGLEYS

SEQ ID NO: 9835 - protein, 81 aa, Heterocephalus glaber
ESVSFEDVAVDFTQEEWILLDPTQRNLYSDVMLENYQNLASMEWKVGLKTKESALHQDFLRGQTSRKIYMAGSHNGAELCD

SEQ ID NO: 9836 - protein, 81 aa, Heterocephalus glaber
MLETYNNLVALGHCSTKPAVIFKLEQGSGPCMVEEAPSRCFPDVQKVNGRIQTNQENQEKHFWQVVTTSAEKKVELVKPFN

SEQ ID NO: 9837 - protein, 81 aa, Heterocephalus glaber
EEVSFEDVAVNFTMEEWALLDPSQKKLYRDVMWETFRNVADIGKNNILSHLCSKRALVIAYQFYTSVNIKPVGTKPNESFG

SEQ ID NO: 9838 - protein, 81 aa, Heterocephalus glaber
MFLPLTFEDVAIYFSEQEWQDLEMWQKELYKGVMRTNYETLVFLDGALSKPELISWIEQGREPFRSWGESQPPGNMALPSA

SEQ ID NO: 9839 - protein, 81 aa, Heterocephalus glaber
SQGPVTFEDMAMYLTREEWRPLDPTQRDLYRDVMQENYGNVVSLDFEIRSENEVNPKQEISEDVEFGTTSEGPGGNVEENP

SEQ ID NO: 9840 - protein, 81 aa, Mus caroli
MEGLLSFRDVAIDFSAEECECLEPAQWKLYRDVMLENYSNLVFLGLAFSKPYLVTFLEQRREPWNVKEAATVAAHPGIKPF

SEQ ID NO: 9841 - protein, 81 aa, Mus caroli
VTLEDVAVNFTLEEWTMLNASQKELYKDVMQDTLRNLSYIGEGNKWEHQNIENECETLWRKLRTSCQEKSLWRYNSQLLET

SEQ ID NO: 9842 - protein, 81 aa, Mus caroli
AVTFMDVAVVFSEEELRLLDAAQRKLYHDVMLENFRNLLAVGGQSPNKIESLHATGVRCLSLGRLPCWQMTSHDVNKLART

SEQ ID NO: 9843 - protein, 81 aa, Mus caroli
GPLTFKDVALDFSLEEWECLSFAQRSLYMDVMLENYNNLLFVENHCLRGKYRKVLDQDSQYIVHEHMNIQEKSSKWDKLSK

SEQ ID NO: 9844 - protein, 81 aa, Mus caroli
VKGLVSFEDVSVDFTWDEWQDLDDSQRKLYRDVMLETYSSLESLGHCITKPEVIFKLEQGAGPWRVEDVPKQSRPDVQKVT

SEQ ID NO: 9845 - protein, 81 aa, Mus caroli
MEAVTFGDVAVHFSREEWQCLDSGQRALYREVMLENHSSVAGLAGFLVFKPELISRLEQGQEPWVLDLQGAEGAEAPRICQ

SEQ ID NO: 9846 - protein, 81 aa, Mus caroli
MLSFWDVAIDFSPEEWECLEPAQWDLYRNVMLENFSHLVFLGLAVSKPFLVTFLEQRQGPWDMKRQGMATVYPGIIPYDPN

SEQ ID NO: 9847 - protein, 81 aa, Mus musculus
EDAVTYDDVHVNFTGEEWKLLDPSQKSLYKDVMLETYWNLTVIGYTWETHHIEGHCQSSRRNERFSLHCQLPWASRIASWV

SEQ ID NO: 9848 - protein, 81 aa, Mus musculus
DAMTFDDVHVNFTKEEWNLLEPSQMNLYKDVMLETYWNLTSIGYKWEDHHIEEPCQSSRRHTRPHEGARFHDTESSVQPPK

SEQ ID NO: 9849 - protein, 81 aa, Cavia porcellus
TGQSISKPDVIDLLEQGKEPWVIRREKKRRPYTDLNLQYKIISYLKIPTHEKDKSSAQHQSIYPRDKLYKCTKCQKKFSSS

SEQ ID NO: 9850 - protein, 81 aa, Cavia porcellus
EMALLTFRDVVINFSLEEWECLDPVQRTLYRDVMLENYRNISSLGLAVSKPHLIICLEQSKDPWTLQTQKRAATPPAVVKS

SEQ ID NO: 9851 - protein, 81 aa, Cricetulus griseus
SHSMGAVTCNDVLTNFPQEEWALLYPSEKSLYKDVMLDTYGNLNVIGCSWEGHNIEENCQTSRSHRREMPHLYPLEEEMGR

SEQ ID NO: 9852 - protein, 81 aa, Cricetulus griseus
GCVSFNDVAIYFLREEWTLLDGSQRRLYHHVMMEVFVLMSSLGLIPSGTHDIAQLASSRDRFIPALRFLTPRVKVEKIPSG

SEQ ID NO: 9853 - protein, 81 aa, Cricetulus griseus
PSDNSGDGLAAARYPTQGPDLPKPAVISQLEQGAELWVTERGGTRACHPGKNPTKWEQDHPEKELSPITERDGFERAISCH

SEQ ID NO: 9854 - protein, 81 aa, Peromyscus maniculatus
VMDAVTYEDVHINFTCEEWALLGPTQKSLYKDVTLETYRVRHHRPSSGSLPILFSGQIVKAEGGEYRRKEVEEENSPEAAV

SEQ ID NO: 9855 - protein, 81 aa, Peromyscus maniculatus
SQVSVTFEDVAVLFTRDEWKKLDHSQRSLYREVMLENYSNLASLGFPFTKPKMISVLQQGEEPWKAEKESHGGSSLGCNSS

SEQ ID NO: 9856 - protein, 81 aa, Peromyscus maniculatus
MAELKEWDYLDPARRSLYKDVMMDSYGNLVSLDVLNRNKNEEPTVKEEIEEDIDPPGVIVTRIKSEIDQDPIGRETFELVG

SEQ ID NO: 9857 - protein, 81 aa, Peromyscus maniculatus
MRPVQKELYKTVTLQNYWNMVSLGLTVYRPTVIPILEEPWMVIKEIVEGPSPESETKAEAHIPLKDLPTFKQDGTQTVKQD

SEQ ID NO: 9858 - protein, 81 aa, Peromyscus maniculatus
MDVLAFEDVAVKFSQEEWILLDPSQKKLYRDVMLETCSYLTFIGIKWENQNIEEQCKHSWRYLRNYMVDAVCEDKEGGQFR

SEQ ID NO: 9859 - protein, 81 aa, Peromyscus maniculatus
PELVSFADVAVYFSPQEWGCLRPAQRALYREVMRETYGLLGALAASVTFHSQGFLGSLHSGDTSDKKEEGCKEGAERPAET

SEQ ID NO: 9860 - protein, 81 aa, Peromyscus maniculatus
WLCNLEKGILTFEDVAIDFSQEAWECLDSTQWALYRDMILENYSNLVSVGLTITKPELINSLEQSKEPWKVTLKASKNSDL

SEQ ID NO: 9861 - protein, 81 aa, Peromyscus maniculatus
MGSVSFEDISLDFTWDEWQDLDSAQRTLYRDVMLENYSSLMFLGHCTTKPELIFKLEHGFGPWSLAEASIQSLPGVHKMTV

SEQ ID NO: 9862 - protein, 81 aa, Peromyscus maniculatus
DMRLVSFEDVAVDFTWQEWQELDAAQRTLYRDVMLENYRSLVWLGHCLAKPELISKLEQGLVPWSGAEATEQCLPDVHKWS

SEQ ID NO: 9863 - protein, 81 aa, Peromyscus maniculatus
RTNAVTYDDVHIDFTWEEWALLDLSQKNLYKDVMLETYRNLTTIGYNWKDHNIEEHYQSSRRHGRPERSLTGEKPCEYTQR

SEQ ID NO: 9864 - protein, 81 aa, Mesocricetus auratus
VTRLYKTVTFKDVAVDLTQEEWQQMKPAQRNLYRDVMLETYSNLVTVGYQATKPDVIFKLEQEEEPWVLEEEMFWRHSPGE

SEQ ID NO: 9865 - protein, 81 aa, Mesocricetus auratus
SQGLVTFGDVAVVFSQEEWEWLSSEQRSLYWRVMLDNYRNLASLGLCASKPDMIALLEQGKDPCVLKRKTARGLRPDLEAV

SEQ ID NO: 9866 - protein, 81 aa, Mesocricetus auratus
MAMYLTREEWRPLDPTQRDLYRDVMQENYGNVVSLDFEIRSENEVNQKQELSEDVEFVTMSEEPIGDAEKNPESEEVFESG

SEQ ID NO: 9867 - protein, 81 aa, Mesocricetus auratus
MDFVTFEDVIVNFTQDEWALLDSSQKNLYREVVGEIFMNLASMGERWDQNIEDWYRNQGRILSNHIIERFGNSKQGSHCGE

SEQ ID NO: 9868 - protein, 81 aa, Mesocricetus auratus
SQEPLTFKDVAVDLSPEEWGQLAPAFRDLYREVMLENYRNLVSVGYQLSKPSVISQLEKGEGPWMAESQGPEDPMLETKET

SEQ ID NO: 9869 - protein, 81 aa, Mesocricetus auratus
AQGLVTFRDVAVDFSQEEWDFLDSAQKSLYRDVMRENYSHFVSLAGPSISKRDAITLLDEGGKEPEIIVREGRRYCPDLES

SEQ ID NO: 9870 - protein, 81 aa, Ictidomys tridecemlineatus
LELLTLEDVAVAFTREEWQLLGPGQKDLYRDVMLENYSNLVSVGYPVSKPDALSKLEQGEEPWTEDEMHTWICPENDKVDH

SEQ ID NO: 9871 - protein, 81 aa, Heterocephalus glaber
RNRNFWILRLPPGSKGEEWGKLEDWQKELYKHVMRGNYETLVSLDYAISKPEVLSQIDQGKDPCTWRRTGPKIPDVPVDPS

SEQ ID NO: 9872 - protein, 81 aa, Heterocephalus glaber
EAVTFEDVTVNFTMEEWALLNASQKKLYRDVMGETFMNIAAIGRAWDNQEVEEEYKKYWRNLRNEQVVKHYQYKAWTQYEE

SEQ ID NO: 9873 - protein, 81 aa, Heterocephalus glaber
VTFEDVFVYFSQEEWELLEEAQRFLYHDVMLENFALVATLAAALCQIPCNCPVGEGQKAQVSGREDTTLVTVEKGFCFPAN

SEQ ID NO: 9874 - protein, 81 aa, Mus caroli
MLETYSNLVSLGYDVTKPNMIIKLEQGEEPWTVEGDRHAQRHLEISKVYDPREGIEEIGEKHLQCGDDPHCWRAEKGAAFD

SEQ ID NO: 9875 - protein, 81 aa, Mus caroli
GSVSFEDVAVNFTVEEWALLDPSQKKLHKDVMEETFRNLAAIGKTQDQNIDEDHRYSRRNQRNDVVERLLEHSKGTESKEI

SEQ ID NO: 9876 - protein, 81 aa, Neotoma lepida
RPRALKFADVAVYFSLEEWGCLRPAQRMLYRDVMRETYGLLGALGCAGPKPALISWLERNTDAWEPAALDPQEYRRWVTFQ

SEQ ID NO: 9877 - protein, 81 aa, Mus musculus
EEDCLSFEDVAVYFSWEEWTLLDDSQRLLYQTVMSEILTLMSSLGLIPSGIHEMTQLKSWGEPSVPALRFLTPGCWIKVDS

SEQ ID NO: 9878 - protein, 81 aa, Mus caroli
SKGWLSFRDVAIDFSPEECECLDAAQWDLYSDVMLENYSNLVSLGLAFSKPYLVTFLEKRQQSWDVKQQATVATYPGTKPY

SEQ ID NO: 9879 - protein, 81 aa, Mus musculus
SQGLLTFRDVAVDFSQEEWECLDSAQRALYIDVMVENYSNLVSVENYCICDTVHQPVRTEKESCPCNELNEMLHEPSNCAL

SEQ ID NO: 9880 - protein, 81 aa, Cavia porcellus
MLENYSNLLSLGILFSKPEVISQLEQTEDSQVVGTGALRGLCRGWESLFETTISKEANQEAMKNFLMDSPLNFKFGKTYIN

SEQ ID NO: 9881 - protein, 81 aa, Cavia porcellus
FQEAVTFGDVAVHFSREEWQCLDSGQRALYREVMLENHSSVAGLAGFLVFKPELISRLEQGQEPWVLDLQGAEGTEASRTF

SEQ ID NO: 9882 - protein, 81 aa, Cricetulus griseus
FQDLLTFKDVSVDFSREEWQCLDTSQRALYVDVMLENYNNLVSVENYYICDPVHQHKKTEKKSCQCTEFGKILHDPSTCAL

SEQ ID NO: 9883 - protein, 81 aa, Cricetulus griseus
FQGVLTFRDVAVDFSQEEWGCLDSAQRALCIDVMLENYSNLLYVENYSKCDPVRHHVKTEKESCQCNELGKVLHDPSTCAL

SEQ ID NO: 9884 - protein, 81 aa, Cricetulus griseus
MLETYSNLVTVVGSSISKPDLITLLEQEREPWMVVKEGTNRPSPDLESDCEAQKRSPGNHNINPSKESIKHISKTSDLQGS

SEQ ID NO: 9885 - protein, 81 aa, Cricetulus griseus
PSKSHGLDPEASAQTRAYLSLFSGEEYQEAVTFGDVAVHFSREEWQCLDSGQRALYREVMLENHSSVAGLGEATPGDPLQT

SEQ ID NO: 9886 - protein, 81 aa, Cricetulus griseus
MQAQDFLAFEDVAVKFSQEEWILLDPSQKKLYRDVMLETCINLTSLGIKWEDKNIEEQYKHSWRYLRSYMVDAINEHKEGG

SEQ ID NO: 9887 - protein, 81 aa, Cricetulus griseus
DAVAYDDVLIKFTQEEWALLNNSQKNLYKDVMMDTYRNRSDIGIFKGMKKFILERNHMNVFNIVKSLHVTVVTNSIKEHKL

SEQ ID NO: 9888 - protein, 81 aa, Cricetulus griseus
EPVTFEDVAVDFTSEEWALLDSSQKKLYRDVMKETFFNLISIEKTLEKNIEEDYEDLSRNMGTPVLGEDCGYECDTECDKK

SEQ ID NO: 9889 - protein, 81 aa, Peromyscus maniculatus
SEGTVTFKDVAIDFTPEEWKQLDPTQRNLYRNVMLENYNNLITVGSPVTKPDVIFKLEQEEEPCVVEKEVLKRHCPGEIWA

SEQ ID NO: 9890 - protein, 81 aa, Peromyscus maniculatus
SQGLLTFGDVALDFSQEEWECLDSAQRALYIDVMLENYSNLVSVENHCMCGKFNKVLDQDSNYIVHQLVNIQEKSYKYNQL

SEQ ID NO: 9891 - protein, 81 aa, Peromyscus maniculatus
LQETVTFRDVAVVFSEEELGLLDAAQKQLYRDVMLENFRTLLSVAHQPFKPDLIAQLEKEEKLCMEETQGGSEGGHAVHSA

SEQ ID NO: 9892 - protein, 81 aa, Peromyscus maniculatus
PFKTVTFKDVAVDLTQEEWQQMKPAQRSLYRDVMLETYSNLVTVGCQVNKPDVILKLEQEEEPWVLEEEMFWRHSPEARRG

SEQ ID NO: 9893 - protein, 81 aa, Peromyscus maniculatus
NAVTYNDVHVDITQEEWALMDPSQRNLYKDVMVETYMNLTAIGYNWEDLEVEEHCQNSLKHGRHEKTQTGEKSYEYNQCSK

SEQ ID NO: 9894 - protein, 81 aa, Peromyscus maniculatus
SQGVLTFRDVTVNFLKDEWDCLESAQRALYIDVMLENYKNLVFVENYWNCDPVYQHVKTEKESCQCTELGKVLHDPSICAL

SEQ ID NO: 9895 - protein, 81 aa, Peromyscus maniculatus
NAVTYDDVHIDFTWAEWTLLDPSQKNLYKDVMLETYRNLTTIGYSWEDHDIEDHCKSSRRHERQERIHIGEQSSEHTECVK

SEQ ID NO: 9896 - protein, 81 aa, Peromyscus maniculatus
ESVTSEDVAVKFSMEEWALLSPSQKKLYRDVMQETFRNLAAIGMEQEDQNFEKDYRCSQRNPKSQMGKSLCEHNEDNQCVE

SEQ ID NO: 9897 - protein, 81 aa, Peromyscus maniculatus
SAVTYDDVHMDFSVEEWALLDSSQKNLYKDVMIETCRNLTAIGYSWEDHNTKKHCQSFRRQGRNERNHTGDKLTENTQCVK

SEQ ID NO: 9898 - protein, 81 aa, Peromyscus maniculatus
DSVTFEDVAVNFTVEEWALLDPSQKKLHRDVMEETFRNLAAIGKPQKDQHIDNDHRYSRRNQRNEVVERLLEHNKDNECEE

SEQ ID NO: 9899 - protein, 81 aa, Peromyscus maniculatus
ESVTFEDVAVHFTMEEWIMLDLSQKDLYKDVMKEILRNMVSIGNIRKHQKIENEYQNSERKRSCQLVEKLHDCKEGHKCAE

SEQ ID NO: 9900 - protein, 81 aa, Peromyscus maniculatus
DMNAVTYDDVHVGFTWEEWTLLDRSQKNLYKDVMLETYRNLTTIGYSWEDHNIEEHCQSSRRHERHERSHNAEKPSVYTQC

SEQ ID NO: 9901 - protein, 81 aa, Peromyscus maniculatus
YEGLLTFRDLDVDFSQEEWECLDSAWRTLYIDVMLENYRNLIFVEKHRICGKYESIMDQGSNSTVYQHVNIQKKSYNNNDL

SEQ ID NO: 9902 - protein, 81 aa, Peromyscus maniculatus
MDPSQRNLYKDVMVETYMNLTAIGYNWEDLEVEEHCQNSLKHGRHERTHTGEKPYQCNQCGKAFAWPRYLQVHKRSHTGEK

SEQ ID NO: 9903 - protein, 81 aa, Ictidomys tridecemlineatus
MFFLFLRAGIPFSKPKLITQLEQGKETWREERKCLLSTCPAEAKPELQPGPLCPPDFSSQKFPVQQVLCNHPPWIFTCLCA

SEQ ID NO: 9904 - protein, 81 aa, Mesocricetus auratus
MASPSPLLEPKEEWDYLDPARRSLYKDVMMDSYGNMLSLDVLNRNKGEEPTVKEEIEEDTEPPGIMVTRIKSEIDEDPICT

SEQ ID NO: 9905 - protein, 81 aa, Marmota monax
MTEALQPSSQVQVLFHFSLTGYHIIKPDVIIKLEQGEEPWIVEGEFPPQSYPDEVWQVEDPMEKLQEDEDMFFINKTLGEE

SEQ ID NO: 9906 - protein, 81 aa, Marmota monax
NRVSPFKDMILCFSEEDWSLLDPAQTGFYGEFIIGEDYGVSMPANDPAAQPDLLQGEENGPRVPELQDLQGKEEPQVSYLD

SEQ ID NO: 9907 - protein, 81 aa, Marmota monax
LVMFEEVSVCFTSEEWACLGPIQRALYWDVMLENYGNVTSLEWETMTENEEVTSKPNISQRADAQKGISKRLQGSVSQVPG

SEQ ID NO: 9908 - protein, 81 aa, Marmota monax
FQELVSFNDVTVGFTQEEWQHLDPSQRSLYREVMLENYSHLVSVGYCVTKPEVIFRLEQGEEPWISEAEFPSQSFPELWKA

SEQ ID NO: 9909 - protein, 81 aa, Marmota monax
NEMVTFKDVAVVFSGEELELLDSAQWKLYQDVMLENFRNLLSVGGRIQTELETFPEAGPHEELSWQQIWEQIASDSTFSQD

SEQ ID NO: 9910 - protein, 81 aa, Heterocephalus glaber
AGHPPEMAVCKPEGRGAEEWEKLGPAQKDLYKDVMLENYSNLASIGYQAPKPDICKLEKEEGAWSGKGKRSSQNHLSKLTR

SEQ ID NO: 9911 - protein, 81 aa, Heterocephalus glaber
RLAPVTFSDLAIYFSQEEWEWLSPTQKELYEEVMLENYRNLVSVGLCLRRPNVITLLEKGKEPWIMEPPRRRWCPDLASKC

SEQ ID NO: 9912 - protein, 81 aa, Mus caroli
VCGSVTFKDVAVDFSQEEWACLDATQKVLYRDMMLETYSNLVAVVGHCISKPDLIVLLEQEKEPWMTVKEETDRPSPDLEA

SEQ ID NO: 9913 - protein, 81 aa, Mus caroli
KPELVSFADVAVYFSPQEWGCLRPAQRALYREVMRETYGLLGALGFPGPKPALISWMEQGSEAWSPAAQDPEEGERLGGAP

SEQ ID NO: 9914 - protein, 81 aa, Cavia porcellus
PKALVTFVDLAVYFSQEEWEWLSPSQKDLYEEVMLENYRNLVSMGLCLRRPNVITLLEKGKEPWMVEPLRRRWALASKSEA

SEQ ID NO: 9915 - protein, 81 aa, Cricetulus griseus
SLGPLSFKDVAVAFTQEEWRQLGSEEKTTYRDVMLENYSNLISVGYHIIKPDVIIKLEQGEEPWIVEGTFSPQSYPDEIWQ

SEQ ID NO: 9916 - protein, 81 aa, Cricetulus griseus
MLSFWDVAIEFSPEERECLEPAQWNLYRDVMLENYSHLDFLGLAVPKPHLVTFLEQKQEPSGVKRQAAATVHPGTTPNDYN

SEQ ID NO: 9917 - protein, 81 aa, Cricetulus griseus
GKQFSFLGLLTFKDVAINFSKEEWEFLNTSQRDLYRDVVLENYSNLVSVGLSKSKPELVTCLEQNKEPWMVTIEEAEGMEP

SEQ ID NO: 9918 - protein, 81 aa, Cricetulus griseus
VSVTFEDVAVLFTRDEWKKLDHSQRSLYREVMLENYSNLASLGFPFTKPEMISVLQQGEEPWKIEKGSHSSSLGCNSSLQT

SEQ ID NO: 9919 - protein, 81 aa, Cricetulus griseus
EKQFSFQSLLTFKDVAIKFSKEEWECLNTSQRDLYRFVMLENYSSLVSVGLSGSKPELVTCLEQNKEPWMVNKEESEVLEE

SEQ ID NO: 9920 - protein, 81 aa, Cricetulus griseus
LSESKPELVTCLEENKEPWMVNIDEAVGLGQDVFCYTIQEMIPKEGTQDTCQREMPGCLGNNSPGELHIRKFSVYTCKGCG

SEQ ID NO: 9921 - protein, 81 aa, Cricetulus griseus
FQDLLTFKDVSVDFSREEWQCLDSSQRALYVDVMLENYNNLVSVENYYICDPVHQHKKTEKKSCQCTEFGKILHDPSTCAL

SEQ ID NO: 9922 - protein, 81 aa, Cricetulus griseus
MIFEDVAVNFTSGEWTLLDSSLKKLFRDLMKETFMNLISIEKTQEENIEEEYQSLGRNLGTQVVEKDSDNEHENQCEENQQ

SEQ ID NO: 9923 - protein, 81 aa, Cricetulus griseus
PAALEAPRDVTVDFPQEEWECLDSAQRALCIDVMLENYNNLVFVGEHILLLEFLTHLLLKRSPVSVMSLAKCLMTPPHVHF

SEQ ID NO: 9924 - protein, 81 aa, Cricetulus griseus
NAVTYDDVHVNFTWDEWALLDPSQKNLYKEVMLDTYKNLIDTAYNCEDNNVEEPDQISTQQGRNNKINNEEESSQYTQCDK

SEQ ID NO: 9925 - protein, 81 aa, Cricetulus griseus
DMLSFWDVAIYFSAEEWECLGPAQWNLYRDVILENYNNLVFLGEEFFHDKFLIIVSMNLATSENIWSCFIKAISGDVSGAK

SEQ ID NO: 9926 - protein, 81 aa, Cricetulus griseus
LSESKPELVTCLEENKEPWMVNIDEAEGLEPALFCPPIQEILPKECTQDTCQREVSGVLRNNITGELHMKKFSVCRDKGCG

SEQ ID NO: 9927 - protein, 81 aa, Cricetulus griseus
QVPISFKDLAVRFSEEEWRLLQEGQREFYRDVMRENYETLVSVGTSELLPLSAFLSPTEPGGATGGERHHDKGQEPPLEHG

SEQ ID NO: 9928 - protein, 81 aa, Cricetulus griseus
TCAAEQRGLEGERRQKLKMQGLVTFSDVTVTFSKEEWECMDSAQWNLYTDVMLANYNNLVFVGENILLLEFLTCLLFVVTS

SEQ ID NO: 9929 - protein, 80 aa, Cricetulus griseus
NAVTYDDVRVNFTPDEWAILDPFQKNLYKEVMLDTYKNLTDIGYNLKDHNIEEPDQISTQHGSLLHHERVHIEEKPCECI

SEQ ID NO: 9930 - protein, 81 aa, Castor canadensis
PKVPVTFDDVAVYFSEQEWGKLEDWQKELYKHVMRGNYETLVSLDYAISKPEVLSQIEQGKEPCTWRRAGPKVPEVPVDPS

SEQ ID NO: 9931 - protein, 81 aa, Peromyscus maniculatus
SKGSLSLKDVTVDFTQEEWQQLDPAQKALYRDVMLENYGHLISVGFHITKPDMIRKLEQGEELWTERMFPSQNYLEDEDVL

SEQ ID NO: 9932 - protein, 81 aa, Peromyscus maniculatus
GEMPLTFQDVAVYFSRAEGQQLGPQERALYRDVMLENYGNVASLGFPVPKPELISQLEQEEELWVLDLLGAEEPEVLRSCQ

SEQ ID NO: 9933 - protein, 81 aa, Peromyscus maniculatus
PQSQLTFRDVAVDLSQEEWECLDCVQRALYMDVMLENYNNLVFVENHCLCDKYEKVLDHGTKHIVYDHVNIQEKPFQCNEL

SEQ ID NO: 9934 - protein, 81 aa, Peromyscus maniculatus
AMNTVTYDDVHVDFTCEEWTLLDPSQKILYKDVMLETYRNLTAIGYSWEDHNVEEHHQSSRRHERHKRSHTREKPSQYTQC

SEQ ID NO: 9935 - protein, 81 aa, Peromyscus maniculatus
SGSQDAVTYEDVHVNFTPEEWALLDSSQKSLYKEVMLETYRNLTSIGYKWEDLNIEEHCQSSRRLKRYIIGHSRYKPCDRE

SEQ ID NO: 9936 - protein, 81 aa, Peromyscus maniculatus
TKGLLTFWDVAVDFSQEEWECLDSAQRTLYIDVMLENYSNLVYVENYCICDPVHQHVNNEKESCQCNELDKVLHDPSTCAL

SEQ ID NO: 9937 - protein, 81 aa, Mesocricetus auratus
PQGLLSLRDVSVDFSQEEWECLDCEQRALYMDVMLENYNNLLFVEFHRLGCKWETVLHQGTKHFVHDRENIQEKSHTCNES

SEQ ID NO: 9938 - protein, 81 aa, Mesocricetus auratus
MLENYSNLLFLGHCKTKPELIFNLEQRLGSWIVGEASNQSIPEFQGMNTLSKICSETKTRNVWQVAVDSDTSKELTGIGKA

SEQ ID NO: 9939 - protein, 81 aa, Mesocricetus auratus
HMGLLTFQDVAVDFTQEEWECLDSAQRTLYIDVMLENYSNLVSLGIISCKADLVPCLEQIQMACNVKKEEMVARPALIVLI

SEQ ID NO: 9940 - protein, 81 aa, Mesocricetus auratus
MLENYSSLMFLGYCMTKPELIFKLEHEFEPWTIVEASIQSLPGVHKVSTPIENHQEYHKGLLWQVEITNSQTSNEEIVEAE

SEQ ID NO: 9941 - protein, 81 aa, Mesocricetus auratus
TQVSYSPAAVGSLSEEEERECLNSAQWNLYREVTLENYSNLVFLGLSFSKPLLVRFLEKNPELQNVHPGKKPYKCKECGKA

SEQ ID NO: 9942 - protein, 81 aa, Mesocricetus auratus
ARVAVMFSDVSIAFSQEEWEYLDLAQRDLYKDVMMENYRNVASLGCFISKPDVISLLEQGKEPWKVVRKRRRNPDLETKDK

SEQ ID NO: 9943 - protein, 81 aa, Mesocricetus auratus
QVPISFKDLAVRFSEEEWRLLQEGQREFYRDVMRENYETLVSVGTSELLPLSAFLSPTEPGGATAGESHHDKGQEPPLERG

SEQ ID NO: 9944 - protein, 81 aa, Heterocephalus glaber
SQKLLNFKDISVDFNQEEWGQLAPAHRNLYREVMLENYRNLVSVGYHFSKPSVISQLEKGEEPWMTEKEDLGDPSTDLKSK

SEQ ID NO: 9945 - protein, 81 aa, Heterocephalus glaber
LQQATERWTGVPNYNSIQQGRMAMSQESLSFRDVFVDFTLEEWQQLDSVQKNLYRDVMLENYSHLVSVGYLVGQPDAISLG

SEQ ID NO: 9946 - protein, 81 aa, Mus caroli
GETPLTFQDVAVYFSRAEGQQLSPQERALYRDVMLENYGNVASLGFPGPKPELISQLEQEEELWVLDLLGAEEPEVLRRCQ

SEQ ID NO: 9947 - protein, 81 aa, Mus musculus
YVELVSFEDVTVKFTWEEWQNLNDAQKMLYRSVMLETYNSLLSLGQCIPKPELIFKLEQGEEPWTAEEPANKTLPVFCSVD

SEQ ID NO: 9948 - protein, 81 aa, Cavia porcellus
PKVPISFEDVSVYFTKAEWKFLDFKQKALYKQVMLDNYRNLASLGLACSKPHLVAQLERGEGPWAGGRLQSPGAARRNPRQ

SEQ ID NO: 9949 - protein, 81 aa, Cavia porcellus
LRDLVTFEDVAVDFTQEEWALLDASQRSLYREVMLENCRNLASLGCHVDKPSLISQLEQEDQAMTEERGNLPGTCPDLETV

SEQ ID NO: 9950 - protein, 81 aa, Cricetulus griseus
DLVSFEDVTVNFTWEEWQNLDDAQRVLYRNVMLETYSSLASLGLCIPKPELIFKLEQGAEPWTAEESANQRLPGFCNVDGT

SEQ ID NO: 9951 - protein, 81 aa, Cricetulus griseus
YQEFVTFEDVAVHLTREEWGCLDPLQRELYREVMLENYGNVVSLGFPVSMPDGISQREQDLQVFDLETKNREVIRDDCSDG

SEQ ID NO: 9952 - protein, 81 aa, Cricetulus griseus
CQVPVTFRDVAMYFCREEWECLSPSQRTLYREVMLENFRNFIELGYCGPRPDLISHLEQWDEPWVEDQDIPKFLEARKGVC

SEQ ID NO: 9953 - protein, 81 aa, Cricetulus griseus
MHVNFTWEECTLLDSSQKNLYKDVMLETDDQIINWLLEFRSSVMYLTKDFEQLINIILRLPWLKRSQTVVEEYLAFLGNLV

SEQ ID NO: 9954 - protein, 81 aa, Cricetulus griseus
QDAVTYEDVHVNLTHEEWALLDPSQKNLYKDVMLEIYWNLISVGYKWEDHNIEEYCQSSRRHGRYIIFRDTKVASTQEDLY

SEQ ID NO: 9955 - protein, 81 aa, Cricetulus griseus
IPVYKPAVISLLEQGKDPWMVHKEGSSDASPDWDYVFKGIELSSKQDICEESAKVLRTERSHLSYSPDCANLEEDRAIEDW

SEQ ID NO: 9956 - protein, 81 aa, Castor canadensis
GSVSFTDVTVDFTQEEWEQLDPSQRILYMDVMLENYSNLLSVEVWKADDQMESDHRNPDEQARQFVILKNQTPVEERGNLF

SEQ ID NO: 9957 - protein, 81 aa, Castor canadensis
YQEFVTFEDVAVHLTREEWGCLDPVQRDLYREVMLENYGNVVSLGFPVPKRDGLSQLEQDLQAFDLETKNRQVLNNDCPDG

SEQ ID NO: 9958 - protein, 81 aa, Peromyscus maniculatus
RPRALKFADVAVYFSPEEWGCLRPAQRLLYREVMRETYGLLGALGCAGPTPALISWLERNTDDWEPAALDPQEYRRWATFQ

SEQ ID NO: 9959 - protein, 81 aa, Peromyscus maniculatus
FQESVTFQDIAVDFTEKEWPLLDSSQRKLYKDVMLENYSNLTSLGYQVGKPNLISHLEQEEELRMEERDIQWGTSPDWGTS

SEQ ID NO: 9960 - protein, 81 aa, Peromyscus maniculatus
MEEMLSFWDVAIDFSPEERECLEPAQWNLYRDVMLENYSNLVFLGLIVSKPHLVTFLEQRQEPSYVQRQAAANVHPGTTPN

SEQ ID NO: 9961 - protein, 81 aa, Peromyscus maniculatus
GETGKVPVTFDDITLYLLQEEWMTPNQPQKDFFASNKLTAPLGPTAANPELFHEFGQGTEPWLGNIQGQRRLLNHHPGKTH

SEQ ID NO: 9962 - protein, 81 aa, Peromyscus maniculatus
CQVPVTFRDVAVYFCREEWDCLSPSQRTLYRDVMLENFRNFIELGYCGPRPDLISHLDQWDEPWVEDWDRPEFLEAQKGVC

SEQ ID NO: 9963 - protein, 81 aa, Peromyscus maniculatus
ARVSVMFSDVSIAFSREEWEYLDLSQRDLYKDVMMENYRNVASLGYFISKPDVISLLEQGKEPWKVVRRRRRNPDLETKDE

SEQ ID NO: 9964 - protein, 81 aa, Peromyscus maniculatus
MLTFRDVTVDFSQEEWECLDSAQRSLYIDVMLENYNNLVFVENDCICDPAHQHVNNEKESCQCNELGKVLHDPSTCALYRT

SEQ ID NO: 9965 - protein, 81 aa, Peromyscus maniculatus
MDAVTYEDVHVNFTHEEWALLDPSQKRLYKDVMQETYWNLTIIGYKWEDTNIKEHGQSSRRHGRYIICHSGYKPCEHTGCG

SEQ ID NO: 9966 - protein, 81 aa, Peromyscus maniculatus
TVNAVTYNDVHVNISQEEWALMDPSQRNLYKDVMLETYMNLTAIGYNWEDVEVEEYCQISQKHGRHERSHTKEKSYGYIEC

SEQ ID NO: 9967 - protein, 81 aa, Peromyscus maniculatus
ETLLSFRDVTVDLSKEEWECLDCAQRALYIDVMLENYNNLVFVGNHCICYKYEKVLDERSKHTVHQHVCTQAKPCNESGKT

SEQ ID NO: 9968 - protein, 81 aa, Peromyscus maniculatus
DAVIYNDVHVDFTWEEWTLLDPSQKNLYKDVMLETYRNLTTIGYNWEDHNTEEHCHNIEEHCQSSRRHERHERSQAEEKPS

SEQ ID NO: 9969 - protein, 81 aa, Peromyscus maniculatus
FKELVVFRDVAVEFCREEWECLDPRQRSLYRDVMLETYGNFVSLGLAISKPSVISLLEQGKEPWMVEQAGWYPDLLSVNET

SEQ ID NO: 9970 - protein, 81 aa, Peromyscus maniculatus
SQLPENFEDMAMYISQEWGHQDPSKRALSRDMVQDSYENVGTLESCIPGQEVLSTQAEQEGKPWDPSVPSYKGDGSPREPV

SEQ ID NO: 9971 - protein, 81 aa, Peromyscus maniculatus
KCLLTFRDVAVDLSKEEWECLDCAQRALYMDVMLENYNNLVFVGQNQRVQKEHKNTELDKSFDCQHKLTLKGTNSGKKAYQ

SEQ ID NO: 9972 - protein, 81 aa, Mesocricetus auratus
ARVAVMFSDVSIAFSQEEWEYLDLAQRDLYKDVMMENYRNVASLAGCFISKPDVISLLEQGKEPWKVVRKRRRNPDLETKD

SEQ ID NO: 9973 - protein, 81 aa, Ictidomys tridecemlineatus
MARCFISKPDVISLLEQGKDPWKIMKKGKRQYSDLETRCETKKLSSENDIYEINLSQWKLMERIKNHGLKGLILKNDWESK

SEQ ID NO: 9974 - protein, 81 aa, Ictidomys tridecemlineatus
YQNLVTFEDVAVDFTQEEWILLDQMHRDLYRDVMLENYQNLASVGCEPIKPSLIYWLEQEEDLWTVQSGDLQEWKMLLNTK

SEQ ID NO: 9975 - protein, 81 aa, Ictidomys tridecemlineatus
AQDCVTFEDVAIYFSQEEWRLLDEAQRLLYLGVMLQNFVLASSLGCGHGTEDEEILSEQKVSVAVSQVRTSKAGSSMQKTY

SEQ ID NO: 9976 - protein, 81 aa, Ictidomys tridecemlineatus
LQDLVTFKDVAVEFSQEEWALLDPSQRTLYRDVMLENCRNLASLGCHVDKHSLISQLEQEDKTVTEERGILPSTCPERSHR

SEQ ID NO: 9977 - protein, 81 aa, Ictidomys tridecemlineatus
EDVAVNFTQEEWALLDPSQKNLYRDVMQEVLRNLASIDKWEDHNVEDQNTYPGINLRPIISHSANKLYENEEYGGKLHERK

SEQ ID NO: 9978 - protein, 81 aa, Marmota monax
SQELVTFEDVAVYFIRKEWKRLEPAQRDLYREVMLENYGNVFSLDGESRTKNDQEISEDTGSRGVLLRRFQKDISQGLKFE

SEQ ID NO: 9979 - protein, 81 aa, Marmota monax
SQGLVTFKDVALDFSQEEWEWLDPSQKDLYREVMFENYRNLVWLGLSISKPNMISLLEQGKEPWMVERKMSHDQCADWESW

SEQ ID NO: 9980 - protein, 81 aa, Marmota monax
LQCPVSFEDVSVDFTWEEWKALDDSQRNLYKDVMLETCSSLVSLGHSIIKPERIFKLDRGSGPWMAKEAPHQHLPDVHKVN

SEQ ID NO: 9981 - protein, 81 aa, Marmota monax
TLGLLSFNDVSLEFSWEEWQLLDSAQRYLYREVILENYSNLLSVGYHGTKPDLIFRLEQGEEPWILNAKMSTQNCPEVWED

SEQ ID NO: 9982 - protein, 81 aa, Marmota monax
MLENYSNLVSLGYSASKPEVITLLEQGKEPFIVIGDVQGRRCAGLFSRYKTKKLPSGKDADEASSSKSETTERRKTVGLKG

SEQ ID NO: 9983 - protein, 81 aa, Marmota monax
ELLTFMDIAIDFTEEEWECLQPGQKNLYRDVMLENYRNFAFLAMTPNHTQVYSPEKGLKHIFHEVISAKYRSCDLEYLPKK

SEQ ID NO: 9984 - protein, 81 aa, Marmota monax
MVSFEDVSVDFTWEEWQDLDDAQRILYRDVMLETYRSLVSLGHCVAKPEVIFKLEQGAGPWTVGEAPHQCLPDVQKVNGLN

SEQ ID NO: 9985 - protein, 81 aa, Heterocephalus glaber
PKVPVTFSDVAVYFSEQEWGELEDWQKELYKHVMRGNYETLVSLDYAISKPDILAQMERGEEPCPCPTAPWSQDKGSREAA

SEQ ID NO: 9986 - protein, 81 aa, Heterocephalus glaber
DVAIEFSQEEWKGLDPAQRTLYRDVMLENYRNLVSLVSSNQRNPSSIKNNISHEYENDFLQSPFFTQEQVMHISTKLYKRN

SEQ ID NO: 9987 - protein, 81 aa, Heterocephalus glaber
MEEWALLDPSQKELHRDVMWENFRNVAAVGRNWDNQQQIEDEHQNYRKNLRSAEVDKCCQYKLWYQCGEIVFMTPDTNVHM

SEQ ID NO: 9988 - protein, 81 aa, Mus caroli
PQDLLTFRNVAVDFSEEEWEYLNSSQRALYMDVMWENYSNLVFVENHCICGKYEEDMDQSSNHIIYQHANIEEKSYKYHEL

SEQ ID NO: 9989 - protein, 81 aa, Mus caroli
VCGSVTFKDVAVDFSQEEWACLDATQKVLYRDMMLETYSNLVAVVGSCISKPDLIVLLEQEKEPWMAVKEETDRPSPDLKT

SEQ ID NO: 9990 - protein, 81 aa, Mus caroli
KPGAVSFADVAVYFSPEEWRCLRLAQRALYRKVMRETYGLLASLEVGGDKPALICWVEEESEVWGPCAQEPEVAMCKTEVH

SEQ ID NO: 9991 - protein, 81 aa, Heterocephalus glaber
PKVPVTFDDVAVHFSEQAEWGNLSEWQKELYKNVMRGNYESLVSMDYAISKPDLMSQMERGERPAMQEQEDSEEGETPTDP

SEQ ID NO: 9992 - protein, 81 aa, Mus caroli
KPGAVSFADVAVYFSPEEWRCLRPAQRALYREKSDAPNQRSSAGWRKSPKCGDPVPRIQRWPCARQNSTQIAGPRREGRDQ

SEQ ID NO: 9993 - protein, 81 aa, Mus musculus
PQGLLTFKDVALDFSLEEWECLSFAQRSLYMDVMLENYNNLLFVENHCIRGKNGKVLDQDSQYIVHEHMNIQEKSSKWDKL

SEQ ID NO: 9994 - protein, 81 aa, Mus musculus
SKHLLTFRDVAVDFSQKEWECLDSAQRALYIDVMVENYSNLVFVEKYSVRDTVHQHVRTEKESRQCNELGEMLHEPTNCAP

SEQ ID NO: 9995 - protein, 81 aa, Mus musculus
SQEQVSFKDVCVDFTKEEWYLLDPAQKVLYRDVILENYSNFVSVGHCVTKPDVIFKIEQGEDPWIPENGFQCHPERKWKVD

SEQ ID NO: 9996 - protein, 81 aa, Mus musculus
SQGALTFMDVAIEFSKEEWECLNSAQRALYRDVMLENYNNLVSVGVAVSKREVIICLEQNKEPWIVDAEETQLCLVNILRI

SEQ ID NO: 9997 - protein, 81 aa, Mus musculus
MEAVTFGDVAVHFSREEWQCLDSGQRALYKEVMLENHSSVAGLAGFLVFKPELISRLEQGQEPWVLDLQGAEGTEAPRICQ

SEQ ID NO: 9998 - protein, 81 aa, Mus musculus
KKGLATEFLTSLLEELVSFEDVTVQFTQEEWALLDPLQRTLYRNVTLENWKNLASLGSLLIIPHISFHDLIPWILRRQAAP

SEQ ID NO: 9999 - protein, 81 aa, Cricetulus griseus
EMGLVSFEDIAVEFTWQEWQDLNEGQRTLYRDVMLENYSNLLFLGHCKTKPELIFNLEQRLGSWIVGEASDQSIPEFQGMN

SEQ ID NO: 10000 - protein, 81 aa, Cricetulus griseus
MAFEDVAVYFSQEEWVFLDAAQRALYRHVMLENFALVDSIGLSISRPRVIIQLQRGEEPWVSNRTNTGPGRGTRRRPSLGS

SEQ ID NO: 10001 - protein, 81 aa, Cricetulus griseus
AQGSVTFRDVAVDFSKDEWDFLDSAQKSLYRDVMRENYSHFISLDLESRFKTNTSSADKDIYEVYSLQWELMEKIRSHSPQ

SEQ ID NO: 10002 - protein, 81 aa, Cricetulus griseus
MVLVSFEDIAVDFTWEEWQDLDAAQRTLYRDVMLENYSSLVSLGHCMTKPELIFNLERGLGPWSTADASVWNLSGVNKMSS

SEQ ID NO: 10003 - protein, 81 aa, Cricetulus griseus
FRGLLSFKDVSVELSCEEWQLLDSAQQHLYREVILENYSNLLSVGYLGSKPDLIFKLEQGKEPWIINAKISTQICPEDWKE

SEQ ID NO: 10004 - protein, 81 aa, Cricetulus griseus
AAAGERAGLAPVPVADEEWRHLVPVQRALYKTVMLETYETIISLGPEKKVHLTFLFVADQETKPESLAASEGTLGESHRQQ

SEQ ID NO: 10005 - protein, 81 aa, Cricetulus griseus
LINAVTYNDVHINFTQEEWALLDPSQKSLYKDVMLETYRNLTAIGYSCEDHNIEEHCQSSTRHRRYERRHSREKPSEYSQC

SEQ ID NO: 10006 - protein, 81 aa, Cricetulus griseus
PQGLLTFWDVAVDLSQEEWECLDSAQRTLYVDVMLENYSNLVFVEDLKQTHSVSVTAASVSVSPYDLYLVDVCGSCSLGVL

SEQ ID NO: 10007 - protein, 81 aa, Cricetulus griseus
IQGVLTFSDVAVDFSQEEWECLDSGQRALYIDVTLENCSNLLSVENYRKCNPVHQHVKTEKESCQCNELGKVLHDPSTCAL

SEQ ID NO: 10008 - protein, 81 aa, Cricetulus griseus
QFSFQNLLTFEDVAIIFSKEEWECLNTSERYLYRGVMLENYSNLVSVGLSVSKPELVTCLEQYKEPWMVNIEESEVLEPVG

SEQ ID NO: 10009 - protein, 81 aa, Cricetulus griseus
MADSPVTMSQEWECLDSAQRTLYINVMLENYNNVVSVENYYIQDPVHQQGKTEMESCQCNQFGKILHDPSTCALYRISEIT

SEQ ID NO: 10010 - protein, 81 aa, Peromyscus maniculatus
MNAVTYDDVHVGFIWEEWALLDPSQKNLYKDVMIETYRNLTTIGYSWEDNNIEEHCQSSRRHGRHERNHTGVKSCGYTQSG

SEQ ID NO: 10011 - protein, 81 aa, Mesocricetus auratus
GLLTFMDVAVYFPQEEWECLDSAQRALCIDVMLENYSNLVFVENYCRCDLVHHHVNTEKESCQCSQLDKVFHDPSTCALHR

SEQ ID NO: 10012 - protein, 81 aa, Mesocricetus auratus
APLPLTFEDVAVYFSEQEWQYLEAWQKELYKQVMRANYETLVSLDNGLPKPELISWLELRRELFGTLGEEQKLGKGVRSSI

SEQ ID NO: 10013 - protein, 81 aa, Mesocricetus auratus
PKVPVAFDDVSIYFSTPEWEKLEEWQKELYKNIMKGNYESLVSMDYAMSQPDVLSQIQPEGEHSADDQPRPEASEIPADAS

SEQ ID NO: 10014 - protein, 81 aa, Mesocricetus auratus
GVSSSAVAGTAARRPWNLPGLTDHPDLLTCAAEQRVLEGERRQTLRMQVLMTFRDVTVNFSKEEWECLDSAQRTLYFQVHL

SEQ ID NO: 10015 - protein, 81 aa, Mesocricetus auratus
IVVHMAFRDVAVDFSQEEWSLLSPAQRSLYREVMLENYSNLVSLGIPFSKPTLITQLEQSKETWPEERKCPQVACQGEWER

SEQ ID NO: 10016 - protein, 81 aa, Mesocricetus auratus
FKGPVTLRDVTVEFTKAEWELLTPAQKSLYKNVMLENYRHLLAVGYRVVKRSVISKLKQGKEPWVSERELPNQRRDDKQQN

SEQ ID NO: 10017 - protein, 81 aa, Mesocricetus auratus
RVTFGDVLVDFSWEEWELLDEPQRLLYLNVMLENFSLVATLGCWCGADSKEAPCEESVSTEAVPQAGTAEPSLGMPTAHPC

SEQ ID NO: 10018 - protein, 81 aa, Mesocricetus auratus
SETGNAVTYDDVHISFTSKEWALLDPSQKSLYKDVMLEIYSHLTAIGYKWEAHDSEDHGQRFRRQRRHKRSHTEVKTYKCS

SEQ ID NO: 10019 - protein, 81 aa, Mesocricetus auratus
MTKGLDFKDVVIYFSREEWECLHRSHRSLYQDVMLENYSNLLSLGLADTKPRVISLLEQGKEPWMVMRNETKEWLPDWVSG

SEQ ID NO: 10020 - protein, 81 aa, Mesocricetus auratus
MDVTIDFGREEWQHLDPDQRSLYRDVMQETYSHLHSVELQQIGDQKETYQQIGNKSGSDVIFIKKTLDTKGHHGCKVIRKI

SEQ ID NO: 10021 - protein, 81 aa, Mesocricetus auratus
YKEPVIFKDVAVHFSQKEWQLLDPAQKDLYRDVMLENYGNLIFVECYIFKPRLITRLEQGIDIFAKGNHVHRDRRRGEARV

SEQ ID NO: 10022 - protein, 81 aa, Mesocricetus auratus
SQGLLTFKDVSVDFSQEEWQSLHSAQRALYIDVMLENYNNLVSVENYYMCDPVHQHGKTEQESCQCNQFGKILHDPSTCAL

SEQ ID NO: 10023 - protein, 81 aa, Mesocricetus auratus
FRGLLSFKDVSVELSCEEWQLLDSAQQHLYREVTLENYSNLLSVGYLGSKPDLIFKLEQGKEPWIINAKMSTQSCPEDWKE

SEQ ID NO: 10024 - protein, 81 aa, Mesocricetus auratus
PISFKDLAVRFSEEEWRLLQEGQREFYRDVMRENYETLVSVEPGGATAGESHHDKGQEPPLERGSQGGQPQQSLHLTALVQ

SEQ ID NO: 10025 - protein, 81 aa, Mesocricetus auratus
SQEQVSFKDVCVDFTKEEWYLLDPAQKVLYRDVILENYSNFVSVGYCVTKPDVIFKIEQGEDPWIPENGFQCHPERKWKAD

SEQ ID NO: 10026 - protein, 81 aa, Mesocricetus auratus
SVTFEDVAVNFTLEEWAMLDPFQKDLYKDVMQETLRNLASIGNNWEHQNIEHEYENLWRKLSQLLERLCEYTEGRQCAEIF

SEQ ID NO: 10027 - protein, 81 aa, Ictidomys tridecemlineatus
LTGLVTFEDVAVYFSLEEWERLDADQRSLYQEVMQENYGILVSLGYPIPKPDLIFHLEQGEEPWVPDSPHPEEGDIVTGVY

SEQ ID NO: 10028 - protein, 81 aa, Ictidomys tridecemlineatus
SQEQVSFKDVCVDFTKEEWSLLGPAQKILYRDVILENYSNLVSVGYCVTKPEVIFKIEQGEEPWILEKEFPSQCHSERKWK

SEQ ID NO: 10029 - protein, 81 aa, Ictidomys tridecemlineatus
AQGQVNFEDVFLYFSQAEWELLDEAQRHLYRDVMLENFALMASLGHASSMFHRVASLELGSEPWQPDWVDIIPAIAREILG

SEQ ID NO: 10030 - protein, 81 aa, Marmota monax
ETATNEDLSVDCTQKKWKGPAVRQRALYRNTILENYSIMNSLAGENRMESSEFTPKQTISKGSESSDRSPGGLFGVTSMGP

SEQ ID NO: 10031 - protein, 81 aa, Heterocephalus glaber
VSVSFTDVTVDFTQEEWEQLDPSQRILYMDVMLENYSNLLSVEVWKADDQMEREHRNPDEQARQFTVLKNQTPFEERGNLF

SEQ ID NO: 10032 - protein, 81 aa, Heterocephalus glaber
SQRAVSFEDVTVDFSREEWQHLDLAQKSLYRDVMLENYFNLISVGCQVPNLEVIFSWEPGEEPCSLGSENSSQSYPSGNTG

SEQ ID NO: 10033 - protein, 81 aa, Heterocephalus glaber
QGSVTFDDVAIHFSWDEWHLLDEAQRCLYHDVMMENLALITSLDTHQHEKLQFGQKCFRSNGGRFLFVNRSKFHVSWEHFT

SEQ ID NO: 10034 - protein, 81 aa, Mus caroli
AVTFRDVAVVFSEEELGLLDAAQRKLYHDVMLENFRNLLAVGGQSPNKMEIVDATGLRCLSLGKLLCWGITSHNINKLARA

SEQ ID NO: 10035 - protein, 81 aa, Mus caroli
DALTYDDVYVNFTQEEWALLNPSQKSLYKDVMLETYRNLNAVGYNWEEHNIEEHCQSSRRHGSECGKAFTCANYLCRNDRS

SEQ ID NO: 10036 - protein, 81 aa, Mus caroli
PQGQLTFKDVAVDFSQEEWECLDCAQRALYMEVMLENYNNLFFVENHCMYPKFVNMLDQELQHIVHEHVNIQVKSYECHEL

SEQ ID NO: 10037 - protein, 81 aa, Mus caroli
SQGLLAFKDVAVEFSQEEWGCLDSAQRALYINVMLENYNNLVSVENYCIRDTVEQHVNTEKESCQYNELGKILHEHFKCTL

SEQ ID NO: 10038 - protein, 81 aa, Mus caroli
MEDMLSFWDVVIYFSAEEWEYLGPAQWKLYRDVTLENYNNFVFLDLVSSTPYLVRFLEQIQEPSDVKSQADISMYSGGKCY

SEQ ID NO: 10039 - protein, 81 aa, Mus caroli
LKVTVTFRDMAVYFCKGKWGCLSPSQGTFHHDVMLENVRNLNVLGCCGRRPGLISRLEQWDELWVEDWDKSEFLEGQKSVC

SEQ ID NO: 10040 - protein, 81 aa, Mus caroli
MEPVTFEDVAVNFSLGEWALLDSSQKKLYRDVMTETFMNLISIGKTEEKENIEDNYQNLRKNVRTLVVERSCDYGDVSQCG

SEQ ID NO: 10041 - protein, 81 aa, Mus caroli
MANAVTYEDVHVNFTQEEWALLDPSQKKLYKDVMLETYRNLNAIGFNLKDKNTEEHWQRSRRQRYERSQSAEKSSEYTQPG

SEQ ID NO: 10042 - protein, 81 aa, Neotoma lepida
EGCVTFKDVAIYFSEEEWTLLDDSQRLLYQRAMMEIFVIMTSLGKGIPSCQNMSLMGLASFLQRDVFSQSYTMFSESFPIV

SEQ ID NO: 10043 - protein, 81 aa, Mus musculus
MLENYRNLVSVAGYQLSKPTVISQLEKGEGPCMAESQGPEDPILDVKNKLETKESTAEDDISVKLDHGITRGRLIEDDIVC

SEQ ID NO: 10044 - protein, 81 aa, Mus musculus
TVRSQEAMTFKDVAMDFTPEEWGKLDPAHRAVMLENYRNLVSLWLPISKPDNYNSEDGKELSKLEKSPKCSDSAIRLHIHP

SEQ ID NO: 10045 - protein, 81 aa, Mus musculus
IQSDLCLLCARLKGMCHHYPEPVTFEDVAVNFTLGEWTMLDSSQKKLYRDVMKETFLNLISIGKTEEEDTEEEYQNPKGNL

SEQ ID NO: 10046 - protein, 81 aa, Mus musculus
MTKLQEAVTFRDVAVVFSEEELGLLDAAQRKLYHDVMLENFRNLLAVGGQSPGKTTHLHTTGLRFLSLGRLPCWQVTSHDA

SEQ ID NO: 10047 - protein, 81 aa, Mus musculus
CLTFEDVAVNFTLEEWDLLDPSQKQLYTDVMQETFKNLIAIGQIEEVQRSKDVDEDSRRNLRRGLVELLYKPSEGRQCDGI

SEQ ID NO: 10048 - protein, 81 aa, Cavia porcellus
GCSITKPHVITLLEQGKEPWMLMQDEKRWSLDLGSRCDTKKLFEEKDFYEINLSQWEIMERVRSCGFEDSFFRKDCEYKMF

SEQ ID NO: 10049 - protein, 81 aa, Cricetulus griseus
NDLLIFKDVAVDLSQEEWECLDCAQKELYMDVMLENYTNLVFVENHFMCDKYEKVSDQDMKNVLYELVNIQEKSYKCNVFG

SEQ ID NO: 10050 - protein, 81 aa, Cricetulus griseus
DSVTFEDVAISFTVEEWALLDPSQKKLHRDVMEETFRNLAAIGRTQDDQHIDNDHRYSRRNQRNEVVERLLERNKSSECKE

SEQ ID NO: 10051 - protein, 81 aa, Cricetulus griseus
MLENYSNLLSVGLPIPKPQVISLLEQGKEPWMIGKELTRGLCSALESMCESKLLSLKKEVYEIESCQRELMGLKKHGLEYP

SEQ ID NO: 10052 - protein, 81 aa, Cricetulus griseus
LIRWQVLQLNNLAYGANKVSNNHHNVSKDHKTVNQFLFQSLLTFKDVALNFLREEWECLNTSQRNLYRDVMLENYGNLVSV

SEQ ID NO: 10053 - protein, 81 aa, Cricetulus griseus
GNQFCFQSLLTFKDVAINFSKEEWECLHTSQKALYRDVILENYSNLVSVGLSESKPELVTCLEENKEPWMVNIDEAEGLGQ

SEQ ID NO: 10054 - protein, 81 aa, Cricetulus griseus
EFVTFEDVAIFFSKEEWRLLAEAQRQLYLRVMLENFALVTSLEDGKDVLAVLNIIPPQALPIGEQPNLITECGERFQTSKG

SEQ ID NO: 10055 - protein, 81 aa, Cricetulus griseus
GNQFSFQSLLTFKDVAINFSKEEWECLHTSQRNLYRDVMLENYSNLVSVGLSESKPELVTCLEQNKEPWMVNIDEAEGLGQ

SEQ ID NO: 10056 - protein, 81 aa, Cricetulus griseus
YQDSLTFDDVAVDFTQEEWVIMDQTQRDLYREVMLENYQNLFSAGCEVSKPSLISWLEEEDLETLQTEDWELQDTLREQSF

SEQ ID NO: 10057 - protein, 81 aa, Cricetulus griseus
EKQFSFQSLLTFEDVAINFSKEEWECLNTSQRDLYRFVMLENYSNLVSVGLSVSKPELVTCLEQNKEPWMVNIKDSEVLEP

SEQ ID NO: 10058 - protein, 81 aa, Peromyscus maniculatus
VCGSVTFRDVAVDFSQEEWACLDATQRVLYRDMMLETYSNLVTVDLESCYNTENISPENHTYDINLPTQSIKQLSKNFDLQ

SEQ ID NO: 10059 - protein, 81 aa, Peromyscus maniculatus
MLENFRNFIELGYCGPRPDLISHLDQWDEPWVEDWDRPEFLEAQKGVCPGGRQSTDRKRARILASAHERTHPRTGAKRGAT

SEQ ID NO: 10060 - protein, 81 aa, Peromyscus maniculatus
SATTAVTYDDVHIDFTWEEWILLDPSQKNLYKNVMLETYRNLTAIGYSWEDYNIEEHYQSSEGHARFKKCHTGTKPCEYIQ

SEQ ID NO: 10061 - protein, 81 aa, Mesocricetus auratus
MEDILSFWDVVIYFSAEEWECLGPAQWKLYRDVMLENYNNLVFLGLASYKPYLVTFLEQRQGPSDVKRQTAAVMQAGKTCY

SEQ ID NO: 10062 - protein, 81 aa, Ictidomys tridecemlineatus
GWVPALFDEVAIYFSDEEWEVLTEQQKALYREVMRMNYETVLSLEFPFPKPDMITRLEGEEECGNSDEWQLQRGTSTENEE

SEQ ID NO: 10063 - protein, 81 aa, Heterocephalus glaber
MLDCDQRMMYWDVMLDNYRNLISVGSPVTKPKVILKVEQGQDPWLAEEENLHGSYPEADCLLDEPEKHQESKDNFLKSVLF

SEQ ID NO: 10064 - protein, 81 aa, Heterocephalus glaber
MLENYSNLVSAGILFAKPKVISQLEQTGDPQMEGTGTPPGMCLGWESLFEATISKEENQEAMKKFLVDHPLDFSLGKTYID

SEQ ID NO: 10065 - protein, 81 aa, Heterocephalus glaber
MLENYSHLVSLGYPITKPDLIASLEQGVLGIIKREIPSSSCSEDGQAEDQLERHQENQNRYLKQAIPIDEKYVAKEGGREC

SEQ ID NO: 10066 - protein, 81 aa, Heterocephalus glaber
MLENYRNLVALGHQVYKPAVITQLEQEELWTRGGGHPVGAPLGDQSHRMSVPRSSVHAKWIVGKVIGTAMQKTAKVRVTRL

SEQ ID NO: 10067 - protein, 81 aa, Heterocephalus glaber
MEEWALLDPSQKKLHRDVMWENFTNVTAIGRNWDNQQQIEDKYQNFRKTLSSPNYDKIQERNDSRVNTYTYIKWGKSLNSH

SEQ ID NO: 10068 - protein, 81 aa, Heterocephalus glaber
QMPVTFEDVALYLSREEWGRLDHTQQNFYRDVLQKKNGLALGFPFSRPFWAPQVPGKVETSSSSRQTGAEEESDAGSGAVE

SEQ ID NO: 10069 - protein, 81 aa, Heterocephalus glaber
MRPSDALAITSYPEHARFSLPRLRRLRLLRYCIAKPEVIFKIEQGEEPWILEKGFPNHYNPERKWKADDLLESSQENQGEH

SEQ ID NO: 10070 - protein, 81 aa, Mus caroli
VTFRDVAVVFSEEELGLLDAAQRKLYHDVMLENFRMLLSVGGQSPGKTTNLHTTGLRFLSLGGRLPCWQVTSHDANKLAGA

SEQ ID NO: 10071 - protein, 81 aa, Mus caroli
VCGSVTFRDVAVDFSQEEWACLDATQKVLYRDMMLKTYSNLVAVVGSCISKPDLIVLLEQEKEPWMTVKEETDRPSPDLEA

SEQ ID NO: 10072 - protein, 81 aa, Mus caroli
MNGMTYDDVHVNFTGEEWALLSPSQKRLYKDVMLETYRNLTAIGYSWEDRNIEEHFQRSRRHGRHERSHTGENPSVYTQCN

SEQ ID NO: 10073 - protein, 81 aa, Mus caroli
VAFDDVAINFTQEEWALLNPSQKNLYRDVMEEVFRNLTSIEKGWEDQNVEDEDKNPQTNLRHIIANSGYNLYESEESSEKP

SEQ ID NO: 10074 - protein, 81 aa, Mus caroli
LQEMVTFRDVAVVFSEEELGLLDAAQWKLYQEVMLENFRMLLSVAHQPFTPGLIAQLESREQLWMVEAEAHAGGLSGHAVE

SEQ ID NO: 10075 - protein, 81 aa, Mus caroli
MEEMLSFWDVAIDFSPEEWECLEPAQWDLYRDVMLENFSHLVFLGLAVSKPFLVTFLEQRQGPWDMKRQAAATVYPGIIPN

SEQ ID NO: 10076 - protein, 81 aa, Mus caroli
CERLVSFEDVTVDFSQEEWRHLDSAQRRLYQDVMLEIYSHLLAVGYLVPSPGAIFRIKKRKEARTGEAKLPHPCWCQEVES

SEQ ID NO: 10077 - protein, 81 aa, Mus caroli
MDALTYDDVHVNFTREEWALLNPTQRNLYKDVMLEIYRNLKAVGYDWEDQNTEEHCQSSRRHGSYTLYHNGYKSCEYRDIE

SEQ ID NO: 10078 - protein, 81 aa, Neotoma lepida
LWKFRDVSADYFQEEWECMESYWRDLCIDVMFENYSNLKYHIWGKYMNILNQESKYIIYHPVNIQKKSHKFNDTGKMAPKF

SEQ ID NO: 10079 - protein, 81 aa, Neotoma lepida
IPFSKPKLITQLEQGKETWQEERKCPQVACPAHAKLELCPGPVCPPDLTNQKFPVQHVLSDRSPRIFTSLCAKSHVDSGDF

SEQ ID NO: 10080 - protein, 81 aa, Mus musculus
MLENYQNLATVGGQMFKPSLISWLEKKVELTVIEQGILQEWEMHLKTKRTALQQDRFWSDMSNGMQLGREHSGGEPGDPVQ

SEQ ID NO: 10081 - protein, 81 aa, Mus musculus
MNLVTYDDVHMNFTQEEGALLETSQKNLYKDVMLETYRNLSAIGNYTRNNVNLTNITCANERPPKGDPHSSLGTAADPRRH

SEQ ID NO: 10082 - protein, 81 aa, Mus musculus
NMDLITYDDVHVNFTQEEWALLDPSQKSLYKGVMLETYRNLTAIGYIWEEHTIEDHLQTSRSHGRHERSCSAEQPSEFIQC

SEQ ID NO: 10083 - protein, 81 aa, Mus musculus
CQVLLTFMDVALEFSKEEWECLDSAQRALYRDVMLENYNNLVSVGVAVSKSEVITFLEENKDPWIVDRNGTERRTPDQEAP

SEQ ID NO: 10084 - protein, 81 aa, Cricetulus griseus
PDSVTFEDVAVYFTKEEWTLLDGFQRSLYREVMLENYQNLASAEVKMDLETKETELQLDSYWSDISNETQLARLTKVGSHN

SEQ ID NO: 10085 - protein, 81 aa, Cricetulus griseus
LEDMLSFWNGAIEFSPEERECLDPAQWSLYRDVMLENYSKLLFLGLAVPKPHLVTFLEQRQESSGVKRQAAATMHPGRIPN

SEQ ID NO: 10086 - protein, 81 aa, Cricetulus griseus
KYELMINILCCESHLSSWKSVETLTFKDVAVIFTLEEWALLDPSQMKLYRDVMKETFRNLLFIEVKWCPIWVNVEKSSARL

SEQ ID NO: 10087 - protein, 81 aa, Cricetulus griseus
VEGSVSFEDVAVDFTQQEWARLDSTQRNMHKDVMLETYSHLASVGLCVAKPDMIFKLERGEELWVLEEESSDHDYSGPLSL

SEQ ID NO: 10088 - protein, 81 aa, Cricetulus griseus
DMKIKSLEALYLPIKAFVATGDYNGHVGLGVKCSKEDLVTFSDVTVTFSKEEWECMDSAQWNLYTDVMLENYNNLVFVVAM

SEQ ID NO: 10089 - protein, 81 aa, Cricetulus griseus
DVLTYDDVHINFPQEEWVLLNPSQKSLYRDVMLDTYSNLTDIGYKWENHNIEEHCQTSRIHRRHLQRQEKIHTGEKQYENL

SEQ ID NO: 10090 - protein, 81 aa, Cricetulus griseus
MLSFQDVAIDFSAEERECLDPDQWDLYRDVMLENYSNLEFLGLASSKPYLVTFLEQSQGSNDMKRQTTSTLQTGKQRFIGK

SEQ ID NO: 10091 - protein, 81 aa, Cricetulus griseus
LSGLLTFWDVAVDFSQEEWECLDSAQRTLYIDVMLENYSNLVSLENYYKCDPVHQHVKTEKESCQCNELGKVLHDPSKCAL

SEQ ID NO: 10092 - protein, 81 aa, Cricetulus griseus
EEKVAFEDVAVNFTSGEWALLDSFQKKLYRDVMKETFLNLISIEEAVEENIGEDYKDLSRITRIQVIEKNCGYACGHECDK

SEQ ID NO: 10093 - protein, 81 aa, Cricetulus griseus
CWGLLTFRNVTVDFSQEEWECLDSSQRALYMDVMWENYSNLVFIENHCICGKYEKVLDQGSKHIVHEDVNTQEKSHKWYEL

SEQ ID NO: 10094 - protein, 81 aa, Peromyscus maniculatus
MASPSPLLEPKEEWDYLDPARRSLYKDVMMDSYGNLVSLDVLNRNKNEEPTVKEEIEEDIDPPGVIVTRIKSEIDQDPIGR

SEQ ID NO: 10095 - protein, 81 aa, Peromyscus maniculatus
MDTVTYEDVHVNFTHEEWALLDPSQKSLYKDVMLDTYWNLTSIGYKWEDHNIEEHCQSSRRHGSRCVICHSGYNPYQHKGY

SEQ ID NO: 10096 - protein, 81 aa, Peromyscus maniculatus
SEEMVTFKDVAVVFSEEELELLDAAQKKLYCDVMLENFRNVVSLGHQIVTPDVSLQLKRENMLWMLTMVSWSCESAGARNL

SEQ ID NO: 10097 - protein, 81 aa, Peromyscus maniculatus
MMEEEWALLDLSQKNIYKDVMLETYINLTAIGYRWEDLNIEEHCQSPRRHGRYERSHTGEKPYECNQCDKGFSPHSHFQKH

SEQ ID NO: 10098 - protein, 81 aa, Mesocricetus auratus
GCVTFEDVAVYFCQEEWELLDEAQRLLYLNVMLENLALTASLVCWHEAETEETTCAPSVSPAEEPHIRVPKEDLPKQKTHP

SEQ ID NO: 10099 - protein, 81 aa, Mesocricetus auratus
MDFLAFEDVAVKFSQEEWILLDPSQKKLYRDVMLETCGNLTSLGIKWENKNIEEQYKHSWTYLRSYMVDAISEHKEGDQFQ

SEQ ID NO: 10100 - protein, 81 aa, Mesocricetus auratus
MNTVTYDDVHIDFTWDEWALLDPSQKSLYKNVMLETYRNLTAIGYKWEDHNIEEHCQRSRRNGRHERRHTGEKQYECSQCG

SEQ ID NO: 10101 - protein, 81 aa, Mesocricetus auratus
MGAVTYDDVHINFTQEEWALLNPSQKRLYKDVMHDTYSNLTATGYSLEDHYIEEHCQSSRRCRRHLQRHKKVHIGEKPYES

SEQ ID NO: 10102 - protein, 81 aa, Ictidomys tridecemlineatus
TGIPVSFEDVTVDFSREEWQQLDSTQRCLYQDVMLENYSHLLSVGFEVPKPEVIFKLEQGEEPWMLEGETPHQSYSGGKFG

SEQ ID NO: 10103 - protein, 81 aa, Ictidomys tridecemlineatus
PQESVTFKDVAVDFTREEWHHVDPAQRNLYRDVMLENYSHLVSLGYQVSKPEVIFKLEQGEEPWISEGEIQRPFCSVVSFN

SEQ ID NO: 10104 - protein, 81 aa, Ictidomys tridecemlineatus
MCPAQRTLYREVMLENYSHLVSVGYCVTKPKVIFKLEQGEEPWSLEDRFLSHKYPGYYKVDVHIKGNQDKQGKPLWQVIFI

SEQ ID NO: 10105 - protein, 81 aa, Ictidomys tridecemlineatus
SKEPVVFKDIALYFTQSEWKLLKPAQKALYKDVMLENYSNLASLVGCHVFKPTLITRLEQGIDPTLEDRPAPGGPPREEAK

SEQ ID NO: 10106 - protein, 81 aa, Ictidomys tridecemlineatus
VTFSDVAIDFSHEEWAWLDSAQKDLYKDVMVQNYENLVSLAGLSITKPYVITLLEDGKEPWMVEKTLSKGMLLDWESRWEN

SEQ ID NO: 10107 - protein, 81 aa, Marmota monax
LVTFEDVAVNFTQEEWILLDQTHRDLYRDVMLENYQNLASVGKTAIIPCCQLIKPSLISWLEKETDLWAVQRRDLQECEMR

SEQ ID NO: 10108 - protein, 81 aa, Marmota monax
PKVPVSFEDVAMYFTKTEWKLLDLKQRILYKQVMLENYGHLVSLGFAFSKPRLVSQLERGEGPWVADSLRGQAEAESHAGE

SEQ ID NO: 10109 - protein, 81 aa, Marmota monax
AQASLTFEDIAVNFSSKEWQSLTYFQRHLYKDVMLENYGNMVSLGFSFPKPPLISHLEQEAEPCVQDLQYGRFLSCSFPVP

SEQ ID NO: 10110 - protein, 81 aa, Marmota monax
RVVFEDVAIYFSQEEWGHLDEAQRFLYCEVMLENLTLLSSLGCWYGAEAEKAAPEQGVSVGAPQVRTPKPGSSTQNAQPSE

SEQ ID NO: 10111 - protein, 81 aa, Marmota monax
MEPLTFRDVTIDLSQEEWDCLDPAQQNLYKDVMLENYQNLFFLAVYSHQVQDFLPEQGSKHLSQKVIKGRHGSQGIENLHL

SEQ ID NO: 10112 - protein, 81 aa, Marmota monax
LQGSVSFEDVAVDFTQEEWNRLDPTQRTLYRDVMLENYSHLVSLGYPITKPDVIASLENGVLEIIKREIPSSSCTEDEQAE

SEQ ID NO: 10113 - protein, 81 aa, Marmota monax
MLETYRSLVSVGLCISKPDVVHLLEQEKEPWTMPGEVVRGLCPDLECVGVTKESSPHRDMHEEKLSQAAVMERLTSRDPEC

SEQ ID NO: 10114 - protein, 81 aa, Marmota monax
QDSMALQDVIIYFTQEEWALLDPSQKKLYRDVMSEIFSNLSSLGKLLQDKNCEDCYRNFGGKLSNNNGEQACESKEHLHCG

SEQ ID NO: 10115 - protein, 81 aa, Marmota monax
SEESVTFKDVAVDFTQEEWGQLDSPQRALYRDVMLENYQNLLALGPPVCKPDVISHLERGEEPWQVHSKVTGRTCSEWEPM

SEQ ID NO: 10116 - protein, 81 aa, Marmota monax
AEGSVVFNDVSIDFSQEEWECLDPAQRDLYRDVMLENYSNLVSMGFYIPKPQVISLLEQGKEPWMVGRELTRGLCSDLESM

SEQ ID NO: 10117 - protein, 81 aa, Marmota monax
LQNLVTFEDVAVDFTQEEWILLDQMHRDLYRDVMLENYRNLASVGCEPIKPSLIYWLEQEEDLWTVQSGDLQEWKILLNTK

SEQ ID NO: 10118 - protein, 81 aa, Marmota monax
EKMPVTFEDVAVNFTWEEWDCLDASQRALYQVVMSETFKNLESVGGIFLPKSDVVTKLEQEERQKRADLHQPNREGLPSGD

SEQ ID NO: 10119 - protein, 81 aa, Heterocephalus glaber
LQGSVSLKDVTVDFTEEEWQQLDTAQKALYMDVMLENYCHFISMGFHITNPETIHELEQGEELWTERIFPSQSYLKDEKPE

SEQ ID NO: 10120 - protein, 81 aa, Heterocephalus glaber
MQETYSHLLSVGYQVPEPEVFMLEQGEEPWASQGDSSHQSCPEKLQQICDQIESYQQTGNKSFSDVAFIKKMMTIKNHHEY

SEQ ID NO: 10121 - protein, 81 aa, Heterocephalus glaber
LTFEDVAVDFTMEEWALLDPSQKKLHRDVMWENFRNVASIEIDKCCKYNTDLKSCELHEFEQNLSNCNRHGETSTPFQSVQ

SEQ ID NO: 10122 - protein, 81 aa, Heterocephalus glaber
MEEWVLLNPSQKKLYRDVMEETFRNIVAIGRAWDNQEVEEDYKNYWRNLRNEEVEKCFQNKGWNQFEEIFLCTPDANVDKK

SEQ ID NO: 10123 - protein, 81 aa, Heterocephalus glaber
AVTFEDVAVNFTMEEWTLLNPSQKKLYRDVMRETFRNLAAVGRAWDNQEVEEEYKNYWRNLRNEEVEKCYQNKGWNQCEEM

SEQ ID NO: 10124 - protein, 81 aa, Neotoma lepida
PSGSVTFRDVAVDFSQEEWEFLDSAQKSLYRDVMWETYSNFISLDLEFRFKTNTSSAAKNIYEVYSLQWELMEKIKSYSSQ

SEQ ID NO: 10125 - protein, 81 aa, Mus caroli
SQRLLTFGDVAVDFPQEEWECLDSAQRALYIDVMLENYTNLVSVENYCISDTVHQHVKTEKESCQCNELGEMLHEPSNCAL

SEQ ID NO: 10126 - protein, 81 aa, Neotoma lepida
DGTVIKVKVLMNLSTLNWLLLKRDLARGFLISCPRANAIIHASLLDVATDFRQEEFCYLDSTQRTLPGNDKLKTYTNLVSA

SEQ ID NO: 10127 - protein, 81 aa, Mus musculus
PQGLLTFKDVALDFSLEEWERLSFAQRTLYIDVMLENYNNLLFVENHCIRGKYRKVLDQDSQYIVHEHMNIQEKSSKWDKL

SEQ ID NO: 10128 - protein, 81 aa, Mus musculus
MDALTFDDVHVHFTREEWSLLDPSQKRLYKDVMLENYRNLTAIGYNWKDHNIEEHSQNDRRNGRHERTPAGEKPYEYAQWD

SEQ ID NO: 10129 - protein, 81 aa, Mus musculus
LSFRDVAIDFSAEERECLDSAQWNLYKEVMLENYSHLVFLGSKPYQCKQCGKAFGWKSLLVQHQRIHTGEKPYICKECGKA

SEQ ID NO: 10130 - protein, 81 aa, Mus musculus
KVPVTFVDIAVYFSEDEWKNLDEWQKELYSNLVKENYKTLMSLDTDGPVSKPDPPVQAEPREEPCVWEQHHPEEREIPVTA

SEQ ID NO: 10131 - protein, 80 aa, Mus musculus
MVLVSFEDVAVDFTWEEWQALDAAQRTLYRDVMLETYSSLVSLGHCMAKPELIFNLEQGLGPRSTAGASVWNLSGRTEDS

SEQ ID NO: 10132 - protein, 81 aa, Mus musculus
MLENFRNLNELGCCSRRPGLITRLEQWDEPWVDDWDRSEFPDGQKSFCPGSRKVAHSRIGAGRGAALRKSALTSGKVRLPR

SEQ ID NO: 10133 - protein, 81 aa, Mus musculus
MEEMLSFRDVAIDFSAEEWECLEPAQLDLYRDVMLENYSNLVFLGLASSKPYLVTCLEQIQEPSDVKRGAATSMLPGVLGG

SEQ ID NO: 10134 - protein, 81 aa, Mus musculus
VTFEDVAVDFTQEEWILLDTKQRNLYREVMLENYQNLATLGCQLIKSRYSFCLEAEELRVVKKRVHQDWAIQLNPRGTMFQ

SEQ ID NO: 10135 - protein, 81 aa, Mus musculus
MASPSPPLEPKEEWGYLDPAPRSLYKDVMMDSYGKLVSLDVLNRNKDEEPTVKEELEKDIEPQGVIVTRIKSEIDQDPVGS

SEQ ID NO: 10136 - protein, 81 aa, Mus musculus
TESRISFEDVAVDFSWDQWQLLSPTQKSLYRDVMLENCSSLVFLGNQTTKPDVTFKLDQQESRIMDEECLSQNFLEIWLDS

SEQ ID NO: 10137 - protein, 81 aa, Mus musculus
SQRLLTFGDVAVEFPQEEWECLDSAQRALYIDVMLENYSNLVSVENYCISDTVHQHVKTEKESCQGNELGEMLHEPTNCAL

SEQ ID NO: 10138 - protein, 81 aa, Mus musculus
DAVTYEDVYVKFTHEEWALLDPSQKSLYKDVMLETCRNLTAIGYKLQDDNIEEHCPSSRGCGRYNIYGYKPCEHKGYGKKQ

SEQ ID NO: 10139 - protein, 81 aa, Cavia porcellus
SHLPTFAQDLVTFRDVAVLFTQEEWGRLNPPQRALYRDVMLENYSNVVSLAGLLGPKCSMFSQLGKEEEWVPEVAAGSSCL

SEQ ID NO: 10140 - protein, 81 aa, Cavia porcellus
EDVAVYFSREEWAYLNPRQKALYRNVMLDNFSSLVALGFCGPRPDLVSHLEQWDELWLEDSERAELREPQSGPCPGEHHGV

SEQ ID NO: 10141 - protein, 81 aa, Cricetulus griseus
MVFSDVSLDFSQEEWECLGPAQRDLYRDVMLENYSNLLSVGLPIPKPQVISLLEQGKEPWMIGKELTRGLCSALESMCESK

SEQ ID NO: 10142 - protein, 81 aa, Cricetulus griseus
VSVTFEDVAVLFTRDEWKKLDHSQRSLYREVMLENYSNLASLGFPFTKPKVISLLQQGEDPWKVEKEGPGGSPLGLKHNHR

SEQ ID NO: 10143 - protein, 81 aa, Cricetulus griseus
CERWMSFEDVTVTFSQEEWQQLDSAQRRLYQDVMLEIYSHLLAVGYPIPSPGVIFRIERGKEAQAGKAEFPGQQCQEKSGI

SEQ ID NO: 10144 - protein, 81 aa, Cricetulus griseus
KEELVTFEDVAVDFTQEEWQYLNPPQRTLYRDVMLETYSNLVSVGSEDQGGIYHLSSLEQQVTKPDLIIKLETPPFIYFFS

SEQ ID NO: 10145 - protein, 81 aa, Cricetulus griseus
PFKTVTFKDVAVDLTQEEWQQMKPAQRNLYRDVMLETYSNLVTVGCQATKPDVIFKLEQEEEPWVLEEEMFWRHSPEVWEV

SEQ ID NO: 10146 - protein, 81 aa, Cricetulus griseus
GVLTFSDVAVNFSQEEWECLDSGQRALYIDVMLENYSNLLSVENYYKCDSVHQHVKTEKESCQFNEPGKVLRDPSTCALYR

SEQ ID NO: 10147 - protein, 81 aa, Cricetulus griseus
GAVTFGDVAVDFSEEEWACLDAAQRAFYRDLMLETYSNLVTVVGSSISKPHLITLLEQEREPWMVVKEETDRPSMDLESDY

SEQ ID NO: 10148 - protein, 81 aa, Cricetulus griseus
LTLGDVAVVFSWEEWQLLSHAQRDLYWDVMPEICRSLASMAGEIREIVEHLQHHLKDRIIRMSIEQCYKHRKFRNVFNQSK

SEQ ID NO: 10149 - protein, 81 aa, Cricetulus griseus
MDLLTFGDVALDFSQEEWECLDSSQRALYIDVMLENYSNLVSVENHGMGGKPKKVLNQDSNHNVQQHGNTQENFCKSNQLG

SEQ ID NO: 10150 - protein, 81 aa, Cricetulus griseus
SQGLLSFRDVSVDLSQEEWECLDCAQRALYMDVMLENYSNLLFVENHRICDKCEKLLHPGTKHFIHDHEYVQEKTCKCDEL

SEQ ID NO: 10151 - protein, 81 aa, Cricetulus griseus
EQWRHLDSTQKEQYWDFMLETYGKMVSGGISNSKPDLTNIADYGEELAGLQLHISEKIPRLTCKEDRQENDKENLNLENHR

SEQ ID NO: 10152 - protein, 81 aa, Cricetulus griseus
EKQFSFQSLLTFEDVAISFSKEEWECLNTCHRDLYRGFLLENYSNLVSDYWAGLGCLPTQSLLTFVDVAINFSKEEWECLN

SEQ ID NO: 10153 - protein, 81 aa, Ictidomys tridecemlineatus
GHVTFEDIAVYFSQEEWGLLDDAQKHLYHDVMLENCTLVASVGCWHRVEKTAHSEQILSIGMSQARTPAPSPSISNAHPCQ

SEQ ID NO: 10154 - protein, 81 aa, Ictidomys tridecemlineatus
ELVTFEDVAVNFTLEEWALLDPSQKKLFKDVMQETFWNLTTIGKDVLVADSSLAMPQTKHERTLTAEKPHVCKHCGKAFSS

SEQ ID NO: 10155 - protein, 81 aa, Marmota monax
LQGMVSFEDVSVDFTWEEWQDLDDAQRTLYRDVMLETYSSLVFLDVQIVDDVVENSQENHGRHLWQVVVNSSTSAKERLEL

SEQ ID NO: 10156 - protein, 81 aa, Marmota monax
MLENYQNLVAVGCQLIKPSLISCLEAEEELRTVERGVIQEWAALRQDVFWLKMTSGIQLASCHNGEELYDFKPHGEIFKGH

SEQ ID NO: 10157 - protein, 81 aa, Marmota monax
MDFSQQEWECLNPFQKTLYRDVMMENYGNLVSLGHSISKPDVITLLEQGKEPWMIVKKETRKWRKDLESRYEKISSEKVHL

SEQ ID NO: 10158 - protein, 81 aa, Marmota monax
SLGLVSFEDVSVDFTWEEWQNLDDAQRTLYRDVMLETYYSLVSLGHCIIKPEVIFKLEQGAEPWMVEEHPNQTLSDVQKVD

SEQ ID NO: 10159 - protein, 81 aa, Marmota monax
MLENYENLTIVGTECQLLKPSLISWLEQEESKIVKGRVLQEWKMGLKIKGASLQQNFLREQISSEILRARRHNGGELCDCK

SEQ ID NO: 10160 - protein, 81 aa, Heterocephalus glaber
QVLVSFEDVTVDFSREEWQQLDSTQRCLYHDVMLENYSHLLSLGFEVPKPEIIFKLEHGEEPWMWEDTPHHDCSGGTFGMK

SEQ ID NO: 10161 - protein, 81 aa, Mus caroli
DLVTYDDVHVNFTQEEWALLDPSQKNLYKDVMLETYRNLSAIGYIWEVHTSEDHFQTSRSHGRHERSCTAVQPSEFIQCGK

SEQ ID NO: 10162 - protein, 81 aa, Mus caroli
QREFLRCRGFLIVRGGVQDALTYDDVYVNFTQEEWALLNPSQKSLYKDVMLETYRNLNAIGFSWEDHTIEEHYQSSRRHER

SEQ ID NO: 10163 - protein, 81 aa, Mus caroli
NGLLTFKDVAVDFSEEEWECLDHAQRRLYLNVTLENYRNLFFVENHHICHKYENVQDTQHIVDEHVNIHEKSYKCHKLGKI

SEQ ID NO: 10164 - protein, 81 aa, Mus caroli
MLSFWDVAMYFSAEEWEYLGPAQWKMYRDVILENYSNLVFLGLASTKPYLVTFLEQRQELSDVKRPAATTKYSGGKSYTCK

SEQ ID NO: 10165 - protein, 81 aa, Mus caroli
MEQLTFRDVAIDFSGEEWECLDSEQQNLYTDVMLENYRNLVFLGLAVSKPYLVTCLEQRKEPWNVKRQKTTALFPAMFSHH

SEQ ID NO: 10166 - protein, 81 aa, Mus caroli
MGLVSFEDVAVDFTWQEWQELDAAQRTLYRDVMLENYSSLVSLGHCVTKPELILRLEHGFQPWSIGDTSVWRLPGVLEVYT

SEQ ID NO: 10167 - protein, 81 aa, Mus caroli
TQGQLSFSDVAIEFSQEEWECLDHAQRALHRDVMLENYSNLVSLGVTLPNLNAMSKLEQNKGPWTVESEAISTRKSNGKEY

SEQ ID NO: 10168 - protein, 81 aa, Mus caroli
PISFKDLAVRFSEEEWRLLQEGQREFYRDVMRENYETLVSVGTSELLPLSAFLSPAEAGGATSGESHQDKGQKTHLEHSSQ

SEQ ID NO: 10169 - protein, 81 aa, Neotoma lepida
SQGLVTIKDVSLCFSQEEWRSLDPSQTDFYGEYVMQENCGIVVSLRFPIPKLDMLSQLEGGEEQGVPDPQDLEGRDILKVT

SEQ ID NO: 10170 - protein, 81 aa, Mus musculus
KPGTVSFADVAVYFSPEEWRCLRPAQRTLYREVMRETYGLLASLEVGGDKPALICWVEEESEVWGPGAQEPEVAMCRTEVH

SEQ ID NO: 10171 - protein, 81 aa, Mus musculus
SQGVLTFMDVAIEFSKEEWECLDSAKRALYRDVMLENYINLVSVGVAVSKQEVIICLEQNKEPWIVDGEKTEVREPALDCN

SEQ ID NO: 10172 - protein, 81 aa, Mus musculus
MEDMLSFWDVAIYFSAEEWDCQGPAQWDLYRDVTLENYSNLVFLGLASSKPYLVTFLEQIQEPSDVKRQAAITVHPGGKCY

SEQ ID NO: 10173 - protein, 81 aa, Mus musculus
GSVSFQDVAVTFTVEEWALLDPSQKKLHKDVMEETFRNLAAIGKTQEGQNIDEDHRYSRRNQRNEVVERLLEHSKGTESKE

SEQ ID NO: 10174 - protein, 81 aa, Mus musculus
TNGRLTFKDVAIEFSQEEWECLDSAQRTLYRDVMLEIYSILVSVGLSVSKLELLTCFEQNEEPSIAGIKELKGIEPVLSCF

SEQ ID NO: 10175 - protein, 81 aa, Mus musculus
KLQEALTFQDVEVTFSQEEWGCLNSAQRNLYRDVILENYGNVVSVVGSSPKPALISWLEARKPWGVNICTVQLKRDADAAP

SEQ ID NO: 10176 - protein, 81 aa, Cricetulus griseus
YQELVSFKDVTVDFTQEEWTSLNPAQRSLYREVTLENYQNLASAEWKMQLETKCLAPQQGVLKGSSISNGMQMTESQNGRE

SEQ ID NO: 10177 - protein, 81 aa, Cricetulus griseus
SIGDLDLQPLRELSVALLLPYPSLEDHDQVHSHFLSTEFFRDLGADETIQSLSESKPELVTCLEENKEPWMVNIDEAEGLE

SEQ ID NO: 10178 - protein, 81 aa, Cricetulus griseus
GSVSFEDISLDFTWDEWQDLDAAQRSLYRDVMLENYSSLMFLGYCMTKPELIFKLERGFGPWSVVEASLQSLPGVHKMTTP

SEQ ID NO: 10179 - protein, 81 aa, Cricetulus griseus
FQELVVFRDVAVEFCKDEWECLGPDQRSLYRDVMLETYSNFVSLGLAVSKPSVISLLEQGKEPWMVEQAGWYPDLLSVNET

SEQ ID NO: 10180 - protein, 81 aa, Cricetulus griseus
NAMTYNDVHIDFTWEEWSLLDTSQKNLYKDVMLETYKNLADMEYSKEHHSTEEECRSSKRHQRHERRQSGEMSSEYTQCVN

SEQ ID NO: 10181 - protein, 81 aa, Cricetulus griseus
FQGRLTFKDVSVDFTQEEWQCLDSSQRALYVDVMLENYNNLVYVENYYICDPVHQHKKTEKESCQCAEFGKILHDPSTCAL

SEQ ID NO: 10182 - protein, 81 aa, Cricetulus griseus
MASPSPLLEPKEEWDYLDPTRRSLYKDVMMDSYGNMVSLDVLSKNKDEEPTVKEEIEEDIEPPGVIVTRIKSEIDQDPIAT

SEQ ID NO: 10183 - protein, 81 aa, Cricetulus griseus
FQGVLTFSDVAVDFSQEEWECLDSAQRALCIDVMLENYSNLVFVEEYCKCDPVHQHVKTEKESCQCNELGKVLHDPSTCAL

SEQ ID NO: 10184 - protein, 81 aa, Cricetulus griseus
LTFEDVAIYFSEQEWQYLEAWQKELYKHVMRTNYETLLNPPESQHSFGLILGEKEEVSFRHDQGVDLVNAQTRSLGALVST

SEQ ID NO: 10185 - protein, 81 aa, Cricetulus griseus
PEKLLQRLLTFGDVAVDFPQEEWECLDSAQRALYIDVMLENYNNLLSVGVNPLIVHIFEVGRHTPLKTIFWLEVTPSYLLL

SEQ ID NO: 10186 - protein, 81 aa, Cricetulus griseus
EKVAFEDMVVNFTSGEWALLDSSQKKLYRDVMKETFLNLISIEEAIEENIGENCKDLSRNTRSQAIDKYYICTCDHECNKN

SEQ ID NO: 10187 - protein, 81 aa, Peromyscus maniculatus
DVNAVTYADVHINFTREEWALLDPSQKKLYKDVMLETYRNLTAIGYSREDHNTENHFQSSRRCGRHERNRTGEKVSENTEC

SEQ ID NO: 10188 - protein, 81 aa, Peromyscus maniculatus
QEHVSFKDVCVDFTKEEWYLLDPAQKVLYRDVILENYSNFVSVERKWKVDELLESSQENQDEHFWPFMLTNKIIHVEGGGT

SEQ ID NO: 10189 - protein, 81 aa, Peromyscus maniculatus
AEGSVSFEDVAVDFTQQEWHRLDSTQRNMHKDVMLETYSHLASVGLCVAKPDMIFKLERGEELWILEEESSGRNYSGPLSL

SEQ ID NO: 10190 - protein, 81 aa, Peromyscus maniculatus
ARLPLTFEDVAIYFSEQEWRHLEAWQQELYKHVMRANYETLVSLDNGLPKPQLISWIELGRELFGSWGEEDKLENGIRSSI

SEQ ID NO: 10191 - protein, 81 aa, Peromyscus maniculatus
YKEPVIFKDVAVYFSQKEWQLLEPAQKDLYRDVMLENYENLISVEYYIFKPRLITRLEHGVDLFAEENSVPRERQQQREAG

SEQ ID NO: 10192 - protein, 81 aa, Peromyscus maniculatus
LHNALTYDDVHINFTWEELTLLEPFQKNLYKDVMMETYRNLTIIGYSWENHNIEAHFQNSRRHVRHEISQTGEKKPFIYTK

SEQ ID NO: 10193 - protein, 81 aa, Peromyscus maniculatus
MEEMLSFWDVAIEFSAEERECLEPAQWNLYRDVMLENYSNLVFLGLAVSKPHLVTHLEQRQESSDVKRQAAANVQPGTTFN

SEQ ID NO: 10194 - protein, 81 aa, Peromyscus maniculatus
SVTFEDVSVNFTLEEWAMLDSSQKNLYKDVMQENLRNLAYIGNKWEHQNIENEYENLWRKLSNQLLERLCEYTEGHPSAAE

SEQ ID NO: 10195 - protein, 81 aa, Mesocricetus auratus
LKEPVTFRDVAVDFTQEEWGQLDPTQRSLYRDVMLETFGHLLCVGPDLPKPAVISQLEQGAELWVTERGGTRVCHPGWILE

SEQ ID NO: 10196 - protein, 81 aa, Mesocricetus auratus
MLSFWDVAIEFSPEEREYLEPAQWNLYRDVMLENYSNLDFLGLALPKPHLVTFLEERQEPSGVERQAAATVQPGTTPNDYV

SEQ ID NO: 10197 - protein, 81 aa, Mesocricetus auratus
WSQGLLTFRDVDISQEEWMCLDSAQRALYIDVMLENYSNLVFVENYCKCDPVHQHVNNEKESCQCNELGKMLHDPFACALY

SEQ ID NO: 10198 - protein, 81 aa, Mesocricetus auratus
GYGSVSFEDVAVDFTQQEWHRLGSTQRTAHKDVMLETYSHLASVGLCVAKPDMIFKLEWGEELWILEEESSGYDYSDKNFE

SEQ ID NO: 10199 - protein, 81 aa, Mesocricetus auratus
PQVKVTFEDVAVLLSQEEWARLGPAQRGLYRNVMMETYGNVVSLGLPGSKPVVISQLERGEDPWVLDGQETEQSLGSDHSE

SEQ ID NO: 10200 - protein, 81 aa, Mesocricetus auratus
EGSELQGSPLQRMTWWGMDAVTYNDVHVDFTREEWTLLDPSQKNLYKDVMLETYTNLTAIGFKWEDHNIQEHCQSSRRHGR

SEQ ID NO: 10201 - protein, 81 aa, Mesocricetus auratus
VQEPVTFKDVAVAFTQEEWGQLDIVQRTLYRDVMLETYGHLLSVGNQIAKPEVIYLLEQGEEPWSVEQAYPQSTCPDWMRN

SEQ ID NO: 10202 - protein, 81 aa, Mesocricetus auratus
QDSVTFEDVAVYFTKEEWNLLNGFQRNLYRDVMLENYQNLATVEVKMDLETKETELQLDTFWSDISNETQLARLTKAGSHN

SEQ ID NO: 10203 - protein, 81 aa, Ictidomys tridecemlineatus
EPVTFEDVAVNFTLEEWALLDPSQKKLFRDVMQETLWNLTTIGKGDIVSSLSQSENRYHLSQVLERLCEQKEDSQCGKIID

SEQ ID NO: 10204 - protein, 81 aa, Ictidomys tridecemlineatus
MAEEFVTLKDVAMDFTLEDWEQLGLDQVDLFWDTALDNYQNLFLLNPPRPSLISYPDGGEELEDLVEGSPEAAGPDMTETK

SEQ ID NO: 10205 - protein, 81 aa, Ictidomys tridecemlineatus
QGVVVVFSDVTVDFSREEWEYLDSVQRVLYRDVMLENYSNLVSVGLSISKPAVITLLEQGHEPWTGGPVPAKSQSLHKWQK

SEQ ID NO: 10206 - protein, 81 aa, Ictidomys tridecemlineatus
PKVPVAFDDVSIYFSTPEWEKLEEWQKELYKNIMKGNYESLISMDYAMNQPDVLSQIQPEGEHNTENQTAPEASEIPADPS

SEQ ID NO: 10207 - protein, 81 aa, Marmota monax
GVPGKSGVVSKRALELKSSVNMAASQNLPQQGRHGNACEIPVSFEDVTVDFSREEWQQLDSTQRCLYQDVMLENYSHLLSV

SEQ ID NO: 10208 - protein, 81 aa, Marmota monax
YEPLTFRDVAIDFSEEEWECLDPAQQNLYREVMLETYSNLVFVEKTYQCEECNTLKNFTQHHSVHTGDMPCKECEKTSNKS

SEQ ID NO: 10209 - protein, 81 aa, Marmota monax
VTFEDVAIYFSQEEWRLLDEAQRLLYLSVMLQNFVLTSSLGKALTLTLVSLSSFSPKQIHLFQALQSVKFSSFLAYVLWTP

SEQ ID NO: 10210 - protein, 81 aa, Marmota monax
MQENYGILVSLGYPIPKPDLIFHLEQGEEPWVPDSPHPEEGDIVTGVYTGAWFWNDDIEDHEEEDDEDFLAEMAEEENEPP

SEQ ID NO: 10211 - protein, 81 aa, Marmota monax
MVGFQVTKPDVIFKLEQEEEPWVIEEEMFWRHSPEVWEVDEQIKKQQETLVRKVTSISKKTVIKEKVVECKKVAKIFPLSS

SEQ ID NO: 10212 - protein, 81 aa, Heterocephalus glaber
MLETYNNLVALGHCSSKPAVIFKLEQGSGPCMVEEAPSQSFPDVQKVNGLIQTNQENQEKHFWQVVTTSADEKVELGKRFN

SEQ ID NO: 10213 - protein, 81 aa, Heterocephalus glaber
MMENYGNLISLGHSISKPDVITLLEQGKEPWMVGREETRKLGEDLESRYEKVSYGKVHLFRKHSSVTLHQRINNSEKSFEC

SEQ ID NO: 10214 - protein, 81 aa, Heterocephalus glaber
KPGAVKFADVAVYFSPEEWGCLRPAQRALYRDVMRETYGLLSALGFPGPKPALISWMEQESEAWSSAAQDPEEGESLVGAL

SEQ ID NO: 10215 - protein, 81 aa, Heterocephalus glaber
AVTFEDVAVTFTMEEWALLDSSQKKLYRDVMWETFSNVSAIGRNWDDQQIEDEWQQCWRKNLRCEEVVEGHQNKSWHQHEE

SEQ ID NO: 10216 - protein, 81 aa, Neotoma lepida
QVPISFKDLAVRFSEEEWRLLQEGQREFYRDVMRENYETLVSVGTSELLPLSAFLSPAEPGGATVGESHHDKGQEPPSEHG

SEQ ID NO: 10217 - protein, 81 aa, Mus musculus
TENAVTYYDVLVSFTQEEWALLDPSQKSLYKDVMLETYRNLTAIGYNWEEDNIEEDCENSGRPTRHLQRDGPSNTGEKPFE

SEQ ID NO: 10218 - protein, 81 aa, Mus musculus
TQGQLSFSDVAIEFSQEEWECLDHAQRALHRDVMLENYSNLLSLGVTLPNLNAMSKLEQYKGPWTVESEAIRTRKSNGKEY

SEQ ID NO: 10219 - protein, 81 aa, Mus musculus
PVTFEDVAVNFSLGEWALLDSYQKKLYRDVMMETFMNLISIGKTEEESMDVNYPQLQRNLRIQVVEKFCDYEHSSQCGKTH

SEQ ID NO: 10220 - protein, 81 aa, Mus musculus
MDALTYDDVHINFTPEEWALLDHTQRNLYTDVMLETYKNLVAIGYKPEDKIIEHLQNFRIPGRHKGSLTREKPYEYTQCGK

SEQ ID NO: 10221 - protein, 81 aa, Mus musculus
LLGSELFRDVTITFSQEEWECLEPVQRDLYRDVMLENYTHLVSLGLAISKPEVIAILEQGKEPWIEERATTGGLCSALESG

SEQ ID NO: 10222 - protein, 81 aa, Mus musculus
MNAVTYEDVHVNFTQEEWALLDPSQKTLYKDVMLETFRNLNAIGFNWEAQNIEEYCQSSRRHRRCERSQSAEKPSEYTQRD

SEQ ID NO: 10223 - protein, 81 aa, Mus musculus
KKEMLSFWDVAIDFSPEEWECLEPAQWDLYRNVMLENFSHLVFLGLAVSKPFLVTFLEQRQGPWDMKRQGAATVYPGITPN

SEQ ID NO: 10224 - protein, 81 aa, Mus musculus
PMTFDDVAIIFSPEEWECLDSAQRDLYRDVMVENCRNLLSVEASRHGTKGFSSKKDMKRFFQEELRRRLSKCGADIFHPRK

SEQ ID NO: 10225 - protein, 81 aa, Mus musculus
DSGCLQERKIAAEMMLVDCLTDDQSSYLAQTSMPAIFQELVSFEDVIVDFTQEEWSSLNPDQRNLYRDVMLENYQNLATVG

SEQ ID NO: 10226 - protein, 81 aa, Peromyscus maniculatus
MNTVTYDDVHIGFTWEEWTLLDPSQKNLYKDVMLETYRNLAIIGYSWEDHNIEEHYQNSRRHERHERRHTGEKPHESNQCN

SEQ ID NO: 10227 - protein, 81 aa, Peromyscus maniculatus
MNAVTYEDVHVNFTREEWTLLDSSQKSLYKDVMLETYRNLTIIGYSWEDHNIEEHYQSSRRHERHERSHTQEKPSEYSHCV

SEQ ID NO: 10228 - protein, 81 aa, Peromyscus maniculatus
SQGLLTFRDVTVNFSQEEWECLDTSQRALYIDVMLENYNNLLFLEKYFKCDSVPQHVKTECESHHYNELEKTLPDPSIYAH

SEQ ID NO: 10229 - protein, 81 aa, Peromyscus maniculatus
AVTYDDVHIDFTWEEWILLDPSQKNLYKNVMLETYRNLTAIGYSWEDYNIEEHCQSSGGHARYHPRHKTFLNIGEHYECIL

SEQ ID NO: 10230 - protein, 81 aa, Peromyscus maniculatus
EARLASFWDVSVELSSEEWQLLDPAQQQMYREVTLENYSNLLSVGYLDTKPELIFKLEQGKEPWVINAKMSTQSCPEGWKK

SEQ ID NO: 10231 - protein, 81 aa, Peromyscus maniculatus
HKKSMVFSDVSLDFSQEEWECLGPAQKDLYRDVMLENYSHLLSVGLHIPKPQVISLLEQGKEPWMIGKELTRGLCSALESM

SEQ ID NO: 10232 - protein, 81 aa, Peromyscus maniculatus
MSAVTYNDVHVDFSVEEWALLDSSQKNLYNDVMLETYRNLRAIGNSLEDHNNEKHCQSSGRHGRNERNHTGEKLAVNTQCV

SEQ ID NO: 10233 - protein, 81 aa, Peromyscus maniculatus
PQSLLSFGDVAVDFSQEEWEYLDYDQRTLYMDVMLENYSNLVFVENHRIYGKYEKDLDQGTKHIAHEDVIIQEKSYKCNEL

SEQ ID NO: 10234 - protein, 81 aa, Peromyscus maniculatus
SQGLLSFRDVAVDISQEEWECLDCAQRALYMDVMLENYNNLLFVENHRICGKYEKVLHQVTKHFIHDHENIREKSYKCNEL

SEQ ID NO: 10235 - protein, 81 aa, Peromyscus maniculatus
MNTVIYDDVHVDFTWEEWTLLDPSQKNLYKNVMLETYRNLTIIGYSWEDHNIEEHCPSSRQHERNERSQTTEKPSKPCECN

SEQ ID NO: 10236 - protein, 81 aa, Peromyscus maniculatus
SLLTFRDVAVDFSQEEWECLDCAQRALYMDVMLENYNNLVFVGENQRVHIGNKEQKNTDLDKSFDSQHKLTLEQIKSRMKL

SEQ ID NO: 10237 - protein, 81 aa, Mesocricetus auratus
GELPATFEDVAVYFTQEEWGLLGKQQKELYRDVMQMNYELLVSLAEPPAAEPDLITELKRRAAPWMKDPNGLKSGKSRSLG

SEQ ID NO: 10238 - protein, 81 aa, Mesocricetus auratus
FQNSLTFDDVAVDFTQEEWVLMDQTQRDLYREVMLENYQNLFSAGCEITKPSLISWLEEDLQIGQREDFQEWEMQDTLREQ

SEQ ID NO: 10239 - protein, 81 aa, Mesocricetus auratus
MEPLTFKDVAIDFSGEEWECLNSEQQNLYKDVMLENYRNLVFLGLAVSKPYLVTCLEQRKEPWNVKKQKTMVLFPAMFPHY

SEQ ID NO: 10240 - protein, 81 aa, Mesocricetus auratus
PQGLLTFKNVTVDFSQEEWECLDSSQRALYMDVMWENYSNLVFVENHCICGKYEIVLNQGSKRIVHEDVNTQEKSHKCYEL

SEQ ID NO: 10241 - protein, 81 aa, Mesocricetus auratus
SKGSVSFKDVTVDFTQEEWQQLDPAQKALYRDVMLENYCHFISVGFHITKPDMIRKLEQGEELWTERIFPSQSYLDEDVLV

SEQ ID NO: 10242 - protein, 81 aa, Mesocricetus auratus
HMGLLTFQDVAVDFTQEEWECLDSAQRTLYIDVMLENYSNLVSLGIISCKADLVPCLEQIQMACNVKKEEMVARPENHQMC

SEQ ID NO: 10243 - protein, 81 aa, Mesocricetus auratus
NAVTYDDVHVKFTKEEWDLLDPSQKKLYSNVMLETIRNLTDIGYNWEDNNIEEDSPSSKRHDSHLERYERLHIEEKTSESI

SEQ ID NO: 10244 - protein, 81 aa, Mesocricetus auratus
SAGILTFEDVAIDFSQEEWECRDSAQKSLYQDVMLENYSNLVSVGLTVSKPELINSLEQSKDPWDVNIGETEDKEQKWSLV

SEQ ID NO: 10245 - protein, 81 aa, Mesocricetus auratus
MDPSQKKLYEDVMLETYRNLTTIGYSWEDHHVEEYYQSSRRYERNERSQTGEKPSVYTQCVKAFAYDTHLQRHETTHTGEK

SEQ ID NO: 10246 - protein, 81 aa, Mesocricetus auratus
EVGDMSFWDVAIYFSAEEWECLDPAQWNLYRDVMLENFSNLVFLGLVSCKPYLVTFLEQRQGPSDVKRQAAASMPTGTKCY

SEQ ID NO: 10247 - protein, 81 aa, Mesocricetus auratus
SQESVTFQDIAVDFTEKEWPLLDSSQRKLYKDVMLENYSNLTSLGYQVGKPSLISHLEQEEEVRMEERGIQLGSSPDSGTP

SEQ ID NO: 10248 - protein, 81 aa, Mesocricetus auratus
MEPVSFDDVAVNFTSGEWVLLDSSQRKLYRDVMKETFMNLIFIGKIQEDNIDVVYQKLQRNLRIQVIEQYDDYEYGSQFGK

SEQ ID NO: 10249 - protein, 81 aa, Mesocricetus auratus
LTGLLTFKDVSVDFSQEEWQCLDSAQRTLYIDVMLENYNNLVYVENYYMCDPIHQHGKTEKESCQCNQFGKILHDPSTCAL

SEQ ID NO: 10250 - protein, 81 aa, Mesocricetus auratus
MAFHDVAVAFNQMEWELLSPSQRILYREVMLENYSHLVSLGKALLFQFSEFTCGHLNMLCSLERPNWTLQVDSSIGRVFRR

SEQ ID NO: 10251 - protein, 81 aa, Mesocricetus auratus
DTVSYDDVHIDFTQEEWALLNPSQKSLYKGVMLDTYRNLSVIGYSWDDHNFDEHCESSRRNRRNEPSHTGEKPCTQNQCHC

SEQ ID NO: 10252 - protein, 81 aa, Ictidomys tridecemlineatus
MLENFRNLLSVGHQSFKPDVISQLEREEKLWMEEIHTHPGGRNQSRVESRHEAGWKCLSLGELSCWQIGRHVVNGMTESQD

SEQ ID NO: 10253 - protein, 81 aa, Ictidomys tridecemlineatus
QIQESVTFRDVAVLFSQDEWLHLDSAQRTLYREVMLENYSNLVSLGIAFSKPKVISQLEAEYPQAVRNGVPQSTCLGWENL

SEQ ID NO: 10254 - protein, 81 aa, Ictidomys tridecemlineatus
MVTFKDVAVVFSEEELGLLDCAQRKLYRDVMLENFRNLLSVAHQPFKPDLIAQLEREEKLLIVEAKIQRDGYSGSISQPKT

SEQ ID NO: 10255 - protein, 81 aa, Marmota monax
TEGQLAFRDVAIEFSQEEWKCLDPTQRALYRDVMLENYRNLVSLGIFLPDLGVISMLEEGKEPWTLKNEVKIARNPSGWGC

SEQ ID NO: 10256 - protein, 81 aa, Heterocephalus glaber
EGVNFKIVTVDFTHEDQGTWNPAVRTPDRGVTLENHRDLVSWDLATAFGRRESTLKQGIFDEELSHGVKIEKLTRDDPWLS

SEQ ID NO: 10257 - protein, 81 aa, Heterocephalus glaber
EEEEIRSRELEDGPTDMQKVRICSEGGWVPALFDEVAIYFSDEEWEVLTEQQKALYWEVMRMNYETVLSLEFPFPKPDMIS

SEQ ID NO: 10258 - protein, 81 aa, Heterocephalus glaber
MYFSQEEWELLDTTQKALYNDVMQENYENVISVALFGLPKPKVISCLEQGEEPWVQGSLDFKDSPRESPTEFKLRKDTENH

SEQ ID NO: 10259 - protein, 81 aa, Heterocephalus glaber
LTFQDVAVYFSRAERRQLGPGQRALYRDVMLENYGNVASLGFPIPKPELISQLERGEELWVLDLLGAEETEVLRTYQTDSE

SEQ ID NO: 10260 - protein, 81 aa, Mus caroli
LNSAVTYDDVNVNFTREEWALLDSSQKSLYKDVMLETYRNLTAIGYNWEGHNIEEHCQSSRRHARTHKRTHTGEKSYECDQ

SEQ ID NO: 10261 - protein, 81 aa, Mus caroli
TKDPLSFTDVAIDFSADEREYLDSAQWNLYKEVMLENYSNLVFLGLAFSKPHLVTFLEQSSDLWSVKRKASAAIPLGSKAH

SEQ ID NO: 10262 - protein, 81 aa, Mus caroli
MDALTFDDVHVHFTREEWCLLDPSQKRLYKDVMLENYRNLTAIGYNWKDHNIEEHSQNDRRYGRHKRSSAGEKPCEYIKWY

SEQ ID NO: 10263 - protein, 81 aa, Mus caroli
DAVTFDDVHVNFTKEEWNLLDLSQMNLYKDVMLETYWNLNSIGYKWEDHHIEEPCQSSGGHVRSHRWKKLYECHQCGKAFA

SEQ ID NO: 10264 - protein, 81 aa, Mus caroli
VQEPVTFRDVAVSFSQDEWLHLDPAQRTLYQEVMLENYSNLASLGILFSKPKVIAQLEQAEDFQMVESGMFQGVYLGWKSL

SEQ ID NO: 10265 - protein, 81 aa, Mus caroli
TGDWEMAAALLAAGSQEEWRSLDPSQTDFYGEYVMQENCGIVVSLRFPIPKLDMLSQQEGGEDQWAPGPQDVEGRDILKVT

SEQ ID NO: 10266 - protein, 81 aa, Neotoma lepida
SQGLLTFQDVTVDFSQEEWECLDSAQRTLYIDVMLENYNNLVSVENYWICDAIQKHVKTEKESCQYNELGKVLHEPSTCTL

SEQ ID NO: 10267 - protein, 81 aa, Mus musculus
FSQEEWECLDSAQRALYIGVMLENYSNLVSVGIIVCKADLVPHLEQIYIPWNVKIKEMVAKPGRESYRMCSESEIVFYQDS

SEQ ID NO: 10268 - protein, 81 aa, Mus musculus
MEAVTFKDVAVVFTKEEFRLLDSAQRTLYQDVMVENFRNLLSVEYQLFKRDKPYLEREEKPQMRRAAPRERDSGINGQSAR

SEQ ID NO: 10269 - protein, 81 aa, Mus musculus
PQGLLTFKDVALYFSLEEWECLSFAQRTLYMDVMLENYNNLLFVENHCIRGKYRKVLDQDSQYVVHEHMNIQEKSSKWDKL

SEQ ID NO: 10270 - protein, 81 aa, Mus musculus
VAFDDVAINFTQEEWALLDPSQKNLYRDVMEEVFRNLTSIEKGWEDQNVEDEDKNPQTNLRHIIANSGYNLYESEESSEKP

SEQ ID NO: 10271 - protein, 81 aa, Mus musculus
PQSQITFKDVAMHFSQEEWECLDCAQRALYMDVMLENYNNLFFVENHCMCPKFENMLDQDLQHIIHKHANIQVKSYECHEL

SEQ ID NO: 10272 - protein, 81 aa, Mus musculus
ALCASQPDMITSLEQGRDPWMMKRKMRKGQHLDLKAMQETKEFPPKDLSEETLFLAVLRKQLLPHRPKCSMVRAAWEGGAV

SEQ ID NO: 10273 - protein, 81 aa, Mus musculus
AGDALTFDDVHVHFTREEWSLLDPSQKRLYKDVMLDTYRNLTTIGYNWEDHNIEEQCQSGRRHGRHQTSHAGEKHCEYTQY

SEQ ID NO: 10274 - protein, 81 aa, Mus musculus
VRSQEAMTFKDVAMDFTPEEWGKLDPAHRAVMLENYRNLVSLWLPISKPDNYNSEDGKELSKLEKSPKCSDSGQPPFQKAE

SEQ ID NO: 10275 - protein, 81 aa, Mus musculus
TNGLLTFKDVAIEFSKEEWECLDSAQRTLYRDVMLEIYSILVSVGLSISKPELLTYLEQNEEPYIAKGIEPVLSCFHNKEL

SEQ ID NO: 10276 - protein, 81 aa, Dipodomys ordii
RLQEPVTFRDVAVDFTQEEWGQLDLTQRTLYREVMLETFRHLLSVGPELPKPEVISQLEQGAELWIERGVTQGYNPVWALG

SEQ ID NO: 10277 - protein, 81 aa, Dipodomys ordii
SKSLENDGVCFSEQEWENLEEWQKELYRNVMQSNYETLVSLKVLGQPEEEAELGTEMLGDLEEEGPHGTHLVDGAMGKQEG

SEQ ID NO: 10278 - protein, 81 aa, Dipodomys ordii
AVTQLTFEDVAVDFTPEEWRCLTPAQRALYRDVMLDTYRNLVSVGVSPPSMSVILPLEFQEEPWVAQSHVTTLGGLNGWEG

SEQ ID NO: 10279 - protein, 81 aa, Dipodomys ordii
SLGLVSFEDVSVDFSWEEWKDLDDAQRTLYKDVMLEIYSNLVSLGHCVPKPEVIVKLEQGAEPWLGEALDKNITDVQQVDG

SEQ ID NO: 10280 - protein, 81 aa, Dipodomys ordii
QAYANFEDVVFSFTPEEWGFLDEAQRQLYLNVMLETFALVTSVGCGHEVDGWASSVPRVSLGGKSHVTSPQICPPTQKTHS

SEQ ID NO: 10281 - protein, 81 aa, Dipodomys ordii
TPKEAFTFQDVAVDFTEEEWAMLDASQRKLHRDVMWESISHLLAVGVDLCESDVLSQLELREMWRERREFLRALKPESELQ

SEQ ID NO: 10282 - protein, 81 aa, Cricetulus griseus
MGLLTFRDLDVDFSQEEWECLDPAWRSLYVDVMLENYRNLVFVEKYRVRGKYENIMDQVSKNIAFQHVNTHKKSYRYTDLG

SEQ ID NO: 10283 - protein, 81 aa, Cricetulus griseus
SIKDMSFWDVAIHFSAEEWECLGPTQWNLYRDVMLENFSNLVFLGLASCKPYLVTFLEQRQETSDVKRQEAAAMPTGAKCY

SEQ ID NO: 10284 - protein, 81 aa, Cricetulus griseus
MTYDDVHINFTWEEWTLLDTPQKMLYKGYIWEDHTIEDHCAISKSHERHERSQTGEQTSVYTKCVKAFAYNSHLQRHKRTH

SEQ ID NO: 10285 - protein, 81 aa, Cricetulus griseus
EYVQESVIFKDVAIDFTLEEWRLVDPTQRKLHKNVMLESYKNLLSLVSKPDMISHLENGKHPWAVVREISRASYGDLKTKS

SEQ ID NO: 10286 - protein, 81 aa, Cricetulus griseus
VSFEDVAVHFTQEEWDLLDASQKSLYGDVMLETCRNFTAIGYEWEDQTVGEHCEDPEINLRHIDSRSECTQYEHEEFEQKP

SEQ ID NO: 10287 - protein, 81 aa, Cricetulus griseus
MACSKVSNHHHNGNQFCFQSLLTFKDVAINFSKEEWECLHTSQKDLYRDVMLENYSNLVSVGENQSFSDCSLGLGMSINFY

SEQ ID NO: 10288 - protein, 81 aa, Peromyscus maniculatus
SQDLVTFGDVSVNFTQEEWEWLNDAQRDLYRKVTLENYKSLVSLAGIPVYKPAVISLLEQGKDPCVVQKEGARDASPDWDY

SEQ ID NO: 10289 - protein, 81 aa, Peromyscus maniculatus
MEEMLSFWDVAIEFSAEEKECLEHAQWNLYRDVMLENYSNLVFLGLAVSKPHLVTFLEQGQESSDVKGQAAAIVHPGITTN

SEQ ID NO: 10290 - protein, 81 aa, Peromyscus maniculatus
VTYEDVHVNFTHEEWALLDPSQKNLYKDVMLETYWNLTIVGYKWEDHNIEEHYPNSTRHSRMMKFRLTLNFRHFCFHLKLL

SEQ ID NO: 10291 - protein, 81 aa, Peromyscus maniculatus
FKELVEFRDVAVEFCREEWECLDPHQRSLYRDVILETYGNFVSLGLAIFKPSVISLPEQGKEPWMVEQAGWYPDLLSVNET

SEQ ID NO: 10292 - protein, 81 aa, Peromyscus maniculatus
ADSVTFEDVAVYFTKEEWNLLDGFQRNLYRDVMLENYQNVATVERKMELEKLQLDSFWSDISNETQLARLTKAGSHNGGKL

SEQ ID NO: 10293 - protein, 81 aa, Peromyscus maniculatus
MVTFKDVAVAFSEEELRLLDPAQRKLYQEVMVENFQNLLSVGINNQSELRAVQDGGSHEALSCWQIWQRVIDNLTRCQDSM

SEQ ID NO: 10294 - protein, 81 aa, Peromyscus maniculatus
KENAVTYDDIHIDFTREEWTLLDPSQKNLYKDVMLETYRHLTTIGYSWEDHNIEKYCESSRRHKSTVQRHKRTNTNENPYE

SEQ ID NO: 10295 - protein, 81 aa, Peromyscus maniculatus
NTVTYDDVHVDFTWEEWTLLDPSQKTLYKDVMLETYRNLYTLGYSWEDDNIEEHHQISRSHERHERRHTGEEHSLYTKYGK

SEQ ID NO: 10296 - protein, 81 aa, Peromyscus maniculatus
EQDAVTYEDVHVNFTHEEWALLDPSQKSLYKDVMMETYWNLTCVGYKWEDHNIEEHCQCCRRNGSRCVICHSGHNPCEHKG

SEQ ID NO: 10297 - protein, 81 aa, Peromyscus maniculatus
FQGLLTFRDVTVNFSQEEWKCLDTAQRALYIDVMLENYNNLLFLEKYFKCDSVPQHVKTECESHQYNELEKTLPDPSIYAH

SEQ ID NO: 10298 - protein, 81 aa, Peromyscus maniculatus
MDPSQRNLYKDVMLETYMNLTAIGYNWEDVEVEEYCQISEKHGRHERSHTKEKSYGYIECGKAFVCHSHPQRHKRTHTREK

SEQ ID NO: 10299 - protein, 81 aa, Peromyscus maniculatus
AQGCMAFNDVAIYFLREEWTLLDDSQRRLYHHVMMEVFVLMSSLGLIPSGTRNITQLESSDPFIPALRFLTPRIVVEKIPC

SEQ ID NO: 10300 - protein, 81 aa, Ictidomys tridecemlineatus
QDLVTFRDVAVDFSQEEWNCLDSSQRHLYSNVMLENYNILVSLGWESMYETKELMPKQELYEEQSSQNIMEKLTSFGFEYS

SEQ ID NO: 10301 - protein, 81 aa, Mesocricetus auratus
AEDFVTLKDTAMDFTLEDWEELELELNKRDPFWDLTLSNCQDLFLLNPPKPSLVSQPDIREELEATVRGGGLEATDTGGTI

SEQ ID NO: 10302 - protein, 81 aa, Mesocricetus auratus
KVPVTFVDIAVYFSEDEWKNLDEWQKELYSNLVKENYKTLMSLDADGPVSKPDAPVQAEPREEPCVWEQHHPEEREIPVAA

SEQ ID NO: 10303 - protein, 81 aa, Ictidomys tridecemlineatus
AQGLVTFRDVIIEFSQEEWKCLEPAQRDLYRDVTLENFSHLVSLGLSISKPDVISLLEQGKEPWILANDMTGPWYPDLKSR

SEQ ID NO: 10304 - protein, 81 aa, Ictidomys tridecemlineatus
APGLIAFEDIAVYFSREEWMLLDTAQRALYRHVMLGNFALVASLGLSASRPRVVIQLEHGEEPWVPSGTDTALGRNAHRKS

SEQ ID NO: 10305 - protein, 81 aa, Marmota monax
MLETYRNLVSLGLAISKPDVISFLEQGKEPWMEERVVSGSLCTVLKSRYETKVSPPEQHVHEVKSPRWEIMERLASYGLRC

SEQ ID NO: 10306 - protein, 81 aa, Marmota monax
SQRMLKMENVALTFSPGWTQLNSSQMNLYRDERQENCGHLVSLGGKIQATIQDLPPAKEHLEKPGQKLYHLGEDIAQISAG

SEQ ID NO: 10307 - protein, 81 aa, Marmota monax
KVPVTFVDIAVYFSEDEWKNLDEWQKELYNNLVKENYKTLMSLDTDGPVPKPDAPAPVEPREEPCVWEQRHPEEREIPVDT

SEQ ID NO: 10308 - protein, 81 aa, Heterocephalus glaber
EPWAITFADVAVYFSPEEWGCLQPTQRALYRDVMRDTYVLLSALGGGGAKPALISWVEREAELWDPDAQDPEVPKWPTEAD

SEQ ID NO: 10309 - protein, 81 aa, Heterocephalus glaber
QGLVIFEDVALHFSQEEWGLLTVAQRSLYRDVMLENFALISSLGKSSSLTTSTSFPGEGFVHTEAPSGSLRGLLGERPDEC

SEQ ID NO: 10310 - protein, 81 aa, Mus caroli
SVTFEDVAVDFTQEEWILLDTKQRNLYREVMLENYQNLATLGLVMAALRTVENNRDLECQLIKSRYSFCLEAEELRVVKRR

SEQ ID NO: 10311 - protein, 81 aa, Mus caroli
SQGLVTFGDVAVVFSQEEWEWLSSEQRSLYWKVMLDNYRNLASLGLCASKPDMITSLEQGRDPWMMKRKMRKGQRLDLKAM

SEQ ID NO: 10312 - protein, 81 aa, Mus caroli
PQGQLTFKDVAVDFSQDEWEYLDCAQRALYVDVMLENYKNLFFVESHHLTHKYENILDEDTQCIVHEHMNLQSYKCHELGK

SEQ ID NO: 10313 - protein, 81 aa, Mus caroli
MDAVTYEDVYVKFTHEEWALLNPSQKTLYKDVMLETCRNLTAIGYKLQDDNIEEHCPSSRGCGRYNIYGYKSCEHKGHGQK

SEQ ID NO: 10314 - protein, 81 aa, Mus musculus
YRNVMFENYQNLATVGGQMFKPSLISWLEKKVELTVIEQGILQEWEMHLKTKRTALQQDRFWSDMSNGMQLMFPPKKCTPE

SEQ ID NO: 10315 - protein, 81 aa, Mus musculus
CERRLVKLRTPNMDLVTYDDVHVNFTQEEWALLDASQKSLYKGVMVETYRNLTAIGYSWEEHTIEDHFQTSRSHGSPDILW

SEQ ID NO: 10316 - protein, 81 aa, Mus musculus
MNAVTYEDLHVNFTQEEWALLDPSQKKLYKHVMLETYRNLNAIGFNWEAQNIEEHCQSSRRHRRCERSQSAEKPSEYTQRD

SEQ ID NO: 10317 - protein, 81 aa, Mus musculus
MENMLSFWDVVIYFSAEEREYLGPPQWKLYRDVMLENYNNLVFLGLASSKPYLVRFLEQIQEPLDVKSQVAISMYSGGNSS

SEQ ID NO: 10318 - protein, 81 aa, Dipodomys ordii
MLENYSHLVSLGYQVSKPEVIFKLEQGEEPWISEREIQRPFCPDQKTRPEAKSSNLLQSTSEVSRHQDERSHAALQDGWDV

SEQ ID NO: 10319 - protein, 81 aa, Mus caroli
LEELVSFEDVTVQFTQEEWALLDPLQRTLYRNVMLENWKNLASLGQHLDKPNLISQLEQEGKVITEDRGIIPGIHPDLETV

SEQ ID NO: 10320 - protein, 81 aa, Mus musculus
NMDLVTYDDVHVNFTQEEWALLDASQKSLYKGVMVETYRNLTAIGYSWEEHTIEDHFQTSRSHGRHERRSSAEQHSEFIPC

SEQ ID NO: 10321 - protein, 81 aa, Cricetulus griseus
ESVTFEDVAVHFTMEEWAILDPSQKELYKDVMKEILRNMVSIGNIRKHQKIENEYQNSGRKLRCHLVEKLHDCKEDHECAE

SEQ ID NO: 10322 - protein, 81 aa, Cricetulus griseus
EEWQHLDPDQKALYRDVMLENYCHFVSVGFPITKPDMIRKLEQGKELWTERIFPSQSYLEDEDVPVKFKDCLDKHPESTVL

SEQ ID NO: 10323 - protein, 81 aa, Cricetulus griseus
PDFGIIDQTSGTILLLAYFQHLLTFGDVAVDFPQEEWECLDSAQRALYIDVMLENYNNLLSVGENILLLEFITHHLFVLTS

SEQ ID NO: 10324 - protein, 81 aa, Cricetulus griseus
KPELVSFADVAVYFSPHEWGCLRPAQRALYREVMRETYGLLGALGFPGPKPALISWMEQESEAWSPAAQDPAEGESLGGAL

SEQ ID NO: 10325 - protein, 81 aa, Cricetulus griseus
MAFRDVAVDFSQEEWSLLSPAQRSLYREVMLENYSNLVSLGIPFSKPKLITQLEQGKETWQEERKCPQVACQAQAKLELCP

SEQ ID NO: 10326 - protein, 81 aa, Peromyscus maniculatus
VKIEDVADVAVSFILEEWGHLDQSQKSLSRDGRKDNCESITPVDYESREGNPELVVPQVSDGADPHWVAAESTGRSGAPSQ

SEQ ID NO: 10327 - protein, 81 aa, Peromyscus maniculatus
VCGSVTFRDVAVDFSQEEWACLDASQRVLYRDMMLETYSNLVTVVGCSISKPDLIALLEQEREPWMVVKEETDRPSPDLES

SEQ ID NO: 10328 - protein, 81 aa, Peromyscus maniculatus
PGLGVTFEDVAIHFSQEEWVLLDKAQRLLYCSVMVENLALVASLGSRPGMGDEEVTSEHAGPTDGVMSKTSPSTQQTHLFE

SEQ ID NO: 10329 - protein, 81 aa, Peromyscus maniculatus
QTAVTYDDVHIDFTWEEWILLDPSQKNLYKNVMLETYRNLTAIGYSWEDYNIEEHCQSSGGHARFKKCHTGKKPCEFSQCA

SEQ ID NO: 10330 - protein, 81 aa, Peromyscus maniculatus
MGLVSFEDVAVDFTWQEWQELDAAQRTLYRDVMLENYSSLVSLGHCVTKPELIFRLEHGFGPWSIGETSLWSLPGVLEVYA

SEQ ID NO: 10331 - protein, 81 aa, Peromyscus maniculatus
LQDPLTFQDVTVDFSQEEWECLDTTQRALYIDVMLENYSNLVSVENYCKYDPVHQHVKTEKESCQCNELGKMVHDPCTCAC

SEQ ID NO: 10332 - protein, 81 aa, Peromyscus maniculatus
VTFGDVAVNFTQEEWTLLDPFQKNLYINVMLETCSNLVSVGIKSEYQTIEEQYKHPGRNLRSIISNLGYTHKFEEYGKKQY

SEQ ID NO: 10333 - protein, 81 aa, Mesocricetus auratus
PQGLLSLRDVSVDFSQEEWECLDYDQRALYMDVMLENYKNLLFVEFHRICCKWKTVLHQGTKHFIHDHETIQEKSYTYNES

SEQ ID NO: 10334 - protein, 81 aa, Mesocricetus auratus
PKVPMTFDDLAVYFSELEWATLEDWQKELYRRVMTDNYETLVSLDYAISKPDILTWIEKGEQPFPAGPCGQGRGSEEKAVC

SEQ ID NO: 10335 - protein, 81 aa, Mesocricetus auratus
MGLLTFRDVSVDFSQEEWQFLDSSQRTLYIHVLLENYNNLLYVENYCICDPVHHHVKTEKESCQWNDLDKVLHDPCTCALH

SEQ ID NO: 10336 - protein, 81 aa, Mesocricetus auratus
MAFEDVAVYFSQEEWMFLDAAQRALYRHVMLENFALVDSIGLSVSRPRVIIQLQRGEEPWVPNRTNPGPGRSTCRRPSLGS

SEQ ID NO: 10337 - protein, 81 aa, Mesocricetus auratus
MNGLLSFRDVAVDLSQEEWECLDCAQRDLYMDVMLENYNNLLFVENHRICAKCEKVLHQGTKHFIHVHANIQGKTCKCNEL

SEQ ID NO: 10338 - protein, 81 aa, Mesocricetus auratus
KTVTFKDVAVDLTQEEWQQMKPAQRNLYRDIVNSLVIENFTSNEFWSSILEVWEVDGQMEKQQETLVRKVTSIFKKSLIKE

SEQ ID NO: 10339 - protein, 81 aa, Mesocricetus auratus
LLSFEDIAVDFTWEEWQDLDAAQRALYRDRALYRDVMLETYSSLVSLGHCMNKPELISKLEQGLGPWNVEESSDRSFPGLS

SEQ ID NO: 10340 - protein, 81 aa, Mesocricetus auratus
MVFSQEEWKCLDSAQRALYINVTLENYNNLSLSRPYTAKKVPRQGEYDQCSENTYSLLKKPVSTREKPYQCGKCKKCFSTA

SEQ ID NO: 10341 - protein, 81 aa, Mesocricetus auratus
SKRQLSFRDVAVDFSPEESECLDPAQWDLYSDVMLENYSNLVSLGLAFSKPYLITFLEQRKQPWNMKQQATVAIYPGSKPY

SEQ ID NO: 10342 - protein, 81 aa, Mesocricetus auratus
HSEEWECLDSAQWAFYIDMMLENYSSLVLVENYFICDPIHHHVKTEKESCHCDELDKLLHAPSTCVLNRTSESTENSNKYT

SEQ ID NO: 10343 - protein, 81 aa, Ictidomys tridecemlineatus
DSVSIEDVAVEFTQEELTLEDPTQRKTHNDVTVKNCKNLATVELDMQLKTKDSALQQNFLTEHTSSDIQLESVTFEDVAVD

SEQ ID NO: 10344 - protein, 81 aa, Mesocricetus auratus
DMDAVTYHDFHVNITQEEWDLLYTSPRNLYRDLILEANMKINSIGYAWEDTNIEEHFESPQRHQRSETSPTGEETSVNIPC

SEQ ID NO: 10345 - protein, 81 aa, Marmota monax
MLENYSHLVSLGYPITKPDVIASLENGVLEIIKREIPSSSCTEDEQAEDQLENHQENQNRHLRQAISIDEKNVSKERAHEF

SEQ ID NO: 10346 - protein, 81 aa, Marmota monax
SISFEDVTVNFSREEWQHLDPVQRRLYWDVTLENYHHLISVGENIRKTQQQEISGEVAFHCERFDQPTGEDSLCSILEELW

SEQ ID NO: 10347 - protein, 81 aa, Heterocephalus glaber
MASPSSPLEPKEEWDYLDPAQRSLYKDVMMENYGNLVSLDVLNRDKDEEPAVKQEIEELEEVEPQGVIVTRIKSEIDQDPM

SEQ ID NO: 10348 - protein, 81 aa, Heterocephalus glaber
VTFEDVALDFTQEEWVLLDQSHRDLYREVMLENYENLTSRGKNPVVSFGLLGRRWRLCTSCVTAWVMWTLCPLGNERDIAS

SEQ ID NO: 10349 - protein, 81 aa, Heterocephalus glaber
MELLIFRDMAIHFSPEQWECLEAALQNMYRDVMLETYGNLVSLGFAGSTLNPITFLEQSREPRNVKRQETLAVYPGGHLQR

SEQ ID NO: 10350 - protein, 81 aa, Mus caroli
MLSFWDVAIDFSPEEWDCLEPAQWDLYRDVMLENYSHLVFLGLAVSKPFLVTFLEQRQGPWDMKRQGMATVYPGIIPNDPN

SEQ ID NO: 10351 - protein, 81 aa, Mus caroli
MATSEPAESDAEWEQLEPVQRNVYKDTKLENCSNPDSMGNQDTKQDIVSKLEEEEPSSGKGKKTSPSSLDKIARPKKAGTS

SEQ ID NO: 10352 - protein, 81 aa, Mus caroli
MAAVTYEDVHVNFTHEEWVLLDPSQKSLYKDVMLETYWNLTAIGYKLEDLNSEEHPQRSRRYGRHKICHSEYKPCELKGHG

SEQ ID NO: 10353 - protein, 81 aa, Mus caroli
LQESVSFEDVSVDFTQEEWNQLDPIQRSLYRDVMLENYSHLVSLGYPITKPEVITSLEQGVLGIIKREIPSSSCTEDGQAE

SEQ ID NO: 10354 - protein, 81 aa, Mus musculus
DMGLVSFEDVAVDFTWQEWQELDAAQRTLYRDVMLENYRSLVWLGHCLAKPELISKLEEGFEPWGVAEATEQCLPCAEDQT

SEQ ID NO: 10355 - protein, 81 aa, Peromyscus maniculatus
VCGSVTFRDVAVDFSQEEWACLDATQRVLYRDMMLETYSNLVTVVGSSVSKPDLIALLEQEREPWMVVKEETDRPSPDLES

SEQ ID NO: 10356 - protein, 81 aa, Peromyscus maniculatus
PQESVTFKDVAVDFTQEEWHHVDPAQKILYRDVMLENYSHLVSLGCQVSKPEVIFKLEQGEEPWISEREIQRPFCPAFCLN

SEQ ID NO: 10357 - protein, 81 aa, Peromyscus maniculatus
MLENYNNMVSVERHFSKPNVISQLEEVEDFWPVEREIPQDIFPESSGPSLDPGINSFPDESPLTKINVVEVLTLNKDVAGP

SEQ ID NO: 10358 - protein, 80 aa, Peromyscus maniculatus
MVSEGPPSPCGEEPWEQDAVTYEDVHVNFTHEEWSLLDPSQKHLYKDVMLETYWNLTCIGYKWEDHNIEEHCQSCRRNGR

SEQ ID NO: 10359 - protein, 81 aa, Peromyscus maniculatus
HDMNTVTYDDVRIDFTWEEWTLLDPSQKNLYKDVMLETYRNLTSIGYIWEDHNIEEYCQSSRGHESTPVIPAQLVQDDDAD

SEQ ID NO: 10360 - protein, 81 aa, Peromyscus maniculatus
KKNAVTYDDVHVDFTWEEWTLLGLSQKNLYKDVMLETYMNLTTIGYSWEDPNIKEHCQSSRGHQRHNGSQSREKPVYTQCV

SEQ ID NO: 10361 - protein, 81 aa, Mesocricetus auratus
TNLKGTSKDVTVDFTQEEWQQLDPAQKALYRDVMLENYCHFISVGFHITKPDMIRKLEQGEELWTERIFPSQSYLEDEDVL

SEQ ID NO: 10362 - protein, 81 aa, Mesocricetus auratus
NAVTYEDLHIDFTWEEWTLMDPSQKNLYKDVMLETYRNLTAIGYSWKDHHIEDYQSSRRYERNERSQTGEKPSIYTQGVKT

SEQ ID NO: 10363 - protein, 81 aa, Mesocricetus auratus
SQVLLTFRDVTVDFSQEEWQCLDSAQRTLYIDVMLENYNNLLYVENYCVCDPVHHHVNNEKESRWCHDLGKVLHDPSTCAL

SEQ ID NO: 10364 - protein, 81 aa, Ictidomys tridecemlineatus
MASPSSPLEPKEEWDYLDPAQRSLYKDVMMENYGNLVSLDVLNRDKDEEPTVKQEIEEIEEEVEPQSVIVTRIKSEIDQDP

SEQ ID NO: 10365 - protein, 81 aa, Ictidomys tridecemlineatus
FQDLVTFRDVAVDFSQEEWNCLDSSQRHLYSNVMLENYNILVSLGLCFSKPSVIILLEQGKEPWMVKREFTNGLCSGWESM

SEQ ID NO: 10366 - protein, 81 aa, Ictidomys tridecemlineatus
WSQMPVTFEDVALYLSREEWGRLDHTQQNFYRDVLQKRNGLALGFPFSRPLWAAQVQGKGEAASSSRQTGAEKEEKRGPGS

SEQ ID NO: 10367 - protein, 81 aa, Ictidomys tridecemlineatus
TEGQLAFRDVAIEFSQEEWKCLDPTQRALYRDVMLENYRNLVSLGMCPSDPSVLSWLEQGREPWTVNGPDEWACVEGVKAG

SEQ ID NO: 10368 - protein, 81 aa, Ictidomys tridecemlineatus
GAVSFADVAVYFSPEEWGCLRPAQRVLYRDVMRETYGHLGALGDISNKEKLEPKEGPAARREMTPGKEQHEELVKHNPDCT

SEQ ID NO: 10369 - protein, 81 aa, Marmota monax
QQRPVSFKDVVVGFTQEEWRRLNPAQRALYRDVMLETYSNLVSVGYEGTKPDVILRLEQEEAPWICEAVCPGCHCQEDFLS

SEQ ID NO: 10370 - protein, 81 aa, Marmota monax
MLETYGHLLSVGNQMAKPEVISLLEQGEEPWLVEQTCPESSCPEWMRDHESSALIPTQSTFNEEPSHGMKLKRYIWDDPWF

SEQ ID NO: 10371 - protein, 81 aa, Marmota monax
SQASVSFKDVTVELSQEEWQHMGPAQRTLYREVMLENYSHLVSVGFCFTKPELIFTLEQGEDPWSLEKEKGFLNWSSPEDS

SEQ ID NO: 10372 - protein, 81 aa, Heterocephalus glaber
RPRALKFADVAVYFSPEEWGCLRPAQRTLYRDVMRETYGLLGALGCAGPKPALISWLERSTDDWEPAALDPQEYPRGVTVQ

SEQ ID NO: 10373 - protein, 81 aa, Heterocephalus glaber
LFQESLTLEDVAVRFTREEWQLLGPAQKDLYRDVMLENYSSLVSVGYQASQPDSLSSLLCGEPWMVEDELHCGTHSDLTLV

SEQ ID NO: 10374 - protein, 81 aa, Mus caroli
GCVTFQDVAICFSHEEWRLLDETQRLLYLSVMLQNFALINSQGCGHRTEDEERRVSTRASKGLRSETTPKTNLCEKCVPIL

SEQ ID NO: 10375 - protein, 81 aa, Mus caroli
MATSEPAESDAVRAEWEQLEPVQRNVYKDTKLENCSNPDSMGNQDTKQDIVSKLEEEEPSSGKGKKTSPSSLDKIARPKKA

SEQ ID NO: 10376 - protein, 81 aa, Mus caroli
DSDVMTCHWATCCWSMSYNAVTYEDVHVNFTREEWALLDPSQKSLYKDVILETYRNLTALGYNWEDCNIEEHCQSSRRHGR

SEQ ID NO: 10377 - protein, 81 aa, Mus caroli
VDMGLVSFEDVAVDFTWQEWQELDAAQRTLYRDVMLENYRSLVWLGVRKWSAPVEKSQQSHEKYLRQVKIIKKNTSDEDKV

SEQ ID NO: 10378 - protein, 81 aa, Mus caroli
VQDLVTFKDVAVLFTQEEWGRLSSAQRALYRDVMLENYSNLVSLGLLGSRPDMFFPLEEVEECVSEEAPEGFVLDAADEPH

SEQ ID NO: 10379 - protein, 81 aa, Mus caroli
VSFEDVAVHFTQDEWALLDPSQKSLYRDVMLETCRSLAAIGYIWEEQNVEDDCKNFGRIQRHVISDSEHLLDEQEGYGNKP

SEQ ID NO: 10380 - protein, 81 aa, Neotoma lepida
LPLTFEDVAIYFSEQEWRRLEAWQRELYKHVMRTNYEILVSLDNGLPKPELISWIELGSELFSSWGEEQKLEEGIRSSADD

SEQ ID NO: 10381 - protein, 81 aa, Mus musculus
VCGSVTFRDVAVDFSQEEWAFLDATQKVLYRDMMLETYSNLVAVVGSCISKPDLIVLLEQEKEPWMAVKEETDWPSPDLEA

SEQ ID NO: 10382 - protein, 81 aa, Mus caroli
SQGLLTFRDVTVDFSQEEWECLDSAQRALYIDVMLENYSNLVYVENYCICDTVCQHVKTEKESCQCNELGEMLHEPSNCVL

SEQ ID NO: 10383 - protein, 81 aa, Mus caroli
VCGSVTFRDVAVDFSQEEWACLDATQKVLYRDMMLETYSNLVAVVGSCISKPDLIVLLEQEKEPWMTVKEETDRPSPDLEL

SEQ ID NO: 10384 - protein, 81 aa, Mus musculus
VEEPVTFKDVAVAFTQEEWGQLDLVQRTLYRDVMLETYGHLLSVGNQIAKPEVISLLEQGEEPWSVEQGYPKSSCPEWMRN

SEQ ID NO: 10385 - protein, 81 aa, Mus musculus
MEDPLSFTDVSIDFSADECECLDSAQWNLYKEVMLENYSNLVFLGLAFSKPYLVTFLEQSSDPWSMKRKESAAIHLGSKPH

SEQ ID NO: 10386 - protein, 81 aa, Mus musculus
VSFEDLVVHFTQDEWDLLAPSQKTLYGDVMLETFRNFTAVGYEWEDEAIEDHCEDPEVNLRNIVTHSEYTQYEHEEYEEKP

SEQ ID NO: 10387 - protein, 81 aa, Mus musculus
DSTGCCERRLVKLRTPNMDLVTYDDVHVNFTQEEWALLDASQKSLYKGVMVETYRNLTAIGYSWEEHTIEDHFQTSRSHGR

SEQ ID NO: 10388 - protein, 81 aa, Cricetulus griseus
TEPIEFEDVSLTFTEEEWALLGHEQKCLYKEIMLENYNNVISVGQKRVPHIIMDICEPQFAGSELGSGHREEQPVVLATDT

SEQ ID NO: 10389 - protein, 81 aa, Cricetulus griseus
GNQFCFQSLLTFKDVAINFSKEEWECLHTSQKDLYRDVMLENYSNLVSVGLFESKPELVTCLEENKEPWMVNIDEAEGLGQ

SEQ ID NO: 10390 - protein, 81 aa, Cricetulus griseus
AVTFKDVAVVFSEEELGLLSAAQRKLYRDVMLETFRNLLSVGGQGPNKMETLHEAGLSCLLLGRLPCWQMMSQGVNELART

SEQ ID NO: 10391 - protein, 81 aa, Cricetulus griseus
QEFILPYRDVSVDFTKEEWQCLDSDQRALYIDVMLENYNNLIFVENYYSSDPAHQRVRIQKKPCQCSELGKVLHDPSMCAF

SEQ ID NO: 10392 - protein, 81 aa, Cricetulus griseus
CALQIYFGLFANTALDLLTGNMSSRKDAVTYDEVHTNFTQEEWAFLDPSQKRLYEDVMLDTYRLLLNGNAMLFRLLAFRSA

SEQ ID NO: 10393 - protein, 81 aa, Cricetulus griseus
MSRSKDVAVAFTQEEWRQLGSEEKTTYRDVMLENYSNLISVGYDVTKPNVIIKLEQGEEPWMMEGDCHAQSHLEISKVGDT

SEQ ID NO: 10394 - protein, 81 aa, Cricetulus griseus
LLIRWQVLQLNNLAYGANKVSNNHHNVSKDHKTVNQFLFQSLLTFKDVALNFLREEWECLNTSQRNLYRDVMLENYGNLVS

SEQ ID NO: 10395 - protein, 81 aa, Cricetulus griseus
EKQFSFQSLLTFEDVAIKFSKEEWECLNTSQRHLYRFVMLENYSNLVSVGLSVSKPELVIFLEQNKEPWMVNIEESEVLEP

SEQ ID NO: 10396 - protein, 81 aa, Cricetulus griseus
GCVTFEDVAVYFCREEWELLDESQRLLYLDVMLENFALIASLDCWHEAETGETACAQSVSPTEEPQVRAPKEGLPTKKTHP

SEQ ID NO: 10397 - protein, 81 aa, Cricetulus griseus
EVCLVGRGGMGVRSRFRWLALLAGPRRAQTGCLNQNKWIPPSKSHAGFLVFKPELISRLEQGQEPWVLDLQGAEGTEAPWI

SEQ ID NO: 10398 - protein, 81 aa, Cricetulus griseus
IQGVLTFRDVTVDFPQEEWECLDSAQRALYIDVMLENYSNLVSVENYYVCDPVHYHVKTEKESCQCNEVGKVLHDPSTCAL

SEQ ID NO: 10399 - protein, 81 aa, Cricetulus griseus
MFRDVTVDFSQEEWECLNSSERDLYKDVMLENYSHLVSLAGHSISKPDVITLLEQGKEPWMIVRDEKRRWSQELESRYSSK

SEQ ID NO: 10400 - protein, 81 aa, Cricetulus griseus
NAVTYDDVHVNFTSDEWALMDTSQKNLYKEVMRDTYRNLTDIGYNWEDNNIEEPDQISTQHGRHEKIQSEEESSQYIRCGK

SEQ ID NO: 10401 - protein, 81 aa, Cricetulus griseus
KHSPTSTLHLQEAVTWVLGIDLWALCKSHEHIWILIRFRTRMEFKKMKMSGEPAPDLVTFSDVAIDFSQEEWACLDSVQRD

SEQ ID NO: 10402 - protein, 81 aa, Cricetulus griseus
KKLLPGVLDVALDFSQEEWECLDSAQRALYSDVMLENYSNLVPVGLTLSKPELLNSLEDSEEPWNVNMGETEDKEQGNAFA

SEQ ID NO: 10403 - protein, 81 aa, Cricetulus griseus
MACSKVSNHHQKGNQFCFQSLLTFKDVAINFSKEEWECLHTSQKDLYRDVMLENYGNLVSVGENQSFSDCSLGLGMSINFY

SEQ ID NO: 10404 - protein, 80 aa, Castor canadensis
MNISQASVSLKDVTVELTQEEWQHMDPFQRTLYRDVMLENYSHLVSVGYCIFKPEVIFRLEQGEEPWLLEEEFPSQSFAG

SEQ ID NO: 10405 - protein, 81 aa, Peromyscus maniculatus
MLENYRNLASMGFPLLKPALISQLEEGKDLENLSQLATGTDSQGLWTEYTAIQTGNNLTKEVCEEKRSILFELQKDFFQET

SEQ ID NO: 10406 - protein, 81 aa, Peromyscus maniculatus
MEEMLSFWDVAIEFSAEERECLEPAQWNLYRDVMLENYSNLDFLGLAESKPHLVTLLEQRQESSDVTRQAAANVQPGTTTD

SEQ ID NO: 10407 - protein, 81 aa, Peromyscus maniculatus
SQVSVTFEDVAVLFTRDEWRKLDHSQRSLYREVMLENYSNLASLGCPFTKPKVISLLQQGEDPWKVEKEGPGDSSRGLTRS

SEQ ID NO: 10408 - protein, 81 aa, Peromyscus maniculatus
MDAVTYEDVHVNFTHEEWALLDPCQKSLYKDVMLETYWNLSAVGYKWGDENIEHCQSSRRHGRYVICHSGYKPCECKGYGK

SEQ ID NO: 10409 - protein, 81 aa, Peromyscus maniculatus
MNTVTYDDVHIGFTWEEWTLLDPSQKNLYKDVMLETYRNLAIIGYSWEDHNIEEHYQNSRRHERHERSQTGMKTSVHTQCS

SEQ ID NO: 10410 - protein, 81 aa, Peromyscus maniculatus
MESVTFDDVAVNFTLGEWALLDSSQKKLYRDVMTETFMNLISIGKTNEKENIEDNYQNLRKNVRTQVLERNCDYGDGGQCG

SEQ ID NO: 10411 - protein, 81 aa, Peromyscus maniculatus
AVNAVTYNDVHVDITQEEWALMDPSQRNLYKDVMVETYMNLTAIGYNWEDLEVEEHCQWSQKHGRHERPHTTEKSCEYMGC

SEQ ID NO: 10412 - protein, 81 aa, Peromyscus maniculatus
ADAVTYEDVHVNFTHEEWALLDPSQKSLYKDVMLETYWNLISTGYKWEDHNIEEHCQSSRRNKRDVICHSGYKACDHKGYG

SEQ ID NO: 10413 - protein, 81 aa, Peromyscus maniculatus
AGSKLSFRDVAIDFSPEEYECLGPAQWDLYSDVMLENYSNLVSLGLAFSKPYLITFLEQRKQPWNVKQQATVAVYPGIKPY

SEQ ID NO: 10414 - protein, 81 aa, Peromyscus maniculatus
QAQESLTLDDVAVVFSWEEWQLLSHAQKDLYWDVMLETCKSLVSMGYLTRKSDVCSQLDPGVPWTIEDEIHNLICPEIREV

SEQ ID NO: 10415 - protein, 81 aa, Peromyscus maniculatus
EPQQCGWTRFSIYLAAPLLHGWNLGAGLTPGHVSILSFSASHTAGFLVFKPELISRLEQGQEPWVLDLQGAEGTEAPWICQ

SEQ ID NO: 10416 - protein, 81 aa, Peromyscus maniculatus
DPVTYEDVHVNFTHEEWALLDPSQKSLYKDVMLETYWNLTCIGYKWEDHNIEEHCQSCRRNGRCVICHSGYNPCEHKGCGK

SEQ ID NO: 10417 - protein, 81 aa, Ictidomys tridecemlineatus
SQVSVTFEDVAVLFTRDEWRKLDPSQRSLYREVMLENYSNLASLGPPFTKPKVISLLQQGEDPWKVEKESPGDSSIGYKSS

SEQ ID NO: 10418 - protein, 81 aa, Marmota monax
DHELVTFRDVVINFSQEEWEYLDSAQRDLYWDVMMENYSNLVSLDLESRCETEILSVRKDVFENSGSQLEVMENSNLIDFK

SEQ ID NO: 10419 - protein, 81 aa, Marmota monax
WSQMPVTFEDVALYLSREEWGRLDHTQQNFYRDVLQKRNGLALGFPFSRPLWAPQVQGKGEAASSSRQTGAEKEEKRGPGS

SEQ ID NO: 10420 - protein, 81 aa, Marmota monax
MTRGFSYKKSVHQIPAHRHLYRDIRKESVGTMVSLGSTVSTSNKISRLEQRKEPWTIGLHSSNKRNILRSNCIKEKSVHAI

SEQ ID NO: 10421 - protein, 81 aa, Marmota monax
TDELVTFRDVAIDFSQEEWECLDPAQRDLYMDVMLENYSNWVSLDLDSTYETKNIFSEKDIFEIKFSRWDTKEESKTLGLE

SEQ ID NO: 10422 - protein, 81 aa, Marmota monax
FKGPVTFKDVTVEFTKEEWKLLTPAQRTLYKDVMLENYNHLVSVGYRVSKPNLVFKLKQGKEPWVLEVEFPRRRCPEELWN

SEQ ID NO: 10423 - protein, 81 aa, Marmota monax
PQLPESIEDVAMYISQEEWGHQDPNKRVLSRDTVQESYENVDSLESHIPSQEALKTQVEQGGKPWDPSVQSCKEGVSPRSA

SEQ ID NO: 10424 - protein, 81 aa, Heterocephalus glaber
SQGLVTIKDVSLCFSQEEWRSLDPSQTDFYGEYVMQENCGIVVSLRFPIPKLDMLSQLGGGEEQWVPGPQDLEERDILRVT

SEQ ID NO: 10425 - protein, 81 aa, Heterocephalus glaber
EAVTFEDVAVNFTKEEWAFLDPSQKKLYRDVMWETLRNLAAIGRSSGDQQIEDEYKTWSKSLSHSEMNTYACIPCGKSFNS

SEQ ID NO: 10426 - protein, 81 aa, Heterocephalus glaber
MLKEAVTFKDVAVAFTEEELGLLDSAQRKLYQDVMVENFRNLVSVEHQLFKQDRSHVERDEKLWMMKAETQRERSLGKDQA

SEQ ID NO: 10427 - protein, 81 aa, Heterocephalus glaber
AVTFEDVAVNFTMEEWALLDPSQKKLYRDVMWENFRNVASIGRNWDNQQIEDEYKNYWENLRNAEVVNLWYQHGKMVFVTP

SEQ ID NO: 10428 - protein, 81 aa, Heterocephalus glaber
VTFEDVAVNFTAEEWALLDPSQKKLYRDVMWETFRNVTAIERNCNDQQVEDEYKSCRRNRRSEEVDKWYQHELWYQHEDMM

SEQ ID NO: 10429 - protein, 81 aa, Mus caroli
MEAVTFGDVAVHFSREEWQCLDSGQRALYREVMLENHSSVAGLGFLVFKPELISRLEQGQEPWVLDLQGAEGAEAPRICQT

SEQ ID NO: 10430 - protein, 81 aa, Mus musculus
NLITYDDVHVNFTQEEWALLDPSHKNLYKDVMVETYRNLTAIGYIWEEHTSEDHFQNSRSHGRHERSCSAEQLSEFIHCGK

SEQ ID NO: 10431 - protein, 81 aa, Mus musculus
MMGSQEEWEQLDPSQRILYMDVMLENYSNLLSVEVWKADGQVERDPRDLQRQVGSLTTIKNQPPTEERGSRFGKTLTLNTD

SEQ ID NO: 10432 - protein, 81 aa, Mus musculus
KPWAVNFADVAVYFSPEEWRYLRPAQRALYREVMRETYGLLAYLDVGCAKPALICWVEEESEVWGPCAQDPEVAMCRTEVH

SEQ ID NO: 10433 - protein, 81 aa, Cavia porcellus
RTIEKAGPPSGPERPEVCGAGRASKARFRRRRAVRTSGGPQAGHGEAGFLVFKPELISRLEQGQEPWVLDLQGAEGTEASR

SEQ ID NO: 10434 - protein, 81 aa, Cricetulus griseus
EQEMLSFWDVAIEFSPEERKCLDPAQWNLYRNVMLENYSNLEFLGLAVPKPHLVTFLEQKQEPSGVKRQAAATVYPGTTTN

SEQ ID NO: 10435 - protein, 81 aa, Cricetulus griseus
MDFSLEEVEYLDPAQRALYKTLMIENYSSLISVGAEEVLSLFLTQKAERREQQGEMDGPVVNTSQGLLTFRDVAVDFSQEE

SEQ ID NO: 10436 - protein, 81 aa, Cricetulus griseus
SSGLVTFGDVAVFFTQEEWERLSPGQRRPYWKVMLENYRSLASLGLCASKPDMITLLEEGKDPWVMERELARGLCPDLKAV

SEQ ID NO: 10437 - protein, 81 aa, Cricetulus griseus
ALGLVSFEDVAVDFTWQEWQELDAAQRTLYRDVMLENYSSLVSLGHCVTKPELIFRLEHGFGPWSIGETSLWNLPEFVNLT

SEQ ID NO: 10438 - protein, 81 aa, Cricetulus griseus
AEVAFTFEDVAVIFTQEEWGQLAPAQRTLYQEVMLENRGLLVSLGYPVPKPELMCQLERGQELWSVMRNLSPRIGAVHMCA

SEQ ID NO: 10439 - protein, 81 aa, Cricetulus griseus
MLENYSNLVSVGLSVSKPELVTCLEQNKEPWMVNIEEADVLEPDSGEEKPSMLEACDNTCTQSSKLQVHQIHNGEKHYKCK

SEQ ID NO: 10440 - protein, 81 aa, Peromyscus maniculatus
DVERLTFEDVSIDFSPGERECLDPARWNLYRDVMLENYRNLVFLGLAVCKPDLVTFLEQRKEPWNVERQESVTICPENLYK

SEQ ID NO: 10441 - protein, 81 aa, Peromyscus maniculatus
MESVNFEDVAVRFTKEEWALLDPSQKKLYKDVMQETLRNLAAIGNKLENQKVVNEYENLCRKLSSQLVEIFCEYKESLQCT

SEQ ID NO: 10442 - protein, 81 aa, Peromyscus maniculatus
MGELENHDMEEWALLDLSQKNIYKDVMLETYINLTAIGYRWEDLNIEEHCQSPRRHGRYERSHTGEKPYECNQCDKGFSPH

SEQ ID NO: 10443 - protein, 81 aa, Peromyscus maniculatus
MEEMLSFRDVAIDFSAEEWECLDLAQWNLYRDVMLENYSNLVFLGLASCKPYLVTFLEQRQGPSDVKRQAAAPVHPGGTPY

SEQ ID NO: 10444 - protein, 81 aa, Peromyscus maniculatus
VSFEDVAVHFTQEEWALLDPSQKSLYRDVMQETCRNLAAIGYIWEEQNIEDDCKNFGRYQRHIISHSEYTPYEHEEYGNKP

SEQ ID NO: 10445 - protein, 81 aa, Peromyscus maniculatus
MVTFRDVAVDFSQEEWDCLNSSQRHLYSHVMLENYRILVSLGLCFSKPSVIILLEQGKEPWPAKTELTDSLSTDWESMYVT

SEQ ID NO: 10446 - protein, 81 aa, Peromyscus maniculatus
PKVPMTFDDVAVYFSELEWAKLEDWQKELYKHVMRNNYESLVSLDSAISKPDILIRIERGEEPCPADPWGQTGSEEEAACP

SEQ ID NO: 10447 - protein, 81 aa, Peromyscus maniculatus
DMNAVTYDDVHVNFTWEEWALLDPSQKNLYKDVMLETYRNLTSIGYSWEDHNIEEHCQSSRRRKRHERSQIGKKTSVNTQW

SEQ ID NO: 10448 - protein, 81 aa, Peromyscus maniculatus
NAVTYNDVHVDFTQEEWALMDPSQRNLYKDVMVETYMNLTAIGYNWEDLEVEEHCQNSLKHGRHKRPHTTEKSCEYMGCGK

SEQ ID NO: 10449 - protein, 81 aa, Peromyscus maniculatus
LKDAVTYNDVHVNFTQEEWALLDPSQKNLYRDVMLETYMNLTDIGYNWEDHKVEEHCQSYQRYGRHERSHTGEQTSEYTEC

SEQ ID NO: 10450 - protein, 81 aa, Peromyscus maniculatus
IQNTVTYDDVHIDFTWEEWTLLDPSQRNLYKDVMVETYTNLTAVGYSWEDHNMEEHCQSSQRQRRYKRSNTGEKPCEYTQC

SEQ ID NO: 10451 - protein, 81 aa, Peromyscus maniculatus
TENAVTYDDVHVGFTWEEWALLDPSQKNLYKDVMLDTYRNLTTIGYSWEGHNIEEHFQSSRRHERHKRSDTGENSSVYTQC

SEQ ID NO: 10452 - protein, 81 aa, Mesocricetus auratus
FQSEVVFRDVTVDFSQEEWECLNSSERDLYKDVMLENYSHLVALAGCSISKPDVITLLEQGKEPWMIVRDEKRRWSQELEP

SEQ ID NO: 10453 - protein, 81 aa, Mesocricetus auratus
MEKLLSFGDVAIDFSAEERECLDLAQWNLYREVMLENYSHLVFLGLAVSKPHLITLLEQRQEPWSVKRRVGAHPGSKSLLV

SEQ ID NO: 10454 - protein, 81 aa, Mesocricetus auratus
MEEMLSFRDVAIDFSAEEWECLGPAQWNLYRDVMLENYSNLVFLGLAFSKPYLVTFLEQRQEPTDVKRQDAATMHPDIKPY

SEQ ID NO: 10455 - protein, 81 aa, Mesocricetus auratus
METVTFEDVAVDFTLEEWALLDSSQKKLYRDVMKETFFNLISIEKTLEERIEEDYKNLNRNTGSPVLEEDCGYECDTECDK

SEQ ID NO: 10456 - protein, 81 aa, Mesocricetus auratus
VSFEDLAVNFTQEEWDLLDSSQRSLYGDVMLETCRNLTAIGYEWDDQAVGEHYEEPEINLRHIVSHSECTQYENEEYEQKP

SEQ ID NO: 10457 - protein, 81 aa, Mesocricetus auratus
MEPVTFDDVAVDFTVGEWALLDPTQKKLYSTVMEETFLNLISIEEALGENIEEDYKELSRNMGAQVIEKACEYKCASRCDT

SEQ ID NO: 10458 - protein, 81 aa, Mesocricetus auratus
HKKSMVFSDVSLDFSQEEWECLGPAQRDLYRDVMLENYSNLLSVGLHIPKPQVISLLEQGKEPWMIGKELTRGLCSALESM

SEQ ID NO: 10459 - protein, 81 aa, Ictidomys tridecemlineatus
MSKISFSKPDVISLLEQGKEPWIVKKEGTRVTCPDWEYVFKNSDFSSKQDVYQESAKAVTLGRSHLSHSLVCPSWKPCVSE

SEQ ID NO: 10460 - protein, 81 aa, Ictidomys tridecemlineatus
FQESVTFKDVVVDFTQEEWKQLDPIQRDLFRDVTLENYTHLVSIGLQVSKPDVISQLEQGTEPWTVEPLWETRPEDSVPRP

SEQ ID NO: 10461 - protein, 81 aa, Ictidomys tridecemlineatus
MDFTREEWQQLDPAQRHLYKDVMLEIYSHLFSVEEFGLDILQQEVSEKASFQNDMVSETTRGGSWCSILEELWRDADLTKR

SEQ ID NO: 10462 - protein, 81 aa, Ictidomys tridecemlineatus
MDLAVRFSEEEWRLLEEQQREFYRDVMRENYETLVSVGTDELLPLSAFLSPTEPGAAMGGGSRGDKGQEPPVKGSPQGRQP

SEQ ID NO: 10463 - protein, 81 aa, Marmota monax
SKDLVTFGDVSVSFTQEEWEWLNPTQRTLYRKVMLENYRSLVSLGISFSKPDVISLLEQGKEPWIVKKEGTRGTCPDWEYL

SEQ ID NO: 10464 - protein, 81 aa, Heterocephalus glaber
MLETFQNLVSLGYQVSIPHLISQWEQEEDLLKVKGGLIQGICMKEHQEGFETQLNTNELVAFQDIDGEKTSREQKIRVKRT

SEQ ID NO: 10465 - protein, 81 aa, Mus musculus
MGLISFEDVAVDFTWEEWQDLDAAQRTLYRDVMLETYISLVSLGHCMNKPELIFKLEQGLGPWSVAEASDRNLSDFHILTA

SEQ ID NO: 10466 - protein, 81 aa, Rattus norvegicus
EMVTFRDVAVVFSEEELGLLDAAQRKLYGEVMLENFRMLLSVEYQLFKQEKPQLEREEKPREQGSGMNNQSERGAVQGGRS

SEQ ID NO: 10467 - protein, 81 aa, Rattus norvegicus
FLESVTFKDVVVNFTQEEWKHLDPTQRDLFRDVTLENYTHLVSIGLQVSKPDMISHLEQGTEPWIEESCIPVGSLEGFRLI

SEQ ID NO: 10468 - protein, 81 aa, Mus musculus
PQDLLTFNDVALNFSLEEWECLNFAQRTLYMEVMLENYNNVLFVENQCICGKNESFLDQDIQHIVNEHGHIRKKSSKCNEL

SEQ ID NO: 10469 - protein, 81 aa, Mus musculus
EQLTFRDVAVDFSPDEWECLDPPQQRLYRDVMVENYRNLVSVALSHHCTQNFSPEQILKYSFTEVTNGSYSLQHLYLREDC

SEQ ID NO: 10470 - protein, 81 aa, Mus musculus
NMDLLTYDDVHVNFTQEEWALLDASQKSLYKGVMVETYRNLTAIGYSWEEHTIEDHFQTSRSLGRHERRSSAEQHSEFIPC

SEQ ID NO: 10471 - protein, 81 aa, Cavia porcellus
GWVPALFDEVAIYFSDEEWEVLTEQQKALYREVMRMNYETVLSLEFPFPKPDMISRLEQEEESPNSDKWQLQRGTSAAPRT

SEQ ID NO: 10472 - protein, 81 aa, Cricetulus griseus
MVVNFTSGEWALLDSSQKKLYRDVMKETFLNLISIEEAIEENIGENCKDLSRNTRSQAIDKYYICTCDHECNKNGKSITEN

SEQ ID NO: 10473 - protein, 81 aa, Cricetulus griseus
ASIQGTSDVAMDFSLEEVEYLDPAQRALYKTLMIENYSSLISVENYCMCAIVHQHVESEEKYSKCNELGKMLHESTRCTVY

SEQ ID NO: 10474 - protein, 81 aa, Ictidomys tridecemlineatus
RVVFEDVAIYFSQEEWGHLDEAQRFLYCEVMLENLTLLSSLGCWNGAEAEKAAPEQGVSVGAPQVRTPKPGSSTQNAQPSE

SEQ ID NO: 10475 - protein, 81 aa, Ictidomys tridecemlineatus
EPGAVSFADVAVYFSPEEWGCLRPAQRVLYRDVMRETYGHLGALGFPGPKPALISWMEQESEAWSSAAQDPEEGESLGGAL

SEQ ID NO: 10476 - protein, 81 aa, Ictidomys tridecemlineatus
MLENYSSLLFLGYQIIKPDAVFKLDQEESWTVYEETLHQNVSEIWLDSDSKICHQDNQDKLKSMEKGHGCDVLGKIFNSSM

SEQ ID NO: 10477 - protein, 81 aa, Marmota monax
MLENYSNLVSVGYPVSKPDALSKLEQGEEPWTEDEMHTWICPENDKVDHLQGHSENQRMLKIIKKYELQNKSHFPFKENHN

SEQ ID NO: 10478 - protein, 81 aa, Marmota monax
LQGMVSFEDVSVDFTWEEWQDLDDAQRTLYRDVMLETYSSLVFLGLFITRPEVIFKLEQGTEPWLVKEALDRCLPDVQIVD

SEQ ID NO: 10479 - protein, 81 aa, Marmota monax
MLENYNNLITVGYPFTKPEVIFKLEQEEEPWVVEEEVFRRHCSGEIWGTDEHQKTQDRLLRQVFKNTLTEEKVKEYPKKFA

SEQ ID NO: 10480 - protein, 81 aa, Marmota monax
AHKLVKFSDVSVVFSQREWKCLNPTQRELYRDVMLENYSNLVSLGYSASKPEVITLLEQGKEPFIVIGDVQGRRCAGLFSR

SEQ ID NO: 10481 - protein, 81 aa, Marmota monax
MLENYSNLVSVGYHIIKPDVIIKLEQGEEPWIVEGEFPPQSYPDEVWQVEDPMEKLQEDEDMFFINKTLGEERGNVSGKAF

SEQ ID NO: 10482 - protein, 81 aa, Heterocephalus glaber
MLTFRDVAIDFSVEEWEFLEPAQQNLYRDVMIENYRNLLSLGLAVTKPYLITFLEQSKELWDVKSQGTAAIHPAMSSHHTE

SEQ ID NO: 10483 - protein, 81 aa, Heterocephalus glaber
SQGSVSFTDVTVGFTQEEWQHLDTSQKSLYRDVMLENYNHLVSVGYCVTKPELIFRLEQGEEPWILEEEFSRQSFSEFWKT

SEQ ID NO: 10484 - protein, 81 aa, Heterocephalus glaber
WQGCVTFDDVAIYFTWEEWRLLDEAQRLLYFNVMLQNFALTSSLGCGHGTQDEEAPSEQIGSVGVSQAQTCKTGPSIKKTY

SEQ ID NO: 10485 - protein, 81 aa, Mus caroli
MEEILSFRDVAIDFSAEEWECLEPAQWNLYRDVMLENYSHLVFLGLAFSKPYLVTFLEQRQDPLDEKKQVATTMHPDIKPY

SEQ ID NO: 10486 - protein, 81 aa, Neotoma lepida
PLTFKDVAISFSKEEWKCLDTSQRDLYREVMLENYSNLVSVAMFCYPIHEFFPKKHTQSICQTEIPGQCGCNSFGELHIRK

SEQ ID NO: 10487 - protein, 81 aa, Mus musculus
QEAVTFRDVAVVFSEEEMGLLDAAQRKLYHDVMLENFLNLLAVGSQSPNKVDTLDLTGLRHLSLGWLPCWHMTGHDVKKLA

SEQ ID NO: 10488 - protein, 81 aa, Mus musculus
VMESVSFEDIAVFFTWEEWQDLDIAQKLLYRDVMLENYSSLVSLGCCVIKPELILMLEREFGPWRVADTSVWNLPGYCMTR

SEQ ID NO: 10489 - protein, 81 aa, Mus musculus
SQGLLAFNDVAVEFSQEEWGCLDSAQRSLYINVMLENYNNLVSVENYCIRDTVDQHVNTEKESCQYNELGKILHEHFKCAL

SEQ ID NO: 10490 - protein, 81 aa, Mus musculus
MLSFRDVAIDFSAEEWECLEPAQWHLYRDVMLENYSHLVFLELADSKPQLVTFLEQRQQSTGVKRQEVLQTPGNCGEGIRS

SEQ ID NO: 10491 - protein, 81 aa, Mus musculus
VTFEDVAVNFTLGEWALLDSYQKELYRDVMKETFSNLISIGKSEEDNIEDYQNIRRNLSTLMVEGFYEFERGIQYREMHQQ

SEQ ID NO: 10492 - protein, 81 aa, Mus musculus
MGVVTYDDVHVNFTQEEWALLDSSQKNLYRDVMLETYRNLAAIGYSWEDHNPEEHFQSSRRHGRHEKSHIEKKPSEFTQCG

SEQ ID NO: 10493 - protein, 81 aa, Mus musculus
PCERLVSFEDVTVNFSQEEWQHLDSAQRRLYQDVLLEIYSHLLVVGYSRPEVILKMKKVKDSPMGKVDFPHQRCGQGEAEH

SEQ ID NO: 10494 - protein, 81 aa, Dipodomys ordii
PQAKVTFEDVAVLLSQEEWNQLGPAQRGLYRNVMMETYGNVVSLGLPGSKPSVISQLERGEDPWVLDGPGAEESQGLGQSL

SEQ ID NO: 10495 - protein, 81 aa, Fukomys damarensis
MEEWALLNPSQKKLYRDVMGETFRNMATIERTWDNQEAEEDYRNYWRNLRNEEVEKCYQYKAWNQYKETFLCTPVANVHGK

SEQ ID NO: 10496 - protein, 81 aa, Rattus norvegicus
EWEQLEPGQRNVYKDTKLENCSNPASMGNQDPKQDLVSKLDGEEERWSSVRANKNSSSSLHRLKKTGTSAKVQQDGAQTEG

SEQ ID NO: 10497 - protein, 81 aa, Mus musculus
VRSQEAMTFKDVAMDFTPEEWGKLDPAHRAVMLENYRNLVSLWLPISKPDNYNSEDGKELSKLEKSPKCSDSDMETRPESK

SEQ ID NO: 10498 - protein, 81 aa, Mus musculus
MGRVTYDDVHVNFTWEEWALLDPSQKNLYRDVMLETYRNLAAIGYVWEDHNMEEHLHISRRYGRHERSHTEQLLSEFIQCD

SEQ ID NO: 10499 - protein, 81 aa, Mus musculus
MLSFRDVAVDFSAEEWECLEPAQWHLYRDVMLENYSHLVFLGLADSKPQLVTFLEQRQGSTGEERQAVKAVFPGITPNDPN

SEQ ID NO: 10500 - protein, 81 aa, Cricetulus griseus
ITGAVTFGDVAVDFSEEEWACLDAAQRAFYRDLMLETYSNLVTVVGSSISKPHLITLLEQEREPWMVVKEETDRPSPDLES

SEQ ID NO: 10501 - protein, 81 aa, Cricetulus griseus
EGQLTFRDVAIEFSQEEWECLDPAQRALHRDVMLENYSNLVSLGKDDFLRELRYLWCNFAVFLPGFVEPCGLSSFLPSSVP

SEQ ID NO: 10502 - protein, 81 aa, Cricetulus griseus
FQESVTFKDVSVNFTWEEWMQLDSVQRNLCGRVMLETYRNLVSLGHQLSKSNVISELEQGLSLREKELPGCISLVDLYYPL

SEQ ID NO: 10503 - protein, 81 aa, Cricetulus griseus
SLQTFEDVAINFSKEEWKCLNTSQRDLYRGFLWGNYSNLVSIGHSEYKPELVTCLEQNKEPWKVNIEEAERLEPDKVKGNN

SEQ ID NO: 10504 - protein, 81 aa, Marmota monax
EPLTFGDVAIDFSEEEWECLDPAQQNLYREVILETYSNLVFVAMTSHHPQEILPEQGIKEREGRYGKSDLDYLQLRKQWEN

SEQ ID NO: 10505 - protein, 81 aa, Marmota monax
GSVSFTDVTVDFTQEEWEQLDPSQRILYMDVMLENYSNLLSVEVWKADDQMERDHRNPDEQVKQFIILKNQTPVEERDNLF

SEQ ID NO: 10506 - protein, 81 aa, Marmota monax
MDFTPEEWGKLDPKQRDMMLENYRNLVSLWLPVSKPENYNLDSGEEPLKLERKTPKCSYSDVETLPESKDSSSVQDFSKDE

SEQ ID NO: 10507 - protein, 81 aa, Marmota monax
SQESLTFRDVFVDFTLEEWQQLDPAQKNLYRDVMLENYSHLVSLGYLLAQPDVLFRLGQGEEAWRADGRTPIQSCPEVWQV

SEQ ID NO: 10508 - protein, 81 aa, Marmota monax
FQESVTFRDVAIAFSQQEWQSLDSSQRDLYRDVMLENYRNLVSLGHSLSKPHVITLLEQWKDPWETGRKDKRRRCADLQLE

SEQ ID NO: 10509 - protein, 81 aa, Marmota monax
SQEQVSFKDVCVDFTKEEWSLLDPAQKILYRDVILENYSNLVSVGYCVTKPEVIFKIEQGEEPWILEKEFPSQCHSERKWK

SEQ ID NO: 10510 - protein, 81 aa, Heterocephalus glaber
MYRDVMLETYRNLVSLGFAGSTPNLITFLEQSKEPCNVKRQETLAVYPAVSSHFAQGISSKQGRKCSFQNMTEERHSICGH

SEQ ID NO: 10511 - protein, 81 aa, Heterocephalus glaber
QESVTFEDVAVIFTDEEWRHLVPVQRALYQAVMLENYESIVSLGLPVPPPDVIFWLKRGDEPWREGPQGSEERECPQSISL

SEQ ID NO: 10512 - protein, 81 aa, Mus musculus
PQGLLTFKDVALDFSLEEWECLSFAQRTLYMDVMLENYNNLLFVENYCIRGKNGKVLDQDSQYIVHEHMNIQEKSSKWDKL

SEQ ID NO: 10513 - protein, 81 aa, Mus musculus
MNLVTYDDVHMNFTQEEGALLETSQKNLYKDVMLETYRNLSAIGYIWEEHTIENHFQTSRSHGRHERSCIAVQPSEFIQCG

SEQ ID NO: 10514 - protein, 81 aa, Mus musculus
SEGLVSFEDVSVDFTWDEWQDLDDSQRKLYRDVMLETYSSLLSLNQCDAKPELILKLEKEAEPWKEDDAPDQSLPDMQNVD

SEQ ID NO: 10515 - protein, 81 aa, Mus musculus
MDAVTFMDVHVNFSQEEWALLDPSQKSLYKDVMLETYWNLTCIGYDWEDNNSEECCQSSRRHGRYFNSSQYSTYKAKGYGK

SEQ ID NO: 10516 - protein, 81 aa, Fukomys damarensis
MAFRDVAVDFSQEEWSLLSPAQRSLYREVMLETYSHLESLGIPFSKPKLITQLEQGKEMWREERKCPLVTCPEPKLELQPG

SEQ ID NO: 10517 - protein, 81 aa, Rattus norvegicus
HKKQVAFSDVSLDFSQEEWACLGPAQRALYKDVMLENYSHLLSVGLHIPKPQVISLLEQGKEPWMVGKELTRGLCSALESM

SEQ ID NO: 10518 - protein, 81 aa, Rattus norvegicus
FQEMLSFRDVAIDFSAEEWECLDLAQWKLYRDVMLENYNNLVFLGLASCKPYLVTFLEQIQEPSDVKGRATTTMHPGGKCC

SEQ ID NO: 10519 - protein, 81 aa, Rattus norvegicus
ACGSVTFRDVAVDFSQEEWACLDATQKVLYRDAMLETYSHLVTVVGSCLSKPHLITLLEQEKEPWMAVKEETDRPSPELET

SEQ ID NO: 10520 - protein, 81 aa, Ictidomys tridecemlineatus
HFRIPEIVPSFLPSVQSIQFLPDFHLIGYPVSKPDVISKLEQGEDPWIIKREIPNWIYPDGNHAHERQERKSNLHNSQSYI

SEQ ID NO: 10521 - protein, 81 aa, Ictidomys tridecemlineatus
FEGSVSFEDVAVDFTRQEWHRLDPAQRTMHKDVMLETYSNLASVGLCVAKPEMIFKLERGEELWILEEESSDHGYSGSLSL

SEQ ID NO: 10522 - protein, 81 aa, Marmota monax
MEEVVLVTITFLLFFLNFNYFLLGGLPFIKPKVISLLQEGEDPWKVEKENPGGTSLAWKSHHKTTKSTQTQDSSFQRLIMN

SEQ ID NO: 10523 - protein, 81 aa, Marmota monax
GAVSFADVAVYFSPEEWGCLRPAQRVLYRDVMRETYGHLGALGDIPNKEKLEPKEGPTARRRGMTPGKEQHEEFVKHNPDS

SEQ ID NO: 10524 - protein, 81 aa, Marmota monax
EPQEAMTFKDVEVTFSLDEWGWLDSAQRNLYRDVMLENYGNMASLVGPFSKPALISWLEAREPWGLNIQAAKPKRDPGASP

SEQ ID NO: 10525 - protein, 81 aa, Marmota monax
EPLTLRDVVIDFSEEEWKCLDPSQQTLYGDVMLEIYRNLLFIGLTSNQNQEFSEEQEIKYFLQNLIKSRKHPCDHLKVLYN

SEQ ID NO: 10526 - protein, 81 aa, Marmota monax
MFEDVAVHFSWEEWGLLNATQRGLYRDVMLENFALVSSLGCLCRMKDEDAPPKQVKSCRVDLSEKPFVYERFVKDGPVTTG

SEQ ID NO: 10527 - protein, 81 aa, Heterocephalus glaber
QELVTVKDVSVDFTWKEWMQLDPAQRNLCGKVMLENYRNLISLGHQLSKPNVMSQLEQELGLRNKDLQGYVFPDWETRLED

SEQ ID NO: 10528 - protein, 81 aa, Heterocephalus glaber
VTFEDVTVTFTMEEWALLNPSQKKLYRDVMQETFRNMATVGGNWEKQKNEEEQIHCQTHEEGHQGEKPYVFKKCGKALSTN

SEQ ID NO: 10529 - protein, 81 aa, Mus caroli
FQEMLSFRDVAIDFSAEEWECLEPAQWDLYRDVMLENYSNLVFLGLASSKPYLVTCLEQIQEPSDVKRGAATSMLPAGEKC

SEQ ID NO: 10530 - protein, 81 aa, Mus caroli
MLSFRDVVIYFSEEEWECLEPAQWNLYRDVMLENYSNLVFLGLASSKPYLVTCLEQIQEISGGKCYKCKECGKVFVWTKVF

SEQ ID NO: 10531 - protein, 81 aa, Mus caroli
SKHLLTFRDVAVDFSQKEWERLDSSQRTLYIDVMVENYTNLVFVEKYSVRDTVHQHVRTEKESRQCNELGEMLHEPSNCAL

SEQ ID NO: 10532 - protein, 81 aa, Mus caroli
SKNLLTFEDVSVNFTQEEWQWLSDTQRNLYRKVTLENYRSLVSLGIPVYKPAVISLLEQGKDPWMVQKKGARDTCPDWEYV

SEQ ID NO: 10533 - protein, 81 aa, Mus caroli
SQELVTFEDVAVYFIWKEWKRLEPAQRDLYRDVMLENYGNVFSLDGDSKTGNDRVISEGMGSCEMILGRFQKDVSQGLKFE

SEQ ID NO: 10534 - protein, 81 aa, Mus caroli
AQGGMAFSDVAIYFLREEWRLLDDSQRHLYHQVMMEVFVLMSSSGLIPSGTDITQLGSSGDRFIPALRFLTPRVELAKISC

SEQ ID NO: 10535 - protein, 81 aa, Mus caroli
AKGLLTFKDVAIEFSQEEWECLDSAQRMLYRDVMLEIYSILVSVGLSVSKLELLTCFEQNEEPSITGIKELKGIEPVLSCF

SEQ ID NO: 10536 - protein, 81 aa, Neotoma lepida
YQVSKPDAIFKLEQGEEPWISETEIQRPFCPDWKTRPDTKSSSLQQGKSEVSHSTNNLSHATLGDIWNVSIQRHQESWRTH

SEQ ID NO: 10537 - protein, 81 aa, Mus musculus
LQESVSFEDVSVDFTQEEWNQLDPIQRSLYRDVMLENYSHLVSLGYPITKPEVIASLEKGVLGIIKREIPSSSCTEDGQAE

SEQ ID NO: 10538 - protein, 81 aa, Mus musculus
FVSVGHCVTKPDVIFKIEQGEDPWIPENGFQCHPERKWKVDDLLESNQENQDGHFWPLMFTNKITNLEGGGNTRETPSPDI

SEQ ID NO: 10539 - protein, 81 aa, Mus musculus
YRDVMFENYQNLATVGYQLIKPSLISWLEQEEFSKGQKIVFPEWKLQLETKCSAFQQEFLRGNISSRMQMQTGINRGRELC

SEQ ID NO: 10540 - protein, 81 aa, Mus musculus
YRDVMFENYNNLITVGPPLTKPEVISKLEQEEEPCVVEREVLWRPCPGEILGIDEHQKIQDGQVFEGIVVTSEASECPEEF

SEQ ID NO: 10541 - protein, 81 aa, Dipodomys ordii
ACVTFEDVVIYFSQEEWEFLNTTQRLLYLNVMLETFALVTSLGCEYGIEDEDTSVQSVSLKGMSHLRIPKAGTPSQDTHPC

SEQ ID NO: 10542 - protein, 81 aa, Dipodomys ordii
SLGLVSFEDVSVHFSWEEWKDLDDIQKTLYRDVMLETYSNVVSLGYCIPKPEVIVNLEQGAEPWPREALDKNITDVQQVDG

SEQ ID NO: 10543 - protein, 81 aa, Dipodomys ordii
KPGAVSFADVAVYFSPEEWGCLRPAQRALYRDVMRETYGHLGALGLPGPKPALISWMEGESEAWNPAAQDPEEGENLGGAL

SEQ ID NO: 10544 - protein, 81 aa, Octodon degus
SHAMEEMTFEDVAVNFTMEEWALLDPSQKKLYRDVMRETFRNMAAVGRAQDNQEVEEDKNDWRNRRKEELEKGYPLNMPTI

SEQ ID NO: 10545 - protein, 81 aa, Octodon degus
SRALENDGVCFSEQEWENLADWQKELYRNVMQSNYEALVSLKVLGQPEGEVELGAEMLGDLEEDEEGLAGAHPVDGPVLRA

SEQ ID NO: 10546 - protein, 81 aa, Octodon degus
WMEAVTLKDVTMAFTQKEWKKMDPAQRDLYKDVMLENYSNLAIVAGYQSSKPDMICKLEKGEEPWSRKGKRSNQSHLRKLA

SEQ ID NO: 10547 - protein, 81 aa, Octodon degus
AVTFEDVAVNFTLEEWALLNPSQKKLYRHVMRETFRNMAAIGRVLDNQKVEEEYKNCWRNLRNKVEKCYQDKGWNQYAEIF

SEQ ID NO: 10548 - protein, 81 aa, Octodon degus
EAVTMEDVLVNFTMEEWAVLNPSQKKLYREVMWETFMNVTAVGRSFRKQQIEEYKNCSRNLRREELVKFSQNKAWDQHGKI

SEQ ID NO: 10549 - protein, 81 aa, Octodon degus
VTEPVTFRDVAVLFSQDEWLQLGPDQRRLYREVMLENYSNLVSLGIPVSTPSVICQLQRGEDPCTAEREGPADTCTDFNTW

SEQ ID NO: 10550 - protein, 81 aa, Octodon degus
CHQDLVTFEDVTVDFTQEEWALLDRGHRDLYREVMLENYENLASVGCELVKPSLIWLEHEEDWRTQQRGDRQEWEMQLSTR

SEQ ID NO: 10551 - protein, 81 aa, Octodon degus
DSFLPQEIIIKVEGEDGGLLATPSKEGINFKIVTVDFTHEDHGTWNPALRTPDRGVTLENHTDLISCSKCIIPHSEESTQS

SEQ ID NO: 10552 - protein, 81 aa, Octodon degus
FQELVTFKDVSVDFTWEEWMQLDPAQRNLYGKVMLENYRILVSLGHQLSKPNVIAQLEQELSLRNKELPGCTSSGLETRFE

SEQ ID NO: 10553 - protein, 81 aa, Fukomys damarensis
RPRALKFADVAVYFSPEEWGCLRPAQRTLYRDVMRETYGLLGALGCAGPKPALISWLERNTDDWEPAALDPQEYPRRVTVQ

SEQ ID NO: 10554 - protein, 81 aa, Fukomys damarensis
EPWAITFADVAVYFSPEEWGCLQPTQRALYRDVMRDTYVLLSALGGGGGAKPALISWVERESELWDSDAQDPEVPKWPTEA

SEQ ID NO: 10555 - protein, 81 aa, Fukomys damarensis
ARGLMAFEDVAVYFSREEWVLLDTGQRALYRHVMLENFALVASLGFFSSPPRVIIQLQRGEEPWVPSGKDSILGRNAYRTL

SEQ ID NO: 10556 - protein, 81 aa, Fukomys damarensis
LTCDSPEQCGRAVTHSNGLVQLDITFEDVAIYFSREEWELLDEAQRLLYCDVMLNNFALVLSLGSFPYSYLSEESESQALS

SEQ ID NO: 10557 - protein, 81 aa, Rattus norvegicus
PVTLEDVAVDFTLEEWTMLNLWQKQLYKEVMQDTLRNLCYIGNKQEHQNIENEYENLWKKLSSQLLEKLCEYTEGHQCAEI

SEQ ID NO: 10558 - protein, 81 aa, Ictidomys tridecemlineatus
VMFSDVSIDFSQEEWECLTDDQRHLYRDVMLENYSNLVSMVLESTCEIKKLFLKKEIYEIESAQWEIMGRLTRHDLQCSSL

SEQ ID NO: 10559 - protein, 81 aa, Marmota monax
PQELLTFKDIFVDFTQEEWGHLAPTHRNLYRDVMLENYRNLVSVGYQFSKPSVISQLEKGEEPWIIQKEGPRNDVSDSKSK

SEQ ID NO: 10560 - protein, 81 aa, Marmota monax
QLDSVTFEDVAVDFTQEEWTSLDPTQRNLYKDVMLENFQNLSTVGRQLLKPSLISWLEEEVQLTIVERGILQEWEMHLQTK

SEQ ID NO: 10561 - protein, 81 aa, Marmota monax
TMELMSIEDVSISFTQEVWAMLDQSQKMLHQSVMLEIINHLVSVGYLLCKSDVTLYLEEGKILWMGEGTGFLPSQSPGMEN

SEQ ID NO: 10562 - protein, 81 aa, Marmota monax
AQGLVTFRDVIIEFSQEEWKCLEPAQRDLYRDVTLENFSHFVSLGLSISKPDVISLLEQGKEPWILANDMTGPWYPDLKSR

SEQ ID NO: 10563 - protein, 81 aa, Marmota monax
GSVTFKDVTMAFTQKEWKQLEPAQKNLYKDVMLENYSNLASMAGYQAPKPDMISKLEKGEEPWLGKGKKPSQNRLNKKARS

SEQ ID NO: 10564 - protein, 81 aa, Marmota monax
QSQESLTLEDVTVKFTWEEWQLLAPAQKDLYWDVMLENCRNLVSVGCQASKPDALSKLLGGEPRTVEDAIHEANSPEIWEI

SEQ ID NO: 10565 - protein, 81 aa, Marmota monax
AQESVMFSDVSIDFSQEEWECLTDDQRHLYRDVMLENYSNLVSMGHSISKPNVISYLEQGKEPWLVDRGRTRGQWPVLEST

SEQ ID NO: 10566 - protein, 81 aa, Heterocephalus glaber
LQDLVTFEDVAVDFTQEEWALLDTSQRSLYREVMLENCRNLASLGCHVGKPSLISQLEQEDKVIIEERRNLPRTCPDLETV

SEQ ID NO: 10567 - protein, 81 aa, Heterocephalus glaber
FESEPCDNFRCLSPLQNHEKILFGEKQHEYKQCGTLFRSHSYVGLAVSKPHLITCLEQSEEPWNVETQGTAATHPGVKSHS

SEQ ID NO: 10568 - protein, 81 aa, Mus musculus
VSFEDVAVNFTAEEWALLNSSQKRLHRDVMQETFRNLAAIAKKQEDWILEDGSKNLRKIPPISVQTDYKLCESQECTEKPG

SEQ ID NO: 10569 - protein, 81 aa, Mus musculus
MEAVTFGDVAVHFSREEWQCLDSGQRALYKEVMLENHSSVAGLAGFLVFKPELISRLEQGQEPWVLDLQGADGTEAPRICQ

SEQ ID NO: 10570 - protein, 81 aa, Mus musculus
PQAKVTFEDVAVLLSQEEWARLGPAQRGLYRHVMMETYGNVVSLGLPGSKPVVISQLERGEDPWVLDGQGNELSQSLGSDH

SEQ ID NO: 10571 - protein, 81 aa, Mus musculus
PQGQLTFKDVAVDFSQEEWECLDCAQRALYMDVMLENYNNLFFVENHCVCPKYENVLDQDTQHIFHKHVNIQKKSCKCNDR

SEQ ID NO: 10572 - protein, 81 aa, Mus musculus
GSLENDGVCFSEQEWENLEDWQKELYRNVMESNYETLVSLKVLGQPEEEVELGAEMVGDLVEEGTHLDRAMVKQEMLYKQE

SEQ ID NO: 10573 - protein, 81 aa, Mus musculus
MDALTYDDVYVNFTREEWALLNPSQKSLYKDVMLENYTNLIAVGNNWEDSNIEEHCESSRRHGRHERSLTGEKPSENTQCG

SEQ ID NO: 10574 - protein, 81 aa, Octodon degus
SRGMMAFEDVAVYFSQEEWALLDQGQRALYRQVMLENFALVASLGFFSSPPRVVIQLERGEEPWVPSGKDSILGRNAHRRL

SEQ ID NO: 10575 - protein, 81 aa, Octodon degus
PSGCLTFRDVAVEFSQEEWECLDPAQRTLYREVMLENYRTLVSLGIFLPNLSVISILEQGREPWTVENERRTARNSNRREC

SEQ ID NO: 10576 - protein, 81 aa, Octodon degus
TRLHLTFEDVAIYFSEQEWQDLEIWQKELYKGVMRTNYETLVSLDGALPKPELISWIEQGREPFRSWGPSQCPGNTVLSSA

SEQ ID NO: 10577 - protein, 81 aa, Octodon degus
PQESVTFKDVAVDFTREEWHHVDSAQRSLYRDVMLENYSHLVSLGYQVSKPEVIFKLEQGEEPWISEGEIPRPFCPDQKTR

SEQ ID NO: 10578 - protein, 81 aa, Octodon degus
VAFEDVAVIFTREEWVLLDPSQKKLYRDVMWETFRNVSAVERNCDEQKIEDECRCCRINLRGKKIEKWHVCELRYQYEEMV

SEQ ID NO: 10579 - protein, 81 aa, Fukomys damarensis
QDSVTFGDVAVDFSWEEWKLLDEMQRLLYRDVMLENFALVASLGLVSSQIHVLVQLKLEEDTKGADGAHLTVATGEPWRQA

SEQ ID NO: 10580 - protein, 81 aa, Fukomys damarensis
AVTFEDVAVNFTMEEWALLDPSQKKLHRDVMWENFTNVTAIGESLACEKPLIGHSLPTMPIIYNTGLKSYELHGFEQKVYN

SEQ ID NO: 10581 - protein, 81 aa, Rattus norvegicus
MATPEPAESDAEWEQLEPGQRNVYKDTKLETCSNPASMGNQDPKQGLVSKLDGEEERWSSVRANKNSSSSLHRLKKTGTSA

SEQ ID NO: 10582 - protein, 81 aa, Rattus norvegicus
AVTFRDVAVVFSKEEMGLLDAAQRKLYHDVMLENLRNLLAVGGQSPNKMKTVDATGVRCLLLGQLLYWEITGHDANKLARA

SEQ ID NO: 10583 - protein, 81 aa, Rattus norvegicus
SQGLLTFRDVAVNFSQEEWEYLNSAQRALYIDVMLENYSNLVSVENYCICETVLPTVKTEKDSCQGNELGEMLRGPSNCVL

SEQ ID NO: 10584 - protein, 81 aa, Marmota monax
MLENYRNLVSVEHQLSKPDVVSQLEVAEDFWPEERGILQDTFPECPKVPLGPQMKSLPAENPLMKIRVVEVLTLNQEMAGP

SEQ ID NO: 10585 - protein, 81 aa, Marmota monax
CSEPVAFEDLTLTFTPEEWGLLDLRQKSLYREVMLENYRNLVSVEHQLSKPDVVSQLEVAEDFWPEERGILQDTFPECPKV

SEQ ID NO: 10586 - protein, 81 aa, Marmota monax
MLENYSHLVSVGYCVTKPEVIFRLEQGEEPWISEAEFPSQSFPELWKADYLKEQSQEDLWKVVFISNKMLMKEQGNIIGRP

SEQ ID NO: 10587 - protein, 81 aa, Marmota monax
FQELVTFGDVAIDFSQQEWEYLDPLQRDLYRDVMLENYRNLVFLGHSTSKPDVVDLLEQGKEPWMFLKEETQRQYTDWGLQ

SEQ ID NO: 10588 - protein, 81 aa, Marmota monax
MIESQISFEDVAVDFTWEEWQLLNPTQRSLYRDVMLENYSSLLFLGYQIIKPDAVFKLDQEESWTVYEETLHRNVSEIWLD

SEQ ID NO: 10589 - protein, 81 aa, Marmota monax
MACGSPGHPFPGPLSDSTCETVIGLCFSKPNVILLLEQGKEPWMVKREFTNGLCSGWESMYETKELMPKQELYEEQSSQNI

SEQ ID NO: 10590 - protein, 81 aa, Marmota monax
MVENFKNLVAVGYLPFKVDMVSQLEAEEKLWMMETETQRSSYFGNTSQNEMETLQKFALKYLSHAELSCWQIWKQVASELT

SEQ ID NO: 10591 - protein, 81 aa, Marmota monax
SLEPVTFKDVAVDLTQEEWQQMKPAERNLYRDVMLENYSNLVIVGFQVTKPDVIFKLEQEEEPWVIEEEMFWRHSPEVWEV

SEQ ID NO: 10592 - protein, 81 aa, Heterocephalus glaber
ETVTFKDVAVDLTQEEWQQMKPVQRNLYRDVMLENYSNLVTVGCQVTKPDVIFKLEQEEEPWVMEEEMFWRHSPEPRRRRE

SEQ ID NO: 10593 - protein, 81 aa, Heterocephalus glaber
GTVIFEDVAVYFSWEEWDLLDETQRDLYHSVMLENLALVTSLGCLCEAEGEKTNSLLTVSAQRRPISPEKAYACEICGPVL

SEQ ID NO: 10594 - protein, 81 aa, Heterocephalus glaber
MLENYCNLIAAAGSTISKPEVIALLEQEKEPWIGVRKETSRQYPDLDSDYGAEKISPENYIYEINLSKQDIKQINTLGLKS

SEQ ID NO: 10595 - protein, 81 aa, Heterocephalus glaber
MLETYKNLVSLGAGSAGPKPGVILQLERGNEPWVLNTKEAEGRRHLRVSSSAHGTRTEHTELASEETFVGRELHQPRRTVH

SEQ ID NO: 10596 - protein, 81 aa, Heterocephalus glaber
SGTFEDVAVDGPQVEKPLMNPTRRSIHSDGMVKNYQNVATVGCQTPIKLSPMACLKEELLTGQKELLQDLEMQLQTKDSAI

SEQ ID NO: 10597 - protein, 81 aa, Mus caroli
MDAVTYDDVHVNFTWEEWALLAPSQKSLYKDVMLETYSNLTAIGCNWEEHNIEEYCQSSRRHGRAYSCASAIHSGEKLYEG

SEQ ID NO: 10598 - protein, 81 aa, Mus caroli
TESRISFEDVAVVFSWDQWQLLSPTQMSLYRDVILENCSSLVFFGNQTTKPDVTFKLDQQESQIMGEECLSQNFLEIWLDS

SEQ ID NO: 10599 - protein, 81 aa, Mus caroli
DELTYDDVHVNFTQEEWALLNPSQKSLYRDVMLETYRNLNAVGYNWEDRNIEDHYKSSRRHGSLQMHKIIHTGEKQYKYNQ

SEQ ID NO: 10600 - protein, 81 aa, Neotoma lepida
MTGPDLPKPAVISQLEQGAELWVAERGGTRACHPGWILGPENHTSLKEQDLTEKESFPITERDEFKRAISCHSMTEVDQKN

SEQ ID NO: 10601 - protein, 81 aa, Mus musculus
MEKLLSFRDVAIDFSAEERECLDSAQWNLYKEVMLENYSHLVFLGLAFSKPHLITFLERRPEPWNVKTQASVGTYPGSKPY

SEQ ID NO: 10602 - protein, 81 aa, Mus musculus
KPELVSFADVAVYFSPQEWGCLRPAQRTLYREVMRETYGLLGALGFPGPKPALISWMEQGSEAWSPAAQDPEEGESLGGAP

SEQ ID NO: 10603 - protein, 81 aa, Mus musculus
MDALTFDDVHIHFTREEWSLLDPSQKRLYQDVMLENYRNLTTIGYNWKDHNIEEHSQNDRRYGRHERSPSAEKPYEYTQWN

SEQ ID NO: 10604 - protein, 81 aa, Mus musculus
PQGLLTFKDVALDFSLEEWECLSFAQRTLYMDVMLENYNNLLFVENYCIRGKNGKVLDQDNQYIVHEHMNIREKSSKWDKL

SEQ ID NO: 10605 - protein, 81 aa, Dipodomys ordii
CQATVTFRDVAIDFTQEEWKQLDPAQRDLYRNVMLENYNNLITVGYPVAKPDVIFKLEQEEEPWVVEDEVLRRHCPGVIWN

SEQ ID NO: 10606 - protein, 81 aa, Dipodomys ordii
QVPISFKDLAVRFSEEEWRLLQEGEREFYRDVMRENYETLVSVGTAELLPLSAFLSPTEPGRAPGTENCAGQGQGPPARAG

SEQ ID NO: 10607 - protein, 81 aa, Dipodomys ordii
AVTQLTLEDVAVDFTRGEWRCLTPAQRALYRDVMLDTYRNLVSVGVSPPSVSVILPLELEEEPWVAQSHVTTPGELNGWKG

SEQ ID NO: 10608 - protein, 81 aa, Dipodomys ordii
LASISFEDLAVTFTEEEWEHLDLGQRNLYQEVMLETYQLLVSLGDQVRLAPPTPGTPLPALPAQPRLLGLPSQPLDRRGTP

SEQ ID NO: 10609 - protein, 81 aa, Fukomys damarensis
EMELLTFKDVAIDLSLEEWECLDPAQQNLYRDVTLENYRNLIFLGLAVSKPHLITLLEQRKEPWIVKTMSYHIQGFSSEQG

SEQ ID NO: 10610 - protein, 81 aa, Fukomys damarensis
QDLPVGTGNQYLCGLEQSSRGPRLVLTCRKVLCPLAQTLLCIYPRAGYQVSKPEVIFKLEQGEEPWISEGEIQRPFCPDWK

SEQ ID NO: 10611 - protein, 81 aa, Peromyscus maniculatus
RSKGLVSFKDVAVAFTQDEWQQLGSEEKTTYRDVMLENYSNLVSVEISKVQDTIEKIQENEDKHMRQADDLNSQRSEKGDA

SEQ ID NO: 10612 - protein, 81 aa, Peromyscus maniculatus
GLLTFGDVAVDFPQEEWECLDSAQRALYIDVMLENYNNLVSVENYCKCDPVHQHVKTEKESCQCNELVKVLHDPSTSAPHK

SEQ ID NO: 10613 - protein, 81 aa, Peromyscus maniculatus
HQDLLTFRDLDVDFSQEEWECLDSAWRTLYIDVMLENYRNLIFVEKHRMCGIYENIMDQGSNSTVYQHVNIQKKSYKNNDP

SEQ ID NO: 10614 - protein, 81 aa, Peromyscus maniculatus
MEKLLSFRDVAIEFSAEEREYLELAQWNLYRDVMLENYSNLVFLGLAFSKPYLVTFLEQRKEPWSVKRHAKVGAHAGSKSY

SEQ ID NO: 10615 - protein, 81 aa, Peromyscus maniculatus
LTLDDVAVVFSWEEWQLLSHAQKDLYWDVMLETCKSLVSMEIREVGDPLQHHLKDRTIHKSIEQCYKHRNFRNILNQSKDH

SEQ ID NO: 10616 - protein, 81 aa, Peromyscus maniculatus
DAVTYEDVHVNFTPEEWALLDPSQKSLYKDVMLETYWNLTIVGYKWEDHNIEEHCQSCRRNGRYIICHSRYKPCEHKGYGK

SEQ ID NO: 10617 - protein, 81 aa, Mesocricetus auratus
SQGLLTFRDVAVDFSQEEWECLDSAQRALCIDVMLENYNNLVFVENYCIYDPVHHHVKTEKESCQCDELDKVLHDPSTCVL

SEQ ID NO: 10618 - protein, 81 aa, Mesocricetus auratus
EEGCVSFEDVAVYFSWEEWKLLDDSQRLLYQTVMTDILAIMSSLGLVPSGIHGITQLGPWGEPSVPALRFLTPGCWIKVES

SEQ ID NO: 10619 - protein, 81 aa, Mesocricetus auratus
GEMPLTFQDVAVYFSRAEGQQLGPQERALYRDVMLENYGNVASLGFPVPKPELISQLEQEEELWVLDLLGAEEPDVLRSCQ

SEQ ID NO: 10620 - protein, 81 aa, Ictidomys tridecemlineatus
LTYIMEVVTFKDVAVVFTEEELRLLDSAQRKLYQDVMLENFRNVVSVGHQSITPERKREELWMKKVSTQSGNSPRNKNLSE

SEQ ID NO: 10621 - protein, 81 aa, Ictidomys tridecemlineatus
MKRHQGSIPRSLIFLSVTKPSFPGPAWILGLFFVPGICAQISVICLTGYPFTKPEVIFKLEQEEEPWVVEEEVFSRHCSGE

SEQ ID NO: 10622 - protein, 81 aa, Ictidomys tridecemlineatus
VPEPVTFEDVAVDFTQEEWGQLDLVQRTLYRDVMLETYGHLLSVGNQIAKPEVISLLEQGEEPWLVEQTCPESSCPEWMRD

SEQ ID NO: 10623 - protein, 81 aa, Ictidomys tridecemlineatus
FQETVTFGDVAVHFSREEWQCLDSGQKALYREVMLENHSSVAGLGFLVFKPELISRLEQGQEPWVIDLQGVEGTEAPWTSQ

SEQ ID NO: 10624 - protein, 81 aa, Heterocephalus glaber
IEDVADMAVSFILEEWEHLDQSQKSLYRDGRKENYGSITSLDYESKDNNMELTAKQISNEASSPNSHWVAVGSTERNISQS

SEQ ID NO: 10625 - protein, 81 aa, Heterocephalus glaber
EAVTLEAVAVNFTMEEWAVLNLSQKKLYRNVMWETLMNTTAIGRTWGKPQIEGECKNCSRSLRIYERFHMEEKTYVCKQCG

SEQ ID NO: 10626 - protein, 81 aa, Mus caroli
ARSQEAVTFKDVAMDFTPEEWGKLDPAHRAVMLENYRNLVSLWLPISKPDNYNSEDGKELSELEKSPKCSDSDMETRPESK

SEQ ID NO: 10627 - protein, 81 aa, Mus caroli
MTFEDVAVKFSMEEWALLNPSQKKLDKDGMQETLRNLTAIGFKMDTNHMNIRNLQSDCMNIRERTHASENLGVCKQHRKEF

SEQ ID NO: 10628 - protein, 81 aa, Neotoma lepida
MLLLSVSLSHVIIGLSVSRPRVIIQLQRGEEPWVPNRTNTGPGRSTHRRPRLGSNYNARDRHVSGDAALPGATCDGPDGTP

SEQ ID NO: 10629 - protein, 81 aa, Mus caroli
IQGPVLFEDVSVAFTQKEWQLLDDAQRHLYREVMLETYRHLGAVGHNVTKPELICKLEQGEGPWEPSSHSLSEVQRADTTT

SEQ ID NO: 10630 - protein, 81 aa, Neotoma lepida
LGAVSFADVAVYFSPEEWGCLRPAQRALYREVMRETYGLLGALDCRQEKMKRPRKETEATQKTLSTQAGPNEPHLSLAGPP

SEQ ID NO: 10631 - protein, 81 aa, Mus musculus
NAVTYEDVHVNFTREEWALLDPSQKSLYKDVMLETYRTLRAIGCYWEDHSNEENSQTSRRHGRHLQMEDRTHTGDKSYEGV

SEQ ID NO: 10632 - protein, 81 aa, Mus musculus
MGLVSFEDVAVDFTWQEWQELDAAQRTLNRDVMLENYSSLVSLGHCVTKPELILRLEHGFQPWSIGDTSVWRLPGVLEVYT

SEQ ID NO: 10633 - protein, 81 aa, Fukomys damarensis
VSFEDVFVSFTWEEWQVLDDAQRTLYREVMLETYSSLAVLGHCITKPEVIFKLEQGAEPWMGEEPPNLSPPDGQKMDDIIE

SEQ ID NO: 10634 - protein, 81 aa, Rattus norvegicus
SQVSVTFEDVAVLFTRDEWKKLDLSQRSLYREVMLENYSNLASMGFLFTKPKVISLLQQGEDPWQVEKEGPRYFSLGLKCS

SEQ ID NO: 10635 - protein, 81 aa, Rattus norvegicus
LQDAVTFKDVAIDFSQEEWEWLNPAQRSLYRNVVLENYRNLVSVGGESVQKTQELSLRQLAFDAVSVENIASLGCESPTSG

SEQ ID NO: 10636 - protein, 81 aa, Rattus norvegicus
FKGPVTLRDVTVEFTKAEWKLLTPAQKSLYKNVMLETYSHLVSVGYRVVKPSMISKLKKGKEPWPLGAEFLRRSCGDKRRT

SEQ ID NO: 10637 - protein, 81 aa, Peromyscus maniculatus
NAVTYDDVHVDFTWEEWALLDPSQKRLYKDVMLETYGNLTAIGYKWKDHHIEEHCESSRRHGRHERIHTREKPYGCNQCGK

SEQ ID NO: 10638 - protein, 81 aa, Peromyscus maniculatus
MLENFRTLLSVAHQPFKPDLIAQLEKEEKLCMEETQGGGYSGSEGGHAVHSAEDVEFNPLCPTELSSCQTCVLPGVQDSLR

SEQ ID NO: 10639 - protein, 81 aa, Peromyscus maniculatus
QDSVTFDDVAVEFTPDEWTLLDLTQRNLYREVMLENYENLTSVGCQFFIPSPTPWLKQEELETVESAVPQQLELQPRIDDT

SEQ ID NO: 10640 - protein, 81 aa, Peromyscus maniculatus
MEEWIMLDLSQKDLYKDVMKEILRNMVSIGNIRKHQKIENEYQNSERKRSCQLVEKLHDCKEGHKCAEIFNFSMEGTVNHK

SEQ ID NO: 10641 - protein, 81 aa, Mesocricetus auratus
KETVTFKDVAVAFTEEELKLLDSAQRKLYQEVMVENFRNLLSVGINHQSELRASQDGRSRDALSCWQIWQRVMDDLSRCQD

SEQ ID NO: 10642 - protein, 81 aa, Mesocricetus auratus
SEETVTFKDVAIDFTPDEWKQLDPVQRNLYRNVMLENYNNLITVGSPLAKPDVIFKLEQEEEPSIVEKEVLKRHSPGEIWE

SEQ ID NO: 10643 - protein, 81 aa, Mesocricetus auratus
MLETYSSLVFLKLCTAKPKLIFNLERGYGPWSPAEASVWSLPNVHKVSALIDTSKENPEIHLGQLEITNQKIPDEVMIEAK

SEQ ID NO: 10644 - protein, 81 aa, Mesocricetus auratus
FQEAVTFKDVALVFTREELRLLDLTQRKLYQDVMLETFKNLVTVGCFSRKADLVSLLEAEERLWLKETKAQRSHRNPGAKA

SEQ ID NO: 10645 - protein, 81 aa, Mesocricetus auratus
MEELLSFPDVAIDFSAEECECLDLAQWNLYKEVMLENYSNLVFLGLSFSKPYLVTFLEQSSEPWSVKRKSAAASHPGSKPH

SEQ ID NO: 10646 - protein, 81 aa, Mesocricetus auratus
VCQEVTFRDVAVYFCREEWECLSPGQRTLYRDVMLEIFRNFLELGYCGPRPDLISHLEQWDEPWVEDQDRPEFLEAGKGVC

SEQ ID NO: 10647 - protein, 81 aa, Mesocricetus auratus
LENYSNLVSLGIPFSKPTLITQLEESKETWPEERKCPQVACQAQAKLELSPGPVCHPDPINQKLPGQHVLSDHVPWVFTCL

SEQ ID NO: 10648 - protein, 81 aa, Mesocricetus auratus
MLEIFRNFLELGYCGPRPDLISHLEQWDEPWVEDQDRPEFLEAGKGVCPGGRKSIDHKRPHDLASAQERALPRTGAKRGAT

SEQ ID NO: 10649 - protein, 81 aa, Mesocricetus auratus
DMGLVSFEDVAVDFTWQEWQELDAAQRTLYRDVMLENYSSLVSLGNCLDKPELISKLEQGLVPWSGAEATEQYQPDVHKWS

SEQ ID NO: 10650 - protein, 81 aa, Mesocricetus auratus
KPELVSFADVAVYFSPHEWGCLRPAQRALYRDVMRETYGLLGALGCAGPKPALISWLERNTDDWEPAALDPQEYRRWVTFQ

SEQ ID NO: 10651 - protein, 81 aa, Ictidomys tridecemlineatus
MVTFKDVAVVFSEEELGLLDCAQRKLYRDVMLENFRNLLSVGHQSFKPDVISQLEREEKLWMEEIHTHPGGRNQSRVESRH

SEQ ID NO: 10652 - protein, 81 aa, Ictidomys tridecemlineatus
MYFTKTEWKLLDLKQRILYKQVMLENYGHLVSLGFAFSKPPLVSQLERGEGPWVANSLRGQAEAESHAGERIKSKTAISKQ

SEQ ID NO: 10653 - protein, 81 aa, Marmota monax
MLENYNNLVSVGFQNIKPHALSNLEQGEELWMIEDEVQNGPCSEIGKVDGHLQEYSQTQRFLKSMHQCSDQNAFKNITHFS

SEQ ID NO: 10654 - protein, 81 aa, Heterocephalus glaber
MLENYNSLVSVGYQASQPDPLSKLLHGEQWTVEDAIHSQIYPEIQKVDIQVRSQTQRWLKRTERHKHNAFGNVVRQRKSNF

SEQ ID NO: 10655 - protein, 81 aa, Marmota monax
MTQVTFSDVAIDFSHEEWAWLDSAQKDLYKDVMVQNYENLVSLGLSITKPYVITLLEDGKEPWMVEKTLSKDWESRWENKE

SEQ ID NO: 10656 - protein, 81 aa, Heterocephalus glaber
LLTFRDVAIDFSPEEWECLEPAQWNLYRDVMLENYRNLVFLAVSTHYTQAFSGDQCIKHLFQNMKKRRNGNYGLDNLYLRK

SEQ ID NO: 10657 - protein, 81 aa, Mus musculus
MNAVTYEDVHVNFTQEEWALLDPSQKKLYKDVMLETYRNLNAIGFNWDSKIFKNIVQVLEDTEGMKEVRVQRKRLNILNVI

SEQ ID NO: 10658 - protein, 81 aa, Mus musculus
LLFEDLDVYFSQEECVSLHPAQKTLSREAPLKSFENLDSIGGEDQTESSQELSLEPVELEELSLEKDSIAAPVVHYSEQSE

SEQ ID NO: 10659 - protein, 81 aa, Mus musculus
MATSEPAESDAKEWEQLEPVQRDVYKDTKLENCSNPASMGNQDPKQDIVSVLEEEEPSSGKGKKASPSSLKKIARPKTAGT

SEQ ID NO: 10660 - protein, 81 aa, Dipodomys ordii
SQGLVTFEDVAVYFSLEEWERLNVEQRALYQEVMQGNYGILVSLGYPIPKPDLIFRLEQGEEPWVPDSPHPEEGDIVTGVY

SEQ ID NO: 10661 - protein, 81 aa, Octodon degus
VTFEDVAVNFSREEWALLDPPQRKLYRDVMWETLRHLAAVDDQQSEDEFRNFQKRVRSEEVEKASQYTLWYQHGEMDSRTP

SEQ ID NO: 10662 - protein, 81 aa, Octodon degus
MEDVAVNFTKEEWALLNPSQKKLYRDVMWETFRNINAIGRTWDNQQMEEHKSCSRNLRDEELPKCCQYAPCSQHENIFLQT

SEQ ID NO: 10663 - protein, 81 aa, Octodon degus
QGSVTFEDVAVHFSWDEWHLLDKAQRCLYRDVMAENLALITSLGLWPGVGDAEASSEQSASLKGMSQVRTFREGLSPQRAQ

SEQ ID NO: 10664 - protein, 81 aa, Octodon degus
LMEAVTFGDVAVHFSREEWQCLDSGQRALYREVMLENHSSVAGLGFLVFKPELISRLEQGQEPWVLDLQGAEGTEAPRTLQ

SEQ ID NO: 10665 - protein, 81 aa, Fukomys damarensis
KAVTFEDVAVNFTMEEWALLDLSQKKLYRDVMWENFRNVTAIGRNMDDQQIEDEYKHYRENLRDAKVDKYCQYKLWNQHGE

SEQ ID NO: 10666 - protein, 81 aa, Rattus norvegicus
SQHVACGLVTFRDVAVDFSQEEWACLDATQKVLYRDTMLETYSHLVTVVGSCLSKPHLITLLEQEKEPWMAVKEETDRPSP

SEQ ID NO: 10667 - protein, 81 aa, Rattus norvegicus
PQKSVTFEDVAVYFTQTEWDGLSPEQRALYRDVMLENYRNLASVGFPLLKPAVISQLEEGEDLESLSQLATGTDSQGLWTE

SEQ ID NO: 10668 - protein, 81 aa, Rattus norvegicus
MGLVSFEDVAVDFTLEEWQDLNAAQRTLYRDVMLENYRSLVFLGHCMNKPELIFKLEQGLGPWNVAEASGRSLPDVHVLTE

SEQ ID NO: 10669 - protein, 81 aa, Rattus norvegicus
SQELVTFEDVAVYFIWKEWKRLEPAQRDLYRDVMLENYGNVFSLDGDSKTGNDQVISEGMGSCEMILGRFQKDVSQGLKFE

SEQ ID NO: 10670 - protein, 81 aa, Mus caroli
MGLISFEDIAVDFTWEEWQDLSAAQRTLYRDVMLETYISLVSLGHCTNKPELIFKLEQGLGPWSVAEASDRNLSDFHILTA

SEQ ID NO: 10671 - protein, 81 aa, Mus caroli
MENMLSFWDVVIYFSAEEREYLGPPQWTLYRDVMLENYNNLVFLGLASSKPYLVRFLEQIQEPLDVKSQVAISMYSGGNSS

SEQ ID NO: 10672 - protein, 81 aa, Mus caroli
NQGESCVSLEDVCLRFTSEEWSLLDDAQKLLYHNMMLENFLLVLSLGLPISKSFPGTRVYPSWPYLLQKDKHMTMEPSINI

SEQ ID NO: 10673 - protein, 81 aa, Mus caroli
MDVAVVFSEEELRLLDAAQRKLYHDVMLENFRNLLAVGGQSPNKIESLHATGVRCLSLGRLPCWQMTSHDVNKLARTPEDG

SEQ ID NO: 10674 - protein, 81 aa, Mus caroli
MDLVTYEDVRVNFTREEWALLDPSQKSLYRDVMLEICWNLTAIGYKWEDFNIEEHCKCPERHERYIICHSGFKPCEDKKYK

SEQ ID NO: 10675 - protein, 81 aa, Mus caroli
VTFEDVAVDFTQEEWILLDTKQRNLYREVMLENYQNLATLECQLIKSRYSFCLEAEELRVVKRRVHQEWAIQLNTRETMFQ

SEQ ID NO: 10676 - protein, 81 aa, Mus caroli
MLENFSHLVFLGFSFSKPLLVRFLEKNQELRNVKRKAAAVPRGKKLYKCKECGKAFAKSSVLTQHLRIHTGEKPYTCDICG

SEQ ID NO: 10677 - protein, 81 aa, Mus caroli
MDAVTYEDVHVNFSQEEWALLDPSQKSLYKDVMLETYWNLTCIGYKWEDHNAEDQHQSSGRHGRCINCPSAYGKKQCTNLF

SEQ ID NO: 10678 - protein, 81 aa, Mus caroli
MGLVSFEDIAVYFNLEEWQDLDTAQRTLYRDVMLETYSSLVFLDPCIAKPKLIFNLERGFGPWSLAEASSRSLPGVHNVST

SEQ ID NO: 10679 - protein, 81 aa, Mus caroli
SKGSASFKDVTVDFAQEEWQALDPAQKALYRDVMLENYCHFISVGFHITKPDLIRKLEQGEELWTERIFPSQSYLEEEEIL

SEQ ID NO: 10680 - protein, 81 aa, Neotoma lepida
FRASKPDVILKLEQGKEPWIVEESPKDDDALEDKGTQGKHSKQFSVFSNKKMPAKATLFEKTVALDMNTVSSEKMLHKYDP

SEQ ID NO: 10681 - protein, 81 aa, Mus musculus
MASVSFEDVAVHFTQDEWALLDSSQKSLYRDVMLEICRSLATIGNRWEEENVEDHYKNPWRNMRNTSRGSQWKNTLSIQGV

SEQ ID NO: 10682 - protein, 81 aa, Mus musculus
GCCSLETHSIRDKNAVTYGDVHVNFTQEEWALLDPSQKKLYKDVMLETYRNLNAIGFNWDDKNTEEHCPSTRRWRRFYRMQ

SEQ ID NO: 10683 - protein, 81 aa, Mus musculus
AQGGMAFSDVAIYFLRGEWRLLDDSQRRLYHQVMMEVFVLMSSLGLIPSGTDITQLGSSGNRFIPALRFLTPRVELAKIPC

SEQ ID NO: 10684 - protein, 81 aa, Mus musculus
NKKPVVFSDVSLDFSQEEWECLGPAQRDLYKDVMLENYSNLLSVGLHIPKPQVISLLEQGKEPWMIGKELTRGLCSALESM

SEQ ID NO: 10685 - protein, 81 aa, Mus musculus
MAAVTYEDVHVNFTHEEWVLLDPSQKSLYKDVMLETYWNLTAIGYKLEDLNSEEHSQRSRRYGRHKICHSEYKPCELKGYG

SEQ ID NO: 10686 - protein, 81 aa, Mus musculus
VPLLGAGTSGKPRSSDMDIVTYDDVHVNFTWEEWALLDPSQKDLYRDVMLETYRNLAAIGYYWKGHNISEGHFQNSRRNGR

SEQ ID NO: 10687 - protein, 81 aa, Mus musculus
PNMDLLTYDDVHVNFTQEEWALLDASQKSLYKGVMVETYRNLTAIGYSWEEHTIEDHFQTSRSLGRVFTMKQSILPRNLGI

SEQ ID NO: 10688 - protein, 81 aa, Dipodomys ordii
SIKTVAFQHVAVDLSQEEWQQMKPAQRNLYRDVMLETYRNLVAVGCQVTKPDVIFKLEQEEEPWVMEEEMFWRLSPESRRE

SEQ ID NO: 10689 - protein, 81 aa, Octodon degus
ELVTAEDVILEFTPEEWALLDTSQKKLYRDVMLENINHLISLGLMSVCKKAEKRSTQCFYRNDTNTVSGARTHTGEKPHQC

SEQ ID NO: 10690 - protein, 81 aa, Octodon degus
FRGSVSFEDVAVDFTQEEWNQLDPTQRTLYRDVMLENYSHLVSLGYPITKPDVITSLEQGVLGIIKKEIPSSVCTEDEKAE

SEQ ID NO: 10691 - protein, 81 aa, Octodon degus
VTFGDVAVHFSREEWQCLDSGQRALYREVMLENHSSVAGLESTIKPDCKQPCLDISLLKPQSHGCENAWNSEVWSERCSSS

SEQ ID NO: 10692 - protein, 81 aa, Octodon degus
FQLPVTFEDVAVYFSKEEWECLSLRQKTLYRNVMLDNFRSLVALGFCGPRPNLVSHLEQWDELWVEDCESAELQESQSDSC

SEQ ID NO: 10693 - protein, 81 aa, Octodon degus
MEPVTLEDVAVNFTLEEWAFLNSSQKKLYRDVMWETFRNMTAIRRTLDKQKIEEQYKNTSRNQSNEKAAKWYPYKSWNQYG

SEQ ID NO: 10694 - protein, 81 aa, Octodon degus
VSFEDVAVNFTLEEWALLDPYQKELYRDVMCETFRNIAALERIWGDEEIKYKNWRRNIRSEVEKGCEYELWYQHGEMVFWT

SEQ ID NO: 10695 - protein, 81 aa, Octodon degus
SQGSVSFKDVTVGFTQEEWQHLDPSQKSLYRDVMLENYSHLVSVGYCVTKPELIFRLEQGEEPWVLEEEFPRPGFLEFWKT

SEQ ID NO: 10696 - protein, 81 aa, Octodon degus
MLRMTKCGPDQGGLLDGGEAVTFEDVAVNFYREEWALLDPSQKKLYRDVMWETFRNLAAVGRSSDDQHLDDKDRKCGKQLR

SEQ ID NO: 10697 - protein, 81 aa, Octodon degus
ADGSVTFRDVAIDFSQEEWEFLDSAQRDLYRDVMWENYSNFISLGASISKPDMITLLDEEGKEPGMIVKEGIRNLYPGIAF

SEQ ID NO: 10698 - protein, 81 aa, Fukomys damarensis
MLETYGNLVSLGLAGSKPYMITCLEQSREPWNVKRQETVVIHPAVSSYFTQDISSEQHKEHSFQNVTDGRYRICGHDNLHL

SEQ ID NO: 10699 - protein, 81 aa, Fukomys damarensis
HGPGALGDIPFYFSREEWSSLDPAQRDLFWDIKRENSQNTTQGLELQSQNKKALLEKRTHTGEKPHKCPECDKSFRSSSDL

SEQ ID NO: 10700 - protein, 81 aa, Fukomys damarensis
MPLTFQDVAVYFSRAERRQLGPGQRALYRDVMLENYGNVASLGFPIPKPELISQLEQEEELWVLDLLGAEEPEVLRTCWTD

SEQ ID NO: 10701 - protein, 81 aa, Fukomys damarensis
VTFSDVAINFSHEEWGWLDSAQRDLYKDVMVQNYKNLASLGLSVTKPYVISLLENGKEPWMVEKKLSKDWESKWKNKELFT

SEQ ID NO: 10702 - protein, 81 aa, Rattus norvegicus
WKVHMAFRDVAVDFSQEEWSLLSPAQRSLYREVMLENYSNLVSLGIPFSKPKLITQLEQGKETWREERKCPQVACPAQAKL

SEQ ID NO: 10703 - protein, 81 aa, Rattus norvegicus
CERLVSFEDVTVDFSQEEWRRLDPAQRRLYQEVMLEIYSHLLSVGYPIPSPGAIFRIKKRKKTQTGEAKFPHHQCWCQEVE

SEQ ID NO: 10704 - protein, 81 aa, Heterocephalus glaber
EAVIFEDVVVRFTMEEWDLLNPSQKKLYRDVMGETFRNMAAVGRAWDNQELEDEHKTYWRNLRNKAWNQYKEIFLWTPDAN

SEQ ID NO: 10705 - protein, 81 aa, Heterocephalus glaber
PKVPVAFDDVSIYFSTPEWEKLEEWQKELYTNIMKGNYESLISMDYAMSQPDVLSQIQPEGEHNTEDQAGPEESDIPAVPS

SEQ ID NO: 10706 - protein, 81 aa, Heterocephalus glaber
MASLCVAKPEMIFKLERGEELWILEEESSGHAYAESLSLLCGNTSVGGIALNLLANQKVPTLNENVDYNGCGKGFHEETAF

SEQ ID NO: 10707 - protein, 81 aa, Heterocephalus glaber
YQEFVTFEDVAVYLTREEWGRLDPVQRDLYREVMLENYGNVVSLGILLRLPTTRIHCVNSCPALSHTQASAFSGETLAVLS

SEQ ID NO: 10708 - protein, 81 aa, Mus caroli
ETGSVSFEDIAVDFSWDEWQHLDVAQRTLYRDVMLENYSSLLFLGHCMTKPEVIFQLEHGFEPWPMGDSSVLSLAGIHKKS

SEQ ID NO: 10709 - protein, 81 aa, Mus caroli
ELVTFEDVAVHFTMEEWALLDLSQKELYKDVMKEILRNVVSIGDIRKHQKIDNEYQNSGRKLRCQLVEKLHDCKEGHECAE

SEQ ID NO: 10710 - protein, 81 aa, Mus caroli
MNAVTYEDLHVNFTQEEWALLDTSQKMLFKDVMLETYRNLNAIGFSWEAQNIEEHCQSSGRHRRCERSQSAEKPSEYTQRG

SEQ ID NO: 10711 - protein, 81 aa, Mus caroli
SQMPVTFEDVALYLSQEEWGRLDHTQQNVYRDVLQGKNGLALGAVEVGKVVPALADATLEDTKSIRTRARWTPGEDPKFGQ

SEQ ID NO: 10712 - protein, 81 aa, Mus caroli
VMESVSFEDIAVFFTWEEWQDLDFAQKLLYRDVMLENYSSLVSLGCCVIKPELILMLEREFGPWRAADTSVWNLPGYCMTR

SEQ ID NO: 10713 - protein, 81 aa, Mus caroli
LKPGAVSFADVAVYFSPEEWRCLRLAQRALYRKVMRETYGLLASLVGGDKPALICWVEEESEVWGPCAQEPEVAMCKTEVH

SEQ ID NO: 10714 - protein, 81 aa, Mus caroli
SQGLVTIKDVSLCFSQEEWRSLDPSQTDFYGEYVMQENCGIVVSLRFPIPKLDMLSQQEGGEDQWAPGPQDVEGRDILKVT

SEQ ID NO: 10715 - protein, 81 aa, Mus caroli
MEAVTFKDVAVVFTKEEFRLLDSAQRTLYQDVMVENFRNLLSVEYQLFKRDKPYLEREEKPPTRRAALRERDSGINGQSAR

SEQ ID NO: 10716 - protein, 81 aa, Mus caroli
KPGAVSFADVAVYFSPEEWRCLRPAQRALYREVMRETYGLLSYIEVGGAKPALICWVEEESEVWGPCAQDPEVAMCKTEFH

SEQ ID NO: 10717 - protein, 81 aa, Neotoma lepida
MLENYSHLVSLGYPITKPEVITSLEQGVLGIMKREISSSSCTEDGQAEDYLEWHQENQNIHREQAISIIEKNVTEERSYEY

SEQ ID NO: 10718 - protein, 81 aa, Mus musculus
LQEMVTFRDVAVVFSEEELGLLDAAQWKLYREVMLENFRMLLSVAHQPFKPGLIAQLENGEQLWMVEAEAHAGRRNGHAVE

SEQ ID NO: 10719 - protein, 81 aa, Dipodomys ordii
SNEPVTFEDIALTFTLEEKGLLDIPQKSLYREVMLENYRNLVSVELHLSKPDVIIQLEKAEDCWTVEREILQDTFPECSGA

SEQ ID NO: 10720 - protein, 81 aa, Mus musculus
TENPVTYNDVLVSFTREEWALLDPSQKSLYKDVMLETYKNLTAIGYNWEDDNIEEDCENSGRPRRHLQRDGPSNTREKPFE

SEQ ID NO: 10721 - protein, 81 aa, Dipodomys ordii
LRESVTFKDVIVDFTQEEWKHLDPTQRDLFRDVALENYTHLVSVGLQVSKPDVISQLEQGTEPWIVEPSIPGGAFGEWNTN

SEQ ID NO: 10722 - protein, 81 aa, Rattus norvegicus
MVTFRDVAVVFSEEELGLLDAAQRKLYGEVMLENFRMLLSVGGKNLEDTESLEEVGLRHLPHEELFCSQIWQRVIRELAKA

SEQ ID NO: 10723 - protein, 81 aa, Rattus norvegicus
FQEMLSFRDVAIDFSAEEWECLDPAQWNLYRDVMLENYSNLVFLGLAFSKPYLVTFLEQRQEPSDEKKQHKLGHTGEKPYK

SEQ ID NO: 10724 - protein, 81 aa, Rattus norvegicus
FQGSVSFTDVTVDFSQEEWEQLDPSQRILYMDVMLENYSNLLSVEVWKADDQVEKDPREPDKQAPSLTTPKNQPPTEERGS

SEQ ID NO: 10725 - protein, 81 aa, Peromyscus maniculatus
MLENYSNLTSLGYQVGKPNLISHLEQEEELRMEERDIQWGTSPDWGTSAKIKWSIVMEDIFGEETSNGVTLEKSHLLEKSS

SEQ ID NO: 10726 - protein, 81 aa, Peromyscus maniculatus
SLLTFRDVAVDLSKEEWECLDCAQRALYMDVMLENYNNLVFVGQNQRVHTGKKEHKNTEFDKSFESQHKLTMKRTNSGKKP

SEQ ID NO: 10727 - protein, 81 aa, Peromyscus maniculatus
VQDLVTFKDVAVLFTQEEWRQLSSAQRALYRDVMSENYSNLVSLGLSGSKPDVFFHLEKADKCVSEDAPGGFVLGWSNLRE

SEQ ID NO: 10728 - protein, 81 aa, Peromyscus maniculatus
SQGLLTFRDVAVDFHQEEWECLDSAQRALYIDVMLENYNNLVFVENYCKCDPVHQHVKTEKESCQCTKLGKVLHDPSTCAL

SEQ ID NO: 10729 - protein, 81 aa, Peromyscus maniculatus
VCGSVTFRDVAVVFSRREWAYLDASQRVLYRDIMLETYSNLVTVVGSSISKPDLIALLEQKREPWMVVKKQTDRPSPDLES

SEQ ID NO: 10730 - protein, 81 aa, Peromyscus maniculatus
SVSFMDVTIDFSREEWQHLDPDQRSLYQDVMQETYSHLRSVEELQQIGDQKETYQQIANSKSASDVIFIKKTLDTKSHYGY

SEQ ID NO: 10731 - protein, 81 aa, Peromyscus maniculatus
MLDNYSNLASLGLCASKPDMIALLEQGEDPWVTKRKRTGGRCPDLKAVQKFPPKDLREGKFSQAVVKKQPLHCRPRCSMLG

SEQ ID NO: 10732 - protein, 81 aa, Mesocricetus auratus
SWGSVSFEDVSVDFTQEEWNQLDPIQRSLYRDVMLENYSHLVSLGYPITKPKVITSLEQGILDIIKREIPSSSCTDDGQAE

SEQ ID NO: 10733 - protein, 81 aa, Mesocricetus auratus
MLSFRDVAIDFTPEEREYLEPAQWNLYRDVMLENYSNLLFLGLASSKPYLVTFLEQSQGPYDMKGQAASAMQTGKKHSTDK

SEQ ID NO: 10734 - protein, 81 aa, Mesocricetus auratus
MVLVSFEDIAVDFTWEEWQNLDAAQRALYRDVMLETYSSLVSLGHCMTKPELIFNLEHGLGPWSTADASVWNLSGVNKMSS

SEQ ID NO: 10735 - protein, 81 aa, Mesocricetus auratus
VQEPVTFRDVAVSFSQDEWLHLDSAQRSLYREVMLENYSNLASLGILFSKPKVISQLEQAEDFQMVESGMLQGVYLGWKSL

SEQ ID NO: 10736 - protein, 81 aa, Mesocricetus auratus
LQDSVTFKDVAVDFSQEEWERLNPAQRSLYRTVVLENYWNLVSVGACVSKSHLISLLEHGKAPWDMRGEVTESTSQDGESV

SEQ ID NO: 10737 - protein, 81 aa, Mesocricetus auratus
KDLVTFQDEAVDFIQEEWTTKDPAHNSVPGDVTVEDYTSLASVEGEKQLHTKDLALEQEFLTRHSFMETQKVDAVTFEDVT

SEQ ID NO: 10738 - protein, 81 aa, Mesocricetus auratus
SQGLSTFRDVTVDFSQEEAQCINSVQGSLYIDVILENYNNLVSLENYYICDPVHHHVKTEKESCQCDELDKVLHDPSTCAL

SEQ ID NO: 10739 - protein, 81 aa, Ictidomys tridecemlineatus
FQDLVMFRDVTVDFSQEEWECLNSYQRNLYRDVILENYSNLLSLAGCSISKPDVITLLEQGKDPWMIVRDEKRRWSLDLES

SEQ ID NO: 10740 - protein, 81 aa, Heterocephalus glaber
QGLITFRDVAIEFSQEEWKYLEPSQRDLYKDVTLENFSHLVTLGLSISKPDVISLLEQGKEPWMVTNDMTGPWYQGLESRC

SEQ ID NO: 10741 - protein, 81 aa, Heterocephalus glaber
MLENYSHLVSMGYPVSKPDVISKLEQGKDPCIMKRDIPNWTYPDENHRGKRQRKKNNLHNSQSCILGTVSFYNKILKGVTK

SEQ ID NO: 10742 - protein, 81 aa, Neotoma lepida
TQGLVTFEDVAVYFSLEEWERLDVDQRDLYREVMQENYGILVSLGYPIPKPDLIFRLEQGEEPWVPDSPHPEEGDIVTGVY

SEQ ID NO: 10743 - protein, 81 aa, Neotoma lepida
PKVPVAFDDVSIYFSTPEWEKLEEWQKELYKNIMKGNYESLISMDYAMNQPDVLSQIQPGEHSADDQPRPEASEIPADASE

SEQ ID NO: 10744 - protein, 81 aa, Mus musculus
MEDPLSFTDVAIDFSADECECLDSAQWNLYKEVMLENYSNLVFLGLAFSKPYLVTFLEQSSDLWSVKRKASVAIHLGSKAH

SEQ ID NO: 10745 - protein, 81 aa, Mus musculus
PQKSVTFEDVAVYFTQTEWDGLSPGQRALYRDVMLENYRNLASVGFPLLKPAVISQLEERKDLENLFQLATGTDSQGLWTE

SEQ ID NO: 10746 - protein, 81 aa, Mus musculus
YRDVMLENYSNFVSLGLAISKPSIISLLEQGKEPWIVEQAGWCPDLLSVNEAKSLSLKNGIFGKESLKWKIIERVGSSCLE

SEQ ID NO: 10747 - protein, 81 aa, Mus musculus
QICSEGAWVPALFDEVAIYFSDEEWEVLTEQQKALYREVMRMNYETVLSLGNALFSFVSGTLQTQRHSSVSVFSAISNLLL

SEQ ID NO: 10748 - protein, 81 aa, Dipodomys ordii
SLGLVSFEDVSVHFSWEEWKDLDDIQKTLYRDVMLETYSNVVSLDVQQVDGSVEICQESPDKHLLQVVITSSNTVEERVRF

SEQ ID NO: 10749 - protein, 81 aa, Dipodomys ordii
MLENYSNLISVGIHTSKPDVIFKLEQGEEPWIGDEITRQNHTEDDGALEKDPEIQDKHLNQIVFNNETMITEKNYVFGNTF

SEQ ID NO: 10750 - protein, 81 aa, Octodon degus
VQEPVTFRDVAVDFTQEEWGQLDPMQRTLYRDVMLETFGHLLSVGHQIAKPEVISLLEQGEEPWSVEPVHPQSSCPEWMRN

SEQ ID NO: 10751 - protein, 81 aa, Octodon degus
KQVSVTFEDVAVRFTAEEWGLLDLSKRTLYWEVMLETCGLLLAVGCPLSKSELIYQLEHSQDPWTAPEALSQSSHPGSSTK

SEQ ID NO: 10752 - protein, 81 aa, Octodon degus
CEGSVSFRDVTIDFTREEWQHLDPGQRNLYRDVMQETYSHLLSVEKLQKIGDQIENYPQTGSKSFSDVAFIKKMMTVKDHH

SEQ ID NO: 10753 - protein, 81 aa, Octodon degus
TLTFEDIAVNFTTEEWALLNPSQKKLYRDVMWETFMNITTVGRTCDNQQVEEKYKNCSGKLSNKEVPIWYQYKTWTKHEKI

SEQ ID NO: 10754 - protein, 81 aa, Octodon degus
KVQELVTFEDVAVDFTPEEWQYVSPPQRTLYRNVMLETYSHFVSLGQQVAKPDLILKLEVEEPCLAEGEVPIWSFPEVCQI

SEQ ID NO: 10755 - protein, 81 aa, Octodon degus
MFSDVSVDFSQEEWECLDSVQRDLYRDVMLENYRNLISLGPSIPKPQVVSLLEQGKEPWMVGRELTRGLCLDLESMCESKL

SEQ ID NO: 10756 - protein, 81 aa, Neotoma lepida
QEMLSFWDVAIEFSPEERECLEPAQWNLYREVMLENYSNLVFLGEDLIHSLAVSKPHLVIFLEQGQEPSYVKRQAAANVHP

SEQ ID NO: 10757 - protein, 81 aa, Mus musculus
DAVTYEDVHVNFSHEEWALLDSSQKSLYRDVMLETYWNLTAIGYKLEDPNVEEYYQSYRRHRRYNICHCGYKPCEHKGYGK

SEQ ID NO: 10758 - protein, 81 aa, Mus musculus
AYRNLASLGLCASQPDMITSLEQGRDPWMMKRKMRKGQHLDLKAMQETKEFPPKDLSEETLFLAVLRKQLLPHRPKCSMVR

SEQ ID NO: 10759 - protein, 81 aa, Mus musculus
EQLTFRDVAIDFSGEEWECLDSEQQNLYTDVMLENYRNLVFLGLAVSKPYLVTCLEQRKEPWNVKTQKTMAVFPAMFSHHS

SEQ ID NO: 10760 - protein, 81 aa, Mus musculus
SQGPVLFEDVSVVFTQKEWQLLDAAQRHLYREVMLETYRHLRAVGHNVTKPELICKLEQGESPWEPSGHSLSEVQRADTMT

SEQ ID NO: 10761 - protein, 81 aa, Dipodomys ordii
ACRKPGAVSFADVAVYFSPEEWGCLRPAQRALYRDVMRETYGKGGTKPALISWVEEEAELWGLDAQDPEVARCQAGTAPDS

SEQ ID NO: 10762 - protein, 81 aa, Dipodomys ordii
AVTQLTFEDVAVDFTQEEWRCLTQAQRTLYRDVMLDTYGNLVSVGVSPPSMSVILPLEFQEDPWVAKSHVTTPGELNGWEG

SEQ ID NO: 10763 - protein, 81 aa, Dipodomys ordii
SLRLVSFEDVAVDFSWEEWQDLDNAQRTLYRDVMLETYSSLVSLDVQQVDDQIEMCQGSPDRHLWQVVITSSNTVEERVRL

SEQ ID NO: 10764 - protein, 81 aa, Octodon degus
ETVTFEDVAVNFTMEEWALLNPSQKRLYRDVMKETFGNITAIGRVLDNQEVEEYKNYCRSLRNEEVEKCYQNKGWNQYEEI

SEQ ID NO: 10765 - protein, 81 aa, Octodon degus
GLLTFEDVAVFFTQEEWDYLDPAQRSLYKDVMMENYGNLVSLDVLNKDKDEEPSVKQEIEELEEEVEPQGVIVTRIKSEID

SEQ ID NO: 10766 - protein, 81 aa, Octodon degus
LQEPVTFRDVAVDFTQEEWGQLDPIQRILYRDVMLETFRHLLSVGPELPKPDVISQLEQGAEFWVGQQGQPQSCHSEKKPA

SEQ ID NO: 10767 - protein, 81 aa, Octodon degus
NQESVTFQDVAVDFTEKEWPLLDPSQRKLYRDVMLENYNNLTSLGYQVGKPSLISHLEQEEEPRTEEMGTPQGACPDWETP

SEQ ID NO: 10768 - protein, 81 aa, Octodon degus
SKDLVTFGDVSINFTEEEWEWLNPVQRNLYRKVMLENYRSLVSLAGISVSKPDVISLLEQGKEPWVMETEGAGDIRPDRES

SEQ ID NO: 10769 - protein, 81 aa, Octodon degus
AQESLTLEDVAVRFTQEEWQLLGPAQKDLYRDVMLENYRSLVSVGFQASRPDVLPTLEQGEPLWMLEDEIHSQILLEIEKA

SEQ ID NO: 10770 - protein, 81 aa, Octodon degus
SLGPALFRDVAVVFSQEEWERLAPAQRELYRHVMLETYRNLVSLGLAASKPGVISCLEQGRAPWVEETVTAGGPCPVSDSE

SEQ ID NO: 10771 - protein, 81 aa, Octodon degus
VTIEDVAVHFSWNECHLLNKAQKCLYCDVLAENMALITSLDMLHMTYHQQETRSDQKLYRCGARGRQLCFTAETHQHEKLQ

SEQ ID NO: 10772 - protein, 81 aa, Octodon degus
GTIEDVAVDGTHLEEPLMNPTQRSIHSDVMVKNLQKLATVGCQTPIKHSPVSYSKGELVTGQKGVLQELEMQLQTRDLALQ

SEQ ID NO: 10773 - protein, 81 aa, Octodon degus
LTLEDVTVTFTQDEWQLLCPAQKNLYRNVMLENYSNLVSLENGQVVNHVQCHMKNQRMLKDMEQYHKHNPFIDTVLQSKNH

SEQ ID NO: 10774 - protein, 81 aa, Octodon degus
TMAQGLVTFGDVAVLFTQEEWGRLSPPQRALYRDVMLENYSNLVSLGLLGPKPDTFSHLGKEWMLEVSSGCFCLDWMTMTV

SEQ ID NO: 10775 - protein, 81 aa, Fukomys damarensis
QGSVSLKDVTVDFTEEEWQRLDTAQKALYMDVMLENYCHFISMVLFINHKKPVKERSNIYGKTLTLGKNRIISKTLYEHKS

SEQ ID NO: 10776 - protein, 81 aa, Fukomys damarensis
EAVSFEDVAVNFTKEEWSSLDPSQKKLYRDVTAETLRNLAAVAFNTCSACQRHERIHTGEKPYVCKHCGKAFRTQSDYKVH

SEQ ID NO: 10777 - protein, 81 aa, Fukomys damarensis
MECICTLHEGLPVLAAPVHHTWRPGPASSIFFFAAHTAGFLVFKPELISRLEQGQEPWVLDLQGAEGTEAPRTFQTGVSQS

SEQ ID NO: 10778 - protein, 81 aa, Fukomys damarensis
VKIEDMAVSLILEEWGCQNLARRNLNRDSRQENYGNVFSQGRENRSENKESTSKAEDTEDTGSHGETTGRFQKDLGEKREQ

SEQ ID NO: 10779 - protein, 81 aa, Fukomys damarensis
SSDSVTFEDVALDFTQEEWVLLDQSHRDLYREVMLENYENLASMGCELVKPSLISWLEHEEDWRTGQRGGPREWEMQLSTK

SEQ ID NO: 10780 - protein, 81 aa, Mus musculus
VTFDDVHMNFTKEEWNLLDPSQMNLYKDVMLETYWNLTSIGYKWEDHHIEEPCQSSRRHTRHVRSHSWKKLYECNQCGKAF

SEQ ID NO: 10781 - protein, 81 aa, Mus musculus
MEKRCHSEMWHDFSAEERECLDSAQWNLYKEVMLENYSHLVFLGLAFSKPHLITFLERRPEPWNVKTQASVGTYPGSKPYQ

SEQ ID NO: 10782 - protein, 81 aa, Mus musculus
YREVMLENHSSVAGLAGFLVFKPELIFRLEQGQEPWVLDLQGADGTEAPRICQTDSAIRTDRKQTCEYTSLLQRQIPGFGD

SEQ ID NO: 10783 - protein, 81 aa, Dipodomys ordii
SLRLVSFEDVAVDFSWEEWQDLDNAQRTLYRDVMLETYSSLVSLAGHCVPKPEAIIKLEQGAEPWVGEPSGQSFAGHCVHK

SEQ ID NO: 10784 - protein, 81 aa, Dipodomys ordii
SLELMSFDDVAVYFTWKEWQDLDPGQRTLHRDVMLETYSNLMSLGHCVPKPELIVKLEQGADPWIREASDKNFTDIQEMED

SEQ ID NO: 10785 - protein, 81 aa, Dipodomys ordii
PQKSVTFEDVAVYFTQVEWDGLSPAQRALYRDVMLENYGNVASLGLPLLKPAVISQLEEGDELVGPFPLATGTGMGSWDFW

SEQ ID NO: 10786 - protein, 81 aa, Dipodomys ordii
TKKLISFDDVAVNFTWKEWQDLDPGQRTLHRDVMLETYSNLMSLGHCVPKPKLIVMLEQGADPCIREGSEKNFTDAQEMED

SEQ ID NO: 10787 - protein, 81 aa, Octodon degus
AQVSVTFEDVAVRFTAEEWGLLDLSKRTLYWEVMLETCGLLLAVGCPMSKSELICQLEHRQALRKATDDLSQSICPGNSTK

SEQ ID NO: 10788 - protein, 81 aa, Octodon degus
YQDSVTFEDVTVDFTQEEWALLDRGHRDLYREVMLENYKNLASVGCEFIKPSLISWLEHEEDSKMQHRGDPQEWEMQLSTK

SEQ ID NO: 10789 - protein, 81 aa, Octodon degus
MAIDFSLEEWEDLDSAQQNLCRDVMLETYGNLVSLGLADSKPYMITCLEQSREPWNVKKQDSVVIHPAVHNGEKPFKCEEC

SEQ ID NO: 10790 - protein, 81 aa, Fukomys damarensis
QGSVTFRDVAIDFCQEEWECLDPAQRVLYRDVMLENYRNLIAAAGSTISKPDVIALLEQEQEPWIDVRKQTSRRDPDLDSD

SEQ ID NO: 10791 - protein, 81 aa, Rattus norvegicus
MGLVSFEDVAVDFTWQEWQELDAAQRTLYRDVMLENYSSLVSLGHCVTKPELILRLEHGFRPWSIGGDASVWSLPGVLEVY

SEQ ID NO: 10792 - protein, 81 aa, Rattus norvegicus
MMDMLSFWDVAIDFSPEEWEWLKPAQWSLYRDVMLENYSNLVFLGLAVSKPQLVTFLEQRPEPMDVKRQEAATVHSGIALN

SEQ ID NO: 10793 - protein, 81 aa, Mus musculus
YKEPVIFKDVAVYFSQKEWQLLEPAQKDLYKDVMLENYENLISVEYYIFKPKLITRLEQGVDLFAKENDVPGDPQQGEAGV

SEQ ID NO: 10794 - protein, 81 aa, Mus musculus
PAFATELKDLIMEDITIKAEPQEPVIFEDEAVYFTEQELASLTLDQKALHEEVVLENFAHVALLGCYDMFEEMGLGAGEIT

SEQ ID NO: 10795 - protein, 81 aa, Mus musculus
ERRLVKLRTPNMDLVTYDDVHVNFTQEEWALLDASQKSLYKGVMVETYRNLTAIGYSWEEHTIEDHFQTSRSHGSNLESVS

SEQ ID NO: 10796 - protein, 81 aa, Dipodomys ordii
TQVSVTFDDVAVTFTQEEWGQLDPAQKTLYQEVMMETFGLLASLGHPVSKPVLMDQLTHGQELWMVTQGLSKSTCPETKAA

SEQ ID NO: 10797 - protein, 81 aa, Dipodomys ordii
MYFSQEEWELLNPTQKSLYNDVMQENYNTVISLALFVLPKPKVIFCLEQGEEPWVQGSSDFKESRRGFCTGLKVKNDNENH

SEQ ID NO: 10798 - protein, 81 aa, Dipodomys ordii
YQEFVTFEDVAVHLTREEWGCLDPVQRDLYREVMLENYGNVVSLGILLRLPTTRIHCVNSCPALSHTQACAFSGETLAVLT

SEQ ID NO: 10799 - protein, 81 aa, Dipodomys ordii
VQEPVTFKDVAVDFTQEEWRQLNLVQRTLYRDVMLETYGHLLSVGNQITKPEVISLLEQGGEPWLVEQACSQSTHPELMRS

SEQ ID NO: 10800 - protein, 81 aa, Ictidomys tridecemlineatus
SLGSEFFRDVAIVFSQEEWEWLEPAQRDLYRDVMLETYRNLVSLGLAISKPDVISFLEQGKEPWMEERVVSGSLCTVLKSR

SEQ ID NO: 10801 - protein, 81 aa, Dipodomys ordii
FKGPVTLKDITVEFSKEEWKLLTPAQKTLYKDVTLDNYNLLVSVGYRVSKPAIVLKLKQGKDPWSLEVECPRRKHPEKVKN

SEQ ID NO: 10802 - protein, 81 aa, Dipodomys ordii
SQGHVSFKDVCVDFTKEEWYLLDPAQKIMYRDVILENYSNLVSVGHCVTKPEVIYKIEQGEEPWILEKGSSGQNHSEKKWK

SEQ ID NO: 10803 - protein, 81 aa, Dipodomys ordii
SQELVTFEDVAVYFIRKEWKRLEPAQRSLYRDVMLENYRNVFSLDGESRTENDEGISEASGSHGMLLGRFQKDIAQGLKYE

SEQ ID NO: 10804 - protein, 81 aa, Octodon degus
GWVPALFDEVAIYFSDEEWEVLTEQQKALYREVMRMNYETVLSLEFPFPKPDMISRLEQEEESHNSDKWQLQRGTFAENEE

SEQ ID NO: 10805 - protein, 81 aa, Peromyscus maniculatus
MAHVMTFSDVAVDFSPEEWECLNLEQRHLYRDVMLENYNHLVAVGLCIYQPRVLPVLEEEQDAYVDLGSETRGFCPDIDSV

SEQ ID NO: 10806 - protein, 81 aa, Peromyscus maniculatus
YQEFVTFEDVAVHLTREEWGCLDPVQRELYREVMLENYGNVVSLGFPISKPDGISQREQDLQVFDLETKNKEVIRDDCSDG

SEQ ID NO: 10807 - protein, 81 aa, Rattus norvegicus
QVDAVTFEDVAVDFTQEEWTSLDPIQRTLYREVMLENYQNLATVGGQLFKPSLISWLERKVELTVMEQGILQEWEMHLKTK

SEQ ID NO: 10808 - protein, 81 aa, Octodon degus
WSQEPLTFEDMAVDFTREEWEQLQPAQKTLYRDVMLENYRKVVALGHQANKPQRIAELEWEELWPVGALPDGDSGPKIKNS

SEQ ID NO: 10809 - protein, 81 aa, Octodon degus
WDLLTFDDLAVDFSPEEWTLLDLAQRKLYRDVMLETFQNLASLGFEILFKSSESVVLPDNDYEKVSNKEKVITLTRNSSWF

SEQ ID NO: 10810 - protein, 81 aa, Octodon degus
QAQVTFEDVAVLLSQDEWGCLGPAQRGLYRDVMLETYRNLVFLGVGSAGPKPAVILQLERGDEPWVLNTEEAEGRRPLRVS

SEQ ID NO: 10811 - protein, 81 aa, Octodon degus
PKDLEILDDVEMPFSENEWASLTSVGNALYAEVMAENCKTVASLAAASIDRPDANLALEEERDALIQRGWEVGLAEYITKL

SEQ ID NO: 10812 - protein, 81 aa, Octodon degus
LQDAVTFEDVTVDFTREEWALLDVSQRSLYREVMLENCRNLASLGCHVDKTSLISQLEQEDKTMTEERGNLTITCPDLETV

SEQ ID NO: 10813 - protein, 81 aa, Peromyscus maniculatus
DKTLMAFHDVAVAFNQVEWELLSPAQRILYREVMLENYSHLVSLGIAFSKPKLITQLEQGAEPWRDGSECLLDLCLAEPRT

SEQ ID NO: 10814 - protein, 81 aa, Peromyscus maniculatus
PQELVTFEDVAVYFTQSQWDGLQPAQRALYRDVMLENYAHVASLVECPPPKPILVSQLERGEAPWATDPWASECLRGCSPD

SEQ ID NO: 10815 - protein, 81 aa, Rattus norvegicus
YVELVSFEDVTVDFTWEEWQNLSDAQRILYRNVMLETYSSLLSLGQCIPKPELIFKLEQGEEPWAAEEPANKTLPVFCNVD

SEQ ID NO: 10816 - protein, 81 aa, Octodon degus
VHGSVTFRDVAIDFCQEEWECLGPIQRDLYRDVMLENYSNLIAVGSTISKPDVIALLEQGTEPWMGVRKDRSRWYPGLNSG

SEQ ID NO: 10817 - protein, 81 aa, Octodon degus
YKGFLTFEDVAVDFNPEEWALLDPIERNLYKEVMLENYQNLVSVGCQLIKPSLISCLEAEEELRIVERGALQEWALQLNTK

SEQ ID NO: 10818 - protein, 81 aa, Peromyscus maniculatus
MLENRGLLVSLGYPVPRPELMCRLEHGQELWPVMKDLFPSIHAGNNGKTKAAELTPCEPALSKGVSLQGKLTKEASEDWQS

SEQ ID NO: 10819 - protein, 81 aa, Peromyscus maniculatus
MEALLSFRDVAIDFSAEECECLDLAQWNLYRDVMLENYSNLVFLGLAFSKPYLVTFLEQRKEPWNVKGPAPVAVHPEIKPY

SEQ ID NO: 10820 - protein, 81 aa, Cavia porcellus
PKVPVTFDDVAVHFSEQEWGNLSEWQKELYKNVMRGNYESLVSMDYAISKPDLMSQMERGERPPMQEQEDSEEGETPTDPS

SEQ ID NO: 10821 - protein, 81 aa, Ictidomys tridecemlineatus
GQVTFQDVAVYFSWEEWDLLDEAQRHLHLEVMLENLALISSLGCLHGVEHEETPSEPSISEGLSHVMTHREGSSSQHAYTC

SEQ ID NO: 10822 - protein, 81 aa, Dipodomys ordii
LKGAVSFNDVAVDFTQEEWQQLDADEKAMYRDVMLENYSHLVSLGYDFIKPNMIIKLEQGEEPWMIEDDFPSQNHPEDIWK

SEQ ID NO: 10823 - protein, 81 aa, Dipodomys ordii
AVTQLTFEDVAVYFTREEWRCLTPAQRTLYRDVMLDTYRNLVSVGVSPPSMSVILPLEFQEEPWVAQSHVTTLGGLNGWEG

SEQ ID NO: 10824 - protein, 81 aa, Peromyscus maniculatus
SLGPLSFKDVAVAFTQEEWQQLGPEEKTTYRDVMLENYSNLVSVGYHIIKPDVIIKLEQGDEPWVGEEAFSPQSCPDEIWQ

SEQ ID NO: 10825 - protein, 81 aa, Octodon degus
SPVLVSFDDVFVSFTREEWQVLDNAQRALYGDVMLETYRSLVLLGQCITKPEVIFKLEQGVEPWTGGEPHNQSPPDVQEVD

SEQ ID NO: 10826 - protein, 81 aa, Octodon degus
CQESVTFEDVAVIFTDEEWRHLAPVQRALYKAVMLENYESMVSLGLLVPPPDVIFWLKRGDEPCREGLQGSEERECPQIIS

SEQ ID NO: 10827 - protein, 81 aa, Mus musculus
VCGSVTFRDVAVDFSQEEWACLDATQKVLYRNIMLETYSNLVAVVGSCISKPDLIVLLEQEKEPWMAVNEETGRPSPDLEA

SEQ ID NO: 10828 - protein, 81 aa, Cavia porcellus
LQVPVTFEDVAVTFTQEEWGQLDPGQRTLYQEVMLENCGLLVSLGCPVPTPELIQQLEHGQPPWTVRLGCGQSTQLGDSGK

SEQ ID NO: 10829 - protein, 81 aa, Cricetulus griseus
MAHVMTFRDVAIDFSPEEWECLTLEQRHLYRDVMLENYSHLVSVGLCIYQPHEFPVLAKEQDAFMDLGSEGRRCCPDIDPV

SEQ ID NO: 10830 - protein, 81 aa, Cricetulus griseus
FQRLVSFKDLTVDFTREEWQYLGPAQRLLYRDVTLENYRNLISLGFRVSKPEVILKLEQGKEPWIVEELSSQNHAGKCEDR

SEQ ID NO: 10831 - protein, 81 aa, Cricetulus griseus
RQESVTFKDVVVNFTQEEWKHLDPTQRDLFRDVTLENYTHLVSIGLQVSKPDMISQLEQGTEPWIEESCIPVGSMGDWKIR

SEQ ID NO: 10832 - protein, 81 aa, Cricetulus griseus
KPGAVSFADVAVYFSPEEWGCLRPAQRALYREVMRETYGLLGALGVGGAKPALISWVEEEAELWGPGAQDPEVAMCQTQAD

SEQ ID NO: 10833 - protein, 81 aa, Heterocephalus glaber
GEVPVTFDDVAVYFSEQEWGKLEDWQKELYKHVMRGNYETLVSLDYAISKPEVLSQIDQGKDPCTWRRTGPKIPDVPVDPS

SEQ ID NO: 10834 - protein, 81 aa, Heterocephalus glaber
LTMEDVTIKFTPEEWALLDTPQRKLYRNVMVENINHLLSLEYQLCESDLNFLSVDKEMLWTVEGRVIPQLQHPERKIAPNI

SEQ ID NO: 10835 - protein, 81 aa, Mus caroli
PKVTVSFEDVSVYFTKTEWKLLDLKQRNLYKQVMLENYSHLVSVGFAFSKPNLVSQLERGEKPWIRDDRMESAARSRAGNR

SEQ ID NO: 10836 - protein, 81 aa, Mus caroli
MEDMLSFWDVAIYFSAEEWECLGPAQWDLYRDVMLENYSNLVFLGLASSKPYLVRFLEQIQEPSDVKRQAAITVHPGGKCY

SEQ ID NO: 10837 - protein, 81 aa, Mus caroli
GSLENDGVCFSEQEWENLEDWQKELYRNVMESNYETLVSLKVLGQPEEEVELGAEMVGDLVEEGTHLADRAMVKQEMLYKQ

SEQ ID NO: 10838 - protein, 81 aa, Mus caroli
RGTEPVTFRDVAVSFSQDEWLHLDPAQRTLYREVMLENYSNLASLGFQASIPPVIGKLQKGQDPCMEREVPEDTCLDFEIW

SEQ ID NO: 10839 - protein, 81 aa, Mus caroli
MESVSFEDVAVKFTQEEWIVLDPSQKKLYKDVMQETLKNLASIGNKSGKQKVINEYGKLWRKLSSHLAEKFSDYNENHQCA

SEQ ID NO: 10840 - protein, 81 aa, Mus caroli
WPQSVTFEDVAVYFTQAEWGGLSPEQRALYRDVMLENYRNLASVGFPLLKPAVISQLEERKDLENLFQLATGTDSQGLWTE

SEQ ID NO: 10841 - protein, 81 aa, Mus caroli
LQEPVTFRDVAVDFTQEEWGQLDPTQRTLYRDVMLETFGHLLSVGPDLPKPAVISQLEQGAELWVADRGGTRACHPGWILE

SEQ ID NO: 10842 - protein, 81 aa, Mus caroli
MEDLLSFTDVAIDFSADECECLDSAQWNLYKEVMLENYSNLVFLGLAFSKPHLVTFLEQSSDPWSVKRKASAAISLGSKPH

SEQ ID NO: 10843 - protein, 81 aa, Mus caroli
MPPVQKELYKTVTLQNYWNMVSLGLTVYRPTVIPVLEEPWMVIKEIVEGPNPEWEPIAQAQSPAKHLPELKQDGTQTVKLE

SEQ ID NO: 10844 - protein, 81 aa, Mus caroli
LQEAVTFNDVAIDFSQEEWEWLNSAQRSLYRTVVLENYRNLVSVGACISKPSLISLLEHGKEPWEVKGQVTGSRVQGGESV

SEQ ID NO: 10845 - protein, 81 aa, Mus caroli
PQGLLTFKDVAVEFSQEEWECLDCAQRTLYMDVMLENYKNLFFVENLCTFPKYENGLDQDTQHIVHKHVTIQKKSYKYYEH

SEQ ID NO: 10846 - protein, 81 aa, Mus caroli
SQESVTFQDIAVDFTEKEWPLLDSSQRKLYKDVMLENYSNLSSLGYQVGKPRLISHLEQEEDLRMEERGIQQGPSPDWGTT

SEQ ID NO: 10847 - protein, 81 aa, Mus caroli
NTVTYEDVHVNFSQEEWALLDPSQKKLYKDVMLETYRNLNAIGFNWEDQNTEEHCESSRRHMRHERSQSAEKTFEYTQCDK

SEQ ID NO: 10848 - protein, 81 aa, Mus musculus
MNAVTYEDVHVNFTQEEWALLDPSQKKLYKDVMLEIYRNLSALGFNWEAQNIEEYCQSSRRHRRCERSQSAEKPSEYTQRD

SEQ ID NO: 10849 - protein, 81 aa, Mus musculus
MVTFRDVAVVFSEEELGLLDAAQRKLYHDVMLENFRNLLAVGCQSPNKMAPLDTKGIRCLPLGKLPYWQMTSHDVNKLARA

SEQ ID NO: 10850 - protein, 81 aa, Mus musculus
ASSHGPSEDSGCLQERKIAAEMMLVDCLTDDQELVSFEDVIVDFTQEEWSSLNPDQRNLYRDVMLENYQNLATGISSSNPV

SEQ ID NO: 10851 - protein, 81 aa, Mus musculus
MASSSSQDMVCGSVTFKDVAVDFSQEEWACLDATQKVLYRDMMLETYSNLVSVDIELSAPSEPCLPGSCHASCHDDNGLNL

SEQ ID NO: 10852 - protein, 81 aa, Mus musculus
YREVMFENYSNLVSLGLAFSKPYLVTFLEKRQQSWDVKQQATVATYPGTKPYKYKECNKTFVRKSLLIQHQRVHTGEKPYK

SEQ ID NO: 10853 - protein, 81 aa, Mus musculus
PQGLLSFKDVALDFSLEEWECLSFAQRSLYMDVMLENYNNLLFVENHCIHGKYEKVMDQDSQYIVLEHMNIQEKSSKWNKL

SEQ ID NO: 10854 - protein, 81 aa, Dipodomys ordii
CQESVTFEDVCVIFTDEEWEYLVPVQKALYKVVMLENYQNIVSLGLPVLQPDVIFQLKKGDMSWKEGLHGSEEKECPESLA

SEQ ID NO: 10855 - protein, 81 aa, Dipodomys ordii
HGSVTFRDVAIDFSQEEWEFLNSAQKDLYRDVMWENYSNFISLAGPSICKPDMNVLLDEEGKEPSTVVKEGTRRYSPDWES

SEQ ID NO: 10856 - protein, 81 aa, Dipodomys ordii
GWGLLSFTDISMELSLEEWQLLDSAQRHLYREVTLENYSNLLSVGYHGTKPDLVFKLEHGEEPWVINTKMSTQNCPEGWED

SEQ ID NO: 10857 - protein, 81 aa, Dipodomys ordii
GGGPVLFRDVCVDFTWKEWQLLDVTQRLLYKDVMLDNYRHLHALGLCVTKPQLICKLEREEEPWIMEREPPSHSHSGTPNM

SEQ ID NO: 10858 - protein, 81 aa, Dipodomys ordii
MTKLVSFDDVAVDFSWEEWQDLDFSQRTLYRDVMLETYSNLVSLGPCVPKPNLIVKLEEGAEPWIGEASDKNYTNVQEMED

SEQ ID NO: 10859 - protein, 81 aa, Dipodomys ordii
SVKLLSFKDVSINFSPEEREYLSPAQCTLYRDVMLENYRNLVSLGLAISQPYLITFLEEWEEPWNLKRQEAGAVYPAVSSQ

SEQ ID NO: 10860 - protein, 81 aa, Dipodomys ordii
SKVPVSFEDVSVYFTKTEWKLLDLKQRILYKQVMLENYSHFVSLGLAFPKPCLVAYLEQGEGAWVPALHREGAAESQAGDG

SEQ ID NO: 10861 - protein, 81 aa, Octodon degus
ELEGPVSLKDVTVDFTEEEWQQLDPAQKALYREVMLENYCHFISVGFHMTVPHVICKLEEKLWTERIFPSQSYLINLTKQM

SEQ ID NO: 10862 - protein, 81 aa, Octodon degus
PQDLEILDDMKTPFSDNEWASLTSVGHALYTEVMAENYKTVASLAAASIDRPDANLALKEERDTLIPRGWEVGLAEYIIKL

SEQ ID NO: 10863 - protein, 81 aa, Octodon degus
IARSQETMTFKDVAMDFTPEEWGKLDPVQRDVMLENYRNLVSLWLPVSKPENYNLDNGKEPLKCERKAPKLRYSDIEIIPE

SEQ ID NO: 10864 - protein, 81 aa, Octodon degus
SLVLVSFDDVFVSFTREEWQVLDNAQRALYRDVMLETYRSLVLLGECITKPEVIFKLEQGAEPWTGGEPPNQSPPDVQEVD

SEQ ID NO: 10865 - protein, 81 aa, Mus musculus
MDALTFDDVHVHFTREEWSLLDPSQKRLYKDVMLENYRNLTAIGYHWKDHNIEEHCQNDRRYGRHERSPAGEKPYEYTQWN

SEQ ID NO: 10866 - protein, 81 aa, Mus musculus
MKDLLSFTDVAIDFSADECECLDSAQWNLYKEVMLENYSNLVFLGLAFSKPYLVTFLEQSSDPWSMKRKESAAIHLGSKPH

SEQ ID NO: 10867 - protein, 81 aa, Cavia porcellus
MLENYGNVASLGFPLLKPAMISQLERGGELKGPSPLATGTGTGSQGLWPVDTDIQTNSNLTKKIHEEKDGTSFELPRDICL

SEQ ID NO: 10868 - protein, 81 aa, Cavia porcellus
RDVAVVFSEEELGLLDSAQRELYREVMLENFRNLLAVEHRFITADISPQLERQGKLWMREMTVQSDDASGENKKLNEMETL

SEQ ID NO: 10869 - protein, 81 aa, Cavia porcellus
ELMTFRDVAIDFSPEEWECLDSAQWNLYRDVMLENYRNLVSLGLAVSKPYLVTFLEQRKELWNVEREEILAIFPAESSPYT

SEQ ID NO: 10870 - protein, 81 aa, Cricetulus griseus
VMTFRDVAIDFSPEEWECLTLEQRHLYRDVMLENYSHLVSVDIDPVWRKNKVLPKDSTRAGQLSQWEVLETDTNHSLEGLC

SEQ ID NO: 10871 - protein, 81 aa, Cricetulus griseus
YFCGMLTASGVTVNLSQEEWQCLDPPLRALYRDWMLQNCSRMVSVGLTDHPDLLTCAAEQRGWKMETDETVVKDPEKQALF

SEQ ID NO: 10872 - protein, 81 aa, Cricetulus griseus
EEALMAFHDVAVAFSQMEWELLSPPQRALYREVMLENYSHLLSLGIAFSKPKLITQLEQGAEPWRDGSECLRDLCLAESRT

SEQ ID NO: 10873 - protein, 81 aa, Cricetulus griseus
PQGPISFRDVAVDLSQEEWECLDCAQRALYLDVMLENYSNLVFVENHCIYGKYEKILDQGTKHMTHKHVNIQEKHFEFDEL

SEQ ID NO: 10874 - protein, 80 aa, Cricetulus griseus
MLENYSSLMFLGYCMTKPELIFKLERGFGPWSVVEASLQSLPGVHKMTTPIENHQEYHNGFLWPVEITNSQTSNEEIVEN

SEQ ID NO: 10875 - protein, 81 aa, Ictidomys tridecemlineatus
QDSVTFKDVAVLFTQEEWGQLSPAQRALYRDVMLENYSNLVSLAQAPLIDEPHHSPVFISLSLSFLIADISKDELDSHWKY

SEQ ID NO: 10876 - protein, 81 aa, Marmota monax
GSVTFEDVAVTFTQEEWGQLDPAQRTLYQEVMLENCGLLVSLGYPVPKPELIFQLEHGQQLWTVMIDLFQSTCPGDSGKPQ

SEQ ID NO: 10877 - protein, 81 aa, Marmota monax
MQEEWALLDASQKNLYRDVMLEVLRNLASIGNKCDEKNFEDQIKHSGSNVRQITSHYGHERYKHEECEEKPCELKQYRKSL

SEQ ID NO: 10878 - protein, 81 aa, Marmota monax
MQRKAILRQSRSFRSPQPAAPPPQARKAAVTWAGHCIPKPDAIIKLEQGAEPWVAEEPPDQSHPGHCIPKPEAIIKLEQGA

SEQ ID NO: 10879 - protein, 81 aa, Marmota monax
CVTFEDVAVYFSQEEWGLLDEAQRLLYLHVMLENFALVTSLVYWHEAEDERIPPGPRVSAEEASHIRTPKQSPSFQKTHPC

SEQ ID NO: 10880 - protein, 81 aa, Marmota monax
PLTFRDVAIDFSEEEWKYLNPSQQNLYRDVMLEIYRSLVFLGMSPHQMLEISAEQGINYLWQTMKNGSPRKHQCDHFKKKV

SEQ ID NO: 10881 - protein, 81 aa, Marmota monax
MWQFGKILHYFSLTGHCIIKPEVIFKLEQGAEPWMVEEHPNQTLSDVQKVDDQIDRSQESQDRRLWQVVITNSNSSTKERV

SEQ ID NO: 10882 - protein, 81 aa, Heterocephalus glaber
RWQDSVTFGDVAVDFSWEEWKLLNEMQRLLYRDVMLENFGLVASLGLVSSQIHVLVQLELEEDWVADRADLTVAAREPWRR

SEQ ID NO: 10883 - protein, 81 aa, Mus musculus
MEAVTFKDVAVVFTKEEFRLLDSAQRTLYQDVMVENFRNLLSVEYQLFKRDKPYLEREEKPQTRRAAPRERDSGINGQSAR

SEQ ID NO: 10884 - protein, 81 aa, Mus musculus
FKELVVFRDVAVEFCKEEWECLGPEQRSLYRDVMLENYSNFVSLGLAISKPSIISLLEQGKEPWIVEQAGWCPDLLSVNEA

SEQ ID NO: 10885 - protein, 81 aa, Mus musculus
YQDVMLENYRNLVSVGYQLSKPTVISQLEKGEGPCMAESQGPEDPILDVKNKLETKESTAEDDISVKLDHGITRGRLIEDD

SEQ ID NO: 10886 - protein, 81 aa, Dipodomys ordii
KVPVTFVDIAVYFSEDEWKNLDEWQKELYNNLVKENYKTLMSLDAEGPVSKPDAPAQVEPREEPCVWEQRHPEEREVPVDA

SEQ ID NO: 10887 - protein, 81 aa, Dipodomys ordii
AYGPVTFRDIAIDFSQQEWECLNSSQKNLYRNVMMENYGNLVSLGHPISKPDIITLLEQGKDPWMIVRKETRKGFREFKPA

SEQ ID NO: 10888 - protein, 81 aa, Octodon degus
IQSLVTFNDVAVEFTPWEWGQLGPAQTHPYKEVMLENTGDLASGGRMGKSPVSETELEMGTHPNWKRRLKAKESASSQRIS

SEQ ID NO: 10889 - protein, 81 aa, Dipodomys ordii
MEEWALLDASQRKLYGNVTSEMYRNLASIEIKEEENTEGGYRNRKRIVRTAKVEKLCEETGDIPCGESFQQVPDCSVNRSL

SEQ ID NO: 10890 - protein, 81 aa, Ictidomys tridecemlineatus
LLTFRDIAIDFSEEEWECLEPAQQNLYRDVMLETYRNLVFLAMISHHTQEISPEPGLEHLLKQVIKRRYGYCNLDYLQQQK

SEQ ID NO: 10891 - protein, 81 aa, Marmota monax
AHVSLAFKDVAIDLSQEEWECLDTAQRDLYRDVMLENYSNLISLGCIIPKPDVIVLLEQEKDPWLETREETRRQSSDFTKK

SEQ ID NO: 10892 - protein, 81 aa, Marmota monax
VMFEDVAVHFSWEEWGLLNATQRGLYRDVMLENFALVSSLGCLCRMKDEDAPPKQVKSCRVDLSEKPFVYERFVKDGPVTT

SEQ ID NO: 10893 - protein, 81 aa, Marmota monax
SQTLVTFKDVLVDFTREEWQLLDPAQQVMYKDVMLENYENLVSLGHQLPKPEVILQLEKGEEPWLVERAVQELCPDLDTNV

SEQ ID NO: 10894 - protein, 81 aa, Marmota monax
MITNYETLLSLDDRLSKPELISWIEQEEEPFKSWGESQKPRNMIHSADMYFDPHIEGELFGGSQETVKSGETKCHFQFSPL

SEQ ID NO: 10895 - protein, 81 aa, Marmota monax
AHGSVTFRDVAMDFSQQEWECLNPFQKTLYRDVMMENYGNLVSLGHSISKPDVITLLEQGKEPWMIVKKETRKWRKDLESR

SEQ ID NO: 10896 - protein, 81 aa, Marmota monax
MLLDTAQRALYRHVMLGNFALVASLGLSASRPRVVIQLEHGEEPWVPSGTDTALGRNAHRKSSLGSCCLAEDRDVSGEPTL

SEQ ID NO: 10897 - protein, 81 aa, Heterocephalus glaber
FQLPVTFKDVAVYFSKEEWECLSPKQRALYRNVMLDNFRSLVALGFCGPRPDLVSRLEQWDELWVEDCEKTELQEAQSAPC

SEQ ID NO: 10898 - protein, 81 aa, Heterocephalus glaber
AVTFEDVAVNFSVEEWALLDPSQKKLYRDVMWENFRNVTALDVRAFSTPIYVQLQERNHSRVNTYICIQSGKVLNSHHDIQ

SEQ ID NO: 10899 - protein, 81 aa, Heterocephalus glaber
SVTFKDVVVDFTQEEWKQLDPGQRDLFRDVTLENYTHLVSIGLQVSKPDVISQLEQGTEPWTVEPGPGVAVGACGGRQQMP

SEQ ID NO: 10900 - protein, 81 aa, Mus caroli
KPGAVSFADVAVYFSPEEWRCLRPAQRALYREVMRETYGLLSYIEVGCAKPALICWVEEESEVWGPCAQDPEVAMCKTEFH

SEQ ID NO: 10901 - protein, 81 aa, Mus caroli
EEEQASSCDSGIMAHEEWECLSSYERDLYRDVMLENYSHLVSLAGCSISKPDVITLLEQGKEPWMIVRAEKRRWSRDLESR

SEQ ID NO: 10902 - protein, 81 aa, Mus caroli
EMVTFRDVAVVFSEEELGLLDAAQRKLYHDVMLENFRMLLSVGDKNPEEIESLEEVGLRHLPHEALFCSQIWQQVSRDLTK

SEQ ID NO: 10903 - protein, 81 aa, Mus caroli
ENAEDSMASTLPTTWPHESVKFEDVSLRFTEEEWALLDRQQKCLYREIMMENYSNMISVGKPGSTLINTCLGGWSMLLIPS

SEQ ID NO: 10904 - protein, 81 aa, Mus caroli
SKAPVTFGDLAIYFSQEEWEWLSPIQKDLYEDVMLENYHNLVSVGLACRRPNIIALLEKGKAPWVIEPSRRRWGPESGSKY

SEQ ID NO: 10905 - protein, 81 aa, Mus caroli
MEEMLSFRDVAIDFSPEERECLEPAQWDLYRDVMLENYSHLDFLGLAVAKPYLVTFLEQNQRSSGVKSQTSATIPPGTTGN

SEQ ID NO: 10906 - protein, 81 aa, Mus caroli
FKELVVFRDVAVEFCKEEWECLGPEQRSLYRDVMLENYSNFVSLGLAISKPTIISLLEQGKEPWIVEQAGWYPDLLSENEA

SEQ ID NO: 10907 - protein, 80 aa, Mus musculus
AGEIWPGFRKPELVSFADVAVYFSPQEWGCLRPAQRTLYREVMRETYGLLGALGEAPSQSPAPILLGVHRGVAVDRSSGL

SEQ ID NO: 10908 - protein, 81 aa, Mus musculus
FQVPVTFRDVAVYFCREEWECLSPSQRTLYRNVMLENFRNLNELGCCSRRPGLITRLEQWDEPWVDDWDRSEFPDGQKSFC

SEQ ID NO: 10909 - protein, 81 aa, Mus musculus
DAVTYDDVHMNFTEEEWDLLDSSQKRLYEEVMLETYQNLTDIGYNWQDHHIEEHCQSSRRHERHERSHIGEKPYERNQCGK

SEQ ID NO: 10910 - protein, 81 aa, Mus musculus
TQRSISFKDLAVDFTREEWQRLGPAQRLLYRDVMLETYSNLIAVGLHVSKPDVILKLEQGKEPWVVENSSRQNHAEDDEPL

SEQ ID NO: 10911 - protein, 81 aa, Mus musculus
YRDVMLENYSNLLFLGHCKTKPELIFNLEQRLGSWIVEASHQCVPDFQNMSTLNKSSPDTKARHVWQVALNSETSKELAGI

SEQ ID NO: 10912 - protein, 81 aa, Mus musculus
YREVMLENYSNLSFLGYQVGEPRLISHLEQEEDLRMEERGIQQGPSPVFSFRLGTTSKVKWSILLEDIFGKEASDDVRLET

SEQ ID NO: 10913 - protein, 81 aa, Mus musculus
DAVTYDDVHINFTQEEWVLLDLSQKRLYKDVILETYRNLTAIGYKWEEYNIEEYCQNSRIHGRQERSHPEDKLYEYRQCGK

SEQ ID NO: 10914 - protein, 81 aa, Dipodomys ordii
VSFEDVTMSFSWEEWNLLDEAQRHLYFSVMLENLARMSSLGRSLEVKHDGTPSEPSISVALSQVRDLLSRFSSPECIFHSA

SEQ ID NO: 10915 - protein, 81 aa, Dipodomys ordii
SQAPVTFEDMAMYLTREEWRPLDPTQRDLYRDVMQENYGNVVSLDFEIRSENEVNPKQEISEEVEFGTTSDGRPVGSREEN

SEQ ID NO: 10916 - protein, 81 aa, Dipodomys ordii
SQTLVTFRDVLVDFTEEEWKLLDAAQQFIYKDVMLENYKNLVFLRFHLPKPDVIHCLEKGEEPWLVERRIYRETQPVKDLR

SEQ ID NO: 10917 - protein, 81 aa, Dipodomys ordii
LQGSVSFEDVAVDFTQEEWNQLDTSQKTLYRDVMLENYSHLVSVGYLITKPEVIAFLEQEAVLGIIKREIPSSSCTEDGQV

SEQ ID NO: 10918 - protein, 81 aa, Dipodomys ordii
YEVPVSFEDVTVDFSREEWQKLDSTQRCLYQDVMLENYSHLLSVGFEVPKPEVIFKLEQGEEPWMLEDEVPHQSCFDGKFG

SEQ ID NO: 10919 - protein, 81 aa, Octodon degus
IVTFEDVAVTFTMEEWTLLNPSQKNLYREVMWVTFLNMASIGTTWDKNIDMAYKNWWQNIRNEEVEKCYEYKAWNQHEDIL

SEQ ID NO: 10920 - protein, 81 aa, Octodon degus
VRFADVAVYFSPEEWGCLRPAQRTLYRDVMRETYGHLGALADSPSKKEEPKEEPGDKGPALTPGKEPPEELVKHSPDSSVS

SEQ ID NO: 10921 - protein, 81 aa, Octodon degus
MEDVAVNFTKEEWALLNPSQKKLYRDVMWETFRNIKAIGRTWDNQMEEKYKNCSRNLRNDEGAKCYQYKACNQPENRSNHT

SEQ ID NO: 10922 - protein, 81 aa, Octodon degus
AQVAVTFEDVAVLFTQDEWRKLDALQKSLYRDVMLENYRNLASLGFLFTKPRVISLLQQEEDPWKVEKEIPGDPAIGCKSS

SEQ ID NO: 10923 - protein, 81 aa, Octodon degus
YKVSVTFDDVALEFTQEEWTLLDITQRNLYREVMLENYENLSSVGYQFFIPSLISWLKQEELNTAETGVLHPLELELQQIT

SEQ ID NO: 10924 - protein, 81 aa, Octodon degus
KVPVTFVDIAVYFSEDEWKNLDEWQKELYNNLVKENYKTLMSLDAEGPVAKPDAPAPVEPREEPCVWEQRHPEERQVPVNT

SEQ ID NO: 10925 - protein, 81 aa, Octodon degus
EESITIEDVTITFTPEEWALLDTAQRTLYRAVMLETIRNLQSLEKNNSPDAEGQIATGPVKRKKPDSVKPRENAQCEEIHF

SEQ ID NO: 10926 - protein, 81 aa, Octodon degus
AQGLVTFRDVAIEFSQEEWKCLEPSQRDLYRDVTLENFSHLATLGLSISKPDVISLLEQGKEPWMVTDDMTGPWYQGLESR

SEQ ID NO: 10927 - protein, 81 aa, Octodon degus
AVTFEDVAVSFTLEEWALLDPSQKKLYRDVMWETFRNLADIGKNWDDHQVEDEYKNYRKIARNAEDYKCCQYKLWCQHAKI

SEQ ID NO: 10928 - protein, 81 aa, Octodon degus
FKGLVMFEDVAIEFSEEEWEGLDPSQRNLYRDVMLENYNTFISLGLAISKPSVIFLLEQGKEPWMAGKTGSYPDLLSWYET

SEQ ID NO: 10929 - protein, 81 aa, Peromyscus maniculatus
AQGRVTFEDVYVNFSREEWELLDEPQRLLYLNVMLENFSLVATLGCWCESDGKEAPCEHNISGEAVPQTRTAESSLPMQTS

SEQ ID NO: 10930 - protein, 81 aa, Peromyscus maniculatus
IILSHNALLAQEKMKKEEMNNGLQIRGRNLYRALMLENYRNLVALGHQLYKPEVITQLEQEVRRTLERGSQLDAFPDGVDR

SEQ ID NO: 10931 - protein, 81 aa, Peromyscus maniculatus
SPSLMAFEDVAVYFSQEEWTFLDAAQRALYRHVMLENFALVDSIGLSVSRPRVIIQLQRGEEPWVPNRTNTGPGRRPHRRS

SEQ ID NO: 10932 - protein, 81 aa, Peromyscus maniculatus
PQGLLSFRDVAVDISQEEWECLDCAQKALYMDVMLENYNNLLFVENHCICGKYEKVLHQDTKHFIHDHENVKEKSYKCNEL

SEQ ID NO: 10933 - protein, 81 aa, Peromyscus maniculatus
VPQVLTFRDVAVSFSQEEWECLESASKALYFDVMLENYSNLVFVEKYRICGKYMNVLDQGSKHIVYHPVNIQEKSYENSDI

SEQ ID NO: 10934 - protein, 81 aa, Mesocricetus auratus
GKDTITYDDVHIGFTQEKWALMNPSQICLYKDVMLEMYRNLSAIGYKWEENNIEKHCDSSRRNRTNERTHSAEKPYACNHC

SEQ ID NO: 10935 - protein, 81 aa, Mesocricetus auratus
PQDPLTFRDVTVVLSQEEWECLDAAQRTLYMDVMLENYSNLVFVENHRPCGNHEKFQDQGLKHIVHHRHVNIQEISCKCNE

SEQ ID NO: 10936 - protein, 81 aa, Mesocricetus auratus
ESVTFEDVAVHFTMEEWAMLDPSQKELYKDVMKEILRNVISIGNIRKHQKIENEYQNSGRKLRCQLVEKLHDCKEDHECAE

SEQ ID NO: 10937 - protein, 81 aa, Mesocricetus auratus
MLENYRHLLAVGYRVVKRSVISKLKQGKEPWVSERELPNQRRDDKQQNVSDPKTKHRERQAGNARKGELGKRRKTPTQYES

SEQ ID NO: 10938 - protein, 81 aa, Mesocricetus auratus
DLVSFKDVTVDFTQEEWTSLNPAQRCLYRDVMLENYKNLATVEWKMQLETKCSTFQQKFLKGNIFNGMQMTGSQNVRELFN

SEQ ID NO: 10939 - protein, 81 aa, Ictidomys tridecemlineatus
FQELVSFNDVTVGFTQEEWQHLDPSQRSLYREVMLENYSHLVSVGYCVTKPEVIFRLEQGEEPWILEAEFPSQSFPELWKA

SEQ ID NO: 10940 - protein, 81 aa, Ictidomys tridecemlineatus
LMTVKDEEMDFTHEELEELNSAHRYMGMDMKVDNYGSLVFWDSESMPETKEFFSKQEVYEEESPERELVIERLEKDDSWGS

SEQ ID NO: 10941 - protein, 81 aa, Ictidomys tridecemlineatus
EPGAVSFADVAVYFSLEEWGCLRPSQRALYRDVMRETYLHLSALGGGGTKPALISWVEEEAELWHPDAQDPEVAKCPTEAD

SEQ ID NO: 10942 - protein, 81 aa, Ictidomys tridecemlineatus
MLENYHVLVSLGYEVMKPDVIFKLEQGEEPWVGDGDTPRSDSAEVCQVDGHMKWHQDNQDKLKNVKKGHEWDAFGKNFNPS

SEQ ID NO: 10943 - protein, 81 aa, Heterocephalus glaber
QGSVMFSDVSIIFSQEEWEYLDREQRNLYRNVMMENYSNLVSLAGCFISKPDVITLLEQGKDPWKVVRKGRKRYSDLETSH

SEQ ID NO: 10944 - protein, 81 aa, Heterocephalus glaber
QESLTFQDVAVDFTKEEEEQLYPAQKNLYRDVMLENYRNLVALGHQVYKPAVITQLEQEELWTRGGGHPVGAPLDGDNGPK

SEQ ID NO: 10945 - protein, 81 aa, Mus caroli
KVPVTFVDIAVYFSEDEWKNLDEWQKELYSNLVKENYKTLMSLDTDGPVSKPDPPVQAESREEPCVWEQHHPEEREIPVTA

SEQ ID NO: 10946 - protein, 81 aa, Mus caroli
MDAVTFMDVHVNFSQEEWALLNPSQKSLYKDVMLETYWNLTCIGYEWEDHNSEECCQSSRRHGRYFNSSQYSTCKAKGYGK

SEQ ID NO: 10947 - protein, 81 aa, Mus caroli
MLSFRDVAIDFSPEEWEYLEPAQWNLYRDVMLENYSHLVFLGLADSKSQLLTFLEQRQGSAAVKRQAVKAVFPGITPNDSN

SEQ ID NO: 10948 - protein, 81 aa, Mus caroli
MEEMLSFRDVAIDFSAEEWECLEPAQWNLYRDVMLENYSNLVFLGLASCKPYLVTFLEQRQEPSVVKRPAAATVHPGGKPY

SEQ ID NO: 10949 - protein, 81 aa, Mus caroli
VPLLGAGTSGKPRSSDMDVVTYDDVHVNFTWEEWALLDPSQKTLYKEVMLETYRNLAAIGYYWKDHNISEGHFQNSRRNGR

SEQ ID NO: 10950 - protein, 81 aa, Mus caroli
EQDGLTHDDVHVNFTREEWALLNPSQKSLYKDVMLETYRNLNAIGYKWEDNNIEEHCQSSRRHGRHERRLIGEKHSENIQC

SEQ ID NO: 10951 - protein, 81 aa, Mus caroli
MMGSQEEWEQLDPSQRILYMDVMLENYSNLLSVEVWKADDEVEKDPRDLQRQAGSLTAIKSQPPTEERGSLSGKTLTLNTD

SEQ ID NO: 10952 - protein, 81 aa, Mus caroli
FWILRLPPGSKGEVPKEWGKLEDWQKELYKHVMRGNYETLVSLGSGAPVPAPDLLMQIKQEGELQLQEQQALGVEAWAAGQ

SEQ ID NO: 10953 - protein, 81 aa, Neotoma lepida
PTLVLLQTCPSAAEDEYILGYHIIKPDVIIKLEQGDEPWIREGGFSPQSCPDEIWQENGLMEKVRGNEKKQSRSTVFNYKS

SEQ ID NO: 10954 - protein, 81 aa, Mus musculus
MGRVTYDDVHVNFTREEWALLDPSQKNLYRDVMLETYRNLAAIGYVWEDHNTEEHLHISRRYERHERSHTAQQLSEFIQCD

SEQ ID NO: 10955 - protein, 81 aa, Mus musculus
MDLVTYDDVQVNFTQEEWALLDPSQKSLYKDVMLETHRNLTAIGYIWEEHTIEDHFQTSRSHGRHERSCSAEQPSEFIQCG

SEQ ID NO: 10956 - protein, 81 aa, Mus musculus
PQGQLTFKDVAVDFSQEEWECLDCAQRALYMDVMLENYNNLFFVETHGMCPKYKNILDQDLQHIVHEHVNIQVKSYKCHEL

SEQ ID NO: 10957 - protein, 81 aa, Dipodomys ordii
SLKLISFDDVAVDFTWKEWQHLDPGQRTLHRDVMLETYSNLMSLGHCVPKPELIVRLEQGSEPWIREASDENFTNVPQMED

SEQ ID NO: 10958 - protein, 81 aa, Dipodomys ordii
LGDQDLGAVLLPGTPQDQWRHLDSTQKEQYWDLMLETYGKMVSGGVSTSKPNLPNSTELGKDLTGLPPHISEKIARLTCAG

SEQ ID NO: 10959 - protein, 81 aa, Octodon degus
TMAQGLVTFGDVAVLFTQEEWGRLSPPQRALYRDVMLENYSNLVSLGLLGPKPDTFSHLGKEWMLEVSSGCFCLAVVNSIL

SEQ ID NO: 10960 - protein, 81 aa, Octodon degus
AVTMEDVTVTFTKEEWAVLNPAQKKLYREVMWETLRNINAVGRTWSNQKMEEEYQNCSRNLRMEERAKCYQYKTCNQHENV

SEQ ID NO: 10961 - protein, 81 aa, Fukomys damarensis
MEEWALLDPSQKKLHRDVMWENFTNVTVIGRNGDDQQIEDEFKNYRNNLSNAEEKSTVYKQDVKNFSKPNYVKIHERNHRR

SEQ ID NO: 10962 - protein, 81 aa, Mus musculus
MDAVTYEDVHVNFSREEWVLLDPSQKSLYKDVMLETYWNLTCIGYKWKDHDNEEYCQNSGRHGRCINCPSAYGKKQCTNLF

SEQ ID NO: 10963 - protein, 81 aa, Cavia porcellus
PRVLETFSDVAVTFTQEEWRQLDLTQRTLYQEVMLEICTILVSLGYQVPKPELIYLPEHGQELWQMKGLMPVTCAGNRAQL

SEQ ID NO: 10964 - protein, 81 aa, Cavia porcellus
MLENYSSLVSVGYQASKPDALSRLLCGEPWMVEDELHCRTPSNIGKTDDDLPRYLQNESKVKRLEKWHEHNTYENVQQSKT

SEQ ID NO: 10965 - protein, 81 aa, Cricetulus griseus
EKQFSFQSLLTFEDVAINFSKKEWECLDTSQRDLYRFVMLENYSNLVSVGLSVSKPELVTCLEQNKEPWMVNIEESEVLEP

SEQ ID NO: 10966 - protein, 81 aa, Cricetulus griseus
GAVTFGDVAVDFSEEEWACLDSAQRAFYRDLMLETYSNLVTVVGSSISKPDLITSLEQEREPWMVVKEETDRPSPGDLSPF

SEQ ID NO: 10967 - protein, 81 aa, Cricetulus griseus
FQEPVTFKDVAVAFTQEEWGQLDIVQRTLYRDVMLETYGHLLSVGNHISKPEVISLLEQGEEPWSVKQAYPPSTCPGEVKP

SEQ ID NO: 10968 - protein, 81 aa, Cricetulus griseus
PQGLLSFRDVSVDFSQEEWECLDCAQRALYMDVMLENYSNLLFVENQRIYGKCEKLLHQGTRHFIHYHENIQEKSFTCNES

SEQ ID NO: 10969 - protein, 81 aa, Cricetulus griseus
SLLTFNDVAINFSKEEWECLDLSQRDLYRNVMLENYINLVSVGFSDSKPELVTCLEQNKEPWMVNMEEAEGLEPNIPKRMY

SEQ ID NO: 10970 - protein, 81 aa, Cricetulus griseus
EKQFSFQSLLTFEDVAINFSKEEWECLNTSQRDLYRFVMLENYSNLASVGLSVSKPELVTCLEQNKEPWMVNIKDSEVLEP

SEQ ID NO: 10971 - protein, 81 aa, Cricetulus griseus
SVPKQKPLDVLRDRNHHPRGRHNQRHKNMSSRKDAVTYDEVHTNFTQEEWAFLDPSQKRLYEDVMLDTYRWKDHNIELSNF

SEQ ID NO: 10972 - protein, 81 aa, Castor canadensis
SRSIENDGVCFSEQEWENLEDWQKELYRNVMQSNYETLVSLKVLGQPEGEAELSSEMLGDLEEEDPHGTHLADGAMVKQEV

SEQ ID NO: 10973 - protein, 81 aa, Peromyscus maniculatus
MDVVTYNDVHVNFTQEEWALLDPSQKSFYRDVILETYMNLTDIGYNWEDHNVEEHCQSSQRYGSYVVCHSGYKPYEHRDIE

SEQ ID NO: 10974 - protein, 81 aa, Mesocricetus auratus
MLSFWDVAIEFSPEEREYLEPAQWNLYRDVMLENYSHLDFLGLAVPKPHLVTFLEQRQEISDVKRQTAATMHPGTTTNDYN

SEQ ID NO: 10975 - protein, 81 aa, Mesocricetus auratus
GSAESRAESVGRLEDRGVDAVTCSDVRVDFTQEEWALLDPSQKILYQDGMLETYRNLTAIGYKWEDDNIKEHCQSSQRHGR

SEQ ID NO: 10976 - protein, 81 aa, Mesocricetus auratus
SKAPVTFGDLVIYFSQEEWEWLSPIQKDLYEEVMLENYHTLVSLGLVSRRPNIITLLEKGKAPWMVEPSRRRRGPESGSKR

SEQ ID NO: 10977 - protein, 81 aa, Mesocricetus auratus
MDAVTYDDVHINFTLEEWALLNPSQKSLYKDVMLDTYRNLTAIGYSWDDHNIEEICQSSRSHRRHLQRHAKINTGEKPYGS

SEQ ID NO: 10978 - protein, 81 aa, Mesocricetus auratus
MLETYSSLESLNQCDAKPELILKLEQGAEPWKEEDVPNQSLPAVENVKSLNNTSWDNQKRYLNHLVITGNSSTEERVKFGK

SEQ ID NO: 10979 - protein, 81 aa, Mesocricetus auratus
AQSQLTFEDVAISFSKEEWKSLHTSQREMYRDVMLENYSHLVSVGLSDSKPELITYLEQKKEPWMENIQEVKGLEPGFVPK

SEQ ID NO: 10980 - protein, 81 aa, Mesocricetus auratus
MLENYSNLVSVGITVSKPELINSLEQSKDPWDVNTGEIEDKDQGNIDIRRHGHRHLSGGMGMPGFCTEILYKDIMLEACRN

SEQ ID NO: 10981 - protein, 81 aa, Mesocricetus auratus
QETVTFEDVAVNFTLGEWALLDSSQKKLYRDVMTETFMNLLSLGKTKGKENIEDNYQNLRKNVRTQVVERSCVYGDGSQCG

SEQ ID NO: 10982 - protein, 81 aa, Mesocricetus auratus
CARLVSFEDVTMNFSQEEWQYLNPAQRRLYQDVMLEVYSHLLAVGEHSQGPYSNPCVPLKESITSLVTSVLHCVPFTVPSN

SEQ ID NO: 10983 - protein, 81 aa, Mesocricetus auratus
VQEPVTFRDVALFFSQDEWLHLDSAQRSLYREVMLENYSNLASLGIQVSIPRVIHKLQKGQDPCMERKDLEDTCLDFQIWP

SEQ ID NO: 10984 - protein, 81 aa, Mesocricetus auratus
IAKSQETMTFKDVAMDFTPEEWGKLDPAHRDVMLENYRNLVSLWLPISKPDSYNLDDGKELLKLERKPPKCSNSDMETRPE

SEQ ID NO: 10985 - protein, 81 aa, Heterocephalus glaber
VQGCVTFEDVTIYFSQEEWGLLSEAQRLLYCDVMLENFALIASLGLTSFRCHVIAQLEVGKEPWVPDRVAMTSAMTRGAFG

SEQ ID NO: 10986 - protein, 81 aa, Heterocephalus glaber
TARSQETVTFKDVAMDFTPEEWGKLDPAQRDVMLENYRNLVSLWLPVSKPENYNLDNGMEPLKFERKPPKRSYSDMESIPE

SEQ ID NO: 10987 - protein, 81 aa, Heterocephalus glaber
GKEAVTFKDVAVVFSEEELGLLDSAQRKLYRDVMLENFRNLLSVGHQSFKPDVISQLEREEKLWMTEIQTQRGNRNQNKME

SEQ ID NO: 10988 - protein, 81 aa, Mus caroli
NAMAHQGTMTFGVVAVELFEEWRCMEPAQRDLYRNVTLKNFSYLVSLGLVIFKPDVIFLLEQGKEPWTVTNYMTHPWHPGK

SEQ ID NO: 10989 - protein, 81 aa, Mus caroli
DAVTYDDVHINFTQEEWVLLDLSQKRLYKDVILETYRNLTAIGYKWEEHNIEEHCQNSRIHGRQERSHPGDKLYEYRQCGK

SEQ ID NO: 10990 - protein, 81 aa, Mus caroli
AVTFRDVAVVFSEEELGLLDAAQRKLYHDVMLENFRNLLAVGCQSLNTMAPLDTTGIRCLPLGKLPCWQMTSHDVNKLARA

SEQ ID NO: 10991 - protein, 81 aa, Mus caroli
PCERWMFFEDVTVDFSQEEWQHLDSAQRCLYQEVMLEIYSHLLAVGYPRPEVILKMKKVKGPLMGKVDFPHQRCGQGEAEH

SEQ ID NO: 10992 - protein, 81 aa, Mus musculus
KPEAVSFADVAVYFSPEEWRCLRPAQRALYREVMRETYGLLASLGLGGAKPALICWVEEESEVWGPCAQDPEVAMCRTEVH

SEQ ID NO: 10993 - protein, 81 aa, Mus musculus
MEPVTFEDVAVNFSLGEWALLDSSQKKLYRDVMTETFMNLISIGKTEEKENIEDNYQNLRKNVRTWVECSVGSFIFTNSHR

SEQ ID NO: 10994 - protein, 81 aa, Mus musculus
MDLLTYDDVHVNFTQEEWALLDASQKSLYKGVMVETYRNLTAIGYSWEEHTIEDHFQTSRSHGRHERSSSAEQHSEFIQCG

SEQ ID NO: 10995 - protein, 81 aa, Mus musculus
MNAVTYEDVHVNFTQEEWALLDPSQKTLYKDVMLETYRNLSALGFSWEAQNIEEHCQSSRRHRRCERSQSAEKPSEYTQHG

SEQ ID NO: 10996 - protein, 81 aa, Marmota monax
SQASVSFRDVTVELTQEEWQHMGPAQRTLYREVMLENYSHLVSLGYCIFKPEVVLKLEQGEVPWFSEEESSNQNDPENYKV

SEQ ID NO: 10997 - protein, 81 aa, Marmota monax
TEGPLTFRDVAIEFSQEEWKFLVPAQRALYRDVMLETYRNLVFLGTCPSDLSVLSWLEQGRELWTVNGPEEISRPANEWAC

SEQ ID NO: 10998 - protein, 81 aa, Heterocephalus glaber
VTFEDVAVNFTLEEWVLLNSSQKKLYRDVMSEIFKNLAAIEPNWNGQQIENQCKCWRRNLRSEEIEEWCQYKLWYQHEDMF

SEQ ID NO: 10999 - protein, 81 aa, Heterocephalus glaber
DSVVFEDVAVQFTQEEWALLDSAQRDLYRDVMLETFWNLASINDESQFKARDSVSQQDIYGEKIPKKPEIAKLTKNDSWAS

SEQ ID NO: 11000 - protein, 81 aa, Heterocephalus glaber
AVTFKDVAVVFTTEELGLLDCTQKKLYEDVMVENFKNLVAVGHLPFKPDMVSQLEAEEKLWMMETETQRSSMNQNEMETLR

SEQ ID NO: 11001 - protein, 81 aa, Heterocephalus glaber
LQTLVTFKDVLLDFTREEWKLLDAAQQIMYKDVMLENYKNLVSLGHQLPKPDMILRLEKGEEPWLMEKGIYHGTYPETIAE

SEQ ID NO: 11002 - protein, 81 aa, Heterocephalus glaber
MLENYRHLVSIGYQVSKSNVVLKLKQGKEPWILEVEFPHHSGPKDPWDIHDLGARYQESPAGNSRQVQELIFKIEALTGEL

SEQ ID NO: 11003 - protein, 81 aa, Mus caroli
SLGPLSFKDVAVAFSQEEWQQLDPEERTTYRDVMLETYSNLVSLDEIRHMSRLMEEDQGGEENQTSSAVFSYRSRADASSK

SEQ ID NO: 11004 - protein, 81 aa, Mus caroli
MDALTYDDVAVNFTQEEWALLNASQKSLYKDVMLETYRNLNAVGYNWEDHNIEEHCQSSRRHGRNDRSLTGENPYEGIQCG

SEQ ID NO: 11005 - protein, 81 aa, Mus caroli
VTFEDVAVNFTLGEWALLDSYQKELYRDVMKETFSNLISIGKSEEDNIEDYQNIRRNLSTLMVEGFYEFERGIQYRETHQQ

SEQ ID NO: 11006 - protein, 81 aa, Mus caroli
VEEPVTFKDVAVAFTQEEWGQLDLVQRTLYRDVMLETYGHLLSVGNEIAKPEVISLLEQGEEPWSVEQGYPKSSCPEWMRN

SEQ ID NO: 11007 - protein, 81 aa, Mus caroli
FQGLLTFRDVAVDFSQEEWECLDSAQRALYIGVMLENYSNLVSVGIIVCKADLVPHLEQIYIPWNVKREEMVAKPGRENYR

SEQ ID NO: 11008 - protein, 81 aa, Mus caroli
MGVVTYDDVYVNFTREEWALLDSSQKNLYRDVMLETYRNLAAIGYSWEDHNTEEHFRSSRRRGRHEKSHIEEKPSEFTQCG

SEQ ID NO: 11009 - protein, 81 aa, Mus caroli
SQCLLTFGDVAVEFPQEEWECLDSAQRALYIDVMLENYSNLVSVENYCICDTVHQHVKTEKESCQCNNLGEMLRNPSHDAL

SEQ ID NO: 11010 - protein, 81 aa, Mus caroli
TQRSISFKDLAVDFTREEWQRLGPAQRLLYRDVMLENYSNLIAVGLHVSKPDVILKLEQGKEPWVVENSSRQNHAEDDEPL

SEQ ID NO: 11011 - protein, 81 aa, Neotoma lepida
MGKEVPVTFDDITLCLLQEEWTMLSQPQKDFSASDKLTAPLGGPTAANPELFHEFGQGTEPWLGKFQGQRRLLNHHPGKTH

SEQ ID NO: 11012 - protein, 81 aa, Mus musculus
NLVTYDDVHVNFTQEEGALLETSQKNLYKDVMLETYRNLSAIGYIWEEHTIEDHFQTSRSHGRHERSCIAVQPSEFIQCGK

SEQ ID NO: 11013 - protein, 81 aa, Mus musculus
VCGSVTFRDVAVDFSQEEWACLDATQKVLYRNIMLETYSNLVAVVGRCISKPDLIVLLEQEKEPWMAVKGETDRPSPDVET

SEQ ID NO: 11014 - protein, 81 aa, Mus musculus
DSTGCCERRLVKLRTPNMDLLTYDDVHVNFTQEEWALLDASQKSLYKGVMVETYRNLTAIGYSWEEHTIEDHFQTSRSLGS

SEQ ID NO: 11015 - protein, 81 aa, Dipodomys ordii
PKVPVAFDDVSIYFSTPEWEKLEEWQKELYKNIMKGNYESLISMDYAMNQPDVLSQIQPEGEHNPENQAGPEESAIPTDPS

SEQ ID NO: 11016 - protein, 81 aa, Dipodomys ordii
MAATATSAAAATAAEVAGHCVPKPKLIAKLEQGAEPWIREASDKNLTDVQEMEYRTKTCQKSPYDCLSEVGVMNSNTGEEN

SEQ ID NO: 11017 - protein, 81 aa, Dipodomys ordii
SKDLVTFGDVSVSFTQAEWECLNPTQRSLYRKVMLDNYRSLVSLGISIHKPDVITLLEQGKEPWKSRKEAPRGASQDWEYV

SEQ ID NO: 11018 - protein, 81 aa, Octodon degus
QVNFEDVFVGFSQEEWELLDEAQRFLYRDVMLENFALAASVGHWRGVQDTEIPCEQSISIKGVSQTWTPRGSPTQKAHSCE

SEQ ID NO: 11019 - protein, 81 aa, Octodon degus
FADLVTFEDVAVTFTPEEMSYLTASQRKLYREVMLENYQNLASLGHHFPKPDMISYLEEEASRTMEEDSNTMICKGRDSPD

SEQ ID NO: 11020 - protein, 81 aa, Octodon degus
MQAERFELDPESNAQAYPVSKPDIISKLEQGEDPWIIKTDMASCNYPDANYTDRKNIHHNSQSCTLGTFSFHDKVIKAVTQ

SEQ ID NO: 11021 - protein, 81 aa, Octodon degus
VTFEDVAVNFSREEWALLDPPQRKLYGDVMWETLRHLAAVGRNSEDRQIEDECRNSRNCLRSEEVEKSYQYKLWCQHAELA

SEQ ID NO: 11022 - protein, 81 aa, Octodon degus
AGQRRKYPCVRHQNQELAESVTFEDVAVTFTLEEWALLDPSQKKLYRDVMREIQQNMAAIGRNWENQQNDEKYKNSWRHLR

SEQ ID NO: 11023 - protein, 81 aa, Octodon degus
VETVTFEDVAVNFTSAEWDLLNPAQKKLYRDVMWETLMNIKGLGRTLATKRMGEVDKNCSGNLRYDTENSFRFEEKLYKCK

SEQ ID NO: 11024 - protein, 81 aa, Octodon degus
QVSVTFEDVAVRFTAEEWGLLDLSKRTLYWEVMLETCGLLLAVGNSTKPSTTKPSAVYQAWPEESWLHDQETEGTCGGSLL

SEQ ID NO: 11025 - protein, 81 aa, Octodon degus
SQGSVSFKDVTVGFTQVEWQHLDPSQKSLYRDVMLENYSHLVSVGYCVTRPELIFRLEQGEEPWVLEEEFPRPGFLEFWKT

SEQ ID NO: 11026 - protein, 81 aa, Octodon degus
VQEPVTFRDVAVLFSQDEWLQLDPGQRRLYREVMLENYSNLVSLGILFSKPEVISQLEQTGGTQVVGTGAPRGVYLGWESF

SEQ ID NO: 11027 - protein, 81 aa, Fukomys damarensis
AEARGGSVMFSDVSIVFSQDEWEYLDLEQRDLYRNVMMENYSNLVSLVNDEVVNLKRSSSPVGIHLNIWQALNFSCELHLC

SEQ ID NO: 11028 - protein, 81 aa, Heterocephalus glaber
VTFEDVAVNFTQEEWALLKPSQKNLYRAVMQETFWNLASVGRPHECNKCDKAFKWPCDLRNHERTHTGEKPYTCVQCGKTF

SEQ ID NO: 11029 - protein, 81 aa, Heterocephalus glaber
RESGKAPVTFDDITVYLLQEEWLLLSQQQKDLCGSDKLVAPLGATVAGPNLFGEFGRGSKPWVGDIHSQRSLLGHHSGKNQ

SEQ ID NO: 11030 - protein, 81 aa, Mus caroli
NKKPVVFSDVSLDFSQEEWECLGPAQRDLYKDVMLENYSNLLAVGLHIPKPQVISLLEQGKEPWMIGKELTRGLCSALESM

SEQ ID NO: 11031 - protein, 81 aa, Mus caroli
MATSEPAESDAVRAKEWEQLEPVQRNVYKDTKLENCSNPDSMGNQDTKQDIVSKLEEEEPSSGKGKKTSPSSLDKIARPKK

SEQ ID NO: 11032 - protein, 81 aa, Mus caroli
PQSQLTFKDVVVDFSQEEWECLDCAQRALYMEVMLENYNNLFFVENHCMCPKFENMLDQDLQHIVHEHVNIQVKSYECHEL

SEQ ID NO: 11033 - protein, 81 aa, Mus caroli
MDALTYDDVHVNFTQEEWALLNPTQRNLYKDVMLEIYRNLKAVGYNWEDQNTEEYCQSSRRHGRHERSHTGEKPSENTQCG

SEQ ID NO: 11034 - protein, 81 aa, Mus caroli
MEDPLSFTDVAIDFSADECECLDSAQWNLYKEVMLENYSNLVFLGLAFSKPHLVTFLEQSSDPWSVKRKASATIPLGSKPH

SEQ ID NO: 11035 - protein, 81 aa, Mus caroli
MDAVTYDDVHVNLTQEEWALLDPSQKCLYKDVMLETYKNLTAIGYNWEYHNIEEHCQSSRRHGRYERSHTGEKHSEYTQCG

SEQ ID NO: 11036 - protein, 81 aa, Mus caroli
SKGLLTFMDVAIEFSKEEWGCLDSAQRTLYRDVMLENYNNLVSLGVAVSKPEVIVCLEQNNEPWIAGREDTERKKNSLYVD

SEQ ID NO: 11037 - protein, 81 aa, Mus caroli
PQGLLIFKDVALDFSLEEWECLNFAQRTLYMDVMLENYNNLLFVEKHCICGKYGKVLDEDIQYIVHKHMNIQEKSSKCNKL

SEQ ID NO: 11038 - protein, 81 aa, Mus caroli
TRDAVTYEDVYVKFTHEEWALLNPSQKSLYKDVMLETCRNLTAIGYKLEDNIEEHCHSSRGRGRYKSCEHKGHGKKQCTFA

SEQ ID NO: 11039 - protein, 81 aa, Mus caroli
MATSEPAESDAKEWEQLEPVQRNVYKDTKLENCSNPDSMGNQDTKQDIVSKLEEEEPSSGKGKKTSPSSLDKIARPKKAGT

SEQ ID NO: 11040 - protein, 81 aa, Mus caroli
MASPSPPLEPKEEWGYLDPAPKSLYKDVMMDSYGKLVSLDVLNRNKDEEPTVKEELEKDIEPQGVIVTRIKSEIDQDPMGS

SEQ ID NO: 11041 - protein, 81 aa, Mus caroli
MEFLAFEDVAVEFSQEEWVLLDPSQKKLYRDVMLETCSNLTSIGIKWEDKNIEEQYKHSWRFLRSCMIDAIYEHKEGGQFQ

SEQ ID NO: 11042 - protein, 81 aa, Mus musculus
DLVTYDDVHVNFTQEEWALLDPSQKSLYKGVMLETYRNLTAIGYIWEEHTIEDHFQTSRSHGRRRSPRDPQITGPAGRVKW

SEQ ID NO: 11043 - protein, 81 aa, Mus musculus
SKGPLTFMDVAIEFSKEEWECLDSTQRALYRDVMLENYNNLVSVGGAVSKPEVIFCLEQNKETWIIGSEDTEGKESALSCD

SEQ ID NO: 11044 - protein, 81 aa, Mus musculus
MLENFSHLVFLGFSFSKPLLVRFLEKNQELRNVKRKAATVPRGKKPYKCKECGKAFAKSSVLTQHLRIHTGEKPYTCDICD

SEQ ID NO: 11045 - protein, 81 aa, Mus musculus
PQGLLTFKDVALDFSLEEWERLSFAQRTLYMDVMLENYNNLLFVENHCIRGKYRKVLDQDSQYIVHEHMNIQEKSSKWDKL

SEQ ID NO: 11046 - protein, 81 aa, Mus musculus
YVELVSFEDVTVKFTWEEWQNLNDAQKMLYRSVVLETYNSLLSLGQCIPKPELIFKLEQGEEPWTAEEPANKTLPVFCSVD

SEQ ID NO: 11047 - protein, 81 aa, Mus musculus
MDLVTYEDVHVNFTQEEWALLDPSQKSLYKDVMLETYRNLTAIGYKWEDFNIEEHCKCPKRHERYIICHSGFKPCEDKQYK

SEQ ID NO: 11048 - protein, 81 aa, Mus musculus
MDVLTHDDVHVNFTREEWALLNPSQKSLYKDVMLETYRNLNAIGYNWEDNNIEEQCQSSRRNGRHERRLIGEKRSENIQCG

SEQ ID NO: 11049 - protein, 81 aa, Dipodomys ordii
VKKLVSFDDVAVDFSWEEWQYLDIAQRTLYRDVMLEIYRNIVSLGHCVPKPNLIVKLEQAVEPRIREASSKNFTNIQEMED

SEQ ID NO: 11050 - protein, 81 aa, Octodon degus
GGEAVTLKDVTMAFTQKEWKKMDPAQRDLYKDVMLENYSNLAIVGYQSSKPDMICKLEKGEEPWSRKGKRSNQSHLRKLAR

SEQ ID NO: 11051 - protein, 81 aa, Octodon degus
AEELLTFRDVAIDFSPEEWECLDPAQWNLYRDVMLENYRNLVFLGLAVSKPCLVTFLEQWKEFWNVEREEVVAVYPAVSYY

SEQ ID NO: 11052 - protein, 81 aa, Octodon degus
SLGSVTFTDVAIDFSQDEWEWLNLAQRSLYRNVMLENYRSLASVGLCISKPDMISFLEQEKDPWVVPGEMSGSPCTDLEYM

SEQ ID NO: 11053 - protein, 81 aa, Rattus norvegicus
MLSFRDVAVDFSPEEREYLGPSQWSLYRDVMLENYSNLVFLGLAVAKPYLVTFLEQTQGSSGVKRQEAATIPPGTTGNEFN

SEQ ID NO: 11054 - protein, 81 aa, Peromyscus maniculatus
MEEILSFWDVAIDFSAEERKCLEPAQWNLYRDVMLENYSNLVFLGLAESKPHLVTLLEQRQESSDVKRQAAANMQPGTTPN

SEQ ID NO: 11055 - protein, 81 aa, Peromyscus maniculatus
TAKSQETVTFKDVAMDLTPEEWGQLDPAHRDVMLENYRSLVSLWLPVSKPDDYNLDAGKELLELEEKPPKCSYSDVETRPE

SEQ ID NO: 11056 - protein, 81 aa, Peromyscus maniculatus
PQGLLTFRNLAVDFSPEEWECLDSSQRSLYMDVMWENYSNLVFVENHCICGKYEKVLDQDSKHIVHEDVNIQEKSYKCCEL

SEQ ID NO: 11057 - protein, 81 aa, Peromyscus maniculatus
AAHTGDLGVDLETMTFEGIAVIFTLEEWALLGPSQMKLYRDVMEETFRNLVSIEQAQECQNIEDNHKISWRLSSWEFNAFF

SEQ ID NO: 11058 - protein, 81 aa, Peromyscus maniculatus
QVDAVTFEDVAVDFTQEEWTSLDPIQRNLYRDVMLENYQNLATVGGQLFKPSLISWLERKVELTVMEQGILQEWELHLQTK

SEQ ID NO: 11059 - protein, 81 aa, Peromyscus maniculatus
AQELVTFRDVAIDFSEEEWECLNIEQKTLYTDVMMETYSHLISVGFCVHLPHLFSLLEKRKDPRMILMDETRGLYPDIDFS

SEQ ID NO: 11060 - protein, 81 aa, Peromyscus maniculatus
MEEMLSFWDVAIEFSAEERECLEPAQWNLYRDVMLENYSNLVFLGLAVSKPHLVTLLEQRQDSSDVKRRAAANVQPGTTFN

SEQ ID NO: 11061 - protein, 81 aa, Peromyscus maniculatus
HKEMLSFWDVAIDFSPEERECLEPAQWNLYRDVMLENYSNLDFLGLVLSKPHLVTFLEQKQGPMGMKKQVAATVHTGKTDN

SEQ ID NO: 11062 - protein, 81 aa, Peromyscus maniculatus
ETMTFEGIAVIFTLEEWALLGPSQMKLYRDVMEETFRNLVSIEQAQECQNIEDNHKISWRLRSEVVHSLGEHKGSECGEIF

SEQ ID NO: 11063 - protein, 81 aa, Peromyscus maniculatus
KGRVTFEDITVTFTPEEWQGLNPEHRHLYKDVMLENYSNLASVEKDQDIERQGGMNINLEKSLKRGVVSIHKKTFTKQNVP

SEQ ID NO: 11064 - protein, 81 aa, Mesocricetus auratus
PQSLLSFRDVAVHLSQEEWECLDCSQRDLYMDVMLENYNNLLFVENHCICGKYETVLDQGTKHIVHDHVNIQRKLSQYNEL

SEQ ID NO: 11065 - protein, 81 aa, Mesocricetus auratus
KPELVSFADVAVYFSPHEWGCLRPAQRALYRDVMRETYGLLGALGFPGPKPALISWMEQESEAWSPAAQDPAEGEILGGAL

SEQ ID NO: 11066 - protein, 81 aa, Ictidomys tridecemlineatus
SQELLTFKDVSVDFTQEEWGQLALDHQNLYREVMLENYGNLVSVGYQLCKPVVISQLEKGEEPWLTEKKISGGSCSDLANK

SEQ ID NO: 11067 - protein, 81 aa, Heterocephalus glaber
LVTFEDVAVSFTQEEWALLDPFQKNLYRDVMRETLSNLAFVGRPCQKIKTILKALIIFLFSYRRHVVERLWEGVKGAQRRE

SEQ ID NO: 11068 - protein, 81 aa, Heterocephalus glaber
VKESVTFKDVAIDFTLEEWRLMDPTQRKLHKDVMLENYRNLASLGLAVSKPDMISHLENGKGPWTVVRKISRTPYPDLETK

SEQ ID NO: 11069 - protein, 81 aa, Neotoma lepida
AQQQHCFGVHGRSQDEVCRHWTGRLSLRRSAISSVYTFPRAAENEQIKGYDVTKPNVIIKLAQGEEPWTVEGDCHVQSHLG

SEQ ID NO: 11070 - protein, 81 aa, Fukomys damarensis
LGLVTFTDVAIDFSQDEWEWLNLAQRSLYRKVMLENYSNLVSVDLKYMWLFKELSSNQDIYEENLSKEEPTSCFTLGENLK

SEQ ID NO: 11071 - protein, 81 aa, Rattus norvegicus
DAVTFNDVHVDFTSEEWTLLDPSQKGLYKDVMLETYWNLTAIGYSLEDHNIEEHFQSSRRHGRPERSHTEEKPYEDMKCGE

SEQ ID NO: 11072 - protein, 81 aa, Rattus norvegicus
AAVTYEDVHVNFTHEEWALLDPFQKSLYKDVMLETYWNLTAIGYKLEDLNSEEHSPRSRRYERHNICHSGYKPCERKGYGK

SEQ ID NO: 11073 - protein, 81 aa, Dipodomys ordii
LHGSVSFKDVTVDFTPEEWGHLDGAQRSLYRDVMLENYSHLVSVGYYVSQPEVIFKLEQGAEPWTLKEEFPSQNFPDLWNA

SEQ ID NO: 11074 - protein, 81 aa, Octodon degus
SQGLVTFKDVAVCFSQDQWSDLDPTQKEFYGEYVLKEDCGIVVSLSFPIPRLDDISQVREEEPQVPGIHEPQEPEEPEILS

SEQ ID NO: 11075 - protein, 81 aa, Octodon degus
FQELVTFQDVAVDFTPEEWQLLDCNQRMMYWDVMLDNYRNLISVGSLVTKPEVILKIEQGQEPWLEEEENLHWSYPKADCP

SEQ ID NO: 11076 - protein, 81 aa, Octodon degus
MLETYRNLVSLGLAASKPGVISCLEQGRAPWVEETVTAGGPCPVSDSECYTKVPSPKRDVRDAESPLWETLGCLTSYDVEC

SEQ ID NO: 11077 - protein, 81 aa, Octodon degus
MVENFKNLVAVGHLPFKPDMVSQLEAEEKLWVMETETHGNCINQNEMTTLQRFTVKYLSELSCWQIWKHVASELTRCLHRT

SEQ ID NO: 11078 - protein, 81 aa, Octodon degus
PKAPVSFEDVSVYFTKAEWKFLDFKQKALYKQVMLENYRNLASLGLASSKPYLVAQLERGAGPWVANLHSKAGGRIQCPRA

SEQ ID NO: 11079 - protein, 81 aa, Octodon degus
AVTMEDVTVTFTNEEWALLNPAQKRLYGDVMWETFRTISAIGRTWDSQQMEEEYKNYLRNLSNEEVAKCCRYTTFNQHENI

SEQ ID NO: 11080 - protein, 81 aa, Fukomys damarensis
MEQKLEQLLEHKRLHIIKVSGNQLLKPDMILRLEKGEEPWMMDKGFYHGTYPDSETAAEIKSSVSRKTISKEEQSCGIKVE

SEQ ID NO: 11081 - protein, 81 aa, Rattus norvegicus
FQDLLSFTDVAIDFSADECECLEPAQWNLYKEVMLENYSNLVFLGLAFSKPYLVTFLEQSSDPWSMKRKASAAIHLGLKPH

SEQ ID NO: 11082 - protein, 81 aa, Dipodomys ordii
VVTQLTFEDVAVDFTPGEWQCLTPAQRALYRDVMLDTYRNLVFVGVSPPNMSVLSLLELRKESWMAQSHMTTPRELSGWER

SEQ ID NO: 11083 - protein, 81 aa, Dipodomys ordii
QLGLVSFEDVILHFSPEEWELLDEAQKLLYCDVMLENFALLASLGLTAFRSHVVARLEMENKPWIPDRGAMTSAMARGVCG

SEQ ID NO: 11084 - protein, 81 aa, Octodon degus
GVTFEDVAVTFTKEEWALLDSSQKKFYGDVMWETFYNVSAIGRNWDNQQIEDEWQQYLRRNLRCEEAVECRQNKSGHEDGE

SEQ ID NO: 11085 - protein, 81 aa, Octodon degus
EAVTFEEVAVTFTTDEWFLLYPSQKELFRDVMWETFRNVSFVERNWDDQKTEDEYESCQRNLRSEEVEKWHQLELLYQYEE

SEQ ID NO: 11086 - protein, 81 aa, Octodon degus
MELLTFRDVAIDFSLEEWEDLDSAQQNLYRDVMLETYGNLVSLGLADSKPYMITCLEQSKEPWNVKKQESVVIHPAVSSHF

SEQ ID NO: 11087 - protein, 81 aa, Fukomys damarensis
SVSFEDVFVSFTWEEWQVLDNAQRTLYREVMLETYSSLAVLGHCITKPEVIFKLEQGAEPWMREEPPNLSPPDVQKVDHIL

SEQ ID NO: 11088 - protein, 81 aa, Fukomys damarensis
ACLVLGVFLRFRDTPVGWMCTLSLAIPVDVVPQFTTTRVWLEKESTGGHQIAKPDVISLLEQGEEPWFVEPVHPRSSCPGK

SEQ ID NO: 11089 - protein, 81 aa, Fukomys damarensis
EAVTFEDVAVDFTLEEWALLDPSQKKLYRDVMSETLKNMSAIEHTQTDQQMENGSEYWQRNLRSEDVEKCYQYKLWNPHRD

SEQ ID NO: 11090 - protein, 81 aa, Fukomys damarensis
EPILFDDLAIYFSQEECVSVDPAQKSLTREATQECSNNVTLMGGESNTEINEMLTLESLEIEEFSLENYSTAVPLVHSQRS

SEQ ID NO: 11091 - protein, 81 aa, Fukomys damarensis
MEEWALLNPSQKKLYRDVMWETVMNMTAIGRTWDNQQIEEEYKNCSKNLRNEEIAKCYQHKAWTQHENIFLWTPDASVVMQ

SEQ ID NO: 11092 - protein, 81 aa, Fukomys damarensis
MLETYSSLVSLGHRNPKPEVIVKLEQGRQPWMGEGPPSQTFSGHCTPSPEETIKLEQGAQPWMGEEPPSQTLSDVQKAEDP

SEQ ID NO: 11093 - protein, 81 aa, Fukomys damarensis
MVMLENYESIVSLGLPVPPPDVIFWLKRGNEPWIEGLPGSEERECPQSISLDWETKLKTQDASKEENPEETLRQSLSRQSL

SEQ ID NO: 11094 - protein, 81 aa, Fukomys damarensis
LQELFSFEDLSVDFTQKEWQLLGPHQKNLYRDVMLENYSSLVSLGYTVMKPDVIFKLEQGEEPWVGDGKVQHSDCPEVWQV

SEQ ID NO: 11095 - protein, 81 aa, Rattus norvegicus
VMGLVSFEDVSVDFTWDEWQDLDDAQRKLYREVMLETYSSLLSLNQCDAKPELILKLEQGAEPWKEDGAADPSLEALQPVK

SEQ ID NO: 11096 - protein, 81 aa, Rattus norvegicus
MAVSVMFSDVSVVFSKEEWDCLDLDQRTLYRDVMMENYHNVLSLGCFISKPDVISLLEQGKEPWKRRRCPDSGVKDETHQL

SEQ ID NO: 11097 - protein, 81 aa, Mus musculus
MEEMLSFRDVAIDFSEEEWECLEPAQWDLYRDVMLENYSHLVFLGLAFSKPYLVTFLEQRREPWNVKEAATVAAHPGIKPY

SEQ ID NO: 11098 - protein, 81 aa, Mus musculus
PQGLLSFKDVALDFSLEEWECLSFAQRSLYMDVMLEDYNNLLFVENHCIHGKYEKVMDQDSQYIVLEHMNIQEKSSKWNKL

SEQ ID NO: 11099 - protein, 81 aa, Mus musculus
SAIEEDVVTYDDVHVNFTGEEWNLLDPSQKSLYKDMMLETYWNLTVIGYTWENHHIKRHCQSSRRNESPSSLPGFQNAFLG

SEQ ID NO: 11100 - protein, 81 aa, Dipodomys ordii
KEDSVAFSDVVVAFTPEEWRLLSPAQRTLHKEVMLETYNHLISLEILLSKSKLISNMEQVEEPGRGDRKYSPESCPAGSMP

SEQ ID NO: 11101 - protein, 81 aa, Dipodomys ordii
AHDLVMFRDVTVDFSQEEWECLTSYQRNLYRDVILENYKNLVSLGCSISKPDVISLLEQGKEPWIVVREERRRWSLDLESR

SEQ ID NO: 11102 - protein, 81 aa, Dipodomys ordii
AELPVVFEDVAVYFTQEEWGLMDKRQKCLYRDVMRMNYELLASLGPAAAKPDLILKLERRATPWIKDPNQLKSGKGHPSVK

SEQ ID NO: 11103 - protein, 81 aa, Dipodomys ordii
SLELVSFEDVSVDFSWEEWQDLSSAQRTLYRDVMLETYSSLASLGHFMTKPAVIFKLEQGAEPWMVKGPPNQSCSEIQRFE

SEQ ID NO: 11104 - protein, 81 aa, Dipodomys ordii
MKGFVSFEDVSVDFTWEEWQDLDDAQRRLYRDVMLETYSSLASLGHCIVKPEVIFRLERGSGPWMVEAATSWSYTDVQKEN

SEQ ID NO: 11105 - protein, 81 aa, Octodon degus
VTMEDVAVNFTKEEWALLNPSQKKLYRDVMWETFRNIKAIGRTWDNQMEEKYKNCSRNLRNDEGAKCYQYKACNQPENRSN

SEQ ID NO: 11106 - protein, 81 aa, Octodon degus
PVSLEDVAVTFTLEEWALLNSSQKKLYRDVMWETFMNLTDIGRTWDNQQAEEYKTCLRNLSNEEVAKWYQYKSWNQYGNVF

SEQ ID NO: 11107 - protein, 81 aa, Octodon degus
KRGVVRFADVAVYFSPEEWGCLRPAQRTLYRDVMRETYGHLGALGFPGPKPALISWMEQESEAWSSAAQDPEERESPVGAL

SEQ ID NO: 11108 - protein, 81 aa, Octodon degus
FQESVTFKDVVVDFTQEEWKQLDPGQRDLFRDVTLENYTHLVSIGLQVSKPDVISQLEQGTEPWTVEPSVTVGTCGDWEPR

SEQ ID NO: 11109 - protein, 81 aa, Octodon degus
MASPSSPLEPKEWDYLDPAQRSLYKDVMMENYGNLVSLDVLNKDKDEEPSVKQEIEELEEEVEPQGVIVTRIKSEIDQDPM

SEQ ID NO: 11110 - protein, 81 aa, Octodon degus
VTFEDVTVDFTQEEWALLDRGHRDLYREVMLENYENLASVECAVRLSTSEYIHQPEFLMEQSSGGQHMERRKSVGELQQSC

SEQ ID NO: 11111 - protein, 81 aa, Fukomys damarensis
MDTTQRKLHKDVMLENYRNLVSLGLAVSKPDMISHLENGKGPWTLVREISRTPYPGLWKWSDRIFRWQNSQESHLNQRIVT

SEQ ID NO: 11112 - protein, 81 aa, Rattus norvegicus
DVVTYEDVHVNFTQEEWALLDPSQKRLYKVVMLETYKNLSAIGYIWEDHTIEQHFQSSRSHGRHKRHRTGEQPSELIQHGK

SEQ ID NO: 11113 - protein, 81 aa, Rattus norvegicus
MQGFLTFKDVAPEFTLEEWESLSFAQRALYMDVILETYYNLLSLENYVICEKHGKVLDRDTECVVDEHVNIQEKFCKWEEI

SEQ ID NO: 11114 - protein, 81 aa, Mus musculus
MLENYRNLVSVGYQLSKPTVISQLEKGEGPCMAESQGPEDPILDVKNKLETKESTAEDDISVKLDHGITRGRLIEDDIVCS

SEQ ID NO: 11115 - protein, 81 aa, Mus musculus
ELKREWGELGICAMDLVTYEDVHVNFTQEEWALLDPSQKSLYKDVMLETYRNLTAIGYKWEDFNIEEHCKCPKRHERSHHL

SEQ ID NO: 11116 - protein, 81 aa, Dipodomys ordii
TARSQERVTFKDVAMDFTPEEWGKLDPTQRDVMLENYRNLVSLWLPISKPENYNLDNSKEPLKLEKKVSKCSYSDLESRPE

SEQ ID NO: 11117 - protein, 81 aa, Dipodomys ordii
PKAPVTFGDLAIHFSQEEWEWLSPTQKDLYEDVMLENFQNLVSLGLCCRRPNVITLLEMGKAPWMVEPKSCRGPDSGSQCV

SEQ ID NO: 11118 - protein, 81 aa, Dipodomys ordii
SLKLVSFDDVAVDFSWEEWQDLDLAQRTLHRDVMLETYSNLLSVGYCVPKPKLIAKLEQGAEPWRREASDKNLTDVQEMEY

SEQ ID NO: 11119 - protein, 81 aa, Dipodomys ordii
SLKLVSFHDVAVRFSWEEWQHLDLAQRTLYRDVMLETYSNLVFLRHCAPKPKLIVKLEQGAEPWRREASDKNLTEHSVHCQ

SEQ ID NO: 11120 - protein, 81 aa, Dipodomys ordii
QLVCGTFQDVVIYFSPEEWKFLNVAQRHLYLSVMLETFALRTSVGCGHRVGGKEVCGHSGSVAGVAFSRTPATDASSLRAR

SEQ ID NO: 11121 - protein, 81 aa, Octodon degus
FQELVTFGDVAIDFSQQEWEYLDSRQRDLYRDVMLENYRNLVSLGQSISKPDVIDLLEQGKEPWMILREETRRPYTDLDLQ

SEQ ID NO: 11122 - protein, 81 aa, Rattus norvegicus
LTFKDVAVDFSQDEWEYLDCAQRALYVDVMLENYKNLFFVESHHLCHKYENILDEDTQCIVHKHVNIQSYKCHELGNPIPE

SEQ ID NO: 11123 - protein, 81 aa, Rattus norvegicus
QGMLAFRDVAVEFSQEEWGCLDSAQRALYIDVMLENYNNLVSVENYCIHDTVHQHVNTEKESCQYNELGKILHEHFKCALY

SEQ ID NO: 11124 - protein, 81 aa, Mus musculus
DVVTYDDVHVNFTWEEWSLLAPSQKSLYKDVMLETYSNLTAIGCNWEEHNIEEYCQSSRRHGRHERSLTGEKPSEYTQCVK

SEQ ID NO: 11125 - protein, 81 aa, Mus musculus
DAVTYDDVHVNFTGEEWKLLDPSQKSLYKDVMLETYWNLTVIGYTWENHQIERHCQSSRKNERFNLPMPVAMGKPKQPAVS

SEQ ID NO: 11126 - protein, 81 aa, Mus musculus
RRLVKLRTPNMDLVTYDDVHVNFTQEEWALLDASQKSLYKGVMVETYRNLTAIGYSWEEHTIEDHFQTSRSHGSYSPDILW

SEQ ID NO: 11127 - protein, 81 aa, Dipodomys ordii
NFWILRLPPGSKGEAPKEWGKLEDWQKELYKHVMRGNYETLVSLDYAISKPEVLSQIEQGKEPCSWRRAGPKVPEVPVDPS

SEQ ID NO: 11128 - protein, 81 aa, Dipodomys ordii
MPLTFQDVAVYFSQAEGQQLGPQQRALYRDVMLENYGNMASLGFSIPKPELISQLEQGEELWVLDLLGAEEPEVLRTCQTD

SEQ ID NO: 11129 - protein, 81 aa, Dipodomys ordii
CCENLSFDDVAVDFTWKEWQDLDPGQRTLHRDVMLETYSNLMSLGLCVPKPKLIVKLEQGAEPWIREGSEENFTDVQEMED

SEQ ID NO: 11130 - protein, 81 aa, Dipodomys ordii
EKKLVSFDDVAVDFSWEEWQDLDHAQRTLHRDVMLETYSNLLSLGHCVPKPKLIAKLEQGAEPWIREASDKNLTDVQEKEY

SEQ ID NO: 11131 - protein, 81 aa, Dipodomys ordii
ASQGAELFRDMAIISSQEEWECPELPQRALYKDVMLETYRNLISLGLTIFKPDVIFLEQGRMPWTEEWAATGGLGPVLELG

SEQ ID NO: 11132 - protein, 81 aa, Dipodomys ordii
SLKLVSFDEVAVDFSWEEWQDLDFSQRTLYRDVMLETYSNLVSLGHCVPKPKLIVKLEQGAEPWIGEASDKNFTDVQEMEE

SEQ ID NO: 11133 - protein, 81 aa, Octodon degus
PKVPVAFDDVSIYFSTPEWEKLEEWQKELYKNIMKGNYESLISMDYAMSQPDVLSQIQPEGEHNTKDQAGPGESEIPAVPR

SEQ ID NO: 11134 - protein, 81 aa, Octodon degus
LTETITIEDVTIRFTPEEWALLDTTQRKLHRAVMLETIRNLQSLGCQYGKSDFVFHKDETQILWKGEQRAFPRNHNACKNE

SEQ ID NO: 11135 - protein, 81 aa, Octodon degus
SQELVTFEDVAVYFIRKEWKRLEPAQRNLYRDVMLENYGNVFSLDSESRTESDREISEDSGSHGMLLGRFQKDISQGLKFE

SEQ ID NO: 11136 - protein, 81 aa, Octodon degus
GVFKVTFSDVAVDFSCEEWGWLDSAQRDLYKGVMVQNYKNLASLGLSVTKPHVIYLLENGKEPWVVEKALSKGMFLDWESK

SEQ ID NO: 11137 - protein, 81 aa, Octodon degus
LLPAAGCGKDSGTPATEAVTFEDVAVNFSREEWALLDPPQRKLYRDVMWETLRHLAAVGMNSDDRQIEDVYKICRKNLSGA

SEQ ID NO: 11138 - protein, 81 aa, Octodon degus
SWPQKLVTFEDVAVYFSQTEWDALSPAQRALYRDVMLENYGNVASLGFPFLKPAMISQLERGGELEHPLPLATGSGIGPQG

SEQ ID NO: 11139 - protein, 81 aa, Octodon degus
EAVTMEDVAVNFTKEEWALLNPSQKKLYRDVMWETFRNINAIGRTWDNQQMEEHKSCSRNLRDEELPKCCQYAPCSQHENI

SEQ ID NO: 11140 - protein, 81 aa, Octodon degus
QGSVTFEDVAVYFSWEEWDLLDEAQRHLYLDVMLENLALMSSLGYSCGVEDEVAPSRLGFSVESPQIGTPKEESSSQNDCA

SEQ ID NO: 11141 - protein, 81 aa, Octodon degus
VVTFEDVAVNFTLEEWALLDPSQKKLYRDVMRETFRNIAAIGKAWDNQEVEEQYKSFWRNLRNKEVKKCYQNKGWSQYEEI

SEQ ID NO: 11142 - protein, 81 aa, Octodon degus
QGSVTFEDVAVHFSWDEWHLLDKAQRCLYRDVMAENLALITSLDTHQHEKLQFVWQCFRSKGSRSLFVNRSKFRVAWEQFA

SEQ ID NO: 11143 - protein, 81 aa, Neotoma lepida
GPISFRNVDVDFSKEEWEYLDCAQRALYMDVMLENYNNLVFVEYHRICDKYGKVLDQGTKHIVHEHVNIQEKPYKCNDLGK

SEQ ID NO: 11144 - protein, 81 aa, Mus musculus
GFATKKTSRTEDRGAMAADPNFQQKSQPLGAEEQPESCERWMSFEDVTVNFSQEEWQHLDSAQRCLYQEVMLEIYSHLLAV

SEQ ID NO: 11145 - protein, 81 aa, Mus musculus
MLENYSNLVFLGLAFSKPYLVTFLEQSSDLWSVKRKASVAIHLGSKAHKCKECGKSFDRNSVLIQHQRIHTGERPYKCEEC

SEQ ID NO: 11146 - protein, 81 aa, Mus musculus
AEEFETLKDLAMDFTVEDWKDLESEWDQRDLFWDVTLNHYQDMFSFTDTSQPSLTSQPDVREELEATSTEVPETKSSPLQS

SEQ ID NO: 11147 - protein, 81 aa, Rattus norvegicus
DMGLVSFEDVAVDFTWQEWQELDAVQRTLYRDVMLENYRSLVWLGYCLVKPELISKLEKGFEPWDVAEAIEQCLPDVHKWS

SEQ ID NO: 11148 - protein, 81 aa, Rattus norvegicus
IKDLLSFTDVAIDFSPEECECLEPAQWNLYKEVMLENYSNLLFLGLAFSKPYLVTFLEQSSDPWRVRRKASAAIHLGSKAH

SEQ ID NO: 11149 - protein, 81 aa, Rattus norvegicus
MVQFPIPQWFSYTTVGPNLLFLLTGYDVTKPNVIIKLEQGEEPWTVEGDRHAKRHLEIKKVDDPREGIQENGEKHLQCGDD

SEQ ID NO: 11150 - protein, 81 aa, Mus caroli
EDAVTYDDVHVNFTGEEWNALDPSQKSLYKDVMLETYWNLTVIGYTWENHHIERHCQSSRRNERFSLHCQLPWTSRIASCV

SEQ ID NO: 11151 - protein, 81 aa, Mus caroli
VCGSVTFRDVAVDFSKEEWACLDATQKVLYRDIMLETYSNLVAVVGRCISKPDLIVLLEQEKEPWMAVNEETGRPSSGLEA

SEQ ID NO: 11152 - protein, 81 aa, Mus caroli
GCVTFEDVAVYFSQEEWELLDESQRLLYLDVMLENFTLITSLAHWSEAEAEDKTCVPHIRTAKEGLPTKKPHPSDICSAVL

SEQ ID NO: 11153 - protein, 81 aa, Mus caroli
RPRALKFADVAVYFSSEEWGCLQPAQRTLYRDVMRETYGLLGALGCAGPKPALISWLERNPDDWEPAALDPQEYRRWVTFQ

SEQ ID NO: 11154 - protein, 81 aa, Mus caroli
ARVSVVFSDVSIAFSQEEWESLDLEQRNLYKDVMMENYHNVASLGCFIAKPDVISLLEQGKEPWKVVRQRKPCPDSETKDE

SEQ ID NO: 11155 - protein, 81 aa, Mus caroli
SQGLLTFRDVAVDFSQEEWECLDSSQKALYIDVMVENYSNLVSVENYCICDTVHQPVRTEKESCQCNELNEMRHEPSNCAL

SEQ ID NO: 11156 - protein, 81 aa, Mus caroli
SQESLTFKDIAVDLSQEEWGQLAPAYRDLYREVMLENYRNLVSVGYQLSKPTVISQLEKGEGPCMAESQGPEDPILDVKNK

SEQ ID NO: 11157 - protein, 81 aa, Mus caroli
SVTLEDVAVNFTLEEWTMLNASQKELYKDVMQDTLRNLSYIGNKWEHQNIENECETLWRKLRTSCQEKSLWRYNSQLLETL

SEQ ID NO: 11158 - protein, 81 aa, Mus caroli
EKNAVTYEDVHVNFTQEEWALLDPSQKKLYKDVMLETYRNLSALGFSWEAQNIEEHCQSSRRHRRCERSQSAEKPSEYTQR

SEQ ID NO: 11159 - protein, 81 aa, Mus caroli
VTLEDVAVNFTLEEWTMLNASQKELYKDVMQDTLRNLSYIGEGNKWEHQNIENECETLWRKLSQLLETLCEYTEGRQRAET

SEQ ID NO: 11160 - protein, 81 aa, Mus caroli
PITFDDVAIIFSPEEWECLDSAQRDLYRDVMVENCRNLLSVEASRHGTKGFSSKKDMKRSFQEELSRRLSKCGADIFHPRK

SEQ ID NO: 11161 - protein, 81 aa, Neotoma lepida
MRGIWGREGSDDREEGVGALDLRACISKPHLISLLEHGKEPWEVKGEVTRSTLRDGEPVHKTQLSLKQFVSDNVSVEKITS

SEQ ID NO: 11162 - protein, 81 aa, Neotoma lepida
SQMPVTFEDVALYLSREEWGRLDHTQQSFYRDVLQEKNGLALGIVEMGKVVPALAMATLGDMKPLRTRARWAPGEEPQCGQ

SEQ ID NO: 11163 - protein, 81 aa, Mus musculus
MNAVTYRDVHVNFTQEEWALLDPSQKKLYKDVMLETYRNLNAIGFNWEAQNIEEHCQSSRRHRRCERSQSAEKPSEYTQRD

SEQ ID NO: 11164 - protein, 81 aa, Mus musculus
MLENYSHLVFLGLADSKPQLVTFLEQRQGSTGEERQAVKAVFPGITPNDPNHYSKPTNCESLLLKRRRINTGEKPYKCEEC

SEQ ID NO: 11165 - protein, 81 aa, Mus musculus
GRVTYDDVQVNFTREEWALLDPSQKNLYRDVMLETYRNLAAIGYVWEDHNIEDHFQSSRRRGSPGRIHNSSFRSATCFPFV

SEQ ID NO: 11166 - protein, 81 aa, Dipodomys ordii
CYQDLVTFEDVAVDFTQDEWMLLDSTQRSLYWEVMLENYGHLATVGYQLVKPSLISCLEAEELRTAERSVLQEWAMRLNTK

SEQ ID NO: 11167 - protein, 81 aa, Dipodomys ordii
FLKLMSFDDVAVYFTWKEWQDLDPGQRNLYREVMLETYSNLMSFGLCVPKPKLIVKLEQGTDSWIREDSEENFTDVPEMEE

SEQ ID NO: 11168 - protein, 81 aa, Dipodomys ordii
RMQVMTFRDVAIDFSQEEWEYLNPEQRNLYTDVMSENYSNLVSVGLYIYQPHVFSLLENGQDPWLDLSDETRRLYPGQTKK

SEQ ID NO: 11169 - protein, 81 aa, Octodon degus
RPRALKFADVAVYFSPEEWGCLRPAQRTLYRDVMRETYGHLGALGCAGPKPALISWLERNTDDWEPAALDPQEYPRGVTVQ

SEQ ID NO: 11170 - protein, 81 aa, Octodon degus
EAVNLEDVLVNFTMEEWAVLNPSQKKLYRDVMWETFMNMTALGSTWDIQQIEEYNNCSRNLRNEKITKFDENKVWNQDEKM

SEQ ID NO: 11171 - protein, 81 aa, Fukomys damarensis
MEEWALLDPSQKKLYRDVMWENFRNLAAIDSNVDVKQAVLTPAESLACRKALTGPLSLTVPVIARTALKPYKHLGSEEKVY

SEQ ID NO: 11172 - protein, 81 aa, Fukomys damarensis
MLENYRNLVSLGISPFDLSVVSLLEQGQPWSVDGQVKVSRNPVQWKSVRGLNTDTSPKCVVKGFTPKGRSDTGEMFQAAML

SEQ ID NO: 11173 - protein, 81 aa, Fukomys damarensis
MEEWQHLDLAQKSLYRDVMLENYFNLISVGCQVPNPEVIFSWNPEEEPCSRGSKNSSQSYPSGDIGIESLQQELSEELFFQ

SEQ ID NO: 11174 - protein, 81 aa, Fukomys damarensis
VTFEDVAVNFSMEEWALLDPSQKKLYRDVMWENFRNVTAIGRNWDDQKIEDKFSNYRKTLRIHTGEKPYVCQQCGKAFSRR

SEQ ID NO: 11175 - protein, 81 aa, Rattus norvegicus
LQALMAFHDVAVAFSQTEWKLLSPAQRILYREVMLENYSHLVSLGIAFPKPKLITQLEQGTEPWRDGCLLDLCSEPRTELE

SEQ ID NO: 11176 - protein, 81 aa, Mus musculus
MDALTFDDVHVHFTREEWSLLDPSQKRLYKDVMLEIYKNLTAIGYKWKDHNVGEHSQNDRRYGRHERSPAGENHNEYTQCD

SEQ ID NO: 11177 - protein, 81 aa, Mus musculus
MLENYQNLATVGYQLIKPSLISWLEQEEFSKGQKIVFPEWKLQLETKCSAFQQEFLRGNISSRMQMQTGINRGRELCDGTQ

SEQ ID NO: 11178 - protein, 81 aa, Mus musculus
GLLTFGDVALDFSQEEWECLDSAQRALYIDVMLENYINLVSVDLYSKELIVERKHTIVGNALGVAQASVHIRDFTLERNHG

SEQ ID NO: 11179 - protein, 81 aa, Mus musculus
YRDVMFENYSHLVFLGLASCKPYLVTFLEQRQEPSVVKRPAAATVHPGGKPYKCQEFDKTFDWNSLLLQRQRVHPVEKPYK

SEQ ID NO: 11180 - protein, 81 aa, Mus musculus
PQGLLTFKDVAVEFSLEEWERLSFAQRSLCIDVMLENYNNLLFVENHFICAKCGKALDEDSQYIVHEHMNIQEKSSKWNKL

SEQ ID NO: 11181 - protein, 81 aa, Dipodomys ordii
QESMTFEDVAVNFTNKEWQRKCLTYSQKDLYKDVMLEIYDNIIFLGLLFPKPPLISHLEQRPKPCNQHPQDEECPSCTSPV

SEQ ID NO: 11182 - protein, 81 aa, Dipodomys ordii
KLVSFDDVAVDFSWEEWQDLDFSQRTLYRDVMLETYNNLVSLWPCVPKPNLIVKLEEGAEPWIGEASDKNFTNVQEMEDMI

SEQ ID NO: 11183 - protein, 81 aa, Dipodomys ordii
GNKLVSFDDVALDFSWEEWQDLDIAQRTLYRDVMLETYSNLMSLGHCIPKPKLIVTLEQGAEPWVGEASHKNFTVLQGERK

SEQ ID NO: 11184 - protein, 81 aa, Octodon degus
RKEMVTFRDVAVVFSEEELGLLDSAQRKLYRDVMLENFRNLLSVAHQPFKPDLIAHLEREEKVFMVETETQRYEYPGSNIQ

SEQ ID NO: 11185 - protein, 81 aa, Octodon degus
EAVTLEDVLVNFTLEEWAVLNPSQKELYREVMWETFMHMTAVGMTWDNQQMEEYKNCLRNLRNEKVSPFDQNTVWNQHEKI

SEQ ID NO: 11186 - protein, 81 aa, Octodon degus
LTGAVTYGDVAIDFSQEEWKWLQPALRDFYRCVMLANYGHLVSLVGLSISKPNVLFLLEQGQEPWLGEGEMNRDLFSVLNG

SEQ ID NO: 11187 - protein, 81 aa, Octodon degus
EAVTMEDVAVNFTKEEWALLNPSQKKLYRDVMWETFRNIKAIGRTWDNQMEEKYKNCSRNLSGEKPHDHLGFDDKLSKYNG

SEQ ID NO: 11188 - protein, 81 aa, Octodon degus
MLENYRNLVSLGIHRFDLGVVSMLEQGTEPWSVDGRVKVARNLDEWESVRDVNTDTSLQSVIKEFPPKRKSDTGEMFQSVM

SEQ ID NO: 11189 - protein, 81 aa, Rattus norvegicus
ESVSFEDVAVKFTQEEWAVLDPSQKKLYKDVMQETLRNLASIGNKLSKQKVVSEYEKLWRKLSSQLVEKFCDYHESRQCAE

SEQ ID NO: 11190 - protein, 81 aa, Rattus norvegicus
GEPPATFEDLASYITKWKPKLREKLTLELYVCDTMRTSFNLNVSPEPPAATPDLITKLEQRAAPWIEDPNGLKSGKSRSLG

SEQ ID NO: 11191 - protein, 81 aa, Rattus norvegicus
SQHTVCGSVTFRDVAVDFSQEEWACLDATQKVLYRDTMLETYSHLVTVVGSCISKPHLITLLEQEKEPWMAVKEETDRPSP

SEQ ID NO: 11192 - protein, 81 aa, Rattus norvegicus
MASSSSQHTVCGLVTFRDVAVDFSQEEWACLDATQKVLYRDTMLETYSHLVTVDVELPSPPAPSLPGGCHASCYDDNGLNL

SEQ ID NO: 11193 - protein, 81 aa, Dipodomys ordii
SQESVTFQDVAVDFTEKEWPLLDSSQRKLYKDVMLENYSNLTSLGYQVGKPSLISHLEQEEDLRTEERSMERSPLSNWETP

SEQ ID NO: 11194 - protein, 81 aa, Fukomys damarensis
ELPEATTFKDVEVTFSQDEWGCLDSTQRNLYRDVMLENYGNAASLAGSCSKPALISWLEAREPWGLKVQTAQSKRLPGSTP

SEQ ID NO: 11195 - protein, 81 aa, Rattus norvegicus
FQEMLSFRDVAIDFSAEEYECLDPAQWKLYRDVMLENYSNLVFLGLASAKPYLVTFLEQTQEPSDVKGGTATIKHPGMSKG

SEQ ID NO: 11196 - protein, 81 aa, Rattus norvegicus
VSFEDVAVHFTQEEWALLDPSQKNLYRDVMLETCRSLAAIGYKWEEQNVEDDCKNVGRIQRHVISDSEYLPEEQEGYGSKP

SEQ ID NO: 11197 - protein, 81 aa, Rattus norvegicus
FKQLCVFRDVAIEFGKEEWECLGPEQRSLYRDVMLENYSHFVSLGLAISKPSVISLLEQGKEPWRVEQAGWYPDLLSVNEA

SEQ ID NO: 11198 - protein, 81 aa, Rattus norvegicus
SQEFVTFQDIAVDFTEKEWPLLDSSQRKLYKDVMLENYSNLSSLGFQVGKPRLISHLEQEEELRMEERGIQQCPSPDWETT

SEQ ID NO: 11199 - protein, 81 aa, Rattus norvegicus
FQEMLSFRDVAIDFSAEEWECLDPAQWNLYRDVMLENYSNLVFLGLAFSKPYLVTFLEQRQEPSDEKKQVGATTMHPDIKP

SEQ ID NO: 11200 - protein, 81 aa, Mus musculus
KKPVVFSDVSLDFSQEEWECLGPAQRDLYKDVMLENYSNLLSVGKDTCISSAAISAVSASSSRNFSAAFQACHLNSCSLFA

SEQ ID NO: 11201 - protein, 81 aa, Mus musculus
MDLVTYDDVHVNFTQEEWALLDASQKSLYKGVMVETYRNLTAIGYSWEEHTIEDHFQTSRSHGRHERSSSAEQHSEFIQCG

SEQ ID NO: 11202 - protein, 81 aa, Dipodomys ordii
ALTQLTFEDVAVDFTWKEWRCLTPAQRTLYRDVMLDTYRNLVSVGVSPPNVSVILPLELEEEPWVGQNHVKTPGEPSGWEG

SEQ ID NO: 11203 - protein, 81 aa, Dipodomys ordii
QRGSVTFEDVAVDFTPEEWMSLDPTQRSLYRDVMLENYRNLATVGGQLFKPSLISWLEEKVELTIVEQGILQEWEMHIKTK

SEQ ID NO: 11204 - protein, 81 aa, Rattus norvegicus
MLENYSNLVSLGMTLQSLNAVSKLEQNKGPWTVESEAIITRKSNVQEYAIAMNAENIDCMEAKSISNGSSILSSDRIFLSG

SEQ ID NO: 11205 - protein, 81 aa, Mus musculus
MASSNCQDMVCGSVTFRDVAVDFSQEEWACLDATQKVLYRDIMLETYSNLVTVGKPVPHEWGMFPLHCGLSSCELKVMAVF

SEQ ID NO: 11206 - protein, 81 aa, Mus musculus
LTFKDVAVDFSQEEWECLDCAQRALYMDVMLENYNNLFFVGKNTLLVEFLIHFLNLPIVCLCYLSEKSKNSQNEGNSSYKL

SEQ ID NO: 11207 - protein, 81 aa, Dipodomys ordii
MASPSPPVEPKEEWEYLDPAQRSLYKDVMVENYGNLVSLDVLNRDKHEEPIVKQEIEEIEEDVEPQGVIVTRIKSEIEQDP

SEQ ID NO: 11208 - protein, 81 aa, Dipodomys ordii
ESLSFEDVTVNFTLEEWLLLGPAQRKLCRDVMSEIAGHLASVGNTGLIPGTKRCAMLKGTCHEKGCTTTEHKMGECSSRKV

SEQ ID NO: 11209 - protein, 81 aa, Fukomys damarensis
MEFSWEEWQLLDSTQRHLYREVTLENYSNLLSVGYHGTKPELIFKMEQGEEPWIINAKMSTPSCAGWQEWYQKNKDELESV

SEQ ID NO: 11210 - protein, 81 aa, Fukomys damarensis
VTFDDVAVNFTMEEWALLDPSQKKLYRDVMWENFRNVTAIGRNWDNQQIEDQYKNYRNNLRKTSADFQSLQKHAMTNPEEK

SEQ ID NO: 11211 - protein, 81 aa, Fukomys damarensis
MASASSPLEPKEEWDYLDPAQRSLYKDVMMENYGNLVSLDVMNRDKEEEPTVKQEIEELEEEVEPQGVIVTRIKSEIDQDP

SEQ ID NO: 11212 - protein, 81 aa, Fukomys damarensis
PRAPLAVQAVTLTLVPLLCAVGVAGNAMVVLVVVRGRHMVTPTNCYLGLCVTKPELICRLEQGEEPWILKREMQSYSHWEA

SEQ ID NO: 11213 - protein, 81 aa, Rattus norvegicus
VCGSVTFRDVAVDFSQEEWACLDATQKVLYRDTMLETYSHLVSVVGRCISKPHLITLLEQEKEPWMAVKEESDRPSPGVKT

SEQ ID NO: 11214 - protein, 81 aa, Mus musculus
MDALTYDDVYVNFTQEEWALLNPSQKSLYKDVMLETYRNLNAVGYNWEDSNIEEHCESSRRHGRHERSHTGEKPFEGIQYG

SEQ ID NO: 11215 - protein, 81 aa, Dipodomys ordii
SVTFDDVFVNFTLEEWALLDAAQQQLYRDVMVETFRNLASVEKEKESQIIEDEEDQTVEEVCENPEPDLRVSILNEKTQKP

SEQ ID NO: 11216 - protein, 81 aa, Dipodomys ordii
MEAVTFGDVAVHFSREEWQCLDSGQRALYREVMLENHSSVAGLGKAALCDSQPPCQASLRSKECGRIAVPSQPSQKDSASR

SEQ ID NO: 11217 - protein, 81 aa, Dipodomys ordii
AEESVTFKDVAVDFTQEEWGQLDSPQRALYRDVMLENYQNLLALGPPVHKPDVICHLERGEEPWRVYREVHTRICAEWEPK

SEQ ID NO: 11218 - protein, 81 aa, Dipodomys ordii
LQSLVSFEDVAVDFTREEWQDLDDAQRTLYRDVMLDNYSSLVFVGHCLAKPELIFKLEQGLGPRRVDGTPRLPGLRRATIL

SEQ ID NO: 11219 - protein, 81 aa, Dipodomys ordii
SLKLISFDDVAVYFTWKEWQDLDTGQRTLHRDVMLETYSNLMSLGHCVPKPELIVKLEQGAEPWIREASDKNFTEKSFIKR

SEQ ID NO: 11220 - protein, 81 aa, Dipodomys ordii
SLRLVSFEDVAVDFSWEEWQDLDNAQRTLYRDVMLETYSSLVSLGHCVPKPEAIIKLEQGAEPWVGEPSGQSFAGHCVHKP

SEQ ID NO: 11221 - protein, 81 aa, Octodon degus
SQTPVTFKDVLVDFTREEWKLLDAAQQIMYKDVMLENYKNLISLGHQLPKPDVILQLENEEEPWLMEKGIYHGTHPDSDTT

SEQ ID NO: 11222 - protein, 81 aa, Octodon degus
FKEAVTFRDVAVVFSEEELGLLDSAQRKLYREVMLENFRNLLSVEHQFITLDILPQLESDEKLWMRKRTTQSGDTSGDKNL

SEQ ID NO: 11223 - protein, 81 aa, Octodon degus
FSELVDFEDITLAFTPEEWGLLDLKQKSLYREVMLENYKNLVSVEHQLSKPDVVSQLEEAEDFWPVEREILQHTIPECPGT

SEQ ID NO: 11224 - protein, 81 aa, Octodon degus
MRGNYETLVSLDYAISKPDILTRLEKEEDPWLKAVWGQEGSREPAVHPGVPGPTRCPEQVSGPTSISHKEPAEGPAPVQPR

SEQ ID NO: 11225 - protein, 81 aa, Octodon degus
RALENDGVCFSEQEWENLADWQKELYRNVMQSNYEALVSLIILSPLEKMCWLGLPCCAAVSPFSAVGWSQSQCGLKVLGQP

SEQ ID NO: 11226 - protein, 81 aa, Octodon degus
MLTFRDVAIDFSMEEWEFLEPAQQNLYRDVMVENYKNLLSLGLAVTKPYLISFLEQSREPWDVKSQGTTGIHPAVSSYHIQ

SEQ ID NO: 11227 - protein, 81 aa, Octodon degus
MASPSSPLEPKEEWDYLDPAQRSLYKDVMMENYGNLVSLDVLNKDKDEEPSVKQEIEELEEEVEPQGVIVTRIKSEIDQDP

SEQ ID NO: 11228 - protein, 81 aa, Octodon degus
VTFEDVAVNFTLEEWALLDPSQKRLYRDVIQETFWNLAAIGNNWEEQNIADEYENSRRNLREDTEQEPYVYEEYGEMLDKF

SEQ ID NO: 11229 - protein, 81 aa, Octodon degus
LQESFSFEDLSVDFTQKEWQLLEPHQKNLYRDVMLENYSSLVSLGYTVMKPDVIFKLEQGEEPWAGDEVQHAEVWQVHDPI

SEQ ID NO: 11230 - protein, 81 aa, Mus musculus
MDALTYDDVHVNFTQEEWALLNPTQRNLYKDVMLEIYRNLKAVGYNWEDQNTEEYCQSSRKHGRHERSRTGEKPSENTKCG

SEQ ID NO: 11231 - protein, 81 aa, Mus musculus
GELPATFEDLAVYFSREEWSLLDKQQKELYRDGMQMSYELLASLEPPAAKPDLITKLEQRAAPWIKDPDGLKPGKSPSLGR

SEQ ID NO: 11232 - protein, 81 aa, Dipodomys ordii
SLRMVSFEDVAIDFSWEEWEYLDDDQKTMYRDVMLETYSNLVSLGHYVPKSKVIVKLEQGAEPWMREAPDKKLTDVQEMDD

SEQ ID NO: 11233 - protein, 81 aa, Dipodomys ordii
SLGLVSFEDVSMDFSWEEWKDLNGAQRTLYRDVMLETYSNMVSLGYCIPKPEVIVKLEQGAEPWLGEAPDKSITDVQQVDG

SEQ ID NO: 11234 - protein, 81 aa, Dipodomys ordii
KLVSFDDVAVDFSWEEWQDLDFSQRTLYRDVMLETYSNLVSLWPCVPKPNLIVKLEEGAEPWIGEASDKNFTNVQEMEDMI

SEQ ID NO: 11235 - protein, 81 aa, Dipodomys ordii
VSFADVAVYFSPEEWGCLRPAQRALYRDVMRETYGHLGALGDAPNQKEGEPKGRPEAVGPGKEKPKPLVKHKRDSAVSKTS

SEQ ID NO: 11236 - protein, 81 aa, Dipodomys ordii
MLETYSNLLSLGHCVPKPKLIAKLEQGAEPWIREASNKNLTDVQEKEYRTKTYQKSPYDCLSEVGVMNTNTGKKKVKLITT

SEQ ID NO: 11237 - protein, 81 aa, Rattus norvegicus
EPVTFEDVALNFSPGEWALLDSSQKKLYRDVMTETFLNLISIGKTEENIEEDYANVRRNLRTQTIERDCKSEDGSQHGEAH

SEQ ID NO: 11238 - protein, 81 aa, Rattus norvegicus
AKGLVSFEDVSVDFTWDEWQDLDDAQRKLYRDVMLETYRSLESLGHCVTKPEVIFKLEQGTGPWRAEDIPKQSRPDVRKVR

SEQ ID NO: 11239 - protein, 81 aa, Rattus norvegicus
MFSDVSVVFSKEEWDCLDLDQRTLYRDVMMENYHNVLSLGCFISKPDVISLLEQGKEPWKRRRCPDSGVKDETHQLFSENG

SEQ ID NO: 11240 - protein, 81 aa, Rattus norvegicus
GYRVVKPSMISKLKKGKEPWPLGAEFLRRSCGDKRRTVHDPKARHQEQQAGTARKGELAKRQKTPTRHESYDCSKCGKSFC

SEQ ID NO: 11241 - protein, 81 aa, Fukomys damarensis
MLENYRNLVFLGLAVSKPYLVTFLEQRKELWNVEREEIVAIYSDNGFKNEEISKCDQFENSFRKSSPCKQETISPFVKTQN

SEQ ID NO: 11242 - protein, 81 aa, Rattus norvegicus
ALVTFEDVAVRFTQEEWALLDPSQKILYRDVMRETYRNLTSVGINWECWDLEACFRSLGRNLRVQVVKRKCELTNSGPCAE

SEQ ID NO: 11243 - protein, 81 aa, Castor canadensis
PKVPVTFVDIAVYFSEDEWKNLDEWQKELYKHVMRGNYETLVSLDYAISKPEVLSQIEQGKEPCTWRRAGPKVPEVPVDPS

SEQ ID NO: 11244 - protein, 81 aa, Peromyscus maniculatus
VTFEDVAVNFTLGEWTMLDSSQKKLYRDVMKETFMNLISIGKTEEEDIEEYQKPKGDLRTLMVERLCKYDRGNQNRETHQQ

SEQ ID NO: 11245 - protein, 81 aa, Peromyscus maniculatus
EEGCVSFEDVAVYFSWEEWKLLNDSQRLLYQTVMTEIFALMSSLGLMPSGIHGVTQLESWGEPSVPALRFLTPGCWIKVKS

SEQ ID NO: 11246 - protein, 81 aa, Peromyscus maniculatus
FQSEVMFRDVTVNFSQEEWECLNSYERDLYKDVMLENYSHLVSLGCSISKPDVITLLEQGKEPWMIVRDERRRWSQDLETR

SEQ ID NO: 11247 - protein, 81 aa, Peromyscus maniculatus
YEGLVSFEDVSVDFTWEEWQDLDDAQRKLYRDVMLETYSSLLSLNQCDPKPELILKLEQEAEPWKEDDVPNPSLPDMQHAN

SEQ ID NO: 11248 - protein, 81 aa, Peromyscus maniculatus
VTYDDVHVDFTWEEWILLDPSQKNLYKDVMLETYRNLTTIGYIWKDHNTEEHFQSSRRHERTHTGEKPYECNQCGKAFAPH

SEQ ID NO: 11249 - protein, 81 aa, Ictidomys tridecemlineatus
FDDITVYLLQEEWMLLSQQQKDFYGSDKLVPPLGPTVTSPELFCEFGKVSKPWPGNVQGQRSLLDHHPGKDQVGYMGEMDV

SEQ ID NO: 11250 - protein, 81 aa, Marmota monax
VTFEDVAVNFNQEEWALLDFSQKNLYRDVMLEVLRYLTSIGNKWEDKTIEDQIEHSGSILRHIACHSGHEPYKHEECEEKP

SEQ ID NO: 11251 - protein, 81 aa, Heterocephalus glaber
SVSFEDVVVSFTREEWQVLDDAQRTLYRDVMLETYCSLLLLGHCITKPEVIFKLEQGAEPWMGEEPLNQSPSDVQKVGNVI

SEQ ID NO: 11252 - protein, 81 aa, Mus musculus
MEPVTFEDVAVNFSLGEWALLDSSQKKLYRDVMTETFMNLISIGKTEEKENIEDNYQNLRKNVRTLVAERSCDYGDVSQCG

SEQ ID NO: 11253 - protein, 81 aa, Mus musculus
MGVVTYDDVHVNFTQEEWALLDPSQKNLYRDVMLETYRNLAAIGYSWEDHNPEEHFQSSRRHGRHEKSHIEEKPSEFTQCG

SEQ ID NO: 11254 - protein, 81 aa, Rattus norvegicus
LQDAVTFKDVAIDFSQEEWEWLNPAQRSLYRNVVLENYRNLVSVGACISKPSLISLLEHGKEPWEVKGQVTRSPVQGGESV

SEQ ID NO: 11255 - protein, 81 aa, Heterocephalus glaber
FAVDPRSVWCLSQDKRRPTCGTHARVLHTWRPGPASSIFFFAAHTAGFLVFKPELISRLEQGQEPWILDLQGAEGTKAPRT

SEQ ID NO: 11256 - protein, 81 aa, Mus caroli
PQALLTFKDVAVDFSLEEWECLNFAQKSLYMDVMLENYNNLLFVENHFICAKYGKALDEDSQYIIHDHMNIQGKSSKWNKL

SEQ ID NO: 11257 - protein, 81 aa, Heterocephalus glaber
EAVTFEDVAVNFTMEEWALLNPSQKNLYRDVMGETFRNMVSIGQFITAKPWNQPRCPSVDPWIKKNFEVFENREEWRGNEE

SEQ ID NO: 11258 - protein, 81 aa, Heterocephalus glaber
IQDSLTFEDLAVDFTPEEWALLDLAHRKLYRDVMLENFQNLTSLGFKILLKTNESVVLPHNNLEKVSNEQKECGKAFHFLA

SEQ ID NO: 11259 - protein, 81 aa, Mus caroli
SQESLTFKDIAVDLSQEEWGQLAPAYRDLYREVMLENYRNLVSVAGYQLSKPTVISQLEKGEGPCMAESQGPEDPILDVKN

SEQ ID NO: 11260 - protein, 81 aa, Mus caroli
DALTYDDVYVNFTQEEWTLLNPSQKSLYKDVMLENYTNLIAVGYNWEDQNIEEHCQSSRRHGRHERTHSGEKAYECKQCSK

SEQ ID NO: 11261 - protein, 81 aa, Mus caroli
MDALTYDDVHINFTPEEWALLDHTQKNLYTDVMLETYKNLTAIGYKPEDKIIEHLQNFRIPGRHKGSLTREKLYEYTQCGK

SEQ ID NO: 11262 - protein, 81 aa, Mus caroli
SQESVSFEDVSVDFTQEEWNQLDPIQRSLYRDVMLENYSHLVSLGYPITKPEVITSLEQGVLGIIKREIPSSSCTDGQAEY

SEQ ID NO: 11263 - protein, 81 aa, Neotoma lepida
LLTFKDVATDFRQEEFGCLDSAERTLPGNHKLKNYTNLVSTALSYHQTQEVSHRSTNTILYRNKEQAYLKLVVLTCYIQGS

SEQ ID NO: 11264 - protein, 81 aa, Mus musculus
QCLLTFKDVFLDFSSEEWECLNFAQRTLYMDVMLENYNNLLFVENHCICGNYEKEKVVEQDTQHIFNEHGHIQEKSFKCNE

SEQ ID NO: 11265 - protein, 81 aa, Mus musculus
MCSFPVLKKIFWAGLFVYRPHLFSLLEKGQDPWMILRDETRGPYPDIDFSSQNKKFLGKPSTYEELSQREMKEYFRKRSLE

SEQ ID NO: 11266 - protein, 81 aa, Mus musculus
MAAVTYEDVHVNFTHEEWALLDSSQKSLYKDVMLETCRNLTAIGYRLEDHNIEEHCQSSRRPGRYICNCGYKPCENEDHGK

SEQ ID NO: 11267 - protein, 81 aa, Mus musculus
RKNLLTFEDVSVNFTQEEWQWLSDTQRDLYRKVTLENYKSLVSLGVPVYKPAVISLLEQGKDPWMVQKKGARDTCPDWQYV

SEQ ID NO: 11268 - protein, 81 aa, Dipodomys ordii
LQGLVTFRDVVIVFSQEEWKYLEPAQRNLYRNVTLETFSHLVSVGLSISKPDVIFLLEQGREPWIIADDMERLWYPDLEPR

SEQ ID NO: 11269 - protein, 81 aa, Dipodomys ordii
SLKLVSFDDVAVDFSWEEWQDLDHAQRTLHRDVMLETYSNLLSLGHWVPKPKLIAKLEQGAEPWIREASDKNLTDVQEKEY

SEQ ID NO: 11270 - protein, 81 aa, Dipodomys ordii
MESFSFKDVSVKFTKEEWALLNPSQKTFYRDVMLETFSNFNCIGHKWTDLNMNDQHKNCQRNIRHVISHSGYKYEHKECRQ

SEQ ID NO: 11271 - protein, 81 aa, Dipodomys ordii
MVTFRDVAVDFSLDEWGWLSPAQRNLYRTVVLENYQNLLSVGVCISKPYVISLLEQGKEPWETSTMTRSLLADGEPMYEGQ

SEQ ID NO: 11272 - protein, 81 aa, Octodon degus
VSLEDVAVNFTMEEWALLNPSQKKLYRDVMLETFMNMTDIGRNWDNHPIEEEYKNTSKNQSNEEVARWCQYKHWNQYINLF

SEQ ID NO: 11273 - protein, 81 aa, Octodon degus
PVTFADVFVYFSPEEWELLEEAQRFLYRDVMLENFALVATLGCSCEAGNEEAHAEQSISVKKVSQIRTEPGLFFQRAHPCG

SEQ ID NO: 11274 - protein, 81 aa, Fukomys damarensis
DWALVTFSDLAIYFSQEEWEWLSPMQKELYEEVMLENYRNLVSVGLCLRRPRVITLLEKGKEPWLVELPRRPWCRASKCET

SEQ ID NO: 11275 - protein, 81 aa, Fukomys damarensis
FQELVTFGDVAIDFSRQEWEYLDLRQRDLYRDVMLENYRNLVSLGHSISKPDVIDLLEQGKEPWTDLDLQYKIISYLKMPA

SEQ ID NO: 11276 - protein, 81 aa, Fukomys damarensis
CLGSVTFDDVAVHFSWDEWHLLDEAQRCLYHDVMMDNLALITSLGCWLGVEDVAASSEQSASSDGMSHVRTPRAGLSPQKA

SEQ ID NO: 11277 - protein, 81 aa, Fukomys damarensis
MTFKDVAMDFTPEEWGNLDPAQRDVMLENYRNLVSLWLPVSKPENYNLDNGKEPLKFERKPPKHSYSDMETIPESKDSTSM

SEQ ID NO: 11278 - protein, 81 aa, Ictidomys tridecemlineatus
RPRALKFVDVAVYFSPEEWGCLRPAQRALYRDVMRETYGHLGSLGCAGPKPALISWLERNTDDWEPAALDPQEYRRGLTVQ

SEQ ID NO: 11279 - protein, 81 aa, Ictidomys tridecemlineatus
AHESLAFRDVAIDLSQEEWECLDTAQRDLYREVMLENYSNLISLGCIIPKPDVIVLLEQEKDPWLETREETRRRSSDFTKK

SEQ ID NO: 11280 - protein, 80 aa, Ictidomys tridecemlineatus
MYFLLKAFVVFRDVAVDFTQEEWRLLSPAQKILHREVMLENYSHLVSLEIAFSKPKLITQLEQGEEPWREVRKHLPDLCP

SEQ ID NO: 11281 - protein, 81 aa, Marmota monax
SKGSVSFKDVTVDFTQEEWQQLDPAQKALYRDVMLENYCHFISVGFHITKPDMIRKLEQGEELWSERIFASQSYLEDGKAE

SEQ ID NO: 11282 - protein, 81 aa, Marmota monax
MLENYGNVASLGFSLLKPAVISRLEGGDLDIQTGSNLSKEMCEEKVSTSFELHKDSSQETDFSEAFMLEQQQEVHLAGSMK

SEQ ID NO: 11283 - protein, 81 aa, Marmota monax
EPGTVSFADVAVYFSLEEWGCLRPAQRALYRDVMRETYLHLSALGGGGTKPALISWVEEEAELWHPDAQDPEVAKCPTEAD

SEQ ID NO: 11284 - protein, 81 aa, Marmota monax
MTCFSSLRSTINNLYTFPRAAENEQIAGYDVTKPNVIIKLEQGEEPWTIEDDFPSQSHSEVWEVDDIVERIQEDEDQHSRQ

SEQ ID NO: 11285 - protein, 81 aa, Marmota monax
MLENYSNLISVGFRVSKPDVIFKLEQGEEPWIVEEISRESYTEDDDALEKDKEIQDKYLSQNSTTLITKRVNAFGTMFTLG

SEQ ID NO: 11286 - protein, 81 aa, Marmota monax
QVPISFMDLAVRFSEEEWRLLEERQREFYRDVMRENYETLVSVGTDELLPLSAFLSPTEPGAAMGGGSHGDEGQEPPVKGS

SEQ ID NO: 11287 - protein, 81 aa, Marmota monax
VQGSVSFDDVTVNFSRDEWLCLSSTQRILYRDVTLENYSHLVFVGYCLTKPDVILRLEQGENPWTLEGEHPGQAYPKAQKL

SEQ ID NO: 11288 - protein, 81 aa, Marmota monax
FQESVTFRDVAIAFSQQEWQSLDSSQRDLYRDVMLENYRNLVSLAGHSLSKPHVITLLEQWKDPWETGRKDKRRRCADLQL

SEQ ID NO: 11289 - protein, 81 aa, Marmota monax
MLETYYSLVSLGHCIIKPEVIFKLEQGAEPWMVEEHPNQTLSDVQKVDDQIDRSQESQDRRLWQVVITNSNSSTKERVEVE

SEQ ID NO: 11290 - protein, 81 aa, Marmota monax
MLENYQNLLALGPPVCKPDVISHLERGEEPWQVHSKVTGRTCSEWEPMPEMKEESSQQQNFFQKNPSLKPIVEQLKRTSLH

SEQ ID NO: 11291 - protein, 81 aa, Heterocephalus glaber
MLETYSHLVSLGQQVTKPDLILKLEVEEPCPAEGKVPIWSFSEVCQIDEQIDKQHQDDRDKCLLMQVGFPGKKIITTKSGC

SEQ ID NO: 11292 - protein, 81 aa, Heterocephalus glaber
MLENYSSLVSLGYTVMKPDVIFKLEQGEEPWVGDGEVQHSDCPEAWQVDDHMTWQQENQDQPRSLKRGHEWDVFGKNFTLN

SEQ ID NO: 11293 - protein, 81 aa, Heterocephalus glaber
SVLFITGLCVTKPELIRRLEQGEEPWILKRDLPSYSHWEAQRASNTKESQENEDKYLIQALFIKNKTVNKDRSKTLREMVD

SEQ ID NO: 11294 - protein, 81 aa, Heterocephalus glaber
ALVSFEDVAVTFTGEEWRHLDLTQRTLYQEVMLETCELLVSLGCPVPKAELMYPLEYGQGLWMVKRGLLQHTCTGEKAKLD

SEQ ID NO: 11295 - protein, 81 aa, Heterocephalus glaber
AVSFEDVAVNFTVEEWALLDPFQKKLYRDVMCETFRNVAALGRTWDNEEIEDEYKNCRRSLSSGEVQKCCEYELWYQHGKM

SEQ ID NO: 11296 - protein, 81 aa, Heterocephalus glaber
MLENYNNLVSVGCHIIKPDVIIKLEQGEEPWIVEGAFPPQSYPDEAWQADDLMERVQQDADMFFINKTLVEERGNVSGKAF

SEQ ID NO: 11297 - protein, 81 aa, Heterocephalus glaber
VSFEDVVVDFTCEEWQDLDDAQRTLYRDVMLETYRSLVLLGHCITKPEVIFKLEQGAEPWMGEPPPNLSPPDGQKMDDIIQ

SEQ ID NO: 11298 - protein, 81 aa, Mus caroli
MDAVTYEDVHVNFSREEWALLDPSQKSLYKDVMLETYWNLTCIGYKWNNHDNEEYCQSSGRHGRCINCPSAYGKKQCTNLF

SEQ ID NO: 11299 - protein, 81 aa, Mus caroli
MGSVSFEDIAVDFSWDEWQHLDMAQRTLYRDVMLENYSSLLFLGHCMTKPEVIFQLEHGFGPWPVGDSSVRSLPGIHKVTT

SEQ ID NO: 11300 - protein, 81 aa, Mus caroli
VQDLVTFKDVAVLFTQEEWGRLSSAQRALYRDVMLENYSNLVSLAGLLGSRPDMFFPLEEVEECVSEEAPEGFVLDAADEP

SEQ ID NO: 11301 - protein, 81 aa, Mus caroli
ARFPLTFEDVAIYFSEQEWQHLEAWQKELYKQVMRTNYETLISLDNGLPKPELISWIELGRELFSSWGEKKKPDKEVHCSI

SEQ ID NO: 11302 - protein, 81 aa, Mus caroli
MAVVTYEDVHVNFSHEEWALLDSSQKSLYRDVMLETYWNLTAIGYKLEDHNVEEYYQSYRRHRRYNICHCEYKPCEHKGYG

SEQ ID NO: 11303 - protein, 81 aa, Mus caroli
AHSMVMFRDVTVDFSQEEWECLSSYERDLYRDVMLENYSHLVSLGCSISKPDVITLLEQGKEPWMIVRAEKRRWSRDLESR

SEQ ID NO: 11304 - protein, 81 aa, Mus caroli
MDALTYDDVHVNFTQEEWALLNPTQRNLYKDVMLEIYRNLKAVGYNWEDQNTEEHCQSSRRHGRHERSHTGEKPSENIQCG

SEQ ID NO: 11305 - protein, 81 aa, Mus caroli
PQGLLTFKDVALDFSLEEWEALSFAQRTLYMDVMLENYNNLLFVENHCICGKYEKVLDQDSQYIVHEHMNIQEKSSKWNKL

SEQ ID NO: 11306 - protein, 81 aa, Mus caroli
ARVSVVFSDVSIAFSQEEWESLDLEQRNLYKDVMMENYHNVASLAGCFIAKPDVISLLEQGKEPWKVVRQRKPCPDSETKD

SEQ ID NO: 11307 - protein, 81 aa, Mus musculus
TQGQLSFSDVAIEFSQEEWECLDHAQRALHRDVMLENYSNLLSLGVTLPNLNAMSKLEQYKGPWTVESEAIRIRKSNGKEY

SEQ ID NO: 11308 - protein, 81 aa, Mus musculus
PQGLLTFKDVALYFSLEEWECLSFAQRTLYKDVMLENYNNLLFVENHCICGKYRKVLDQDSQYIVHEHMNIQEKSSKWDKL

SEQ ID NO: 11309 - protein, 81 aa, Mus musculus
RADALTYDDVYVNFTQEEWALLNPSQKSLYKDVMLETYRNLIAVGYNWEDSNIEEHCESSRRHGRHERSHTGENPDEGIQC

SEQ ID NO: 11310 - protein, 81 aa, Rattus norvegicus
MEAVTFKDVAVIFTKEEFRLLDSTQRKLYQDVMVENFRNLLSVEYQLFKQEKPQLEREEKPREQGSGMNNQSERGAVQGGR

SEQ ID NO: 11311 - protein, 81 aa, Heterocephalus glaber
ITFDDVALYFLEQEWEILEMWQKEIYAQVMKANYEALDFLAGDYAASREAVMAEPASVTITFDDVALYFLEQEWEILEMWQ

SEQ ID NO: 11312 - protein, 81 aa, Mus musculus
SASLENTAQCLLTFKDVFLDFSSEEWECLNFAQRTLYMDVMLENYNNLLFVENHCICGNYEKEKVVEQDTQHIFNEHGHIQ

SEQ ID NO: 11313 - protein, 81 aa, Mus musculus
LQVPISFKDLAVRFSEEEWRLLQEGQREFYRDVMRENYETLVSVGTSELLPLSAFLSPAEAGGATSGESHQDKGQKPHLEH

SEQ ID NO: 11314 - protein, 81 aa, Mus musculus
KPGTVSFADVAVYFSPEEWRCLRPAQRTLYREKSGATNQRSSAGWRKSPKCGDPVPRSQRWPCAGQKSTQIAGTRRKGRDQ

SEQ ID NO: 11315 - protein, 81 aa, Mus musculus
PQGQLTFKDVAVDFSQEEWECLDCAQRALYMDVMLENYNNLLFVENQYMCPEFENMLNQDLQHIVHEHANTQVKSYECHEL

SEQ ID NO: 11316 - protein, 81 aa, Mus musculus
VEEPVTFKDVAVALPQEEWRQLDLVQRTLYRDVMLETYGHLLSVGNQIAKPEVISLLEQGEEPWSVEQGYPKSSCPEWMRN

SEQ ID NO: 11317 - protein, 81 aa, Mus musculus
MDALTFDDVHVHFTREEWSLLDPSQKRLYKDVMLENYRNLTTIGYNWKDHNIGEHSQNDRRYGRHKITPAGEKPYEYTQWD

SEQ ID NO: 11318 - protein, 81 aa, Mus musculus
LRTPNMDLVTYDDVHVNFTQEEWALLDASQKSLYKGVMVETYRNLTAIGYSWEEHTIEDHFQTSRSHGRHERRSSAEQHSE

SEQ ID NO: 11319 - protein, 81 aa, Dipodomys ordii
SLKLMSFDDVAVNFTRKEWQDLDPGQRALHREVMLETYSNLMSLGHCVPKPILIVKLEQGAEPWMREDSEENFTDVPEMED

SEQ ID NO: 11320 - protein, 81 aa, Dipodomys ordii
PEKSISFTDLTVDFTHEEWLRLGPVQRLLYREVMLENYSNLISVGIHTSKPDVIFKLEQGEEPWIGDEITRQNHTEDDGAL

SEQ ID NO: 11321 - protein, 81 aa, Rattus norvegicus
FQDMLSFCDVAMYFSAEEWECLGPDQWKLYRDVMLENYSNLVFLGLASSKPYLVTLLEQIKDSSDMKKQEAITVHPGAKGY

SEQ ID NO: 11322 - protein, 81 aa, Rattus norvegicus
MDFTPEEWGKLDPVHRDVMLENYRNLVSLWLPISKPDDYDSEDGKELLKLERKSPKCSDSDVETRPESKESTSVLDFPKEE

SEQ ID NO: 11323 - protein, 81 aa, Rattus norvegicus
MLSFCDVAMYFSAEEWECLGPDQWKLYRDVMLENYSNLVFLGAKGYMCKEYGKGFEHKNVYQNHQRTHLRVKSYKCEECGK

SEQ ID NO: 11324 - protein, 81 aa, Marmota monax
LQEPVTFRDVAVDFTQEEWGQLEPAQRTLYRDVMLETFGHLLSVGPELPKPEVISQLEQGAELWVVGKGVAQGCHPGWELA

SEQ ID NO: 11325 - protein, 81 aa, Marmota monax
SQGTVTFKDVAIAFTQEEWKQLDPAQRNLYRNVMLENYNNLITVGYPFTKPEVIFKLEQEEEPWVVEEEVFRRHCSGEIWG

SEQ ID NO: 11326 - protein, 81 aa, Marmota monax
PKVPVTFDDVAVYFSEQEWGKLEDWQKELYKHVMRGNYETLVSLDYAISKPDILTRIERGEEPCPEDQQSKEKGTEEEAAC

SEQ ID NO: 11327 - protein, 81 aa, Marmota monax
CVTFEDVFVYFSWEEWELLEEAQKFLYRDVMLENFALVATLGCWCDADNEKALFEQSISVERQLEIRHPESDLFIQKAYPC

SEQ ID NO: 11328 - protein, 81 aa, Marmota monax
LEVSISFEDVTVNFSREEWQHLDPVQRRLYWDVTLENYHHLISVGYQVPKLEAIYKLEQGERPWTLEGEAPCQSCSGENIR

SEQ ID NO: 11329 - protein, 81 aa, Marmota monax
MLENYRNLVALGHQLYKPEVITQLEKEELRLTERDGPLETPPDAENIPEVKKSALNQSISDENQTQDMIMQRLTRDSFWYS

SEQ ID NO: 11330 - protein, 81 aa, Marmota monax
PKVPVTFDDVAVYFSEQEWGKLEDWQKELYKHVMRGNYETLVSLDYAISKPEVLSQIEQGKEPCTWRRAGPKVPDVPVDPS

SEQ ID NO: 11331 - protein, 81 aa, Heterocephalus glaber
SEESVTFKDVAVDFTQEEWGQLDSPQRALYRDVMLENYQNLVALGPPVCKPDVISHLERGEEPWRVYREGSGGACSEWGPA

SEQ ID NO: 11332 - protein, 81 aa, Heterocephalus glaber
GPVSFKDVAVDFTQEEWQQLDRDEKMTYRDVMLENYNNLISVGYDVTKPNVIIKLEQGEEPWTIEGDFSQTCPEVWKIDDL

SEQ ID NO: 11333 - protein, 81 aa, Mus musculus
SQGALTFMDVAIEFSKEEWECLNSAQRALYRDVMLENYNNLVSVGVAVSKREVIICLEQNKEPWIVDAEETQVREPALSCE

SEQ ID NO: 11334 - protein, 81 aa, Mus musculus
RHAPPPLQIPAAATWPLTNPPRRWMAFEDVAVYFSQEEWMFLNAAQRALYRHVMLENFALVDSIELSKAFQISMGQRRDVG

SEQ ID NO: 11335 - protein, 81 aa, Mus musculus
EAVTFGDVAVHFSREEWQCLDSGQRALYKEVMLENHSSVAGLDSAIRTDRKQTCEYTSLLQRQIPGFGDNLDSKVWSENCP

SEQ ID NO: 11336 - protein, 81 aa, Dipodomys ordii
SQASVSFMDVCVDLTEEEWQCLGPAHRTLYRDVMLEIYSHLVSVGYCSTKPELIFKLEQGDNLWSLNKKNQLLSPNSPEDC

SEQ ID NO: 11337 - protein, 81 aa, Dipodomys ordii
SLRLVSFEDVAVDFSWEEWQDLDNAQRTLYRDVMLETYSSLVSLGHCVHKPEVIVAEPQVGGAPDQNFPDVQQVDDQIEMC

SEQ ID NO: 11338 - protein, 81 aa, Dipodomys ordii
SQDCVTFDDVAVEFTPEEWTLLDSAQRTLYRDVMLENYKNLATLGCQFFMPRVILWLTQEVLGPVEGAGIQELEEQPRTCG

SEQ ID NO: 11339 - protein, 81 aa, Octodon degus
LQGSVLFEDVSMAFTQKEWQLLDPSQKCLYRDMMLENYGHLESLGLCVTKPELICRLEKGEEPWISKKELPSHSHWEYQRA

SEQ ID NO: 11340 - protein, 81 aa, Octodon degus
SLGLVSFEDVAVDFSWEEWQDLDDAQKTLYRDVMLETYSSLVSLGHCSPKPEVIIKLELGAQQWMGEEHPSQAHTDVQKVE

SEQ ID NO: 11341 - protein, 81 aa, Octodon degus
QELAESVTFEDVAVTFTLEEWALLDPSQKKLYRDVMREIQQNMAAIGRNWENQQNDEKYKNSWRHLRNEEVEKSYQYKAWN

SEQ ID NO: 11342 - protein, 81 aa, Fukomys damarensis
PKVPVAFDDVSIYFSTPEWEKLEEWQKELYKNIMKGNYESLISMDYAMSQPDVLSQIQPEGEHNTEDQAGPEGSDIAAVPN

SEQ ID NO: 11343 - protein, 81 aa, Fukomys damarensis
QMPVTFEDVALYLSREEWGRLDHAQQNFYRDVLQKKNGLALGSPFSGPFWAPQVPGKVETSSSSRRTGAKEEESDPGSGAV

SEQ ID NO: 11344 - protein, 81 aa, Fukomys damarensis
KVPVTFVDIAVYFSEDEWKNLDEWQKELYNNLVKENYKTLMSLDAEGPVAKPDTSAPVEPREEPCVWEQRHPEEREIPVDT

SEQ ID NO: 11345 - protein, 81 aa, Fukomys damarensis
SQGLVTFEDVAVYFSLEEWERLDSDQRGLYQEVMQENYGILVSLGYPVPKPDLIFRLEQGEEPWVPDSPHPEEGDIVTGVY

SEQ ID NO: 11346 - protein, 81 aa, Rattus norvegicus
MSSFCLQAGFLFTKPKVISLLQQGEDPWQVEKEGPRYFSLGLKCSHRTTKSTQTQDSSFQELIVRKSKRTFAFEPLNMKSE

SEQ ID NO: 11347 - protein, 81 aa, Rattus norvegicus
PVTYDDVHVNFTHEEWALLDPSQKNLYKDVMLETYLNLCGIGCKWEDCNIEEHCQSSGRHERMSRRWGDNPALSASTVVDM

SEQ ID NO: 11348 - protein, 81 aa, Rattus norvegicus
EQLTFRDVAIDFSGEEWECLNSEQQNLYTDVMLENYRNLVFLGLAVSKPYLVTCLEQRKEPWSVKRQKPVALFPALFPHHN

SEQ ID NO: 11349 - protein, 81 aa, Mus musculus
CSISKPDVITLLEQGKEPWMIVRAEKRRWSRDLESRYSSNGLLPEKNTYEINLSPWEIMGRIQRRGPEDSPLGKDFEYKIF

SEQ ID NO: 11350 - protein, 81 aa, Mus musculus
SSFTRTAQCRNTAAAIEEDAVTYDDVHVNFTREEWNLLHPSQKSLYKDVMLETYWNLTVIGYTWENHHIERHCQSSRRNER

SEQ ID NO: 11351 - protein, 81 aa, Mus musculus
YREVMLENYSNLVFLGLAFSKPYLVTFLEQSSDPWSMKRKESAAIHLGSKPHKCKECGKAFDRNSVLIQHQRIHTGERSYK

SEQ ID NO: 11352 - protein, 81 aa, Dipodomys ordii
SLNLVSFDDVAMDFSWEEWQDLDIAQRTLYKDVMLETYSNLASLGHCVPKPKLIVKLEQGAEPWMGETLNKNFPDVQEMED

SEQ ID NO: 11353 - protein, 81 aa, Dipodomys ordii
LQKPVSFKDVVVGFTHEEWHRLTPAQRALYRDVMLETYSNLISVGYKGTKPDVILRLEQRKAPWICEAACPSCQWPEKIWK

SEQ ID NO: 11354 - protein, 81 aa, Dipodomys ordii
MEWEYLDPAQRSLYKDVMVENYGNLVSLDVLNRDKHEEPIVKQEIEEIEEDVEPQGVIVTRIKSEIEQDPMGQETFELVGR

SEQ ID NO: 11355 - protein, 81 aa, Dipodomys ordii
QQELVAFEDVAMDFTQEEWQYLSPSQKTLYRDVMLETCSNFVFVEQQLTKPDRILKLEVEELSPADGKIWNFPEAYQVDDE

SEQ ID NO: 11356 - protein, 81 aa, Octodon degus
ALALVSFEDVAVTFTGEEWRYLDLAQRTLYKEVMLETCELLVSLAGHPVPKAELMYLLECGQGPWMMKRGLLQRTCTGRKA

SEQ ID NO: 11357 - protein, 81 aa, Octodon degus
MGLVSFEDVSVNFTWEEWKDLSDAQRNLYREVMLETYSNLVALGHCSTKPDVIFKLEQGSEPCLVEEASSQSLPDVQKVNG

SEQ ID NO: 11358 - protein, 81 aa, Octodon degus
AVTFEDVTVDFTREEWALLDVSQRSLYREVMLENCRNLASLDLETVLKTKWLTPKKGVFRQEQVKSVKTEKSRRGVKINEC

SEQ ID NO: 11359 - protein, 81 aa, Octodon degus
MEPVSLEDVAVTFTLEEWALLNSSQKKLYRDVMWETFMNLTDIGRTWDNQQAEEYKTCLRNLSLDAYHGMHGNRACGVNST

SEQ ID NO: 11360 - protein, 81 aa, Octodon degus
PTAPVAFSDLTICFSQEEWGWLSPTQKLLYEEVMLENYQNLVSVGLCTRKPHIITLLEKGKDPWIAEPLRKRGGPDPASRY

SEQ ID NO: 11361 - protein, 81 aa, Rattus norvegicus
AGYQVSKPEVIFKLEQGEEPWISERELQRPFCPDWKTRPDIKSWSSQQGVSEVSHSANVWSHATFGDIWGVNTQRHQESWR

SEQ ID NO: 11362 - protein, 81 aa, Rattus norvegicus
KLGAVSFADVAVYFSPEEWGCLRPAQRALYREVMRETYSLLGSLGVRGAKPALICWVEEETELWGPRAQDPELAMCKTEVH

SEQ ID NO: 11363 - protein, 81 aa, Mus musculus
YREVMLENYNHLVSLGYQVSKPEVISNWSKEKSHGYARKKSKDLSVQTGRPGLSPHGVLSRAYLKYSSEQMLSHTTIGDTW

SEQ ID NO: 11364 - protein, 81 aa, Dipodomys ordii
MPVTFEDVALYLSREEWGRLDHAQQSVYKDMLQKRNGLAWAFPLGRPFWAPQVPGKGEASCSGGPPGAGKERRGPASGELL

SEQ ID NO: 11365 - protein, 81 aa, Dipodomys ordii
MLETYSLLLSLGHCVPKPKLIAKLEQGAEPWIREASDKNLTDVQEMEYRIKTCQESPYEYLSEVAVMNSNTGEEKVRLLTT

SEQ ID NO: 11366 - protein, 81 aa, Dipodomys ordii
SLRLVSFEDVAVDFSWEEWQDLDNAQRTLYRDVMLETYSSLVSLAGHCVPKPEAIIKLEQGAEPWVGEPSGQSFADVQQVD

SEQ ID NO: 11367 - protein, 81 aa, Dipodomys ordii
RPRALKFADVAVYFSPEEWGCLRPTQRALYRDVMRETYGLLGALGCAGPKPSLISWLERNTENWEPAALDPQEYRKGVTVQ

SEQ ID NO: 11368 - protein, 81 aa, Dipodomys ordii
ALTQLTFENVAVDFTQEEWRCLTPAQRALYRDVMLDTYRNLVSVGVSPPSVSVILPLELEEEPWVAQSHVTTPGELNGWEG

SEQ ID NO: 11369 - protein, 81 aa, Dipodomys ordii
CYEDSVTFDDVAVGFTQEEWILLDRAHRELYREVMLETYQNLASLGREPIKPSLISWLEEDVWLVQSGALHDWEMQLNTKE

SEQ ID NO: 11370 - protein, 81 aa, Dipodomys ordii
SKETVKFKDVAINFTLEEWTLLNLSQKKLYRNVMVEILRNLVSIESKTSLKSLETPSQKVDEHFYPVLQAARSPQDNLSPE

SEQ ID NO: 11371 - protein, 81 aa, Dipodomys ordii
LQFSVSFEDVTVDFSKEEWQSLDHGQRRLYWDVTLENYCHLLSVGYHIAKTETVFKLGQEEEPWTPEEEAPQESCLGEAIW

SEQ ID NO: 11372 - protein, 81 aa, Octodon degus
MYFSQEEWELLDTTQKALYNDVMQENYKNVISIALFGLPKPKVISCLEQGEEPWVQGSLDFKDTPRESLTELKLRNDTENH

SEQ ID NO: 11373 - protein, 81 aa, Octodon degus
VPISFKDLAVRFSEEEWRLLEEGQREFYRDVMRENYETLVSVGRQLQHSLHLTALVQLVKEIPEFLFGETKGTDDSPESGR

SEQ ID NO: 11374 - protein, 81 aa, Octodon degus
FQEAVTFKDVAVVFTTEELGLLDPTQRELYEDVMVENFKNLVAVGHLPFKPDMVSQLEAEEKLWVMETETHGNCINQNEMT

SEQ ID NO: 11375 - protein, 81 aa, Octodon degus
MDLVTFEDVAVHFTQEEWALLDPFQKNLYRDVMEETVSNLASVGIKLDDLNIEELYQSPDENLRSHVVERLWARVEDGQCR

SEQ ID NO: 11376 - protein, 81 aa, Octodon degus
EPWAVTFADVAVYFSSEEWRCLRPAQRALYRDVMRDTYGLLSALGGGGTKPALISWVEGEAELWDPDAQDPEVVRWPAEAD

SEQ ID NO: 11377 - protein, 81 aa, Octodon degus
AVTLEDVTVNFCEEEWALLNPAQKKLYRDVMLETFGNINAIGTTLENQQMEEEYKNCLENLRNEEIAMFDREKSCNEHANI

SEQ ID NO: 11378 - protein, 81 aa, Octodon degus
ALALVSFEDVAVTFTGEEWRYLDLAQRTLYKEVMLETCELLVSLGHPVPKAELMYLLECGQGPWMMKRGLLQRTCTGRKAK

SEQ ID NO: 11379 - protein, 81 aa, Octodon degus
PKVPVTFDDVAVYFSEQEWGKLEDWQKELYKHVMRGNYETLVSLDYAISKPEVLSQIEQGKEPCTWRRAAPKIPDAPVDPS

SEQ ID NO: 11380 - protein, 81 aa, Octodon degus
SQEQVSFKDVCVDFTKEEWCLLDPTQKILYRDVILENYSNLVSVGFCIAKPEVIFKIEQGEEPWVLENGFPSHYNPEKKWK

SEQ ID NO: 11381 - protein, 81 aa, Octodon degus
AAITFEDVAVHFTTEEWALLEPSHKKFYRDVMRETFRNVAAVGRAWEHQEVKKEHKNGCRNKRNEELEKCYPVNMPTISHT

SEQ ID NO: 11382 - protein, 81 aa, Octodon degus
AVTLEDVTVTFTKEEWALLNPSQKKLYRDVMWETLRNINAVGRTWDNQQMEEKYKNCSRNRRNEEVAECCQYKTWNQQESL

SEQ ID NO: 11383 - protein, 81 aa, Fukomys damarensis
ARGPALFRDVAVVFSQEEWKRLEPAQRELYREVTLETYGNLVSLGLATSKPDVISFLEQGREPWVEERVTAGGLCPVAGSE

SEQ ID NO: 11384 - protein, 81 aa, Fukomys damarensis
VPAFSNKDSLGDEMLAAALLKAKSQKLVTFEDVAVYFIRKEWKRLEPAQRDLYRDVMLENYGNVFSLGKELLWFLSFLPCW

SEQ ID NO: 11385 - protein, 81 aa, Fukomys damarensis
VQGCVTFEDVTVYFSQEEWGLLSEAQRLLYCDVMRENFALIASLGLTSFRCHVVAQLEMGKEPWVPDRVAMTSAMARGALG

SEQ ID NO: 11386 - protein, 81 aa, Fukomys damarensis
QQGCVTFEDVTVYFSQDEWGLLSEAQRLLYCDVMLENFALIASLGLTSFRCHVVVPLEMGKEPWMPDRVAMTSAMERGALG

SEQ ID NO: 11387 - protein, 81 aa, Mus musculus
MAAVTYEDVHVNFTHEEWALLDSSQKSLYKDVMLETCRNLTAIDTFVIVDTSPVRMKTMERSNVPLHATVFFKCMKESTMK

SEQ ID NO: 11388 - protein, 81 aa, Mus musculus
MNAVTYEDLHVNFTQEEWALLDPSQKKLYKDVMVETYRNLNAIGFNWEAHNIEEYCQSSRRHRRCERSQSAEKPSEYTQCG

SEQ ID NO: 11389 - protein, 81 aa, Mus musculus
LKPGTVSFADVAVYFSPEEWRCLRPAQRTLYREVMRETYGLLASLVGGDKPALICWVEEESEVWGPGAQEPEVAMCRTEVH

SEQ ID NO: 11390 - protein, 81 aa, Mus musculus
YKEVMLENYSHLVFLGLALSKPYLVTCLEKIQETSGVKRGAAPFMLPGGKCYTCTECGKIFEWKKVFQNHQMLDLRMNPYK

SEQ ID NO: 11391 - protein, 81 aa, Dipodomys ordii
AQEAVVFSDVSIDFSQEEWECLTDGQRDLYRDVMLETYSILVSMGHSISKPHVILYLEQGKEPWLGDGELTRGQWSVLESP

SEQ ID NO: 11392 - protein, 81 aa, Dipodomys ordii
SKESVTFKDVAVDFTQEEWYHVDPAQRSLYRDVMLENYSHLVSLGYQVSKPEVIFKLEQGEEPWISEREIQRPFCPDQKTR

SEQ ID NO: 11393 - protein, 81 aa, Dipodomys ordii
SLKLVSFDDVAVDFSWEEWQYLDVAQRTLYRDVMLEIYRNIVSLGHCVPKPNLIVKLEQAVETRIREASSKNFTSVSHEAG

SEQ ID NO: 11394 - protein, 81 aa, Dipodomys ordii
VKLLSFKDVSINFSPEEREYLSPAQCTLYRDVMLENYRNLVSLAVSSQCTEPSKKHSLQKVIKGRHGKHGLSNLNLRKALD

SEQ ID NO: 11395 - protein, 81 aa, Dipodomys ordii
ALGCVTFEDVAICFSQEEWRLLDEAQRFLHLNVTLQNLALINSLGCGHEIEGEAEPRLPGGAPQVKTSKTSQSTQKTDLCG

SEQ ID NO: 11396 - protein, 81 aa, Dipodomys ordii
SNKLVSFDDVAVEFSWEEWQELDISQRTLYRDVMLETYSMLVSLGHTGPKPQLIVKLEQDEESYMREASDKNFSDVQKMKH

SEQ ID NO: 11397 - protein, 81 aa, Dipodomys ordii
SCEGSVSLRDVTIDFSREEWQHLEPAQRNLYRDVMQETYSHLLSVGYQVPEPEVFMVDQRKEPWALQGESPHQNCPELQQS

SEQ ID NO: 11398 - protein, 81 aa, Dipodomys ordii
PRSLMTFEDVAVYFSWEEWLLLDATQKALYRHVMLENFALVTSLGLSASRPRVVVLIQRGEEPWVLSEMDTGLAGSTDERH

SEQ ID NO: 11399 - protein, 81 aa, Dipodomys ordii
MLETYSNLMSLGHCVPKPELIVKLEQGAEPWIREASDKNFTDVPEMEDVISTCQESHHKYLSEVAVMNSNPGEEKVRLIRN

SEQ ID NO: 11400 - protein, 81 aa, Octodon degus
VLTFEDVAVNFTKEEWTLLNPLQKKLYRDVMEETFMNMAAIGRAWDNQEFEEQYKKYWRNLRNEQIAKCCEYKALSQYEKI

SEQ ID NO: 11401 - protein, 81 aa, Octodon degus
MDSVVIEDVVVRFTQEEWALLDSAQRDLYRDVMLETFWNLASIDDEYQFKASDSVSEQNICGGNISKKLEMAKFMKNDSWA

SEQ ID NO: 11402 - protein, 81 aa, Octodon degus
SKDLVTFGDVSINFTEEEWEWLNPVQRNLYRKVMLENYRSLVSLGISVSKPDVISLLEQGKEPWVMETEGAGDIRPDRESV

SEQ ID NO: 11403 - protein, 81 aa, Octodon degus
GGCPGPEPAKRPAGLQPAARALRPEQRTLYQEVMLENCGLLVSLGCPVPTPELMQRLEQGQQPWPVRLGDSGKTKTAEPAT

SEQ ID NO: 11404 - protein, 81 aa, Octodon degus
TQDLLTFRDVAVEFSQEEWECLDPAQRTLYREVMLENYRTLVSLGGEPWSVDGQVKVSRNRNEWKCVTSVNTDSSPKCMIK

SEQ ID NO: 11405 - protein, 81 aa, Fukomys damarensis
NLTTPHIKFPLGVILFGGSVSGDWVRQQQSVTFLRTTENVQTAGYDVTKPNVIIKLEQGEEPWTIDGDFSQTCPEVWKIDD

SEQ ID NO: 11406 - protein, 81 aa, Fukomys damarensis
GWVPALFDEVAIYFSDEEWEVLTEQQKALYREVMRMNYETVLSLEFPFPKPDMISRLEREEESQNSDEWQLQRATFAENED

SEQ ID NO: 11407 - protein, 81 aa, Fukomys damarensis
IEDVADVAVSFILEEWGHLDQSQKSLYRDDRKEIYGSITSLDYEPKDNNRELVAKQISNEASSPNSHWVAVGSTERNIPRS

SEQ ID NO: 11408 - protein, 81 aa, Rattus norvegicus
AQGGVAFHDVAIYFLREEWRLLDDSQRRLYHHVMMEVFVLMSSSGLVPSGTDITQLESSGDRFIPALRFLTPRVEPAKIPC

SEQ ID NO: 11409 - protein, 81 aa, Heterocephalus glaber
QELVTFGDVAIDFSQQEWEYLDLRQRDLYRDVMLENYRNLESLGHSISKPDVIDLLEQGKEPWTGENKRSQHELWKELQLC

SEQ ID NO: 11410 - protein, 81 aa, Heterocephalus glaber
LVTFRDVALNFSQEEWEWLDPSQKDLYREVMLENYKNLVWLDWESWCEMKELSSKWFTDEEEISQGMALERIKSHGLQCSN

SEQ ID NO: 11411 - protein, 81 aa, Mus musculus
VSFEDLVVHFTQDEWDLLAPSQKTLYGDVMLETFRNFTDTGCEWEDQKIEDHFEEPEINLRNIVTHSEYTQYEHEEYEEKP

SEQ ID NO: 11412 - protein, 81 aa, Mus musculus
LEELVSFEDVTVQFTQEEWALLDPLQRTLYRNVTLENWKNLASLGQHLDKPNLISQLEEEDKVIREDRGIIPGIHPDLEKV

SEQ ID NO: 11413 - protein, 81 aa, Mus musculus
SQVSLTFEDVAVLFTRDEWKKLVPSQRSLYREVMLENYSNLASLAGFPFTKPKVISLLQQGEDPWKVEEEGPGGFSLGLKC

SEQ ID NO: 11414 - protein, 81 aa, Octodon degus
EKELLTFSDVAIDFSPEEWECLDSVQQNMYKDVMLETYGNLISLGFSGSPPSLISFLEQIQEPYSVKRQEPLAVCPAVSSH

SEQ ID NO: 11415 - protein, 81 aa, Octodon degus
FMVPVTLEDVAVNFTMEEWECLDASQRALHRDVMSETLRNLLSVAKILMLKPGLIANPKQEERQRREDLHSPRGEALPSGS

SEQ ID NO: 11416 - protein, 81 aa, Octodon degus
MLENYGNVASLGFPFLKPAVISQLEQGGELEHPLPLATGSGIGPQVGTNMQTNSNLTKEVCEEKDSTSFELPRAFPLEINF

SEQ ID NO: 11417 - protein, 81 aa, Octodon degus
MTKPDMILKLEQGEEPWTSFADHACLKENWKAEDFLMKFKEHQDKYSRSVVCINHNKLIKQKSSICEKTLAIVKKPINQKN

SEQ ID NO: 11418 - protein, 81 aa, Octodon degus
YQEAVSFEDVAVDFTLDEWTSLDPPQRKLYSDVMLENFQNLAAVGCELLKPSLISWLEQEELRTGEGSTLKEWKVELKTKG

SEQ ID NO: 11419 - protein, 81 aa, Octodon degus
CVDFEDVAVYFSQEEWGHLSEAQRILYCDVMLENLALLSSLGCWHGAKGEEAVPEQGISAGGSQVTAAKPESPTEKTKPRE

SEQ ID NO: 11420 - protein, 81 aa, Octodon degus
MELLTFRDVAIDFSSEEWECLDPAEQKLYTEVMLENYSNLVFLGLNVSKPKLIAFLEQKKDDCILKSKGTAAIHPGMTSSP

SEQ ID NO: 11421 - protein, 81 aa, Fukomys damarensis
GGAVWRSEVVSAWHVSVVSEGKIWELLGSKPESLFRDQCWYQAPKPDMICKLEKGEEAWSGKRKRSSQNHLSKLARSKQTG

SEQ ID NO: 11422 - protein, 81 aa, Fukomys damarensis
YQDSVTFEDVALDFTQEEWVLLDQSHRDLYREVMLENYENLASMGCELVKPSLISWLENKKDWRTGQRGDPREWEMQLSTK

SEQ ID NO: 11423 - protein, 81 aa, Fukomys damarensis
MEEWALLYPSQKKLYRDVMGETFRNIAAIGRMWNNQEVEEDYRNYWRNLRNEEVEKCYQYKAWNQYEETFLCTPVANVHGK

SEQ ID NO: 11424 - protein, 81 aa, Rattus norvegicus
SQCLLTFRDVAVDFPQEEWECLDSTQRALYIDVMLENYRNLVSVENYCICDATYQHVKTDKESHHFNEFGEMLPEPSHSAL

SEQ ID NO: 11425 - protein, 81 aa, Rattus norvegicus
QEMLSFRDVAIDFSAEEWECLDLAQWNLYRDVMLENYSNLVFLGLASCKPYLVTFLEQRQEPSVVKRPPAATMHPGGKPYK

SEQ ID NO: 11426 - protein, 81 aa, Rattus norvegicus
MLDNYRNLASLGLCASKPDMIALLEQGTDPWMMGRGRCTDLKAVQETKELPPKDLSEETSQAVLRRRLLHRRPMCYMSGAS

SEQ ID NO: 11427 - protein, 81 aa, Rattus norvegicus
LQVPVSFEDVAVDFSRGEWQQLNSFQRCLYQDVMLENYSHLLSVGLKVPKPEVILKLEQGEEPWTLQEVAPYQNFSGGKFR

SEQ ID NO: 11428 - protein, 81 aa, Mus musculus
PQGQLTFKDVAVDFSQEEWQCLDCAQQALYMDVMLENYNNLFFVENHCMCPKFEKMLDQDLQHIVLEHVNTQVKSYECHEL

SEQ ID NO: 11429 - protein, 81 aa, Dipodomys ordii
EEWTLLDPSQKNLYREVMLDALWSLACEAVTFDDVFVNFTLEEWALLDAAQQQLYRDVMVETFRNLASIRRTTIICTSKMF

SEQ ID NO: 11430 - protein, 81 aa, Octodon degus
MPLTFQDVAVYFSRAERRQLGPRQRALYRDVMLENYGNVASLGFPIPKPELISQLEQGEELWVVDLLGAEEPEVLRTCRTD

SEQ ID NO: 11431 - protein, 81 aa, Octodon degus
VEKGLLTLEDVAVRVTQEEWQLLGPAQRSMYQNVMLENYCSLVSVGYQASKLDALSKLLHGEPWRAEDELHCQALSDIRKA

SEQ ID NO: 11432 - protein, 81 aa, Octodon degus
SHDLVMFRDVTVDFSAEEWECLNFYQRNLYRDALLENYSKLVSLECSITKPDVITLLEQGKEPWMLVADEKRWSLGLESAY

SEQ ID NO: 11433 - protein, 81 aa, Octodon degus
SQGLVTFGDVVVDFSRDEWQWLNSMQRSLYRKVMLENYRNLASLGLCASKPDMISFLEQGQDPWMARKRRTGGRRPDSGAV

SEQ ID NO: 11434 - protein, 81 aa, Octodon degus
QEISVSFKDVVVGFTQEEWHRLNPAQRALYRDVMLETYSNLVSVGYEGTKPDVILRLEQEEAPWICEASCPGCYCREDIWQ

SEQ ID NO: 11435 - protein, 81 aa, Octodon degus
MALLTFRDVVIDFSLEKWKCLDLAQRTLYRDVTLQNYRNIFSLGLAVFKPHLVTCLEQNRDPWNVQPRNKAAAPPVHISEK

SEQ ID NO: 11436 - protein, 81 aa, Rattus norvegicus
MSGLKEEWGYLDAAPRSLYKDVVMDSYGKLVSLDVLNRNEDEEPTVKEEIEKDIEPQGIIVTRIKSELDQDPMGSETFELV

SEQ ID NO: 11437 - protein, 81 aa, Phytophthora kernoviae
EQEQVVKEVMEYYTQQEQQIQETKQRLLAMNITLPVQVTVRPVPDAWQNEDQQLPGLLEGDEDQWSLQRREGHSTGPFADA

SEQ ID NO: 11438 - protein, 81 aa, Cervus elaphus
LQDTVTFKDVAIDFTQEEWQQLDPAQRNLYRNVMLENYNNLITVGCPFTKPDVIFKLEQEEEPWVMEEEVLKKHCPGEIWG

SEQ ID NO: 11439 - protein, 81 aa, Cervus elaphus
PEGRVTFEDVAVYFSWEEWGLLDEAQRLLYHRVMLETFSLMASLGLTSFRTHDMTQLEQWEEPCVPAEGVSTTATPAGCWC

SEQ ID NO: 11440 - protein, 81 aa, Cervus elaphus
RSLTFRDVAIDFSQEEWGFLDPAQRELYTAVMSETYQNLVWLGISVADPNIAFLLERGPQPWVMREEDAEAPGAGESGTKL

SEQ ID NO: 11441 - protein, 81 aa, Cervus elaphus
FQVPVTYEDVAVTFTQEEWGHLGPVQRTLYWEVMLETCRLLVSLGCPLPEPELISPAEPGPESQTSKRGPTPGSCSCDNKN

SEQ ID NO: 11442 - protein, 81 aa, Colobus angolensis
KKKLISFQDLTVNFTQEEWQQLDPAQRLLYRDVMLENYSNLVSVGYHVSKPDVIFKLEQGEEPWIVEEFSNQNYPEVDDAL

SEQ ID NO: 11443 - protein, 81 aa, Colobus angolensis
AAVSVTFKHVTMTFTQKEWKQLDPAQRNVYHDVMLENYSNQASMGYQAPKPDMISKLEKGEAPWLGKGKRPSQGCPSKIAR

SEQ ID NO: 11444 - protein, 81 aa, Colobus angolensis
MDSVAFEDVAVSFTQEEWALLDPSQKNLYRDVMQETFRNLTSVGKTWKVQNMEDKYKNPRRNLRWSFALVAQAGMQWCDLG

SEQ ID NO: 11445 - protein, 81 aa, Colobus angolensis
AQVSVTFEDVAVTFTQEEWGQLDAAQKTLYQEVMLETCGLLVSLGCPLFEPELIYQLDRREELWIVKKDVSQSSCPGDNTK

SEQ ID NO: 11446 - protein, 81 aa, Colobus angolensis
ALALVSFEDVVVTFTGEEWGHLDLAQRTLYQEVMLETCRLLVSLGHPVPKPELIYLLEHGQDLWTVKRGLSQSTCAGEKAK

SEQ ID NO: 11447 - protein, 81 aa, Colobus angolensis
SEELLTFRDVAIEFSPEEWKCLDPAQQNLYRDVMLENYRNLVSLGVAISNPDLVTCLEQRKEPYNVKIRKIVARPPAVCSH

SEQ ID NO: 11448 - protein, 81 aa, Colobus angolensis
QLLFRDVAIEFSQEEWKCLNPGQKALYRDVMLENYRNLVSLDFSLLARDPRVFRVKAWRTSGGAQEPTSPNFGGNESPLPS

SEQ ID NO: 11449 - protein, 81 aa, Colobus angolensis
LQGSVSFKDVTVDFTQEEWQQLDPAQKALYRDVMLENYCHFVSVGFHMTKPDMIRKLEQGEELWTQRIFPSYSYLEEDGKT

SEQ ID NO: 11450 - protein, 81 aa, Colobus angolensis
SQGSVTFRDVAIDFSQEEWKWLQPAQRDLYRRVMLENYGHLVSLGLSISKPDVVSLLEQGKEPWLGKRNVKRDLFSASESS

SEQ ID NO: 11451 - protein, 81 aa, Mustela putorius
EGIVTFEDIAVSFSWEEWDLLDEAQRHLYQDVMLENLALITSLGCWHGAEDEEARSEQSISVERESQVRTPKTGLFPQKAN

SEQ ID NO: 11452 - protein, 81 aa, Mustela putorius
GQGSVSFRDVTVDFTRDEWSQLTGTQRTLYRDVMLENYSHLVSVGCHLAKPEVIFRLEQGEELWPSDAGIPDQGDQDRNQE

SEQ ID NO: 11453 - protein, 81 aa, Mustela putorius
PQKSVTFEDVAVYFTQTEWDGLSPAQRALYRDVMLENYGNVASLGFSLLKPAVISQLEGAGELGRPSPLVAGTEIGLQGLW

SEQ ID NO: 11454 - protein, 81 aa, Mustela putorius
AQELVTFKDIAIDFTQEEWALLDTSQRKLYRDVMLENISHLVSVGYHLCKSDVISQLEQGVELWREGRGFLQGLNPDRKSG

SEQ ID NO: 11455 - protein, 81 aa, Mustela putorius
LQEQVSFKDVCVDFTQEEWYLLDPAQKILYRDVILENYSHFVSVGYCITKPEVVFKIEQGEEPWILEAGFPSHCHQEDWKV

SEQ ID NO: 11456 - protein, 81 aa, Mustela putorius
KSLGSVSFKDVTVDFSKEEWQQLNLAQKSLYRDVMLENYFNLISVGCQVPKQEVIFSLEQEEPRMLDGETSSHSALGGDIG

SEQ ID NO: 11457 - protein, 81 aa, Mustela putorius
QEPVTFADVAVLFTPEEWMFLDSAQRSLYRDVMLENYRNLASVGAGDQLGKPSTLSLSEPGEDLWAPERRTFPGTHPEPQH

SEQ ID NO: 11458 - protein, 81 aa, Tupaia chinensis
NTVTFEDVAVEFTKEEWVLLDSSQRKLYRKVMLETYDNVASLGHKLSKPILIIQLEQECTLNTAERIRRHPHSAFRKKESL

SEQ ID NO: 11459 - protein, 81 aa, Tupaia chinensis
MPLTFQDVAVYFSEAEGQQLGPQQRALYRDVMLENYGNMASLGFPVPKPELISQLEQGEELWVLDLMGEEKPEVARLCQTA

SEQ ID NO: 11460 - protein, 81 aa, Tupaia chinensis
QKFQRSVSFKDVTVGFTQDEWQQLDPSQRSLYRDVKLENYSHLVSVGFCVTKPEVIFRLEQGEEPWILEKEFPSQNFPGNN

SEQ ID NO: 11461 - protein, 81 aa, Carlito syrichta
EVGLLSFKDVAIEFSPEEWACLNSPQRTLYRTVMLENHRNLVFLGLAVSKPDLITCLEQRKEPWDMKRHGTLAKIPAVTSH

SEQ ID NO: 11462 - protein, 81 aa, Gulo gulo
DLVVLEDVAVDFTLEEWALLDSVQKNLYRDVMLETLQNLVSVDYETLFKASGLVSQQDTLEKKKSIEQKMAKFTGNHSCAY

SEQ ID NO: 11463 - protein, 81 aa, Tupaia chinensis
MLENISHLVSVGYQFCKSDVIFHLAKDEMEWTVEGRGFSQGQSPASFAFTMTPEATFTLRLGPVHSNFVSINFTIFHGLLG

SEQ ID NO: 11464 - protein, 81 aa, Odobenus rosmarus
STEPVIFRDVAMYFTQKEWQLLEPAQKDLYREVMLENYGNLASLGYRLFKPKLITRLEQGDEPCVKERDVPRAPQQGGAGV

SEQ ID NO: 11465 - protein, 81 aa, Odobenus rosmarus
GTVTFEDIAVSFSWEEWDLLDEAQRHLYQDVMLENLALITSLGKQQQKQHVSDKPFGNNVSRASVVKSCRLQVSGKPFICG

SEQ ID NO: 11466 - protein, 81 aa, Odobenus rosmarus
WEAWLEKPVTFDDVAVNFTQEEWVCLDASQRVLYQDVMSETFRNLMSVDLIIELEQEDKQWRAELQLHPPNGEGLPSGGRK

SEQ ID NO: 11467 - protein, 81 aa, Odobenus rosmarus
CEGSVSFEDVTMDFSREEWQQLDPAQRCLYWDVMLEIYSHLLSVGYHIPNPEIISRREKGKKSWVRGAQLPHQRHRVVFGL

SEQ ID NO: 11468 - protein, 81 aa, Delphinapterus leucas
MDSVVFEDVAVNFTVEEWALLDLAQRKLYRDVMLETFRNLASVGSCPQVKTSGSSPQWDILENELCSEKKIVRCTRNDSCS

SEQ ID NO: 11469 - protein, 81 aa, Delphinapterus leucas
PLQGSVSFRDVAVDFSREEWQQLDLDQKNLYRDVMLETYSHLLSVGYQVPETEVFMLEQGKEPWALQGESPHQSCPEGLWQ

SEQ ID NO: 11470 - protein, 81 aa, Delphinapterus leucas
FQGSVSFKDVTVDFSREEWQQLDLAQKSLYRDVMLENYFNLISVGCQVPKPEVIFNLERGEQPCMLDGEISSQSYLDQGIG

SEQ ID NO: 11471 - protein, 81 aa, Delphinapterus leucas
MAQESVMFSDVSIDFSQEEWEYLNDDQRDLYREVMLENYSNLVSMDVISFLEQGKEPWLVDRELTRDQWPVLESRCETKKL

SEQ ID NO: 11472 - protein, 81 aa, Delphinapterus leucas
GQLTLSDVAIEFSPEEWECLDLAQRALYRDVMLETYRNLISVDISHIHVVRKLQLKSNIDRGGVFQTVILGRHEIQEPFYL

SEQ ID NO: 11473 - protein, 81 aa, Delphinapterus leucas
SQGPVSFEDVSMGFTQEEWQHLDPAQRTLYRDVMLGNYSHLISVGYCVIKPEAIFKLQQGEEPWMLEEESQSQSHPDFCVV

SEQ ID NO: 11474 - protein, 81 aa, Delphinapterus leucas
SLGSDLFRDVAVVFSQEEWEQLVPAQRDLYRDVMLEIYSNLVSLGFAISKPDVISFLEQGREPWMVEKVATGGQCPVLESR

SEQ ID NO: 11475 - protein, 81 aa, Delphinapterus leucas
TPEPLSFADVAVYFSPEEWGCLRPAQRALYRDVMRETYGHLGALGFRGTKPALISWVEEEAELWGPDARDPETGECLREAD

SEQ ID NO: 11476 - protein, 81 aa, Carlito syrichta
FQEVVTFGDVAVHFSREEWQCLDPGQRALYREVMLENHSSVAGLAGFLVFKPELISRLEQGQEPWFLDLQGAERTETPRTS

SEQ ID NO: 11477 - protein, 81 aa, Carlito syrichta
CVTFKDVSIYFSQEEWELLDESQRHLYLEVMLENSALITSLAYWHGMEDEEISSTQSVSVGKTSQVRTPRACLSPQKTHPC

SEQ ID NO: 11478 - protein, 81 aa, Delphinapterus leucas
AQGLMAFEDVAVYFSREEWGLLDAAQRALYRRVMLENFTLLASLGLSVSRPHVVIQLECGKEPWVLNGTDVTLARNAQRRP

SEQ ID NO: 11479 - protein, 81 aa, Carlito syrichta
MSQVTFSDVAIDFSHEEWTWLDSAQRNLYKDVMVQNYKNLVSLGLSVTKPYVITLLEDGKEPWMVEKKLSKGMFPDWESRW

SEQ ID NO: 11480 - protein, 81 aa, Carlito syrichta
SQGLLTFRDVAIEFSPEEWECLDPIQRILYRNVMLENHRNLVSLGLAVSKPDLIMCLEQRKEPWNVNRHNMLEKPTAMTSH

SEQ ID NO: 11481 - protein, 81 aa, Delphinapterus leucas
SHTLVTFKDILVNFTREEWKLLDPAQQLMYKDVMLENYRNLVSLGHQLPKPEVILQLEKGEEPWLLERGIHQETYPDLETA

SEQ ID NO: 11482 - protein, 81 aa, Delphinapterus leucas
QSQETLTFDDVTVDFTWEEWQLLTPPQKDLYQEVMLENYSNLLSVGYQARKPDVLSNLDHGEPWMIEDEIHCRTHSGYQAS

SEQ ID NO: 11483 - protein, 81 aa, Delphinapterus leucas
APFPVAFDDVALYFLEREWEILEKWQKDMYQQEMKNNYESLDSLGCISSKPDLITWMEQGRMLLIRDQGHLEKTQMTLSLS

SEQ ID NO: 11484 - protein, 81 aa, Carlito syrichta
SQKSLTLEDVVVEFTWEEWQLLDPAQKDLYQDVMLENYRNLVSLGYQASKPDTLSKLEQGEPPWTIEDKIHCEGPSEIWKV

SEQ ID NO: 11485 - protein, 81 aa, Delphinapterus leucas
MLEIYGNLTSLGYPVPKPALVSLLERGDLPWGLETQDDPPAQGTKHICKNAGTNTDNELTPTWGVSEERDMMMSHGPQKNV

SEQ ID NO: 11486 - protein, 81 aa, Erinaceus europaeus
SLGTVSFDDVKVTFSWEEWQLLSDAQRNLYQTVMLETYSSLTALGRGVSKPEVIVKLEQGAEPWTVAEPPPRSLSAFRIFH

SEQ ID NO: 11487 - protein, 81 aa, Mustela putorius
MLENYSNLVSLGYCVTKPEVIFRLERGEEPWILEEEFPSQSFPEIWKTDHKKERNHKNQPKHVWEVAFINNKTLTKEQGNV

SEQ ID NO: 11488 - protein, 81 aa, Mustela putorius
APLPLTFDDVAIYFSEQEWQNLQARQKELYKHVMRTNYEILVSLDNGLPKPELISWIEQEKEFFQNWREAQKSGTIICSSA

SEQ ID NO: 11489 - protein, 81 aa, Mustela putorius
YQDVMLENFRNLVSVGHQPFKRDKWLTEREERRPWLTKTAPQIERNVGGNSQSALRTVRGREPHEELSCWQIWQHITDDLS

SEQ ID NO: 11490 - protein, 81 aa, Mustela putorius
DSVTFEDIAVYFSWEEWRLLDEAQRCVYHDVMLENFTLVSSLGCCCGAENEEAPFAQSASVGVSQTWMPRAALSSRKTHPC

SEQ ID NO: 11491 - protein, 81 aa, Tupaia chinensis
GPLTFKDVAVEFSQEEWKRLDPAQRALYRDVMLENYRNLVSVDKSPKSVISELPLRENSNTGQIFQTVMLERPKSHDMEDF

SEQ ID NO: 11492 - protein, 81 aa, Vicugna pacos
PQKSVTFEDVAVYFTQTEWDGLSPAQRALYRDVMLENYGNVASLGFPLLKPAVISQLEGGVDIDIQTDNNLTEEMYEEKHN

SEQ ID NO: 11493 - protein, 81 aa, Vicugna pacos
DPVAFEDVAVNFTLEEWALLDPSQKKLYRDVMRETFRNLASLGETWKDHIIEDQYRQQGRKLRSCKVGRICEEKEDSPCEE

SEQ ID NO: 11494 - protein, 81 aa, Vicugna pacos
WSQMPVTFEDVALYLSREEWGQLDHTQQSFYRDVLQKRNGLSFGFPFSRPFWASQVQGKGEASSSSRQTGDEERRGAMEVG

SEQ ID NO: 11495 - protein, 81 aa, Vicugna pacos
RESGKAPVTFDDITVYLLQEEWMLLSQQRKELCGSDKLEAPLGPTIANPELFYKFERGPEPWLASVQGQRTLLSHHPGKSK

SEQ ID NO: 11496 - protein, 81 aa, Vicugna pacos
LRGLFTLKDVAIEFSQEEWECLVPAQRALYRDVMLETCRNLLSLGEENFPPEVGSHSAGLAIKELLPKEDIHKGELYHLVI

SEQ ID NO: 11497 - protein, 81 aa, Vicugna pacos
MWRFLAGDISHDLSFFLSCTLTVLHSLPAPAENDHVPGYCIPKPEVILKLEQGEEPWILEEESSSQSVPELINSSENYSRN

SEQ ID NO: 11498 - protein, 81 aa, Vicugna pacos
LGTVTFEEVAVYFSQEEWRLLDETQRLLYRDVMLENFVLVASLGCWRRAEDKETTCVQEVSGKGPQVNTSKADLSTQKAYP

SEQ ID NO: 11499 - protein, 81 aa, Vicugna pacos
MASRSPPPEPKEWDYLEPAQRSLYKDVMMENYGNLVSLDVLNRDKEEEPTVKQEIEEIEEEVEPQGVIVTRIKSEIDQDPM

SEQ ID NO: 11500 - protein, 81 aa, Vicugna pacos
SQGSLSFRDVTVGFTWEEWQQLDPAQRALYRDVMLETYSHLLSVGYCIPKPEVILKLEQGEEPWILEEESSSQSVPELINS

SEQ ID NO: 11501 - protein, 81 aa, Odobenus rosmarus
WSQMPVTFEDVALYLSREEWGRLDHVQQSFYRDVLQKRNGLSLGFPFSRPFWASQGQGKGEASSSCRQMGDEEEKPGATEM

SEQ ID NO: 11502 - protein, 81 aa, Odobenus rosmarus
PQDLMTFEDVAVEFTQWEWGKLDPAQKDLYRAVMLENFKNLASLGLPVSKPYVISQLEEGKEPYVLEGEISTDWEKRPKAK

SEQ ID NO: 11503 - protein, 81 aa, Odobenus rosmarus
FQVPLTFSDVAIDFSQEEWECLNSSQRDLYRDVMLENYTNLVSLDFDFTTETNKLSSEKSSYEVNSYHRETLKRSKTFNLM

SEQ ID NO: 11504 - protein, 81 aa, Odobenus rosmarus
AHRSVTFRDVAIDFSQQEWEYLDSLQKNLYRDVMMENYDNLVSLGHSISKPDVITLLEQGKDPWMVVREDTRRWCTDLESR

SEQ ID NO: 11505 - protein, 81 aa, Odobenus rosmarus
SHGPLSFEDVAIAFTKEEWQQLDPAQRTLYRDVMLENFSHLVSLGHPVSKPDIISRLEQGEEPWIIKRDISDWICPERETR

SEQ ID NO: 11506 - protein, 81 aa, Delphinapterus leucas
LELVTFKDVAVNFTQEEWQQLEPAQRGLYKDVMLENFQNLSSLAGPGRSGRWLPLGLCIRRGRDSFRKGPFRASARRPPAR

SEQ ID NO: 11507 - protein, 81 aa, Gulo gulo
MLENYANVASLAFPFPKPDLISQLESGEAPWGPDPWEAELLRGICPGGESWIKEEEPAVKQEASEQAELPRTPGGGLLRNV

SEQ ID NO: 11508 - protein, 81 aa, Erinaceus europaeus
AVISLEFRDVAIDFSPEEWEYLGPSQKALYRDVMLENYSNLVSLGCSIPKPEVITLLEQEKEPWMIKREGTRSVCTDLESN

SEQ ID NO: 11509 - protein, 81 aa, Erinaceus europaeus
CKELVTFKDVAVDFTREEWGQLDSPQRALYCDVMLENYQNLLALGPLVCKPDVISHLERGEEPWHIPRGVPGGPHTEWGPR

SEQ ID NO: 11510 - protein, 81 aa, Erinaceus europaeus
QESVTFQDVSVDFSREEWGLLDPTQRTKYHDVMLETLGNLVSVGWETTLESKQLTPESSTSKEVPGLGTEVLREESSNSGN

SEQ ID NO: 11511 - protein, 81 aa, Erinaceus europaeus
GVAFEDVAVFFSLDEWELLGEAQRLLYHTVMLENLGLLLSLGCGHGAEDEGPSERSISVLQLGVSRGGPPQTHLPSRKALP

SEQ ID NO: 11512 - protein, 81 aa, Erinaceus europaeus
AQGPLSFEDVAVDFSREEWQLLTPSQKALYRDTMLETHSNLVSVGGGAAEPGSLLCLEQGEPLWTLEGAAQSQSCAVLSSG

SEQ ID NO: 11513 - protein, 81 aa, Erinaceus europaeus
PWDMVSFEDVAVMFTWEEWQELEEDQRSLYRDVMLETYSILASVGLCITKPEVIISLECGAEPWSIRKPLIHSLSGEKLFE

SEQ ID NO: 11514 - protein, 81 aa, Tupaia chinensis
MLETYSSLVSLGHCITKPEVIFKLEQGAEPWTLEELPNQSLPDVQIVKDLERCQENQDRYLWQVLITNSNPSSQERVETKK

SEQ ID NO: 11515 - protein, 81 aa, Tupaia chinensis
GSIAFEDVTMAFSQKEWKQLDPAQRNLYKDVMLENCNNLASVEKHKTLSRISSSKHDKSQASVKPYECNQCGKVLSHKQGL

SEQ ID NO: 11516 - protein, 81 aa, Vicugna pacos
MGMAGLFSEGFIQRCHVGKLQELGLSISKPNMISLLEQGKEPWLVEREMSDGQYADWESWYEIKALSPKWYIDEEEISQGM

SEQ ID NO: 11517 - protein, 81 aa, Vicugna pacos
AQESLTYDDVAMKFTWEEWQLLAPDQKVLYRDVMLENYSHLVSVGYQASKPDTLSRLERGEELWTIEAEIHRRVHAGRWVR

SEQ ID NO: 11518 - protein, 81 aa, Vicugna pacos
PQAKVTFEDVAVLLSQEEWDRLGPAQRGLYRHVMMETYGNVVSLGLPGSKPRVISQLERGEEPWVLDRQGAEEHRGLGSEH

SEQ ID NO: 11519 - protein, 81 aa, Vicugna pacos
SQEPVTFEDVAVYFTQDQWVSLAPAQRALYREVMLENYANVVSLAAFPFPKPDLVFQLERGGAPWGLDAWTAIGAKALRGI

SEQ ID NO: 11520 - protein, 81 aa, Vicugna pacos
MDPVAFEDVAVNFTLEEWALLDPSQKKLYRDVMRETLRNLASVGGKWEDHNTEDKYKDQGRNLRSHTFERDCESNEGSQDG

SEQ ID NO: 11521 - protein, 81 aa, Vicugna pacos
PQESVTFKDVAVNFTQEEWHHVDPAQRRLYKDVMLENYSHLVSLGYQVSKPEVIFKLEQGEEPWIAEGEIQRPFYPAAFNC

SEQ ID NO: 11522 - protein, 81 aa, Vicugna pacos
AQGSVMFSDVSIDFSQEEWECLNDDQRDLYRDVMLENYSNLVSMGHCISKPDVISFLEQGKEPWLVDREPTRYQWPVLESR

SEQ ID NO: 11523 - protein, 81 aa, Vicugna pacos
FKEALTFKDVAVVFTEEELRLLDSTQRELYQDVMLENFRNLVSVGHLPFKPDMVSQLEAEEELWMTERETQRNGCSGENRA

SEQ ID NO: 11524 - protein, 81 aa, Vicugna pacos
PQGSVSFKDVTVDFTQEEWQQLDSAQKALYRDVMLENYCHFVSVGFHMTKPDMIHKLEQGKELWTTGRIFPSRSYPEDDGK

SEQ ID NO: 11525 - protein, 81 aa, Vicugna pacos
GQGPVTFEDVAVSFSQEEWGLLSDAQRLLYHDVMLDTLSLLASLGCWPGVHAEVVTSEQGVSVEQVAQARSPKPDPSTLKT

SEQ ID NO: 11526 - protein, 81 aa, Vicugna pacos
MAEDLKFKDVAIYFSQKEWEGLLSAQKDLYRDVMLESYDNLLSLGFSDSKPDVISLLEQGKDPWMVKSKESKEWCPGWESR

SEQ ID NO: 11527 - protein, 81 aa, Vicugna pacos
FWPPVSFKDVAVTFTWEEWGQLDPAQRTLYRDVTLETCSHLVSLGLLLSKPDVICRLEQGEDPWRVQRGPPRDWKITLEKK

SEQ ID NO: 11528 - protein, 81 aa, Vicugna pacos
CQGSLSFEDVTVGFTQEEWQQLDPAQRTLYRDVMLENYSHLISVGYCISKPELIFKLEQGEQPWVLEKESPSQDYPEVCRV

SEQ ID NO: 11529 - protein, 81 aa, Odobenus rosmarus
SVGPVSFRDVAVDFTQEEWQQLEPEQKTTYRDVMLENYSHLVSVGCHIIKPEVIIKLEQGEEPWIVEGAFLPQSYPEELWK

SEQ ID NO: 11530 - protein, 81 aa, Odobenus rosmarus
QESVTFKDVAVDFTLEEWGQLGPGQRELYRDVMLENYQNLLSLGVGPLGSKPDVISRLERGEEPRMEKKEVRQATCPALHT

SEQ ID NO: 11531 - protein, 81 aa, Odobenus rosmarus
MFKEAVTFKDVAVAFTEEELGLLDSAQRKLYQDVMLENFRNLVSVGHQPFKRDKWHIEREERPWLMKTASPIERNVGGSNQ

SEQ ID NO: 11532 - protein, 81 aa, Odobenus rosmarus
SKDLVTFGDVAVDFSQEEWEWLNPAQRNLYRKVMLENYRSLVSLGVSVSKPDVISLLEQGKEPWMVKKEGTRGTCPDWEYT

SEQ ID NO: 11533 - protein, 81 aa, Odobenus rosmarus
GPGGVSFADVAVYFSPEEWGCLRPAQRALYRDVMRETYGHLGALGFRGAKPALISWVEEEADLWGPAARDPEVGECLTEAD

SEQ ID NO: 11534 - protein, 81 aa, Odobenus rosmarus
SQAPVTFEDMAMYLTREEWRPLDPTQRDLYRDVMQENYGNVVSLDFEIRSENEVNPKQEISEDVEFGTASERPVENTEENP

SEQ ID NO: 11535 - protein, 81 aa, Odobenus rosmarus
VMAHMAFRDVAVDFSQEEWMLLSPAQRSLYREVMLENYSNLVSLGIPFSKPKLITQLEQGKETWREERTCPPATRPVEPKP

SEQ ID NO: 11536 - protein, 81 aa, Odobenus rosmarus
GRKGSLSFKDVAVVFTWEEWQLLDPIQKNLYQDVMLENYSNLVSLGYQITKADAFYQLEHGTPWITEEEIQSQIHPEDTWQ

SEQ ID NO: 11537 - protein, 81 aa, Odobenus rosmarus
SQGPLTFRDVAIEFSQEEWECLTHTQQELYRDVMLENYRHLLFLGLIVSKPDLIIFLEQEEQFWGVKRKETVTFHPGISSL

SEQ ID NO: 11538 - protein, 81 aa, Odobenus rosmarus
NFWILRLPPGSKGEAPKEWGKLDEWQKELYKHVMRGNYETLVSLDYAISKPEVLSQTEQGKEPCSWRRPGPKVPDVPVDPS

SEQ ID NO: 11539 - protein, 81 aa, Odobenus rosmarus
SQEPVTFEDVAVYFTQNQWASLDPMQRALYLEVMLENYANITSLAALPFPKPDLILQLEQGEAPWGLDPWTPLEREALGGV

SEQ ID NO: 11540 - protein, 81 aa, Delphinapterus leucas
FQEPVSFKDVAVVFTEGELGLLDSAQRKLYRDVMLENFRNLLSVGNQPFKPELIFQLEREEELLMMETETQRDGCSGTKSQ

SEQ ID NO: 11541 - protein, 81 aa, Delphinapterus leucas
ARMIVTYEDVAVTFTQEEWGQLDPAQRTLYQEVMLETCGLLVSLGCPLPKPELIHPLEHSPELQTWKRGLSPSSCPVRESG

SEQ ID NO: 11542 - protein, 81 aa, Delphinapterus leucas
SQPPVSFKDVAVTFTWEEWGQLDLAQRMLYREVTLETCSHLVSLGLLLSKPDVIARLEQGEDPWRVEPGPPRDWKTTLEKK

SEQ ID NO: 11543 - protein, 81 aa, Delphinapterus leucas
KHGCAISEDVFVYFSREEWVLLDEDQRLLYRDVMLENFALLAFLGIASSRSHLVTQLEQGEELWMPAQVDMTPATEKEAQK

SEQ ID NO: 11544 - protein, 81 aa, Delphinapterus leucas
SQESVSFEDVAVYFTRNQWASLDSAQRTLYREVMLENYANVTSLAAFPFPKPDLIFQLERGKAPGGLDPWTPIRREVRGVC

SEQ ID NO: 11545 - protein, 81 aa, Carlito syrichta
SQGLLTFKDVAIEFSPEEWECLDPPQRILYRNVMLENHRNLVFLGLAISKPDLIKCLEQRKEPWDVKRHSTLAKPPAVTSH

SEQ ID NO: 11546 - protein, 81 aa, Carlito syrichta
SKDLVTFGDVAVNFSQEEWEWLNPAQRNLYRRVMLENYRSLVSLGVSVSKPDVISLLEQGKEPWMVKKEGTRGACPDWEYV

SEQ ID NO: 11547 - protein, 81 aa, Carlito syrichta
PQDLVTFKDVAIDFSKEEWQWMNPAQKRLYRGMMLENYQCLESLGLCISKPYVISLLEQGKEPWEVKSEMTRSPFSDRESI

SEQ ID NO: 11548 - protein, 81 aa, Carlito syrichta
KMNMAQKGSVSFEDVTVELTREEWRLMGPRERSLYRDVMLENYGHLVAVGCCFTKPKVILKLEQGEEPWPLEVKFLNRKYP

SEQ ID NO: 11549 - protein, 81 aa, Carlito syrichta
PLESVTFEDVVIDFTQEEWALMDTSQRNLFRDVMLENIKHLVSIGYELCKSDMIFQLEQGKELWREGVLLQGQSLGRKSAL

SEQ ID NO: 11550 - protein, 81 aa, Carlito syrichta
SQGLLTFMDVAIEFSLEEWECLDPTQRMLYKNVMLENHRNLVFLGLAVSKPDLITCLEERKEPWNVKRHNTLAKPPDPGDH

SEQ ID NO: 11551 - protein, 81 aa, Carlito syrichta
AHVSLTFRDVAIDLSQEEWEYLDPTQRDLYRDVMLENYSNLVSLGCTVPKPDVITLLEQEKEPWIVLREGTTSWYTDLEYV

SEQ ID NO: 11552 - protein, 81 aa, Carlito syrichta
FQESLTLEDVAVEFTWEEWQLLDCFQKDLYRDVMLENYNHLVSLGYQDSKSDALSKLAQGQEPWIMEDKIQRRNCPGISKI

SEQ ID NO: 11553 - protein, 81 aa, Carlito syrichta
SQETVTFKDVAIDFTQEEWKQLDPAQRNLYRNVMLENYNNLITVGYPLTKPEVIFKLEQEEEPWVVEEEVLRRHCPGEIWE

SEQ ID NO: 11554 - protein, 81 aa, Carlito syrichta
SQGPVSFKDVAVDFTQEEWQQLDLNEKITYRDVMLENYSNLVSVGCDITKPNVIIRLEQGEEPWIIESEFSSQSSPEEVWE

SEQ ID NO: 11555 - protein, 81 aa, Carlito syrichta
LQESLTFKDVFVDFSREEWQQLDSAQKTLYRDVMLENYSHLVSVGYLLAKPDVIFRLGPREESWMADGGTRIRTCPGEHTP

SEQ ID NO: 11556 - protein, 81 aa, Carlito syrichta
AQGLVTFRDVAIDFSQEEWKCLEPAQRDLYRDVTLENFSNLVSLGLSISKPDVISLLEEGKEPWVIANDATRPWCPDLESR

SEQ ID NO: 11557 - protein, 81 aa, Delphinapterus leucas
SVTFEDVAVYFSQEEWRLLDEAQRFLYHDVMLETFALVASLGCWHGAKVKETPSEQNVFVEVPRINTSKTNLSTQEAYPWE

SEQ ID NO: 11558 - protein, 81 aa, Delphinapterus leucas
MARQDLAVRFSEDEWRLLGEGQRALYLDVMRENYETLASLGTVELLPLSAFLCPSEPGGAVGGGGCAADGQDPPRGGGPLG

SEQ ID NO: 11559 - protein, 81 aa, Delphinapterus leucas
PKVPVTFDDISIYFSTPEWEKLEEWQKELYKNIMKGNYESLISMDYAMNQPDVLSQIQPEGDHNTEDQAGPEESEIPTDPT

SEQ ID NO: 11560 - protein, 81 aa, Carlito syrichta
FQDLVTFEDVAVDFSQEEWEWLSSAQRHLYRKVMLENYRNLVLLGLCVSKPDVISSLEQGKEPWTVKRKTRGQCPDLKAVQ

SEQ ID NO: 11561 - protein, 81 aa, Gulo gulo
SQGPVSFRDVAVDFTQEEWQQLEPDEKTTYRDVMLENYSHLVSVGYDSVKPKVILKLEQGEEPWVADGEVPCQSQPEEVWK

SEQ ID NO: 11562 - protein, 81 aa, Gulo gulo
IQEPVTFKDVAVDFTQEEWGQLDPVQRTLYRDVMLETYGHLLSVGNQIAKPEVISLLEQGEEPWSVEQAYPQSTCPEWMRN

SEQ ID NO: 11563 - protein, 81 aa, Erinaceus europaeus
MVENVALFFTQKEWDYLDPTQRSLYQDVVMDNYGNLLSLDVLNSDKDEEPIIKQEIEEIEEEVEPQNVILTKIKSEIDQDP

SEQ ID NO: 11564 - protein, 81 aa, Erinaceus europaeus
PLTLTSEDVIIIFTWDEWTILNSQKKLAREVMRQNYTNVMSYLLISIDAQVIISTHVPGYGNYELTFEGKSQGNLKYTKFI

SEQ ID NO: 11565 - protein, 81 aa, Cervus elaphus
CLLFQGSDLFRDVAIVFSQEEWEQLAPTQRDLYRDVMLETYSNLVSLGLAVSKPDVISFLEQGKEPWTVGEVATGGPCPGE

SEQ ID NO: 11566 - protein, 81 aa, Cervus elaphus
EHEPVTFNDVAVDFTQEEWGQLDLVQRTLYRDVMLETYGHLLSVGNQITKPEVISLLEQGEEPWSMESAYPLQGTCPEWMK

SEQ ID NO: 11567 - protein, 81 aa, Cervus elaphus
MSQKNLFRNVMMETVTHLVSVGYQISKSDVISQLEQGKELWTEAAGSERPLRRQEMIVMQSVYRKHISPTMAMLRSERRIV

SEQ ID NO: 11568 - protein, 81 aa, Cervus elaphus
FQELVTLEDVAVDFSPEELPYLSASQRNLYREVMLENYRNLVSLGYQFPKPDIISQLEEEESHAREEDGSTMTCQDWEEQS

SEQ ID NO: 11569 - protein, 81 aa, Cervus elaphus
AALLKAKAQELVTFEDVAVYFIRKEWKRLEPAQRDLYRDVMLENYGNVFSLGPGSGTELWATWYEQDKPCPVFPHEQESLF

SEQ ID NO: 11570 - protein, 81 aa, Colobus angolensis
RESRPGAVSFADVAVYFSPEEWGCLRPAQKALDTFGHLGALGEAACSSWDPQSSVEREVEAWSPEAQDPEGESPAALSKGQ

SEQ ID NO: 11571 - protein, 81 aa, Colobus angolensis
SQGLFTFKDVAIEFSQEEWECLDPAQRALYRDVMLENYRNLLSLDEDNIPPENGSHLAACGQSTLPLLKNPTKSDPFILPP

SEQ ID NO: 11572 - protein, 81 aa, Colobus angolensis
FQGSVTFEDVAIAFSQQEWESLDCSQRGLYRDVMLENYRNLMSMAGHSLSKPHVITLLQQWKEPEVTVRTDERRWCTDLQL

SEQ ID NO: 11573 - protein, 81 aa, Colobus angolensis
EKETLTFRDVAIEFSLEEWECLNPAQQSLYMNVMLENYKNLVFLGIAVSKQDPVTSLEQEKEPWNMKRHEMVDEPPGYMCR

SEQ ID NO: 11574 - protein, 81 aa, Vicugna pacos
CQDSVTFEEVSVKFSMEEWALLDLSQKKLYRDMMQETCRNLTSIEEKLKDPDIEGQYENHGKNLRHMTSHTTPNPYEYLGY

SEQ ID NO: 11575 - protein, 81 aa, Vicugna pacos
AQGPVVFSDVSVDFSQEEWECLDPAQRDLYKDVMLENYSNLVSMGLYIPKPQVISLLEQGKEPWMVGRELTRGLCSDLESM

SEQ ID NO: 11576 - protein, 81 aa, Odobenus rosmarus
AQGGVTFEDVAVYFSQEEWGLLNEAQRCLYLDVMLENFALTSSLGCSCQTEAAEVPFEQSISVGVSQARTPKEPRSSQKTH

SEQ ID NO: 11577 - protein, 81 aa, Odobenus rosmarus
LQALLTFRDVAIEFSQEEWRCLNHTQRQLYRDVMLENYGHLLFLGLTLSKPDLIMFLEQEKQLWDVKRKETVAFHPGIKTY

SEQ ID NO: 11578 - protein, 81 aa, Odobenus rosmarus
FQGSVTFRDVAVAFSQQEWESLNPAQSQLYRNVMLENYSNLVSLAGHSISKPHVITLLEQWKEPWMIVRKDQRRQYTDFQL

SEQ ID NO: 11579 - protein, 81 aa, Odobenus rosmarus
KVPVTFVDIAVYFSEDEWKNLDEWQKELYNNLVKENYKTLMSLDTEGAVPKPDAPSQVEPREEPCVWEQRDPEEREILMDP

SEQ ID NO: 11580 - protein, 81 aa, Odobenus rosmarus
AQGCVTFEDVTIYFSQEEWGLLDEAQRLLYCDVMLENFALIASLGLTSFRSHIVAQLQMGAEPWVPDRVDMTSAMARGAYS

SEQ ID NO: 11581 - protein, 81 aa, Delphinapterus leucas
STGLSSFKDISMEFTWEEWQLLDSAQKHLYRDVTLENYSNLVSVGYHGTKPDLVFKLEQGEEPWIINAEVSRQSCPEGWKE

SEQ ID NO: 11582 - protein, 81 aa, Delphinapterus leucas
KAQETLTFDDVAVAFTWEEWQFLAPPQKDLYRDVMLENYSNLLSVGFQASKPDILSKLDQGEPWTMEDEIHCRTHSVWKVD

SEQ ID NO: 11583 - protein, 81 aa, Delphinapterus leucas
ASQGLLTFQDVVIEFSQDKWEFLDSTQWELYRDVMLENYKNLVSLGPVSKPDLVTFMEQKKGPWDVKGMETIAIHPGTGDP

SEQ ID NO: 11584 - protein, 81 aa, Delphinapterus leucas
PQACVTFEDVAIYFSQEEWGLLDEAQRFLYHDVMLENFELTTSLDCQCGAEDEEIPSEQSVSGGESQVRTSQLVPSNQKTR

SEQ ID NO: 11585 - protein, 81 aa, Erinaceus europaeus
EGTVSFEDVTVTFSREEWQLLSATQRTLYRTVMLDTYSSLAALGGTAVRWKPSSPLATPMADRKTSSRGPSLAFPPRPAPK

SEQ ID NO: 11586 - protein, 81 aa, Erinaceus europaeus
VTFNDVAVTFTQEEWEQLRPAQRALYHEVMLDNYSLLVSVGDKGILKLIDPATFKPVLSEGVSVHEQLAQGTPRESQKEQT

SEQ ID NO: 11587 - protein, 81 aa, Ornithorhynchus anatinus
YWVPALFDEVAVSFSDEEWDLLTEEQKTLYREVMKMNYETVVSLEFPFPRPDVISQLEEGEGLWAAPFPADSEEWLFPRGA

SEQ ID NO: 11588 - protein, 81 aa, Cervus elaphus
ESVTFEDVAVNFSHEEWQCLTHAQRHLYKDVMLENYGNMVSLAAKTWPENEKARSEQEVFENGEVCWVKFRSLLKVVSRDP

SEQ ID NO: 11589 - protein, 81 aa, Colobus angolensis
PQGLLTFRDVAIEFSQEEWKCLDPAQRTLYRDVMLENYRNLVSLAISSKCRMKKFSSTGQGNTEVIHTGTLQRQASHHIGE

SEQ ID NO: 11590 - protein, 81 aa, Colobus angolensis
MTEEFVTLKDVGMDFTLEDWEQLGLEQGDMFWDSALDNCQDLFLLDPPRPNLTSHADGVEDLEPLPGGSPEATGPDVTETK

SEQ ID NO: 11591 - protein, 81 aa, Colobus angolensis
SVMGSVTFQDVAIDFSEEEWGFLNPAQRDLYTAVTLENYQNLVWLGLSISKSVISLLEKRKLPWIMGKEEIRVPLPGEYEE

SEQ ID NO: 11592 - protein, 81 aa, Colobus angolensis
TSKEAVTFKDVAVFFTEEELGLLDLAQRKLYRDVMLENFRNLLSVGHQPFHRDTFHFLREEKFWMMDIATQREGNSGGKIQ

SEQ ID NO: 11593 - protein, 81 aa, Colobus angolensis
IQGPLTFGDVAVAFTRIEWRHLDAAQRALYRDVMLENYGNLVSVGLLSSKPKLITQLEEGAEPWMEVREAPSGTRAVQDYW

SEQ ID NO: 11594 - protein, 81 aa, Colobus angolensis
TEGESGQQDLVLCWGEGPVTFEDVAVLFTEAEWKRLNLEQRNLFKEVMLENLRNLVSLGEDILGSLRSGLLHVDMNLDLWL

SEQ ID NO: 11595 - protein, 81 aa, Colobus angolensis
EKEPLTFRDVVIEFSQEEWQCLDTAQQDLYRKVMLENFRNLVFLGIDVSKPDLITCLEQGKDPWNMKRHSTVATPPGVFFV

SEQ ID NO: 11596 - protein, 81 aa, Mustela putorius
SQDLMTFEDVAVEFTKWEWGQLDPAQKDLYRVVMLENFKNLASLGLPVAKPYVISQLEKGKEPCVLEGEISTDWEKRPKAK

SEQ ID NO: 11597 - protein, 81 aa, Mustela putorius
TQDSVVFEDVAVDFTQEEWALLDLAQRSLYRDVMLENFQNLASLGYPLHTPYLISQWKQEEDLETVEGGPVQGEHQEGFEI

SEQ ID NO: 11598 - protein, 81 aa, Mustela putorius
KDQVTLTLEDVAVDFTWEEWQLLAPAQKNLYRDVMLENYRNLVSVGYKASKPDALSRWEQGALWTTEDEIRSRICPEIKKD

SEQ ID NO: 11599 - protein, 81 aa, Mustela putorius
TQGCVTFEDVTIDFSQEEWGLLDEAQRLLYCDVMLENFALIASLGLTSFRSHVVAQPQMGAEPWVPDRVDMTSVMARGAYS

SEQ ID NO: 11600 - protein, 81 aa, Mustela putorius
GPVTMTFDDVALYFSEQEWEILEQWQKEMYQQVMKTNYETLDSLGGIFSKPNLITWIEQGRMLLIRDRGPLEKNMTFSPST

SEQ ID NO: 11601 - protein, 81 aa, Mustela putorius
ARLLPPPAGPQAKVTFEDVAVLLSQEEWDRLGPAQRGLYRHVMMETYGNVVSLGLPGSKPSVISQLERGEEPWVLDGHGAE

SEQ ID NO: 11602 - protein, 81 aa, Mustela putorius
SLSFRDVAVGFTRKEWQQLDPTQRTLYRDVMLENYSHLVSVGYQVTKPAVISRLEQGQEPWMEEEEILRWSFPGENLQVDH

SEQ ID NO: 11603 - protein, 81 aa, Tupaia chinensis
LTLEDVIVKFTWEEWQLLGPAQKDLYQDVMLENYSNLLALEVWEADAHLWEHLHHGSAVNRLQQWHEHNAWENILHQSKTQ

SEQ ID NO: 11604 - protein, 81 aa, Tupaia chinensis
SLGPVSFNDVAVDFTQEEWQQLDPEQKMTYRDVMLENYNNLVSVGYHIIKPDVIIKLEQGEEPWIVGEFLLQNYPDEMWQT

SEQ ID NO: 11605 - protein, 81 aa, Tupaia chinensis
REGLVSFKDVTVSFSKEEWQQLDPAQRHLYQDVTLEIYSHLSSVGCSIPSPEVIFRMIKGKESWTGEAELPYQRVEGGEFG

SEQ ID NO: 11606 - protein, 81 aa, Vicugna pacos
FPEPVIFEDVTLGFNPEEWEMLDLEQKSLYREVMLENYRNLVSVEHQLSKPDVVSQLEEEEELWSVERGIPQDTSSECPEA

SEQ ID NO: 11607 - protein, 81 aa, Vicugna pacos
PQDLMTFEDVAVEFTWWEWGQLDTAQKDLYREVMLENFRNLASLGFPVSKPHVICQLEKGEEPYMMEREVSTGAHPDWERR

SEQ ID NO: 11608 - protein, 81 aa, Vicugna pacos
LQETVTFKDVAIDFTQEEWQQLDPAQRNLYRNVMLENYNNLITVGCPFTKPDVIFKLEQEEEPWVVEEEVLKRHCPGEIWG

SEQ ID NO: 11609 - protein, 81 aa, Vicugna pacos
PQGRVTFEDVAVYFSWDEWGLLDETQRLLYRSVMLENFALMASLGFTSSRTCEITKLEWWGEPFLPPPGVRTAAVPRGCGC

SEQ ID NO: 11610 - protein, 81 aa, Vicugna pacos
RPESVTFEDVAIYFSENEWTGLAPAQRALYRDVMLENYGALASLAAFPFPKPALIFQLEQGEAPWSSAPQGALDGEGPRGI

SEQ ID NO: 11611 - protein, 81 aa, Odobenus rosmarus
FREPVTFEDVTLGFTSEEWGLLDLEQKSLYREVMLENYRNLVSVEHQLSKPDVVSQLEEEEALWSVERGIPQDTFSEYPAA

SEQ ID NO: 11612 - protein, 81 aa, Delphinapterus leucas
SQGLLSFNDVAVDFTWEEWQLLDLVQKNLYRDVMLENYSNLMSLGYHVTKPEPVMHLEKGEEKEKAVVEREFPSQCGPERP

SEQ ID NO: 11613 - protein, 81 aa, Delphinapterus leucas
FQEAVTFKDVAVTFTEEELGLLDSAQRKLYKDVMVENFRNLVSVGHLPFKPDMVSQLETEEKLWMMEREIQRNGHSGENRK

SEQ ID NO: 11614 - protein, 81 aa, Delphinapterus leucas
SQEAVTFEDVAVNFSNEEWQCLTHAQRHLYKDVMLENYGNVVSLGFPFPKPPLISHLEQEAELCVQDGQDREFLSCSHPVS

SEQ ID NO: 11615 - protein, 81 aa, Gulo gulo
WSQMPVTFEDVALYLSREEWGRLDHAQQSFYRDVLQKRNGLSLAGFPFSRPLWGSQGQGKGEASSSCQQMGDDREKTGAIE

SEQ ID NO: 11616 - protein, 81 aa, Mustela putorius
SRSLENDGVCFSEQEWENLEDWQKELYRNVMKSNYETLVSLKVLGQPEEEAELGAGMLGDLEEEGPGDVHPAEGVMIKQEI

SEQ ID NO: 11617 - protein, 81 aa, Tupaia chinensis
FQESVTFQDVIINFTQEEWTLLDTSGKKLYKDVMLENMNHLVSLGYDLCQSDLIFHLLWMVEGRGLPECQSPDWESAHRKQ

SEQ ID NO: 11618 - protein, 81 aa, Tupaia chinensis
EPVTFEDVAVHFTQKQGARLDPAQRALYKEVMLENYAHVASLEAESCIKSEEPVVKQEAPEGTEFHGMPAGTLLRNVSEPA

SEQ ID NO: 11619 - protein, 81 aa, Tupaia chinensis
MLENFALIASLGLMSFRSHVVAQLEMGEEPWVPDRVDISSAMARGAYSRPASGHMIAREQEPSSVKSPDSQKLLDTLLQNL

SEQ ID NO: 11620 - protein, 81 aa, Delphinapterus leucas
PQDLMTFEDVAVEFTRWEWGQLDPTQKDVYREVMLENFKNLASLGFPMSKPYVICQLEEGEEPCILEREISTGAPADYQLL

SEQ ID NO: 11621 - protein, 81 aa, Delphinapterus leucas
VTESVTFRDIAVLFSRNEWLHLDSAQRTLYREVMLENYSTLVSLGIPFSMPNLICKLQHGEDPCMVEREIPQDTCLGFKTW

SEQ ID NO: 11622 - protein, 81 aa, Carlito syrichta
PQGSTSFSSVTVAFAQDRWRYLVPTPRDRFKEGISETSRNLFLLGIPVSQPRMNSQLEQREGPWMLEGEDLRSTCPDWKTV

SEQ ID NO: 11623 - protein, 81 aa, Delphinapterus leucas
RQVSMAFQDLAVRFSEDEWRLLGEGQRALYLDVMRENYETLASLGTVELLPLSAFLCPSEPGGAVGGGGCAADGQDPPRGG

SEQ ID NO: 11624 - protein, 81 aa, Delphinapterus leucas
SRDSVTFADVAVDFTQEEWTLLDPIQRKLYRDVMLENYKNLTTAGYQSLKPTLISWLEQEDDLRTVERRGVLQASCFFLQT

SEQ ID NO: 11625 - protein, 81 aa, Delphinapterus leucas
RLKGPLSFMDVFVDFTWEEWQLLDPAQKHLYRSVMLENYSNLVSLGYQLTKLNIIFQLEQEELWMMQIPTQGHLGIGFPRV

SEQ ID NO: 11626 - protein, 81 aa, Carlito syrichta
SQDLLTFRDVAIEFSQEEWTCLDPAQRTLYRDVMLENYRNLVSLGISLSDLPVISMLEQEREPWIVKSEVKIAKNPDGWEC

SEQ ID NO: 11627 - protein, 81 aa, Delphinapterus leucas
SVTFEDIAVYFSWEEWRLLDETQRRLYLDVMLENFALISSLGCCCGAEDAEAPFEQITSLGVSQARTPKAALSFQKTHPCE

SEQ ID NO: 11628 - protein, 81 aa, Carlito syrichta
PQAKVTFEDVAVLLSQEEWDRLGPAQRGLYRNVMMETYGNVVSLGLPGSKPKVISQLERGEEPWVLDRKGTEESQGREHGC

SEQ ID NO: 11629 - protein, 81 aa, Carlito syrichta
AQGSVSFEDVTMELTWEEWRQMGPGERSLYRDVMLENYGHLVAVGCCITKPKVIHMLEQGEEPWSLEVKFLNRKYPGYYKI

SEQ ID NO: 11630 - protein, 81 aa, Carlito syrichta
LRPAQLQEPVTFGDVAVLFSQDEWLRLDPTQRTLYREVMLETYSSLAALGVLFSKPKVISQLEQGEDPWMVEAGDLQGTRL

SEQ ID NO: 11631 - protein, 81 aa, Carlito syrichta
QTGSVTFRDVAIDFSQEEWEFLDPAQRDLYRDVMWENYSNFISLGPSISKPGVITLLDEEGKEPGMIVREETRRYCADLES

SEQ ID NO: 11632 - protein, 81 aa, Carlito syrichta
VKNPVTFEDVAVNFTQEEWEYLDASQRVLYQDVMSETFKNLASVARIFLHKPYLITKLEQEEKQWRTHLHLTYRERLLSGG

SEQ ID NO: 11633 - protein, 81 aa, Carlito syrichta
SQGLLTFKDVAIEFSPEEWKCLDSAQQILYRNVMMENHRNLVSLGLAVSKPDLIVCLEQRNKPWNVMRHNMLEKPTGLHGQ

SEQ ID NO: 11634 - protein, 81 aa, Carlito syrichta
LQKLVTFEDVAVYFTQTEWDGLSPAQRTLYRDVMLENYGNVASLGFPLLKPAVILQLEGGGELGGPSPLAVGTRTDSQDLW

SEQ ID NO: 11635 - protein, 81 aa, Delphinapterus leucas
SQGLVTFKDVAVCFSQDQWSDLDPTQKEFYGEYVLEEDCGIVVSLSFPIPRLDEISHMGEEEPLIPEIPEAQEPQEPEILS

SEQ ID NO: 11636 - protein, 81 aa, Carlito syrichta
PVAFRDVAVIFTEAEWMSLSLEQRNLYKEVMLENYRNLLSLAEPKSGVYPCSSCLLVSSCQQFLSQHVLQIFQGLCTENHS

SEQ ID NO: 11637 - protein, 81 aa, Carlito syrichta
MSQVTFSDVAIDFSHEEWTWLDSAQRNLYKDVMVQNYKNLVSLGLSVTKPYVITLLEDGKEPWMVEKKLSKDWESRWENKK

SEQ ID NO: 11638 - protein, 81 aa, Delphinapterus leucas
SQEQVSFKDVCVDFTQEEWYLLDPAQKILYRDVILENYSHLVSVGNCITKPEVIFKIEQGEEPWILEERFPKQCRSDWKVD

SEQ ID NO: 11639 - protein, 81 aa, Delphinapterus leucas
ARLTFKDVVIEFSPEEWECLDPAQRALYRDVMVETYRNLISVDLSHIHVIKKLQLKSNTDVGEIFPTVMLGSHGSCEIKHF

SEQ ID NO: 11640 - protein, 81 aa, Carlito syrichta
EMGLLSFKDVAIEFSPEEWECLDSPQRILYRTVMLENHRNLVFLGLADSKSDLIMHLEQRKEPWDVKRHDILAKLPAVTSH

SEQ ID NO: 11641 - protein, 81 aa, Carlito syrichta
LKGSVSFEGVTMEVTREEWQQMAPMEWSLYRDVTLEIYGHLVAVGCCITKPKVILKLEQGEEPWSLEVKFLNGKYPGYYKI

SEQ ID NO: 11642 - protein, 81 aa, Carlito syrichta
EPEGLFTFKDVTIEFSPEEWEYLDPSQQRLYRTVMLENHRNLVFLGLAVSKPDLITCLEQRKEPWDVKRYSTLTKPPGRWE

SEQ ID NO: 11643 - protein, 81 aa, Carlito syrichta
LQAEVTFEDVAVLLSREEWGRLGPAQRGLYRDVMLETYGNLVSLVCETRTEYKELTSWETFDEQELDHLRGIFSQGPEPVE

SEQ ID NO: 11644 - protein, 81 aa, Carlito syrichta
MNLYKEVMLENFSNLVSVGLSNSKPAVISLLEQGKEPWMVNRELTRGLCSDLESMCDTKILSLKKRHFSQVILTHEDMPTF

SEQ ID NO: 11645 - protein, 81 aa, Delphinapterus leucas
FQGSLSFRDVAVGFTRKEWQQLDPTQRTLYRDVMLENYSHLVSVGCQVTKPAVISRLEQGQEPWMKEEEILRWSFPEVLQV

SEQ ID NO: 11646 - protein, 81 aa, Carlito syrichta
SQGPVSFEDVAVNFTWEEWQHLDPAQRTLYRDVMLENYSHLVTVGGPVSKPDVISKLEQGGEPWIIMRDRPNWIYPGANVA

SEQ ID NO: 11647 - protein, 81 aa, Gulo gulo
MDFPQEEWALLNSQQRKLYRDVMLENYRNLASLEKQLSKPTLITQMEQEEEMKTETRYHQDSSSNGMVLLKTKQAQHKQDI

SEQ ID NO: 11648 - protein, 81 aa, Erinaceus europaeus
MKPAQRNLYRDVMLENYSNLVIVGCQFTKPDVIFKLEKEEEPWVVEEEMFKGHCSEVWEVDQKIKKQQEILVRKVTSISKK

SEQ ID NO: 11649 - protein, 81 aa, Erinaceus europaeus
SQGPVSFRDVAVDFTRDEWQQLDREQRATYRDVMLENYNHLEAVGCDEHKPNVIIKLEQGEEPWETESEPPSLSHAEVWKV

SEQ ID NO: 11650 - protein, 81 aa, Erinaceus europaeus
TQVKVTFDDVAVLLTQEEWDHLGPAQRGLYRNVMMETYGNVVSLGLPGSKPNVISQLERGEEPWVRDGQETKESWDPGIGH

SEQ ID NO: 11651 - protein, 81 aa, Erinaceus europaeus
AISCEDVTVNFSQEEWALLNPSEKKLYNDVMWEIFHNLFSIGKLLEYSFIEQSEDEEGSKQRNIEDKIAEKEGSLYREKPH

SEQ ID NO: 11652 - protein, 81 aa, Ornithorhynchus anatinus
MCENYRHLLWLGFSLPKPEIISLFKRGEEPWIANLPRNVKVEFPRESRPVMHNRTIDSEFFLLGLTDVQGLQTFLFALLLL

SEQ ID NO: 11653 - protein, 81 aa, Oryctolagus cuniculus
QVTITFKDLAVRFSEEEWRLLEERQREFYREVMRENYETLVSVGTAELLPLSAFLSPMEPGRAIGGGERADKGQEPLARGG

SEQ ID NO: 11654 - protein, 81 aa, Rhinopithecus bieti
EQGYVTFEDVAVYFSQEEWRLLDEAQRLLCRNVMLENFSLLASLGLASSKTHDITQLESWKEPFMPAWGVVTSAIPRGCWH

SEQ ID NO: 11655 - protein, 80 aa, Ursus americanus
LQGLLTFGDVAIEFSQEEWRCLSHTQRELYSDVMLENYGHLLFLGLVVSKPDLVIFLEQKRELWDVRRKETVFIHPGRWE

SEQ ID NO: 11656 - protein, 81 aa, Propithecus coquereli
TQESLTPEDVAVEFTWEEWQLLGPAQKDLYRDVMLENYSNLVSVGYQASKPDALSRLEHGDPPWRREDEIHRGARSEVWKV

SEQ ID NO: 11657 - protein, 81 aa, Saimiri boliviensis
MLENYGSVASLAAFPFPKPALISQLEQGEAPWCLAPRGALDGEGQRGISGEILELPGATIWSLRIKPIPKKTVAKQRETRS

SEQ ID NO: 11658 - protein, 81 aa, Lynx pardinus
AQGCVTFEDVTIYFSQEEWGLLDEAQRLLYCDVMLENFALTASLGLTSFRSHIVARLEMGAEPWVPDRVDMTSAMARGAYG

SEQ ID NO: 11659 - protein, 81 aa, Balaenoptera acutorostrata
LSQTSVSFRDVTVEFTQEEWQCMSSAQRTLYRDVMLENYSHLVSSGYCLTKPDVIVKLEQDDPLLLEEEILSKSHADCKLD

SEQ ID NO: 11660 - protein, 81 aa, Saimiri boliviensis
SQELVTLEDVVVHFSLEELSSLSAAQRNLYREVTLENYRNLVSLGYHFSKPDIISRLEKEESRAVETGSNAVICQGESHDD

SEQ ID NO: 11661 - protein, 81 aa, Balaenoptera acutorostrata
MDPVAFEDVAVNFTLEEWALLGPSQKKLYRDVMRETLRNLASVGEKWEDHNTEDQYKNQGRNLRSHTLRRRCESEESSQGG

SEQ ID NO: 11662 - protein, 81 aa, Vombatus ursinus
WGCLGPSEKELYRNVMLENYGHLVYLGLAISKPDVICHSERGDPPWKPVIKECNKFQRSFNQELDLTLSVQQTVRTGKIHH

SEQ ID NO: 11663 - protein, 81 aa, Balaenoptera acutorostrata
AKDCVTFEDVTIYFSQEEWGLLDEAQRLLYCDVMLENFALIASLGLTSFRSHVVAQLEMGAEPWVPDQVDMTSAMARGAYR

SEQ ID NO: 11664 - protein, 81 aa, Lynx pardinus
DPGQVNFEDVAVYFSREEWGLLDEAQRLLYRDVMLENLALTASLGYESSMSLGVASLELGGEPWVSDWADVTPARTREAQG

SEQ ID NO: 11665 - protein, 81 aa, Saimiri boliviensis
GTVTFEDVAVKFSQEEWSLLSEAQRCLYHDVMLENLTLISSLGCWYGAKDETPSKQTLSIQQQSPLRSHWTGVCTKKAHPW

SEQ ID NO: 11666 - protein, 81 aa, Lynx pardinus
QAQESLTFEDVAVGFSREEWRLLAPAQKDLYRDVMLENYRNLVSVGYLASKPDALSKLEGGELWTAEDEIDSRICPEIRKV

SEQ ID NO: 11667 - protein, 81 aa, Lynx pardinus
PQVSVSFKDITVEFTQEEWRQMDSAQRTLYRDVMLENYSHLVSVGYCFTKPELIFTLEQGEDPWLFKKEFLRKGFPEEYQP

SEQ ID NO: 11668 - protein, 81 aa, Saimiri boliviensis
AQVSVTFDDVAVTFTQEEWGQLDLAQRTLYQEVMLENCGLLVSLGCPVPRPELIYHLEHGQEPWTRKEDLSQGTRPGDKAK

SEQ ID NO: 11669 - protein, 81 aa, Vombatus ursinus
MFEDMAMYLTPEEWGQPDPTQRALYRDMMLESCRNDILLDDGSETENMESLSNLEVSEDVESEEKLSSEFPIALPQGPDFG

SEQ ID NO: 11670 - protein, 81 aa, Balaenoptera acutorostrata
SYESLSFADVTLGFTQEEWQQLDPDQRTLYRDVMLENYSHLVSVGYCIPKPELIFRLEQGEQPWVLEEESPSQSYPEVCKV

SEQ ID NO: 11671 - protein, 81 aa, Balaenoptera acutorostrata
LSQALLTFRDVAIEFSQEEWECLNPAQRALYRDVMLENYRNLVSLDMSTRCMIKELSPKEDINNGDLFQTLVFERLESPGQ

SEQ ID NO: 11672 - protein, 81 aa, Lynx pardinus
NSQGLLTFRDVAIEFSQEELQCLNHSQWELYRDVMLENYGHLLFLGLVVSKPDLVIFLEQKKDVWAVKRKETVATHPGRWE

SEQ ID NO: 11673 - protein, 81 aa, Lynx pardinus
MDLSQRNLHKDVMLENYRNLVSLGLAVSKPDMISHLEDGKGPWVVVREIARTPYPELETKPAAKNVVSTENTSEDVSQETI

SEQ ID NO: 11674 - protein, 81 aa, Saimiri boliviensis
RPGAVSFADVAVYFSPEEWGCLRPAQRALYRDVMRETCGHLGALGFSGPKSAFISWVEGEVEAWNPEVQDPEGESPGTVSR

SEQ ID NO: 11675 - protein, 81 aa, Lynx pardinus
CEVSVSFEDVTMDFSREEWEQLGPAQRCLYWDVMLEICSHLLSLGYPIPRPEMIFRMEKEQESWIREAQLPHQWRPEGEFG

SEQ ID NO: 11676 - protein, 81 aa, Saimiri boliviensis
MLENYRNLVFLGIAVSKPDLITSLEQGKEPWNMKSHAMVAKPPVIWSHFAQDLWPEEGIKDSFQKGILRTYGKYGHESLQL

SEQ ID NO: 11677 - protein, 81 aa, Lynx pardinus
SVAFQDLAVRFSEDEWQLLGEGQRALYQDVMRENYETLLSLGTAELLPLSAFLSPTEPAGTMEGRSYAGEGQEPPQGGGPL

SEQ ID NO: 11678 - protein, 81 aa, Balaenoptera acutorostrata
AQGSVMFSDVSIDFSQEEWEFLDPVQRDLYRDVMLENYSNLVSVGLYIPKPQVIFLLEQGKEPWMIGRELTRGLCSDLESM

SEQ ID NO: 11679 - protein, 81 aa, Colobus angolensis
RPEPVTFWDVAVDFTQEEWGQLDPTQRILYRDVMLETFGHLLSIGPEFPKPEVISQLEQGTELWVAERGTIQGCHPGWEAP

SEQ ID NO: 11680 - protein, 81 aa, Colobus angolensis
SYEGSVSFRDVAINFSREEWQHLDLSQRNLYRDVMLETYSHLLSVGYQVPEPEAVMLEQGKEPWALQGERPRQSCPGEKLW

SEQ ID NO: 11681 - protein, 81 aa, Colobus angolensis
VVIFQGSVSFKDVTEWQYLDSAQRTLSRDVMLENYNHFVSVGYCIPKPEVILKLEKGEEPWILEEKFPFRVIWVKLINTSR

SEQ ID NO: 11682 - protein, 81 aa, Colobus angolensis
MALVTFRDVAIDFSQKEWEYLDTTQRKLYRDVMLENYSNLVSLGYSGSKPDVITLLEQGKEPCVVVRDVTGRQYPGWLSRH

SEQ ID NO: 11683 - protein, 81 aa, Colobus angolensis
MDSVAFEDVAVNFTQEEWALLDSSQKNLYREVMQETCRNLASVGNKWKDQNIEDHFEKPEKDIRNHVVQRLCESKDSSQYG

SEQ ID NO: 11684 - protein, 81 aa, Colobus angolensis
LRGLVTFEDVAVEFTQEEWALLDPTQRTLYRDVMLENCRNLASLGFRVNKPSLISQLEQDKKVMTEERGILPSTCPDLETL

SEQ ID NO: 11685 - protein, 81 aa, Colobus angolensis
SKGSVMFRDVSIDFSQEEWECLDSGQMNLYKEVMLENFSNLVSVGLSNSKPAVISLLEQGKEPWMVERELTRGLCSDLESM

SEQ ID NO: 11686 - protein, 81 aa, Colobus angolensis
MSNVTFSDVAIDFSHEEWAWLDSAQRDLYKDVMVQNYENLVSVAGLPVTKPYVIMLLEDGKEPWMVEKKLSKVYPFPLSHS

SEQ ID NO: 11687 - protein, 81 aa, Colobus angolensis
EKGPLTFRDVAIEFSLEEWQCLDTAQQDLYRKVMLENYRNLVFLGIAVSNPDLITCLEQGKEPWNMKRHAMADEPPVIYSH

SEQ ID NO: 11688 - protein, 81 aa, Mustela putorius
SLDSVTFTDVAIDFSQDEWEWLNLAQRTLYKKVMLENYTNLLSLGLCLSKPDVISLLEQGREPWMMEGEMTRGFCSDLEYV

SEQ ID NO: 11689 - protein, 81 aa, Tupaia chinensis
VTFRDVAVDFSQEEWDCLDSSQRHLYSNVMLENYRVLVSLGWESICETGELTPKEDLYEEQSSQKIIETLTRYDFEYSNLK

SEQ ID NO: 11690 - protein, 81 aa, Tupaia chinensis
VSFEDVVVDFSLEEWQLLNPIQKNLYRDVMLENYSNLIFLGYQIIKLDESLKLEQEESWIIDEGFLGQNISEKVWLNDNCK

SEQ ID NO: 11691 - protein, 81 aa, Delphinapterus leucas
SQASVSFKDVTVELTQEEWQQMGPIQKTLYRDVMLENYNNLVSVGNCIFKPEVIFKLEQGEEPWFLEEEFSNQSHKEDYRD

SEQ ID NO: 11692 - protein, 81 aa, Cervus elaphus
SHTLVTFKDILVNFTREEWKLLDTAQQIMYKDVMLENYRNLVSLGHQLPKPDVILRLEKGEEPWLVEKEIHQETHPDLETP

SEQ ID NO: 11693 - protein, 81 aa, Colobus angolensis
SKDLVTFGDVAVNFSQEEWEWLNPAQRNLYRKVMLENYRSLVSLGVSVSKPDVISLLEQGKEPWMVKKEGTRGTCSDWEYV

SEQ ID NO: 11694 - protein, 81 aa, Colobus angolensis
MGPLTFRDVAIEFSLKEWQCLDTAQRNLYRNVMLENYRNLVFLGIAVSKPDLIACLEQGKEAWSMKRHEIMVAKPPVMCSY

SEQ ID NO: 11695 - protein, 81 aa, Colobus angolensis
WSQMPVTFEDVALYLSREEWGRLDHTQQNFYRDVLQKRNGLSLGFPFSRPFWAPQAQGKGEASGSSRQTGDEKEEWRGAYT

SEQ ID NO: 11696 - protein, 81 aa, Colobus angolensis
KPGAVSFADVAVYFSPEEWGCLRPAQRALYRDVMRETYGHLGALGFPGPKPALISWMEQESEAWSPAAQDPEKGERLGGAR

SEQ ID NO: 11697 - protein, 81 aa, Colobus angolensis
DSVVFEDVAVDFTLEEWALLDSAQRDLYRDVMLETFQNLASVDDETQFKASGSVSQQDIYGEKIPKESKIAAFTRNVSWAS

SEQ ID NO: 11698 - protein, 81 aa, Colobus angolensis
RDVAIEFSLKEWHCLDTAQRNLYRDMMSENYRNLVFLARPDHLSGVKKIKPLTMKRHEMIAKHSGPGTVVALICNPKILGG

SEQ ID NO: 11699 - protein, 81 aa, Colobus angolensis
PKVPVTFDDVAVYFSELEWGKLEDWQKELYKHVMRGNYETLVSLDYAISKPDILTRIERGEEPCLDRWGQEKQNEVEVGHP

SEQ ID NO: 11700 - protein, 81 aa, Colobus angolensis
RQAFLAFGDVTVDFTQKEWRLLNPAQRALYREVTLENYSHLVSLGILHSKPELIRRLEQGEAPWGEERRCRPVPRAGIYAE

SEQ ID NO: 11701 - protein, 81 aa, Colobus angolensis
MLETYSHLLSVGYQVPEAEVVMLEQGKEPWALQGERPRQSCPGEKLWDHNQCRKILSYKQVSSQPQRVYPGEKPYECAEFE

SEQ ID NO: 11702 - protein, 81 aa, Vicugna pacos
QKPLTFKDVAVVFTKEELGLLDSAQRELYQDVMLENFQNLVSVGKGNFWVIETALIGVFLFPEEIRFLSHRELPCWKIWEQ

SEQ ID NO: 11703 - protein, 81 aa, Vicugna pacos
MAFEDVAVYFSREEWGLLDAAQRALYRRVMLENFALLASLGLSVSRPHVVIQLERGEEPWVLSATDVTLARSAQRRPSPGS

SEQ ID NO: 11704 - protein, 81 aa, Vicugna pacos
FEGSLSFEDVAVDFTRQEWHRLDPAQRTMHKDVMLENYSNLASVGLCVAKPEMIFKLERGEELWILEEESSGHGYPGSLSL

SEQ ID NO: 11705 - protein, 81 aa, Vicugna pacos
AQELVTFEDVAVYFIRKEWKRLEPAQRDLYRDVMLENYGNVFSLDGETRTEHDQHISEDTGSHGVLLGRFQKDISQGLKFE

SEQ ID NO: 11706 - protein, 81 aa, Vicugna pacos
SQGLLSFTDVSMEFTWEEWQLLDSTQKHLYRDVTLENYNNLLSVGYHGSKPDLIFKLEQGEEPWIINARLSRQSCPEGWKE

SEQ ID NO: 11707 - protein, 81 aa, Vicugna pacos
PVELVTFEDVAIDFTQEEWALLDASQRKLFRDVMLENLSHLVSVGYQHCKSDVIFQLEEGEELWSEAGGFLQSHSPGREGA

SEQ ID NO: 11708 - protein, 81 aa, Vicugna pacos
SRSLENDGVCFSEQEWENLEDWQKELYTNVMKSNYETLVSLKVLGQPEGDSELGTEMLGDLEEEGPGRVHPGAAMIKQEIQ

SEQ ID NO: 11709 - protein, 81 aa, Odobenus rosmarus
QGSAAYQFLSVDYTERKWKGPALSQRAVYRSIVPENYCSMASLAGETRMRRSELPARQEVSKGPASSDGISGGLCGVVSGE

SEQ ID NO: 11710 - protein, 81 aa, Odobenus rosmarus
CQESVTFEDVAVIFTDEEWRHLVPIQRDLYKEVMLENYKSIVSLGLPVPRPDVIFQLKRGDEPWIVDLHGSEERECPENVS

SEQ ID NO: 11711 - protein, 81 aa, Odobenus rosmarus
KEAVTFKDVAVAFTEEELGLLDSAQRKLYQDVMLENFRNLVSVGGSNQSELRTVQDRGPHEELSCWQIWQHIANDLSRCQN

SEQ ID NO: 11712 - protein, 81 aa, Carlito syrichta
GIMTFEDVAVYFSWEEWGLLEEAQRCLYHNVMQENLALIISLGCCCGAENEEAPSQQSISPQGVSQVRIFKAIPLLQKAIP

SEQ ID NO: 11713 - protein, 81 aa, Carlito syrichta
MGPGGRSLYRDVTLETFGHLVAVGYCFTKPKLIFTLEQGEDPWSLQKEKELLSRHSPEVSQPDDISEKSPENQGKHLWQVL

SEQ ID NO: 11714 - protein, 81 aa, Delphinapterus leucas
MNSVVFEDVAVDFNLEEWALLDSAQRELYRDVMLENFRNLASVGKIWEELSLEDQHIDQGRHLRNHVVERLHESTDQCGEG

SEQ ID NO: 11715 - protein, 81 aa, Delphinapterus leucas
SQERLTFEDVAIEFTQEEWECLDPAQRALYSDVMVETYRNLISLGKIQETEAFFYQEESRHLERLLVSRRVHTGEKPYQCN

SEQ ID NO: 11716 - protein, 81 aa, Delphinapterus leucas
FQEAVTFKDVAVTFTEEELGLLDSTQRKLYREVMLENFRNLLSVGHQSSKPDMISQLEREEKLWMTEVQTQRGARNHNEME

SEQ ID NO: 11717 - protein, 81 aa, Carlito syrichta
SQGLVSFKDVAVDFTQEEWQQLDIAQRTLYRDVMLENYSHLVSMGYPVSKPDVISKLEQGEEPWIIKRDRPNWIYPGEDQA

SEQ ID NO: 11718 - protein, 81 aa, Cervus elaphus
QLTFKDVFIDFTPEEWECLDPAQRTLYKDVMVETLRNLLSVAGPCSVRFGPVRPRLAPPLATPDRGLSYATPLTRPDAGRR

SEQ ID NO: 11719 - protein, 81 aa, Cervus elaphus
PKVPVSFEDVAVYFTKAEWKLLDHRQRKLYKQVMLDNHHNLVSLGFSSSKPQLIIQLEQGEKPWVADVHRMRITTGMQEGD

SEQ ID NO: 11720 - protein, 81 aa, Cervus elaphus
FQEFVTFEDVAVHLTREEWGCLDPVQRALYREVMLENYGNLVSLGILLRLPTTRIHSVNSCPALSHTRASAFSGETLAILS

SEQ ID NO: 11721 - protein, 81 aa, Colobus angolensis
TGGDVTFSDVAIDFSHEEWAWLDSAQRDLYKDVMVQNYENLVSVGLPVTKPYVIMLLEDGKEPWMVEKKLSKDWESRWENK

SEQ ID NO: 11722 - protein, 81 aa, Colobus angolensis
TFKEAVTFKDVAVFFTEEELGLLDPAQRKLYRDVMLENFRNLLSTGHQPFHQDTFHFLREEKFWMMETVTQREGNSGGKIQ

SEQ ID NO: 11723 - protein, 81 aa, Colobus angolensis
PQAKLTFEDVAVLLSQDEWDRLCPAQRGLYRNVMMETYGNVVSLGLPGSKPDIISQLERGEDPWVLDRKGTKKSQSLWSDY

SEQ ID NO: 11724 - protein, 81 aa, Colobus angolensis
VTLRDVVINFSQEEWEYLDSAQRNLYWDVMMENYSNLLSLDLESRNETKHLSVGKDSIENTGSEWEVMESSRLHGLESSIF

SEQ ID NO: 11725 - protein, 81 aa, Colobus angolensis
QEPLTFRDVAIEFSPEEWKCLDRAQQNLYRDVMLENYRNLVSLAMCSHFTQDFLPVQGIEDSFHKCILRRYEKFSSLFSSC

SEQ ID NO: 11726 - protein, 81 aa, Colobus angolensis
QGLVTFEDVAVDFTQEEWQYLNLPQRTLYRDVMLETYSNLVFVGQQVTKPNLILKLEVEECPAEGKIPFWNFPEVCQVDEQ

SEQ ID NO: 11727 - protein, 81 aa, Colobus angolensis
MLETYNHLVSLEIPSSKPKLIAQLEQGEEPWREERKCSLDLCPDGVSLCCLGWSAVVRSWLTATSSSWVQTVVCLSLPRSW

SEQ ID NO: 11728 - protein, 81 aa, Colobus angolensis
DSVTFEDVAVDFTQEEWTLLDQTQRNLYRDVMLENYKNLVAVDWESHINTKWSASQQNFLQGKTSSVVEMVRFRRYNLLPS

SEQ ID NO: 11729 - protein, 81 aa, Vicugna pacos
QPQEALTFKDVEVTFSQDEWGWLDASQRNLYRDVMLENYGNMASLVGPFTKPAVISWLEAREPWGLNVQGAQPKGNPGAAP

SEQ ID NO: 11730 - protein, 81 aa, Vicugna pacos
LLTFEDVALSFSEEEWQILDPSQKILYNDVMQENYENVISLGLKLKNDTGNDQPISLSTLEIQGSGCKVLRKARVKVAQKT

SEQ ID NO: 11731 - protein, 81 aa, Vicugna pacos
ALESVTFRDVAVFFSRDEWLHLNPAQRALYREVMLDNYSALLSLGILFSKPKVILQLEQGEDPWMVENGVSQSACLGWESL

SEQ ID NO: 11732 - protein, 81 aa, Odobenus rosmarus
EELPVVFEDVAVYFTREEWGMLVKRQKELYRDVMRMNYELLASLGPAAAKPDLISKLERRAAPWIKDPNGPKWGKGRPPGK

SEQ ID NO: 11733 - protein, 81 aa, Odobenus rosmarus
MMQENCRNLASLGNQVDKPGLVSELEQEDKVITEEIRILPGNCPDLETLLKAKGLTSKQHVFRKEQYEGVKMERNHLGVKL

SEQ ID NO: 11734 - protein, 81 aa, Odobenus rosmarus
PQGSAAYQFLSVDYTERKWKGPALSQRAVYRSIVPENYCSMASLGETRMRRSELPARQEVSKGPASSDGISGGLCGVVSGE

SEQ ID NO: 11735 - protein, 81 aa, Odobenus rosmarus
VEGRVTFEDVAVYFSWEEWGLLDEAQRCLYQDVMLENLALITSLGCRHGAEDEEAPERKVSVQGVSQVRTFKAVVSPQKAH

SEQ ID NO: 11736 - protein, 81 aa, Odobenus rosmarus
SSQGLLTFRDVAIEFSQEEWGCLNHTQRELYRDVMLENYGHLLFLGLIVWKPDLVIFLEQEKQLWDVKRKETVAFHPGRWK

SEQ ID NO: 11737 - protein, 81 aa, Odobenus rosmarus
QRGVVTFEDIAVYFSWEEWRLLDEAQRCLYHDVMLENFTLISSLGCCCGAEDTEAPFEQSTSIGVSQTRTPKAALSSRKTH

SEQ ID NO: 11738 - protein, 81 aa, Odobenus rosmarus
HGSMPFSNVTVAFTQDGWRHLIPAPRGTPRFKEGIPENARNLVLLGLPVSQPSMNSQLEQREEGPWMLEGGGLRSTCPDWK

SEQ ID NO: 11739 - protein, 81 aa, Delphinapterus leucas
MSKSQGSLSFKDVAVVFTWEEWQLLDRVQKNLYQDVMLENYINLVSVDAFYRLEQETPWIIEEESQSQIHPEDTWQVDNHR

SEQ ID NO: 11740 - protein, 81 aa, Carlito syrichta
LQELLTLEDVSVEFTSAEWQLLDPAQKDLYRDVMLENYSNLVSVGYQASKTDALSKLERGEEPWTVENEMHGQICPENDKV

SEQ ID NO: 11741 - protein, 81 aa, Carlito syrichta
PQVSLTFNDVAVLFTRDEWRKLHPSQRTLYREVMLENYRNLVSLGLLFTTPRLISLLQRGEDPWKVGKEGPGGSSLGGKSS

SEQ ID NO: 11742 - protein, 81 aa, Carlito syrichta
SQGLVTFGDVALDFSQEEWEWLNPSQKDLYRDVMLENYRNLVWLGLSISKPNMISLLEQGKEPWMVEREMSHGQCADWESW

SEQ ID NO: 11743 - protein, 81 aa, Delphinapterus leucas
WSQDSVTFEEVAVDFSQEEWALLDPAQKILYRDVMLENFRNLASVGYHLCKHSLITEVEQEELRPEQRGILQGAYRDRDTQ

SEQ ID NO: 11744 - protein, 81 aa, Carlito syrichta
AQGSVSFEDVTVELTREEWWQMGPGERSLYRDVMLENYGHLVAVGCCITKPKVICKLEQGEEPWSLEVKFLNRKYPGYHKI

SEQ ID NO: 11745 - protein, 81 aa, Carlito syrichta
MLETYGHLLSVGNQITKPEVISLLEQGEEPWSMEQAYPQSTCPEWMRSLENKALIPTQNIFEEEQSHGMKLERYIWDDPWF

SEQ ID NO: 11746 - protein, 81 aa, Carlito syrichta
HKELLTFRDVAVEFSLEEWECLDPTQKCLYRDVMSENYRNLVSLGLAVFKPDVITSLEQMKAPWNVNRQDVVAKNPAVSFY

SEQ ID NO: 11747 - protein, 81 aa, Erinaceus europaeus
KFQGLVSFEDVAVDFTQEEWNYLDPSQRTLYRDVMLENYSHVLSLGYPVTKPDVIASLEKRRIWIIEREIPSSSCTEVWQV

SEQ ID NO: 11748 - protein, 81 aa, Colobus angolensis
ESVTFQDVAVDFTEKEWPLLDSSQRKLYKDVMLENYSNLTSLDWETPSKTKWSLLMEDIFGKETPRGVTMERAGLAEKSTE

SEQ ID NO: 11749 - protein, 81 aa, Mustela putorius
SQHLVTFEDVAVTFTQEEWTLLDQTQRDLYRDVMLENYQNLIILGYESCKPDLYSLMGGAEELRTGGRGILQELDLQLKTK

SEQ ID NO: 11750 - protein, 81 aa, Mustela putorius
QGSVTFEDVVVYFSWEEWGLLDETQRCLYHDVMLENFALVISLGCWYGMEEEEALSVQQVSMGRTSSPAPSVWRAQPCDKC

SEQ ID NO: 11751 - protein, 81 aa, Mustela putorius
PQGSVSFKDVTVDFTQEEWQQLDPAQKALYRDVMLENYCHLISVGFHMTKPEMIRKLEQGEELWTVERIFPSQSDLEEDGK

SEQ ID NO: 11752 - protein, 81 aa, Mustela putorius
GLSDSKPDVISLLEQGKEPWVVKNQDKKEWCPDWESRRETKNLCPKEHSYEIKSLHLEIKRLTSSDLECTRFGNSREIKCH

SEQ ID NO: 11753 - protein, 81 aa, Mustela putorius
SKESVTFKDVAVDFTQEEWGQLDSPQRALYRDVMLENYQNLLALGPPVCKPDVISHLERGEEPWWMPREVPGGSCPGPRTP

SEQ ID NO: 11754 - protein, 81 aa, Tupaia chinensis
LQGFISFKDVAMDFTWEEWQDLEDAQKILYKVVMLETYSNLMFLGEKLYKCKQYKKMFSQNSDLTVHQRSHIKEKFYEKKI

SEQ ID NO: 11755 - protein, 81 aa, Tupaia chinensis
SQELLTFKDVSVDFTPEEWGQLAPAHRSLYREVMLENYGNLVSVGFQLSKPGVISQLEKGKEPWQMEGEISGGPNSDKSTA

SEQ ID NO: 11756 - protein, 81 aa, Tupaia chinensis
MFEDVAVLFTRDEWRKLDPSQRNLYRDVMLENYSNLVSLGLPFTKPKVISLLQQGGDPWMVEKESSGGSCLDRSHKNTEFD

SEQ ID NO: 11757 - protein, 81 aa, Odobenus rosmarus
SQESVTFEDVAVDFTQEEWTLLDRSQRKLFRDVMLENISHLVSIGRQLYKSDTISHLEPGEHLSKEGRGLLQCRSLDREDD

SEQ ID NO: 11758 - protein, 81 aa, Odobenus rosmarus
KSLGSVSFKDVTVDFSRDEWQQLDLAQKSLYRDVMLENYFNLISVGCQVPKPEVIFSLEQEEPCLLDGEISSHSCLDGDIG

SEQ ID NO: 11759 - protein, 81 aa, Odobenus rosmarus
SQESLSFRDVTVGFTQEEWQHLDPAQRTLYRDVMLENYSHLVSVGCSIPKPEVILKLEQGEEPWILEEEIPSQSNPELINN

SEQ ID NO: 11760 - protein, 81 aa, Odobenus rosmarus
VVFADVAVNFTPEEWALLDRGQRRLYRDVMLETYRNLASLVCPSQDKRSASRTQWNVLQNELPSEEKIVIFARNDLCSVFG

SEQ ID NO: 11761 - protein, 81 aa, Odobenus rosmarus
FQELVTFRDVAIDFSRQEWEYLDPIQRDLYRDVMLENYRNLVSLAGHSISKPDVVDLLEQGKEPWMILREETQRQYTDLDL

SEQ ID NO: 11762 - protein, 81 aa, Odobenus rosmarus
SQGSVLFEDISVDFTQKEWQLLDPAQRLLYREVMLENHRLLVSLGCSVTKPELIHKLEQGEEPWTPKRELPGQSRPGEKIY

SEQ ID NO: 11763 - protein, 81 aa, Delphinapterus leucas
AHGSLTFSDVAIGFSQQEWDCLDLVQKTLYRDVMMENYGNLVSLGHSISKPNVITLLEQGKEPWMFMREKTRSWCTDLDSR

SEQ ID NO: 11764 - protein, 81 aa, Carlito syrichta
ERPPEMAVSEDRASAAKEWKQLDPAQRNLYKNVMLENYSNIASMGCQASKPDIISKLEKGEEPWLGKEKRPSQGHLSKTAG

SEQ ID NO: 11765 - protein, 81 aa, Delphinapterus leucas
FESVVFEDVAVDFTPEEWALLDPAQRNLYRDVMLETFRNLASVGENWKCHSIEDQHKNQGTHLRWRVVEIPSENNESNQCG

SEQ ID NO: 11766 - protein, 81 aa, Delphinapterus leucas
AQESVMFSDVSIDFSQEEWEYLNDDQRDLYREVMLENYSNLVSMAGHSISKPDVISFLEQGKEPWLVDRELTRDQWPVLES

SEQ ID NO: 11767 - protein, 81 aa, Delphinapterus leucas
TDGLVTFRDVAIDFSQEEWEFLDPAQRDLYVDVMLENYSNLVSLELESTYETKNTFAKKDIFEINFPQQEIKERSKTLGFE

SEQ ID NO: 11768 - protein, 81 aa, Delphinapterus leucas
GPLTFKDVAIEFTEEEWECLDPAQRALYRDVMLENYRNLISVDISYMHVIKILQLKANTDRGEVFQTVMSERHERNEMKHF

SEQ ID NO: 11769 - protein, 81 aa, Gulo gulo
VQESVTFKDVVVLFTRDEWAQLSPTQRALYRDVMLENYSNLVSLGLLGPQSDVFSRLGKGEEWMLEDASGSFCLDWMTMPV

SEQ ID NO: 11770 - protein, 81 aa, Erinaceus europaeus
MAFRDVAVDFTQEEWMLLSPAQRSLYREVMLENYSNLVSLGIPFSKPELITQLEQGKETWREERKCPPASCPATEPKPKQP

SEQ ID NO: 11771 - protein, 80 aa, Carlito syrichta
MAGSQGLLTFRDVAIEFSREEWKCLDPTQRILYRNVMLENHRNLVSLGLAVSKPDLITCLEQRKEPWNVKRHNTLAKPPG

SEQ ID NO: 11772 - protein, 81 aa, Carlito syrichta
VTFADVVVNFTKEEWSLLDPAQRNLYRDVMLENCRTLASIDEMTQHETKDTTPQPDVLAKRTFLEASRVCLTSSHSQPSPI

SEQ ID NO: 11773 - protein, 81 aa, Carlito syrichta
SLTPVSFKDVTVEFSRDEWRQLDLTQKSLYRDVMLENYFNLISVGCHISKPEVIFSLEQGEEPCMLDGGISSQKCPDGDTG

SEQ ID NO: 11774 - protein, 81 aa, Delphinapterus leucas
RMEAVTFGDVAVHFSREEWQCLDPGQRALYKEVMLENHSSVAGLAGFLVFKPELISRLEQGQEPWVLDLQGAEGREAARTS

SEQ ID NO: 11775 - protein, 81 aa, Gulo gulo
LREPVAFEDVTLGFTSEEWGLLDLEQKSLYREVMLENYRNLVSVEHQLSKPDVVSQLEEEEALWSVERGIPQDTFSEYPTA

SEQ ID NO: 11776 - protein, 81 aa, Gulo gulo
SHVSVTFEDVAVLFTRDEWRKLGPSQRNVYQEVMLENYSNLVSLGLLFSKPRVISLLQQGEDPWKVEKESPGGPSLGWKSS

SEQ ID NO: 11777 - protein, 81 aa, Gulo gulo
AQGLLTFRDVAIEFSQEEWGFLNHTQRELYRDVMLENYGHLLFLGLIVWKPDLVIFLEQEKQLWDVRRKETVAFHPAAAAA

SEQ ID NO: 11778 - protein, 81 aa, Erinaceus europaeus
SMGTVSFEDVTVTFSLEEWQLLSTAQRTLYRTVMLDTYSSLAALGHCAAKPGVIVKLEQGAEPWMGAQAPPRSLAGHCAAK

SEQ ID NO: 11779 - protein, 81 aa, Erinaceus europaeus
AQGPLSFEDVAVDFSREEWQLLTPSQKALYRDTMLETHRNLVSVGGGAAEPGSLLCLEQGEPLWTLEGAAQSQSCARKKSY

SEQ ID NO: 11780 - protein, 81 aa, Ornithorhynchus anatinus
MEVTFQDAAIFPTRREWESLGDAQRELYRPVMLENYGYLRSLGAGRPKPQCIRQLEKGEDPWVPEPPAHHKWIFLKEAWTE

SEQ ID NO: 11781 - protein, 81 aa, Ornithorhynchus anatinus
DRMGVTFEDVAVYFSPGEWGCLDRAQRALYRDVMRENCDSLSSLGKMHSNFLNHQRIHTGEEPYKCTVCGISFCQSAHLIR

SEQ ID NO: 11782 - protein, 81 aa, Carlito syrichta
MRSNYETLVSLDDRLPKPELISWIEQGAEPFRNWKESQKSGNIICSSADLHFDPVIKGQLFWGSQQAVNSGQTKCYLQLDL

SEQ ID NO: 11783 - protein, 81 aa, Delphinapterus leucas
ELELVSFEDVAVTFTGEEWRHLDLAQRTLYQEVMLETCGLLVSLGHPVPKPELIHLLEHGQELRTVKRGLSRSTCTGEKAK

SEQ ID NO: 11784 - protein, 81 aa, Carlito syrichta
MAEPISEGFIQRCHVGELQELGLSISKPNMISLLEQGKEPWMVEREMSHGQCADWESWCEIKELSPKWFTDEDEISQGMEM

SEQ ID NO: 11785 - protein, 81 aa, Carlito syrichta
MFKEAVTFKDVAVAFTEEELGLLDSAQRKLYRDVMVENFRNLLSVGHLPFKRDISHVEREEQLWMMKATNQRERNLGENSQ

SEQ ID NO: 11786 - protein, 81 aa, Carlito syrichta
SQGSVTFRDVAIDFSQEEWKWLQPAQRDLYRCVMLENYGHLVSLGLSVSKPDVVSLLEQGKEPWLGKGDVRGDLFSVSNCE

SEQ ID NO: 11787 - protein, 81 aa, Carlito syrichta
MDPVQRNLHKDVMLENYRNLVSLGLAVSKPDMISHLENGKGPWAMVREISRNPYPDLESKPATKNATLTKNIPEDLSQEAI

SEQ ID NO: 11788 - protein, 81 aa, Carlito syrichta
MLENYSNLVAVGYCATKPEVIFRLEQGEEPWILEEFPTQSFLEIWKTDHLKEKSKENQPKHLWEVVFINNKMLTKERGNVI

SEQ ID NO: 11789 - protein, 81 aa, Carlito syrichta
SQGSVSFEDVAVGFTQEEWQLLDPDQKTLYRDVMLENYHNLVAVGYFINKPEVIFKLEQGEESWILKEDFPYRNYPEDCKA

SEQ ID NO: 11790 - protein, 81 aa, Carlito syrichta
GSVSFTDVTVDFTQEEWEQLDPSQRILYMDVMLENYSNLLSVEVWKADDQMERDHRNPDEQARQFVILKNQTSIEERGSIF

SEQ ID NO: 11791 - protein, 81 aa, Erinaceus europaeus
FQELVTFEDVAVYFIRKEWKRLEPAQRNLYRDVMLENYRNVFSLDGEARTEHHQDISEDTGAHGVLLGRLQEDISQGLKFE

SEQ ID NO: 11792 - protein, 81 aa, Erinaceus europaeus
WEPVTFKDVVVEFSKEEWGQLDPAGKDLYRDVILENLRNLDSLHKGKHQLSEPVTACQLKNKTKKWAMKQEIPRTTVLGPL

SEQ ID NO: 11793 - protein, 81 aa, Erinaceus europaeus
PKVPVTFDDVAVHFSEQEWSNLSEWQKELYKNVIRGNYESLVSMDYAISKPDLMSQMERSERPATQEQEDLEEGEAPTDPS

SEQ ID NO: 11794 - protein, 81 aa, Ornithorhynchus anatinus
AQVPVTFEDVAVYFSREEWAALDGRQKELYRDVMRGNYELVASLGCPAAKPDLICQIERDEELGVGEPQGRPVRRQPQRRS

SEQ ID NO: 11795 - protein, 81 aa, Erinaceus europaeus
PEGNLSFEDVTISFTWEEWQKLDDSQRALYKSVMLETYSHLLLLGKCVTKPAVIIKLEQGAEPWIIKEPPDQRLSDFKAFE

SEQ ID NO: 11796 - protein, 81 aa, Erinaceus europaeus
SQGLVTIKDVSLCFSQEEWRSLDPSQTDFYGEYVMQENCGIVVSLRFPIPKLDMLSQLEGGEEQWVPDTQDMEERDILKVT

SEQ ID NO: 11797 - protein, 81 aa, Ornithorhynchus anatinus
PKVPVIFDDVSVYFSTPEWEKLEEWQKELYKNIMKGNYESLVSMDYAMSQPDVLSQPAPDVPSQPAPDEARTVAEARPEAE

SEQ ID NO: 11798 - protein, 81 aa, Tupaia chinensis
PQKAKEGAPQSLDFTQEEWGQLAPLHQNLYREVLLENYGNLVSVGYQLSKPSVISQLEKGEAPWMTEKKSPRDPSSDLKNK

SEQ ID NO: 11799 - protein, 81 aa, Tupaia chinensis
SGSLENDDIGFSEQEWENLEDWQKELYRNVMQSNYETLVSLKVLGQPEGEADLGTEMLGDLEEEGPAGSHPADGVIIKQEI

SEQ ID NO: 11800 - protein, 81 aa, Odobenus rosmarus
SLESDLFRAVAIVFSQEEWEQLAPAQRDLYRDVMLETYSNLVSLGLAIAKPDVISFLEQGKEPWVVEKTSRGGLWPVLESR

SEQ ID NO: 11801 - protein, 81 aa, Odobenus rosmarus
MLDNYRDLVSVGPQLSKPNVISQRELEELSWMTKGLPVGLSPDWETRLETKESTIKPSITEYLSYGVIMEREDLWPSSLGE

SEQ ID NO: 11802 - protein, 81 aa, Odobenus rosmarus
APVRMTFDDVALYFSEQEWEILEKWQKEMYQQVMKTNYETLDSLGGVFSKPDLISWIEQGKMLLIRDQGPLEKNITLSPST

SEQ ID NO: 11803 - protein, 81 aa, Odobenus rosmarus
QAEVTFEDVAVLFSREEWGRLSPAQRGLYRDVMLETYRNLVSLGAGPAGPKPGVITQLERGDEPWVLDAQGAKGKERLRVS

SEQ ID NO: 11804 - protein, 81 aa, Odobenus rosmarus
MLENYSNLVSLGYCVTKPEVIFRLEQGEEPWILEEEFPSQSFPGEIWKTDHKKERSHENQPKHVWEFAFINNKMLTEERGN

SEQ ID NO: 11805 - protein, 81 aa, Delphinapterus leucas
ISKTSVSFRDVTVEFTLEEWQCMSSAQKTLYRDVMLENYSLLVSSGYCLTKPDVIVKLEQDDPLLLEEEILSKSHADCKLD

SEQ ID NO: 11806 - protein, 81 aa, Delphinapterus leucas
QGPVTFEDVAVYFSQEEWKLLDEAQRLLYRDVLLETFVLVASLGCWHGAEHKEITSEQNVSVEVPQINTSKTDLSIWKSYP

SEQ ID NO: 11807 - protein, 81 aa, Delphinapterus leucas
AQGKVNFEDVFVYFSQEEWGLLDEAQRLLYREVMLENFALMASLGYVSSMFHRIAPLELDREPWLSEWANMTPAMTREAQG

SEQ ID NO: 11808 - protein, 81 aa, Erinaceus europaeus
GSVTYEDVTVIFTQEEWALLNPSEKKLYRDVMCENFRNFLSIEKIQEHFTKEQHNLPGSKQRNTTLKISEGKKSQNGRKSQ

SEQ ID NO: 11809 - protein, 81 aa, Carlito syrichta
TFKEAVTFKDVAVVFTEEELGLLDSAQRKLYRDVMLENFRNLLSVGHQPFHQDTFHFLREEKFWMKNTATQREGNSGSKIQ

SEQ ID NO: 11810 - protein, 81 aa, Carlito syrichta
TQGTVTFEDVAVNFSQEEWSLLSETQRCLYRDVMLENLTLISSLGDWHGREDAAAPSKQSTCIHIYKDQRAHHGERPYDCE

SEQ ID NO: 11811 - protein, 81 aa, Delphinapterus leucas
VMESVTLEDVAVGLIQEWALLDDTRRNLYRYVLLDNCRTLAPRAGTPSCKACLVSQVGPREELMTAEQGILCATGVDWESQ

SEQ ID NO: 11812 - protein, 81 aa, Delphinapterus leucas
CEVSVSFEDVTVDFSREEWQQLDSTQRRLYQDVMLENYSHLLSLGCEIPKPEVIFKLEQGEEPWTLEEETPHQSCSDEKFG

SEQ ID NO: 11813 - protein, 81 aa, Carlito syrichta
QVHVSQGLLTFKDVAIEFSPEEWKCLDSAQQILYRNVMMENHRNLVSLDLIVCLEQRNKPWNVMRHNMLEKPTGLHGQTRF

SEQ ID NO: 11814 - protein, 81 aa, Carlito syrichta
QVNFEDVFVYFSQEEWVLLDEAQRLLYRDVMLENFALMASLGCWHGMEDEEIPFEQSISVEGVSQIWTHKGSPSTQKAHPC

SEQ ID NO: 11815 - protein, 81 aa, Delphinapterus leucas
PQESVTFKDVAVNFTQEEWHHMDPAQRRLYRDVMLENYSHLVSLGYQVSKPEVIFKLEQGEEPWIAEGEIQRPFCPGGRIH

SEQ ID NO: 11816 - protein, 81 aa, Carlito syrichta
LQESVSFEDVAVDFTRQEWHRLDPAQRTMHKDVMLETYSNLASVGLCVAKPEMIFKLERGEELWVLEEESSGHGYSGSLSL

SEQ ID NO: 11817 - protein, 81 aa, Delphinapterus leucas
YQRPVSFKDVVVGFTQEEWHRLNPAQRALYRDVMLETYSNLVSVGYEGTKPYVILRLEQEEAPWICEASCSGCHCRENIWQ

SEQ ID NO: 11818 - protein, 81 aa, Carlito syrichta
MGLLTFSDVAIDFSPEEWECLDPTQRILYRNVMLENHQNLVSLGLAISTPDLIMCLEQRKEPWNVKRQNTVPKPPGLEEAW

SEQ ID NO: 11819 - protein, 81 aa, Gulo gulo
SLDSDLFRDVAVVFSREEWERLAPAQRVLYRDVMLETYGNLVSLGLAVYKPDVISFLEHGGEPWLVEEAAGRGRWPVSESK

SEQ ID NO: 11820 - protein, 81 aa, Colobus angolensis
DSVTFDDVAVDFTQEEWTLLDPTQRSLYSDVMLENYKNLATVGWEMQLETQWSTLQQDFLMGQKSIGIQLEGKHNGGELCD

SEQ ID NO: 11821 - protein, 81 aa, Colobus angolensis
PQASVCFEDVAMAFTKEEWEQLDLAQRTLYREVTLETWEHIVSLGLFLSKSDVISQLEQEEDLHRAEQVSPREKGKLPQED

SEQ ID NO: 11822 - protein, 81 aa, Colobus angolensis
AQESVMFSDVSIDFSQEEWECLNDDQRDLYRDVMLENYSNLVSMGHSISKPNVISSLEQGKEPWLVDRELTRGQWPVLESR

SEQ ID NO: 11823 - protein, 81 aa, Colobus angolensis
RLESVTFEDVAVYFTQNQWASLNPAQRALYGEVMLENYANVASLVAFPFPKPALISHLERGEAPWGPDPWDTKIPRGIGQG

SEQ ID NO: 11824 - protein, 81 aa, Colobus angolensis
SKAPITFGDLAIYFSQEEWEWLSPIQKDLYEDVMLENYRNLVSLGLSFRRPNVITLLEKGKAPWMVEPVRRRQAPDSGSKC

SEQ ID NO: 11825 - protein, 81 aa, Colobus angolensis
TFKEAVTFKDVAVVFTEDELRLLDSAQRKLYRDVMLENFRNLLSVGNQPFHQDTFHFLRKEKLWMMKTTSQREGNSGGKIQ

SEQ ID NO: 11826 - protein, 81 aa, Colobus angolensis
APGSVTFEDVAVYFSWEEWDLLDEAQKHLYFDVMLENFALTSSLGLTSFWSHVVAQPGLGKVSSVLHRMFMTPASARWDQR

SEQ ID NO: 11827 - protein, 81 aa, Colobus angolensis
LVTFRDVAIDFSQEEWECLDPAQRDLYRDVMLENYSNLISLDLESSRATKELSPEKEIYEMESFQWENMGKLINHHLQYNG

SEQ ID NO: 11828 - protein, 81 aa, Colobus angolensis
EMGPLTFRDVAIEFSLEEWQCLDTAQHDLYIKVMLENYRNLVLAGITVSKPNLITCLEQGKDPWNMKRHSMVVKPPVETRF

SEQ ID NO: 11829 - protein, 81 aa, Colobus angolensis
FISFTGQLTFRDVAIEFSQEEWKCLNSTQRTLYRDVMLENYRNLVSLGEDYFLPEHRKEPWTMKSQVQIAGKPKGWEWIKG

SEQ ID NO: 11830 - protein, 81 aa, Colobus angolensis
GEGSLSFEDVAVDLTREEWQSLDWSQKVLYKEVMLENYSHLVSAGYQGTKPDSLFKLEQGEPPWIVEGAAHSQTRPGFVIQ

SEQ ID NO: 11831 - protein, 81 aa, Colobus angolensis
TARSQETVTFKDVAMDFTPEEWGKLDPAQRDVMLENYRNLVSLWLPVSKPENYNLENGKEPLKLERKIPKSSYSGEHILIF

SEQ ID NO: 11832 - protein, 81 aa, Mustela putorius
GWVPALFDEVAIYFSDEEWEVLTEQQKALYREVMRMNYETVLSLEFPFPKPDMITRLEGDEESQNSDEWQLQGGPLAEPEE

SEQ ID NO: 11833 - protein, 81 aa, Erinaceus europaeus
MVSFEDVAVMFTGEEWQHLEDDQRSLYRDVMLETYSILASVGLCITKPEMIINLECGIEPWNISEPLMHSLSGEKPLKCKE

SEQ ID NO: 11834 - protein, 81 aa, Erinaceus europaeus
YEDSVTYEDVTVIFTQEEWALLNPSEKKLYRDVMCENLRNFLSIEKIQEHSTKGLHNLHGSKQSITTVKISKGKDSQNGTI

SEQ ID NO: 11835 - protein, 81 aa, Ornithorhynchus anatinus
AAAAGPVTLEDVSVELSREEWGLLDRARRELYRDVMLDNYPRAGAAGGRRGRTSPDLPPSVERGRSPRATARRPRLFPGFP

SEQ ID NO: 11836 - protein, 81 aa, Tupaia chinensis
MLYQEVMLETCRLLVSLGHPVPKPELIFRLEHGQELWTLKRGPSQGTYAGEKANPRITEPTASQLAFSDESSFQGQLTQRF

SEQ ID NO: 11837 - protein, 81 aa, Tupaia chinensis
MSFEDVAMDFTWEEWQDLEDAQKILYKDVMLETYSNLVFLGQCSAKPAVIYKLEQGGEPWTLELPNQSLPGETTYECKQCK

SEQ ID NO: 11838 - protein, 81 aa, Vicugna pacos
LQEATVFKDVAVYFTRIEWSCLAPDQRALYGDMMLENCGHVASLGFLVAKPALISLLEQGEEPGALILQVAEERGTKASLA

SEQ ID NO: 11839 - protein, 81 aa, Vicugna pacos
AKETVTFGDVALDFTQEEWALLDTSQKKLFRDVMLENIHHLVSVGYQISKSDVILQLEQGKELWREGEGRPQGRGPGSESP

SEQ ID NO: 11840 - protein, 81 aa, Vicugna pacos
MTFTDVAVDITPEDWELMRPVQKELYKTVTLQNYWNMVSLGLTVYRPTVIPILEEPWMVIKEILEGPSPEWEAKAQDCTSV

SEQ ID NO: 11841 - protein, 81 aa, Vicugna pacos
DVCQGSVSFEDVAVEFTQDEWQYVATLYRDVMLENYSHLISVGYCFPTPEVIVKLEQDEEPWSLEEESLNQRYPGRYRVDV

SEQ ID NO: 11842 - protein, 81 aa, Vicugna pacos
ELVTFRDVVISFSQEEWEYLDSAQRDLYWDVMMENYSNLVSLDLESKYDPKTLPIEKDIIEKNDSQWEVIESSTSVGLENS

SEQ ID NO: 11843 - protein, 81 aa, Vicugna pacos
FQGSVSFKDVTVGFTQEEWQHLDPTQRSLYRDVMLENYSNLVSVGYCITKPEVIFRLEQGKEPWIMEEEFPSHSFPEPWKT

SEQ ID NO: 11844 - protein, 81 aa, Vicugna pacos
QNEGSLSFRDVAVVFTWEEWQLLDLIQKNLYQDVMLENYSNLVSVGYQDTRADTFCQLEQGKPWIAEEETHSQIHPEDTWQ

SEQ ID NO: 11845 - protein, 81 aa, Vicugna pacos
RVGSLSFRDVTVGFTWKEWQQLNPAQRALYRDVMLETYSHLLSVGYCIPKPEVILKLEQGEEPWILEEESSSQSVPGQEPG

SEQ ID NO: 11846 - protein, 81 aa, Vicugna pacos
MDSVTFEDVAVNFTMEEWTLLGPSQKKLYRDVMRETFRNLASVGKTWEDHDTEDQYKNQERKLSYVVEALCENKEGNQCGE

SEQ ID NO: 11847 - protein, 81 aa, Odobenus rosmarus
VTFKDVAVVFTEEELGLLDPAQRKLYGDVMLENFRNLISVGEHRRSVGGKIQSKMKTVIEAEPPEELSCWRIWQQIASDLT

SEQ ID NO: 11848 - protein, 81 aa, Odobenus rosmarus
VQEPVTFKDVAVDFTQEEWGQLDPVQRTLYRDVMLETYRHLLSVGNQIAKPEVISLLEQGEEPWSVEQAYPQSTCPEWMRN

SEQ ID NO: 11849 - protein, 81 aa, Odobenus rosmarus
VSLKDVTVDFTWEEWQHLDSAQRNLYRDVMLENYSNLVSVELKSEVTSYTLGLFSDFDIRPKMKELTPWKSISEQVILHNM

SEQ ID NO: 11850 - protein, 81 aa, Odobenus rosmarus
SQGLLTFKDISVDFTQEEWGQLAPAHRNLYREVMLENYGNLVSVGYQLSKPGVISQLEKGEEPWLIEREISGSPSSDLENK

SEQ ID NO: 11851 - protein, 81 aa, Odobenus rosmarus
MTLFQISFEDVAVGFTSEEWQLLNPSQKSLYREVMLENYSNLVFLGYQIIKPDAIFKLEHEEPWIIDEEVLSQNFSEVWLD

SEQ ID NO: 11852 - protein, 81 aa, Odobenus rosmarus
RPRAVKFADVAVYFSPEEWGCLRPAQRALYRDVMRETYGHLGALGCAGPKPALISWLERNTDDWEPAALDPQECPRGLTVQ

SEQ ID NO: 11853 - protein, 81 aa, Carlito syrichta
GLLSFKDISMEFTWEEWQLLDSTQKYLYRDVILENYNNLVAVEDWEEWYQESQDEFESIERSFAYNVFGKLHLSKTHVSSK

SEQ ID NO: 11854 - protein, 81 aa, Delphinapterus leucas
MLENYNNLITVGCPFTKPDVIFKLEQEEPWVVEEEVSKRHCPGEIWGMDEHQKIQDRLLTQLEDKFTKTLTEEKVNECHKK

SEQ ID NO: 11855 - protein, 81 aa, Delphinapterus leucas
QGSVTFEDVAVYFSWEEWCLLDEVQIHLYLDVMLENFALVCMLGSWHWVEDEETPSEQSVSAEGVSQIRTSSAGSSLEKTQ

SEQ ID NO: 11856 - protein, 81 aa, Gulo gulo
PQVLVSFEEVAVFLSREEWGCLGPAQRDLYSDVMLETYGNLISLGLQGSKPDVISRLEKGEEPWAPYSPRIEEGWIWSHGS

SEQ ID NO: 11857 - protein, 81 aa, Gulo gulo
KSQGLLSFSDVAVDFTWEEWQLLDTVQRNLYRDVMLENYSNLMSLGYQVTRPEAMVHLEKEQGVLEREFSSLSSPERSRQC

SEQ ID NO: 11858 - protein, 81 aa, Gulo gulo
PQDLMTFEDVAVEFTQWEWGQLDPAQKDLYRVVMLENFKNLASLGLPVAKPYVISQLEKGKEPCVLEGEISTAAAAAAAAA

SEQ ID NO: 11859 - protein, 81 aa, Cervus elaphus
QGLFTFKDVAVEFTQEEWECLDPTQRALYKDVMLETYRNLLSLGSYSATFAIKELSSPKEDINKGELCHLMTLEKNETYGI

SEQ ID NO: 11860 - protein, 81 aa, Cervus elaphus
VTFEDVAVSFSQEEWGLLGEAQRLLYYDVMLENLSLVASLGKNCVCTHRLCWARPFSLRGSLQPSQPGPWTLLPSLVSWHL

SEQ ID NO: 11861 - protein, 81 aa, Cervus elaphus
LDPVAFEDVAVNFTLEEWALLGPSQKKLYRDVMRETLSNLALIKTTAPPTHEPTVTTRYGADNGRLQAQRGSSPRDNAAGC

SEQ ID NO: 11862 - protein, 81 aa, Colobus angolensis
EKGPLTFRDVAIEFSLEEWQCLDTAQQGLYRKVMLENYRNLVFLAGIAVTKPDLITCLEQGKEPWNIKSHEMVAKPSVICS

SEQ ID NO: 11863 - protein, 81 aa, Colobus angolensis
LQESFSFDDLYVDFTQKEWQLLDPSQKNLYKDVMLENYSSLVSLGYEVMKPDVIFKLEQGEEPWVGDGEIPSSDSSVSGCF

SEQ ID NO: 11864 - protein, 81 aa, Colobus angolensis
MDLMLDVAIEFSLEEWHCLDTAQRNLYRNVMLENYRNLVFLGIVVSKPDLITCLEQGEKPLTMKKHDMVTNPSVLCSHFTQ

SEQ ID NO: 11865 - protein, 81 aa, Colobus angolensis
AEGSVMFSDVSIDFSQEEWDYLDPVQRDLYRDVMLENYSNLVSMGLYTPKPQVISLLEQGKEPWMVGRELTRGLCSDLESM

(The sequence listing continues in the following parts.)

What is claimed is:

1. A gene repressor system comprising:

a) an RNA encoding a fusion protein, the fusion protein comprising:

i) a catalytically-dead Cas12e (dCasX) protein, wherein the dCasX protein comprises the sequence of SEQ ID NOS: 18, 25, 59355, 59356, 59357 or 59358;

ii) a first transcription repressor domain comprising the sequence of SEQ ID NO: 57755, or a sequence having at least 95% identity thereto;

iii) a second transcription repressor domain; and iv) a third transcription repressor domain, and b) a guide ribonucleic acid (gRNA) capable of forming ribonucleoprotein (RNP) with the fusion protein, wherein the gRNA comprises a targeting sequence complementary to a target nucleic acid sequence of a gene targeted for repression, silencing, or downregulation.

2. The gene repressor system of claim 1, wherein the second transcription repressor domain comprises a DNMT3 A catalytic domain (DNMT3A CD).

3. The gene repressor system of claim 2, wherein the DNTM3A CD comprises the sequence of SEQ ID NO: 59450, or a sequence having at least 95% identity thereto.

4. The gene repressor system of claim 1, wherein the third transcription repressor domain comprises a DNMT3L interaction domain (DNMT3L ID).

5. The gene repressor system of claim 4, wherein the DNMT3L ID comprises the sequence of SEQ ID NO: 59625, or a sequence having at least 95% identity thereto.

6. The gene repressor system of claim 1, wherein the fusion protein comprises a fourth transcription repressor domain, and wherein the fourth transcription repressor domain comprises an ATRX-DNMT3-DNMT3L (ADD) domain.

7. The gene repressor system of claim 6, wherein the C-terminus of the ADD domain is linked to the N-terminus of the second transcription repressor domain, and wherein the second transcription repressor domain comprises a DNMT3A catalytic domain.

8. The gene repressor system of claim 6, wherein the ADD domain comprises the sequence of SEQ ID NO: 59452 or a sequence having at least 95% identity thereto.

9. The gene repressor system of claim 6, wherein the fusion protein comprises, from N to C terminus:

a) a nuclear localization signal (NLS), the ADD domain, the second transcription repressor domain, the third transcription repressor domain, the dCasX protein, the first transcription repressor domain and a second NLS; or b) an NLS, the ADD domain, the second transcription repressor domain, the third transcription repressor domain, the first transcription repressor domain, the dCasX protein, and a second NLS, wherein the first transcription repressor domain, the second transcription repressor domain, the third transcription repressor domain, and the dCasX protein are separated by linker sequences, and wherein:

i) the second transcription repressor domain comprises a DNMT3A catalytic domain (DNMT3A CD); and ii) the third transcription repressor domain comprises a DNMT3L interaction domain (DNMT3L ID).

10. The gene repressor system of claim 1, wherein the fusion protein comprises one or more nuclear localization signals.

11. The gene repressor system of claim 1, wherein the fusion protein comprises one or more linker sequences.

12. The gene repressor system of claim 1, wherein the fusion protein comprises, from N to C terminus:

a) a nuclear localization signal (NLS), the second transcription repressor domain, the third transcription repressor domain, the dCasX protein, the first transcription repressor domain and a second NLS; or b) an NLS, the second transcription repressor domain, the third transcription repressor domain, the first transcription repressor domain, the dCasX protein, and a second NLS, wherein the first transcription repressor domain, the second transcription repressor domain, the third transcription repressor domain, and the dCasX protein are separated by linker sequences, and wherein:

i) the second transcription repressor domain comprises a DNMT3A catalytic domain (DNMT3A CD); and ii) the third transcription repressor domain comprises a DNMT3L interaction domain (DNMT3L ID).

13. A lipid nanoparticle comprising the gene repressor system of claim 1.

14. A method of repressing transcription of a target nucleic acid sequence in a cell, comprising introducing into the cell a gene repressor system comprising:

a) an RNA encoding a fusion protein, the fusion protein comprising:

i) a catalytically-dead Cas12e (dCasX) protein, wherein the dCasX protein comprises the sequence of SEQ ID NO: 18, 25, 59355, 59356, 59357 or 59358;

ii) a first transcription repressor domain comprising the sequence of SEQ ID NO: 57755, or a sequence having at least 95% identity thereto;

iii) a second transcription repressor domain; and iv) a third transcription repressor domain, and b) a guide ribonucleic acid (gRNA) capable of forming ribonucleoprotein (RNP) with the fusion protein, wherein the gRNA comprises a targeting sequence complementary to a target nucleic acid sequence of a gene targeted for repression, silencing, or downregulation.

15. The method of claim 14, wherein the second transcription repressor domain comprises a DNMT3A catalytic domain (DNMT3A CD).

16. The method of claim 15, wherein the DNTM3A CD comprises the sequence of SEQ ID NO: 59450, or a sequence having at least 95% identity thereto.

17. The method of claim 14, wherein the third transcription repressor domain comprises a DNMT3L interaction domain (DNMT3L ID).

18. The method of claim 17, wherein the DNMT3L ID comprises the sequence of SEQ ID NO: 59625, or a sequence having at least 95% identity thereto.

19. The method of claim 14, wherein the dCasX protein comprises the sequence of SEQ ID NO: 18.

20. The method of claim 14, wherein the fusion protein comprises a fourth transcription repressor domain, and wherein the fourth transcription repressor domain comprises an ATRX-DNMT3-DNMT3L (ADD) domain.

21. The method of claim 20, wherein the C-terminus of the ADD domain is linked to the N-terminus of the second transcription repressor domain, and wherein the second transcription repressor domain comprises a DNMT3A catalytic domain.

22. The method of claim 21, wherein the ADD domain comprises the sequence of SEQ ID NO: 59452 or a sequence having at least 95% identity thereto.

23. The method of claim 20, wherein the fusion protein comprises, from N to C terminus:

a) a nuclear localization signal (NLS), the ADD domain, the second transcription repressor domain, the third transcription repressor domain, the dCasX protein, the first transcription repressor domain and a second NLS; or b) an NLS, the ADD domain, the second transcription repressor domain, the third transcription repressor domain, the first transcription repressor domain, the dCasX protein, and a second NLS, wherein the first transcription repressor domain, the second transcription repressor domain, the third transcription repressor domain, and the dCasX protein are separated by linker sequences, and wherein:

i) the second transcription repressor domain comprises a DNMT3A catalytic domain (DNMT3A CD); and ii) the third transcription repressor domain comprises a DNMT3L interaction domain (DNMT3L ID).

24. The method of claim 14, wherein the fusion protein comprises one or more nuclear localization signals.

25. The method of claim 14, wherein the fusion protein comprises one or more linker sequences.

26. The method of claim 14, wherein the fusion protein comprises, from N to C terminus:

a) a nuclear localization signal (NLS), the second transcription repressor domain, the third transcription repressor domain, the dCasX protein, the first transcription repressor domain and a second NLS; or b) an NLS, the second transcription repressor domain, the third transcription repressor domain, the first transcription repressor domain, the dCasX protein, and a second NLS, wherein the first transcription repressor domain, the second transcription repressor domain, the third transcription repressor domain, and the dCasX protein are separated by linker sequences, and wherein:

i) the second transcription repressor domain comprises a DNMT3A catalytic domain (DNMT3A CD); and ii) the third transcription repressor domain comprises a DNMT3L interaction domain (DNMT3L ID).

* * * * *